United States Patent 9,328,346 (POLYCOMB-ASSOCIATED NON-CODING RNAS) - sequence listing, part 31

SEQ ID NO: 5181 - RNA, 88892 nt, Mus musculus
cuccccccucacggcgcccagcagccccgcuccgcgaugggagccggagcggccucggcguacacagcccgcgcuccucccucgccuccuccucuuucuccuccuccucagggcuccagucaggccgagccgcuccgcucacgguaagcgucccccgccccgcgcggccgcccgcccgcccgcccgcgaaggcccucccgcgcggccgcgccgccgcacuccgggggcgcagggugggggucucgggccgcggcgcgucggcgagagcgcccgggccgggcagggcaggggccggcugcgcauggggccgggcccgccaucuugccgggccuggcgcgggaggguucccggcgcgacgaggcgaggcggccggcggcgcggcggcccacaguacagggccgcccagccgucgccucgccucgucgccucgccaccgcgcagauccucccaucgcuuucucagcccggcugugcucucgggggacgacuccccucgguccuuuguaccuuguccgcggguguguguguguguguguguguguguguguguguguguggcggagacccgagcucacaacccaacccacucgacucuucacgcaagagcagaaccccacuggcguucgccauaacagccacagaggccuuaccuugugcuagacgaccgcuccuaucuagccaccuuucuugucaaaggaauguccccacucugccauagccccgcuauugucuaccagaggagggcuuugaggagaaccgagccugacagauuuuccagcugugcguugcagguuucacuuaauaaaccacaaacgaguggucgcgcugagguuuuagccugcgcaagaagaugguguuuucacgaccaaccugcauuuguaacccguuaggaaagaaauaugcuaggaaaaaaauggacguuaaccugcugcgagcauggagacuuuuggcuucacgaagaaaaaaaauuuuuuuuuuaaauaguccgccauacuuaaacauuuggcuuuauuuucaaguuuggacugaaucaucuaaauacuuggacgucuuuuagugcccuuaaccauaaauucacacgauggaaguaagaguuugaagguacaaaacccuucccuuggcaucugugugcuaucuuguuuugagagaugacuguaccaacucaaguuguuuggauguaacugauagggugaagggaccggguuggaggaccuugugcuuuuugaugguccaccaucugcacuaaagccauccuugaguuugagugguuguaucugucauuggugucaauguuuaccuugggcuacuuucggagacguuuuuguuggcagagcaguuuugaaggucagccucagaaaugacgaugagaacgcuuggcuaccggggccauuacggaaccuuaaguuuuaggacuccucauucagcucaccucaguauuuuaugucccauuuucacugcagugagguuccugagaauaggugaggaggcacaggccuccacauuugagaaacuccguuugccauuagacucuaauuucuggaucauuuguuaucuuuagauguuauuaguggucauguucuuuccaagcacacuggggaguugaauauagcauguucagaugccuaccaccuagugugaauauuuguaaacauuuugucacauuugcuuugucucagucugcugaauaugugaaugauugcuaaagacguuacaguucaccccuaaguacuggauauguauaucaauaaagaaaagauaaaggccacuuucucuauacuaccguaacagaauaccauggucacacccaagaaaaauauuugcuaaaaugcauuuaguacauaaaguuagggcuaaaaaacuugaauacauucaggcuuaauuauuuuuuuacaauauuucauaaaucaucuggaacacuucauauuauaaaaaguggggagacaguauaugauuaguaauucuagcuuuagucucaguuaaaauguugacuauugaaacuguuccuuuugcaauuagcauguagucuggcauaguuuuagugcuuaguaugaauucaccuucaucucugguaaaauagaauccauucuaggaaugacuggaguuaggaagaaaaggagcaguuuuggagacuagaauaugcucaguuuaaucaauuuguaauuggccagucugguggggcauguuuuuaaucccaacacucugggaggcugaggcaaguggauccuccuauguagacuaagccagcagggugguauagugaaaccuugucucaaacaaaagcaacaaaaaccuuuggaauugucuaucccuugguaaggccuggagaacaguuggaaacuuggaaaaccugccuuugaaaauuuggacuuuuguagcaguagugagccauaagguaguugaauuguaaaucucaauaucucacagguuuaagccuauuaugucauuccuucaguguuuuucuucucaacauuauauuuguagaaaaaaagaguaaaagaauaacaccuguuuuauuuacuagauaauuuauaacuauacaaauaacuuuucaauguaaauugaagcaauugcuuuuuuacauuaaaacaguuuuagggggcuggagagauggcucagugguuaagagcacuaccuucucuuccagaggaccuggguucaauuccagcacccacauggcagcucacaccugucuguaacuccaguuccagaggaucugaugcccucauacagacaaacaugcaggcaagacaccaauguacaugaaauaaaauaaaauuaauuaaaaaaaaaacaguuuuaggugacaggauauuauuggcaacauuguuauuuacuucaaaaguaacuuuggaaauaugagaaauuuauaaaauauuuaaauacauuuauaaccuugaauagcuucccuccccuuuuuugagggacugaaguaguuugcuuuuuuguuuguuuguuuguuuguuuguuuugagacagggucucucuguauagcccuggcuguccugaaacucaauuuguagaccaggcuggccucgaacucagaaauucgccucccaagugcugggauuaaaggcgugugccacuuuuuuuuuccaucuauauuuuaccccuucuuuuggagauucgguuuuucuauguagcccaggcugcccucaaaguuaugauccucuugcuucagccuucuaaauacccggauuauaaguguguaucagcuucagauuguuuuaaaucaggauugaagcaauaguuugaauuauguagugacuuauauuaaaaacuauauguuuagacuuuugguucauuucugugaagcaguuuuuguuuuguuuugucuuugagacaaggcuagucuggccucuaacuagaagauccugcuguguagccuauccugaguauaggauuacagguuugccauaccuguuaacuuuucaauuuuauuuugaaagaaauuaaacaugugagugugugagugucagacuauagcagauuauauaaccuguauuaaacaguuuagauuuacauuuaugucuucaacacaauuuucucugaaggauucugucacuucugauuacauuaggagaaauaguuaucauuuagauuggaaugagaauacuguauucuuucuuuaaaaacagaaccagauauuacuuacacauugauuguuugggaaaguuuaucuuggacaccucaucugaagccuccagggucccuuuguaaggauucugacgugccguuaucucuucauucauuugcuuuguaugauuguacauuuuuucuauuguaggcaaucaguuaaaaaaaaaacugaaaauuuaaccacauucaguaaaaauuaaaagcagauaaaaaucaggacauaccagcacaaaaauaugucacucugaugucgaaugaaaaaaagaaaaaguaaaggacaugacuacuacuagauauggaagaagagaaaguuuauuauagauaagugggugagcauagccagaggcugggacaucuggaagaguccagaguggccaugacccugagccuugugaggagaaggggagagaagggaaccauguacagcagcuaggaggcgaagguacaaaaagggacagguaaccaaauaucuagauuauauaagguagaacuucugggggaagggcagcucagcgccuggccuggagacuucaggguagagagggguaugucagccuacccuauaauagguagggacggaggaaugcuuggggggaccugaacuucaggucuauuuugauuuuuuuuuuuuuuuuuuuuaaauaggcaccuuaguugcuuguccuggguuugaaacuuaacagauguagaauauuuugaauuuaaggcaauugagaaccaacaguuccaggaagagguccacucuccugcaucaggaagacagaacuugaguuucucuucuagaugugaaagagguuaauuugcauaaacauaccuuacuaacauagcucuucuauucaucuuccaguguuuuauucuuuuguuuguuuguuugaaagaauuuuauguagcuuaggcuggccugguacaggugcuguuaccagggaugaucuugccuccccaguucugaaauuugagguauaagauaccauaugccucagugauuuauucguuucaagucauuuucagugauuuauucuugcucagcuccuaaucucuuuucuauuaaaauaauacaugaauuuccaaauuuagccaauucugugaguuucaauuucugugaauucuugggcaugagaauaugagugaaguuuguguacuuuuuuuuuuucccuaacuuuacuuuaaaaaguuuaauucacaguccucuagguacugaacucuguguaugaauagaacaaaaguuuguguuuccuaacacaaacuguaaggaugaucaugucagucuuauaucuguugcaagucaauguaacauuuugugaaaaucauaagaaaacugaaaaaaaaaagaucuugcauuggucagauuuauuucacuacuguguccuuuuucuagggaguugaauuauucaauuuucuuuuuuccuuuucaaaaaucuuuuauuuauuuauuuuaaacuccagauuuuauucccuuccugggccacccucugacuguuccacaucccauaccucgucacugucuccaugaggaaguccccaccccucacucccuaccccaccagaccucuaaacucccuggggccuccagucucuuggguuaggugcaucuucucugauuaaacccagacuuggcaguccucugcuguguauguguugggggacucauaucagcugguguaugcugccugauugguggucccguguuugagcgaucucggggguccagguugagacugcugguccuugagacagcuggucuuccuaaaggauugcccuccuccucagcuucuuucagcuuuucccuaauucaaccacaagggucagcagcuucuguccauugguugggugcaaauaucugcaucugauucagcugcuuuuugggucuuucugaggguagucaugauaggucccuuuuugugagugcucuguagccucaguaauagugucaggccuuggggccuucucuugagcuggaucccacuuugggccugucacuggaccuucuuuuccucaggcuccuuuccauuuccaucucugcaguucuuucaauuauuggucauuggucagaguuuugauugugggauagcaacccauuccucacuugaugcccugacuuucuguuggagaugggcuuuacaaguucccucuccccaguauagggcauuuugucuaagguccuuugaguccugggagucuuucacuucccaggucucucugguacauucuggagggucuuuccaaccuccuacuucuugauccugagguuuguuuuuuuuuuuuuuuaaggauagguaagauuuuaaccuguagaaaaaauagaaauuaguaagaucccacaauggguuuucauauguaaaaggauauuucuguaggaucauguaagguggaaugaguuugguucuguuuaagcgcuguaagggcuggugagauggcucaguguguagugguuugauuccugagaccaccaugguggauagagacaacugauccugcauguuggugcuaugaugcaugugcacacacacacaauuugauguuuuauuuuaagucagcaaauuucccuuguuugaaaaucucuaggaacaaauggaaaucauaggaguugaaguaaauugaaauaaagauggaaaaaaaaucaaaaguauucuguggacacuaacaguaugugaugaugagaauuuuauuuuucagacuucuaccuuucuaaugcaugaauuguauuugccugaucuauguuagcuuuuuaaaaauuuuacuauauuauauacaucucuaagaaauauggguaguacuuaguuuuucuuugaaugaucuguucuaagauacuuuucuuguuaggaauuuuucuuuccuucucaauuuuaccuucagagguccuccauaaugacaaaugguaaacugaaaucuuagagucaagauguuaguuacauuuagguuuuuuugaaaucagacuaagccaaaaaacaaaacaacaacaaaaaccccacaauucuugaagucauuuuuaaacauaacuuuuuuuucugaucuaacauaacauacaaugaugaacacagaaaugauuugggauaaauuuguaugcauguacgugugugugugugugcguguguguguacaaacacacacacacguauuaguucuguguagcucugaccaaucaauacucaacaagcacaaagauguauuguggcuuaugguuucagagaguucaguccauuauggccaggaaaguguagcagagcaugacauuucacuucauggcagcccagugaauugagaacaggacaugaauauacuuuguuuauauuuacuuucucuguacuuuuuauucccaguaccuggaagguugccacucacauccuagauagauaagucuucccuacucagcuaguccuaucaaauaccaggcucacuuaaagauguguuuuacuaauuuccuaauugacucugacuccaaucagaaugaugaugaagauuaaccaucacacccucuguuuuaugagacuggauuuuuuuuuuuuuuuuuuuugagacaggguuucucuguauagcccuggcuguccuagaacucacuuuguagaccaggcuggccuggaauucagaaaucugccugccuuugccucccaagugcugggauuaaaggcgugcaccaccaugcccagcaauauucuuuucaacagaacaggagugugcagucuguuuaccauucacugcacucuggaaaguuaagcaguaagacagcccagcugugcuugguuggcauaaagucauuuauguuugauauugcucaagaaucuguauuuuuuccuuaaauuuuuauuauuuaaaugcauuuuauacaucaagcaauaauauugaguguuuugagaaucaaauaauacauaaaauauuuguucaacuuuuauauucauauucuuucgcacccuaaaaauaucauuaaugaauauuuaaugcuauccauagcuggggauccuauaucuaauguugaauauuaaauuguuuccaaacauauaacauauucuuuggaaauuaagcauaguaaaagagcauaaaauauuaaaaaugaaucacuaagaaauauguuuaaaagcccuucuaugauaccaccugacauagugagagagucauauauuuguguacauuaucuaacaaucaguuuacuuaaaaaagauuaucaguguuucuaggagagaaauuauuuuaucaguaaguauauuuuaaaaauuucaaaauagcaaaaacuuuuugaaguuaaacauuaagaaaaugcuaauuucaagcacagugagaaaaauuauaauauuuccaugguguuuguagaacaugauuuuaguauuuucaacuguuaauauucaacagacagaauaaucauuuuaagauauauuucauuguuauguuuccuuuuucauuucugauuuuauuaauuuggauacugucucugugcccucugguuagucugccuaaggguuuaucuaucuuguugauuuuucucagagaaccaguuccugguuuuguugauucuuuguauaguucuuuuuguuucuauuugguugauuucaaccucagguuugauuauuuccugccuucuacuccucuuggguguauuugcuucuuuuuguucuagaacuuucaggugugcuguuaagcugcuaguguaagcucucaccaguuucuuuuuggaggcacuuagagcuaugaguuuuccucuuaccacugcuuucauugugucccauaaguuuugguaugaugcaucuuaauuuucauuaaauuuuauuuuuuauuuauuuauuuauuuauuauuacuauuuuuuuuuuuuuuuuuuuugagacaggguuucucuuuguagucuugacugcccuggaacucacuguauagaccaggcuggccuugaacucagaaauccaccugccucugccucccaagugcugggacaaaaggcaugcaccaccacugcccgccuggcucauuaaauucuaaaaagucuuuaauuucucucuuuauuucuaucuugaccaagguaucauugaguagagcauuguucagcuuccauguguaugugugauuucuguuguuuuguuguuauuuaagaccagucuuagucccuggugaucugauagggugcaugggauuauuccagucuucuuguaucuguugaggccuguuuugugacugauuauauggucaauuuuggagaagguaccaugaggugcugugaagaagguauauuuuuuuccuuuaggaugaaauauuauguaucuguuagauccauuuccuucuguuaguuucacugugccucuguuuaguuucuguuuccaugaucuguccauugcugagaguggguuguugaagucucccacuguuauugugugcuuugagcuuuaguaaagcuuuuaugaauguagaugccuuugcauuuggagcauauugagaguucaucuugguagauuuuuccuuugaccaguaugaauguucuuucuuaucuuuuugauaauuuuugguugaaaguugauauuauuugauauuagaaugacuacuccagcuuguuucuuggaaccauuuacuuggaaaauuguuuucuaaccuuuuacucugagguagugucugucuuugucacugagguggguuuccuguaugcagcaaaauguuggguccuguuuauguagccagucuguuaguccaugucuuuuuauugaggaauugaguccauugaugguaagagauauuaaggaaaaaaugauuguuacuuccuguuacuuuuguuguuagagguggaauuauguuuguguggcuaucuuuuagguuuuuugaaagauuacuuucuugcuuuuucuaggauguaguucuccuuguguuggaguuuuccaucuauuauccuuuguagggcuggguuuauagaaagauauuguguaaauuugguuuugucauggaauaucuuguuuucuccaucuaugguaauugagaguuuugcuggguauaguagucuggacuggcauuuguguuuucuuagggucuguaugacaucugccagguucuucuagcuuucauagucucuggugagaagucugguguaauucugauagguuugccuuuauacguuacuugaccuuuuucccuuacugcuuuuaauauucuuucuuuguuuagugagugcauuugguguuuugauuauuaugugaugggaggaauuucuuugcugucccagucuauuuggaguucuguaggcuuuuauuuucaugggcaucucuuuuuuuaagguuagggaaguuuucuucuaugaucuuguugaagauauuuacuggcccuuuaagaugggaaucuucacucucuucuauaccuauuauccuuagguuugguccucucauuauguccuggauuuccuguuuuggguuaggagcuuuuugcuuuuuguguuuucuuuaacuauugugucaguguuuucuaugguaucuucugcaccugagauucucucuucuaucucuuguauucuguugaugaugcuugcaccuaugacuucugaucucuuuccuagguuuucuuacuuaagggcugucucccuuugugauuucuuuauuguuucuauuuccauuuuuagaucuuggaugguuuuguucauuuccuucuccuguuugauuguauuuucuuguaauucuuuaagggauuuuuguguuuccucuuuaagggcuucuagcuguuuaccuguguucuucuguauuucuuucucucucucucucucucucucucucucucucucucucucucucucuuuuuuuuuuccaagacaggauuucucuggguagccuuggcuguacuggaacucacucuguagaccaggcugaccucaaacucagaaauccgccugccucugccucugcgccucugccucugccuccucugccuccucugccucugccgucucugccucccaagugcugagacuaaaagcaugcgccaccacugcccagcucuccuguauuucuuuaaggaaguuauuuauguuuuucuuuuuuuuuaaauauauauuuuuuaauuagguauuuucauuuacauuucaggugcuaucccaaaagucccccauacgcuccccccuauuuauguccuucuuaaagucauauaucaucaucaugagaagugauuuuagaucacuuuagucuugcuuuucuggugugauaguguauccaggacuuguuauggugggagaauuggguuuugaugaugccaaguaaccuugguuucuguuguuuauguuauuaagcuugccuucugccaucugauuuuucucuagugcuaccuguccucgcuauaccugacuggagccuguccuuccugugauccuggcugugucagaacuccuaugaguucagcugucucugggguccugugauucuguuaucuugggauccugagauccugggugugucagagcuccggaagucaagcugccucugggauccugagauccuggugugaccaagcuccugagauccuaugauccugggcguguuaaaauggagcuuccucuggauguugugggacuggcugcagaauuugagcccaaggucuguucaggaaaaugucccaagacuggaaggaaccugugcaacugguuggguggcuggguccugcuggucccaguuacuucugguguuggggcagauguuguaucuuccucaccugauucuaugaucuugggcauguuagagcaccugggaguggaacuuccucugaguguuguaagagucuguauuuaauggcugaaagcagagcaaucuguguguccaaaguauaaagugaaccuuagaaaguaagccuguuuaguuuugauacaaagauuccaagcacuuaacaugacugauugaauacagauuuugaaggaaagcuauaacacugaaaaaauugacuagauaggaaugaaaaagagagacuucgagaaaaaauaaaauuccagagauucauuaugaaguuguaguagaaaaaggggaaaaugcagaggaaguuuuugucaagugaaguuagauuugcacaauacaaaauuauucugaagcauacaguucaguggcauuuaguauagucauuaugauauccaacaauuaauguuaucugauuccagaauauauguucaaguccccuaaaggaaacuugcuucucauaaagcagucucucauucccccuuccccucaacucuuggcaaacauuaacaggcuuuuuguuucuggauuucccuauuuugaguauuuuagguaaauggaauauguauaucuaacauuuuaguauguuuuuggggauuuggugggcuuuaguuuguacauaucuuuugcaaauuguugugaaggaaaaugcuguuucaugaauguuucuugaaguaguccacugcuuuuggcuuuuuacagccuuucugccugccugcuuaauuccuuccuuccuuccuuccuuccuuccuuccuuccuuccuuccuuccuuucuuuuuuauuuauaugaauacacugcagcugucuucagacacacacuaaaagagugcaucggauccuauuacagaugguugugagccaugugguugcugggaauugaacucgggaccucuggcagaauagucagugcucuuaaccuuugagccaucucuccagucccugccuuauucuuauucugcguagguagaccucugauucuugaggggagaggugugaugaacauuaucccauuuagggcugacugaaguguucagcaugucucauucucuacaaugucaguugugggucucugucaguuaccaucuacuacaagaaguuuugcuggugaaaggugagcgauauacuggacuuuaaguauagauauauguucuuaggagucauuuaugacuuagcaugucuucaaaguuuuuuuuauuauggugugccuucaauaaacuauucuuucuuaacugagauugauacacgccgugugguucgugugacaauucccugaacuucaaaaguuugucuguuagaauuuugggaauuuucagguggauacuuuuagcagaauaguguagugagaauuuugauuucuuugaaaaacacagaaauaauauuugaauauguuuucauuuuaaucccaggugugggauaaggcugcuucagauuguccacagcaacagacuaugauuugccucaugcucuagcaggagcaggauuuugccagcagcacuuucugcaauugugugauauuaggaauucuggggacuuuucagaggguauauaaaugcuagggucccagggguuguugauaagugguugguugguguuugguugcugcuugucaugcaugguuuguuaaguagucauguacaaaagaagaaacaagaagaaacuagauuuccugauggugaagaucaaacuugccacaaggaacuuggagccccuaaucagcaggaaguagucccacaauaaugucgcuuccuuucccuucuacccauuuuuuucuuucuuguuuaguauuggguugaaaggguggaggaaaaagaguagaagaaagaagaaccuacaaaguagucaaaagauaggguagguuacaagaaagcuuuguaucugggcuucuucguuuuagcucaauguggcugauaagugaguagcaaaaaagagcaaauggcuugcagccuguauuaaauuuguaagauuuauuuguugaggugauacaaagggauuuuguuguuguuguugacuuuuguauuuuguugugaaaaaguuuuuuuuguaaaguuuuuuguuuguuuguuugguuuuuugagauagguuuuuccuguguaacccuggcugacccggagcucacucuguagaccagacuggccucaaacucaagaguucugccugucucuaugcuggaauuauaggcaugugauaucacaccuggcugaaccuugggcucuugacccuuggcagcuuuguggaacucuugcagcuacugagauucucauucuuggcuucuagcagcugauucuugccuuguauagucuuagcucauugcugcucgucacuuacccucccagugcuccuccagucccuuuuguuuccucagucuguguacuuggucacuauuuggacucuaaagauucaccuagcuacagagugaacaaacucuccuguuacuuucuagcaguugcuuuugaugucccacugccuggaacuagaagccuggaguucuuucuguuuauaguguuacuaacacagccugaucuacucuugauaauguagauuauuaaaaagaaaaaaaaaaacccaaaacauugggucuaauguuacaauaauguaguugguuaggcaaaguacauagaaggcaaaguacaucuucaagaucagcaugucgaacuaagacaaaaauggcuuagcaugcuucugcucagauugugguuuugcuaaauacagucaugcuuauauauggaugcuaguuucaccaggcacaagccucauguuacacuaaauaauaggcuuuuuauugaaucaugggaguagugcauuuccaaucccaaguuagaauaucugcagaaugugcucagugagguuucucuuuuguuuguuuguuuguuguuuguuuguuuguuuguuuguuuuuucgagacaggguuucucuguguagcccuggcuguccuggaacucacucuguagaccaggcuggccucgaacucagaaauuugcuugccucugcuucccaagugcuaggaccaaaggcaugcaccaccaagcccagcucucuuuucugaauggaaaguucuaaaucuagugcagauuaccuggggcaguuauaacuggaacaaguccugacaugaagcugauguggcuucagcagcauugaaaccuugguuauugcugcuagaguaguuucucuucucuuuucauaaauuuuauuuauuuuacauccagauugcaguuuuccuucucuccucuccucccagaaccccccacccccauuaguuucuucagagagauucaaguucauuaaaguucacagcucucagaacaguuuuagcaguuaacaacaacaaaaagaagcuguuugucuggcagagaaaugaagguucuuaugguugucauuuuaagggcuuaacagcuaacaguuuuacucaguaccccaacccccaagugguacuuacaacaagaccuaggaagcugccuuuucccuuucugccaccaccaugccauccagacugaggaagacccggaaacuccggggcccggugagccauggccacggccgcaucgguaagcaccgcaagcacccaggcggccgcgggaaugcuggaggcaugcgucaccgcaggaucaacucugacaaauaucacccugguuacuuugggaaaguugguaugaggcauuaccaccugaagaggaaccagagcuccugcccaacagucaaccuggauaaacuguggacauuggucagcgagcagacgcgggucaaugcagcaaaaaacaagacuggagcugcucccaucauugauguuguucgaucaagcuacuacaaaguucuggacaagggaaagcucccuaagcaaccugucaucgugaaggccgaauucuucagcagaagagcugaagagaagauuaaguguguuagaggugccuguguucugguggcuuaaaagccacaccggagguuaauuaaaugcuaacauuuuccaaacgaacaaacaaacaaaaaacaacaacaaaaacaaaagaccuaggaaacuaacauucugaacaguguuuaguaaaacauuaacccuagccgcaugcucuuuggaggaauccucugguuugccucuguaucuuuucaaguaauaauuuaaaccaucacacagcuuugcuaaggugaaauuuguauugguuguuacuuaagauuaugaguuaguucucuuucuucccuaccaggaauuuacuuauuuuaaauagacuuagguauaguguuggacuucugccuaacuucuucauuuguuauauuauaccuagaagcuucuagaaaaauauuugaauguaauagcuugauaaaaaaguuuaaguccuaaguauggcauuaaaaaaagugaagaaaugaaagguucuuccuuaucugucaguuuaggcugaaaauuaauauuccuuuacuagauuaggauuaucaugguccuugagggaaucuugaaagugacaguuucugguccauauuacaugaugguugaaauuuuccugugaguuuuuuuuuccccccaauuugaugauauauguucuuuacaauuuuuuuuucuuuuaacuguuacauuuggugaaaucagccucuuuccuguacauuugguauuuuaugccuggugaauauugaaauaguacugguuuuuuaaaugaaugggcuugaauguuacuucuuuuuauuuuuuguauguauaugugaggcuuuauguguacucaaaauguguguguaggccugaguuugauguugggaaucuucuagauugcucaucuaccuuauuucugagggagggucuuccagccaaaccaagaacucacugauaguaccuuguguaguacuacaugguccgcuuacucaaagauuacuggacuggguuuuggagauuggaacucagguccaccugauugcaagucacauaccuuaacccuugagcagucucuucaacccugaguauuugccccaucacuuagcaauguuacuuuagagaagacacucaccugucuuuguaacucacuuuucaugacaguaugcuuugaacauuaaaugaaguaaugggguuuugauuuguuuguuugucugcuuuuuguuuuguuuuaagagaguuucucuggcuguccuggaacucaaaaaauuccaccuggcucugccuccugaaugcugggauuaaaagccuggacuacugcuccucagugaaauaauguuuuaauuagaacaaauauaauuguaauaauuauaaugauuuuguaacuauaaguuguaguaauuuguaguuaaauauaaugaauggcaguaguugugcgaaacuugacauuaagaguuaaauuguguaguuaaagaggauaaugguuuguuuuugagacagggccuucuguaauucagguuuggcauugaguuuaaaauuccucugccucaaccuuuuaaauaaugugauuauagguguguacuaccauacuugauuuauaauugucucagucacacuugaauuacccuuuccuuuuuucauuauaacauugaaaguacaaugacuguggcaucauucugagaaauuuuuaucuagacuuuuaucacuguugaaucagucauuuggugugacuucuccaugcagguaaaaagauuuggucauccaggacagucagggcuauacagagaaacgcugucucaaacucccccccucaaaaaagauuuggucaacacaggauguauaaggcugcugguggccuaacauggaaugcuguugaagucaaaaaauaguuaaguagagcauucuaaacuaauaacuuagaaaaacccauguauuauuguacaaaccaguaacauaguuguuuauugucuuuguaaaggauuguguauaguacauaauuguauauuuauguauucuggcaaggcugagucccaacuuuuccuuucuuguuugcuugucacugcuaagauucccaaauauauaaucuuuuaaaaaugcuauuugcuaguuuugguuuacuuaaaaaauuaaaacugauaauuauuuuuuacuuuuuuauuaguguuuguauauauuauguguguaugcaugacagagcaugcauguggagaucugaggacaacuuucuuuuuuuuuuuuuuuuaauuuuguaauuauauuuagguacagaaaacuuaguguacauuuaacccaauuuaguggggaguucuuuuuuuuuuuuuuuuaaagauuuauuuauuuauauuacauauacauuguauaguacacuguagcugucuucagacacuccagaagagggagucagaucucauuacggaugguugugagccaccaugugguugcugggauuugaacuccggaccuucggaagagcagucgggugcucuuacccacugagccaucucaccagccccuaguggcgaguucuuuagccuuugcuuuuuccagcuuggcaaugcgagccacagacuuaggacccaggacguugccuccccaguggugacggaucucgucauaucugucauuauaauugguccuaauagcuuccaccagcuuagccagagcacccuugucuuccgaguuaaccugugugaaggcaacaguggugcaugucuuccuguggaccaggugccccagccuggccuuucccuugaugauccaguagggcacccccaucuuucgacacagggcagguaggaaaaccaccagcucaauggggucuacgucaugggcagucaccaccagcugagccuucuuguucuccaccaagguggugacuguauugacuccugcucggaggacagguggccucuuaguugggacgucgccuuugccagcagcuuucuucucagcacgggccaguagccuuugcuucuucucuugcuuugucucuggccuguacuugugggcaagcuuaagcagcugaguagcugucugccuguccagggccugggugaacugguuaauggcaggagggacuuugagccucuuguagaggguagcucuuugccacugcagccugauguagcggggccauuugacgaagcgcguuaaaucucuuuugggcuggauguccuguccaaugccgaaguucuugggccucuucucgaacagaggguugaccaccuucuuggccuccugcuucuugacgacggcgggggccggggccaccuucuuccccuuggccuucuucccuuugggcaucuugcucggcugcuggagaaagcugaggauaacuuucuagagucaguugucucuaccuugauugaguucuauaguuuuaagucagguugccagaauuacauagcauaguacucuacucacugaggcaucuugguggugaaacuauauugaaauauagugacuucaaagcuuaccuuacucaacuaaaagcugagaggaaaggaggaugcaggaaaucaaacacaaggucuuaaauaggcuaagcaugcacucuacucucacgcuucauucuuagcuacaauaaauacaguuuuuauaacucauuuuugggcaguuuuucauaauuuagagauuugggguuuuuguuuugauuuuuuuguuuguagcuuuuuuuuaguauuggggauugaauccaggaccuccugaguagcaggccaacauucuaccccuaagcuaucucucuagucuagaauuucagaauugcuaaacauuaauaagagauuacauguauuuaaaauuccuauuacuuucuaauuaaaaaaacuuuuaaggcauaguuuaaucuuauuuauguaaaagcuaaaacauggugcuggagagaugucucagggguuaagaacgcugaccacucuucugaaggucgugaguucaaaucccagcaaccacauaauggcucacaaccauccguaaugagaucugaugcccucuucuggggugucugaagacagcuacaguguacuuacauauaauaaauaacuaaaucuuaaaaaaaaaaaaaagcuaaaacauuuaauaaaauaaaaucauauuuuuaauguacaaaagguuaggucauauuuugaagucuuuaacuuuuuuuuuuuacauuuuauuuauuuauuuauuuuguguaugccugugcacacaugugguggagguagcaggacaacuuacaugaaugaguuguuuuuugaguuuuuuuuuuuuuuuuuuuuuuuuuuuuuuuuuuuuuuuggucaugugaguuccagguaucaaguucaagucuucaggcuggcuccaaagccagcuguaauuuacuugaacuugauacucucuuuaccucagcccccuaaauaauaggauuucaagcaugugccaucaugccugacuaauugugauuuuuuuuuucuuuuccuuuuuuuauuggauauuuucuuuaauuacauuucaaauauuuuccucuuuccaggucucccuuuuggaaacccccuaucccaucccucuucccccugacuaugagggugccaauugugaauuuuuaguaauguuuauuguaacuuuuuucuugaagaacaaugaacuacaagugugguuaauugcaaacuauuuacauaucuuuauuuucaccuaauacuuaacauauuaccuuccacuuagcugacuagggauaccuuuugucuugaauaacuuaaucugaugagcuuucuuuuuuguugauaaagucaaaguuguguuuuauuacagaaauaauuauauuuuugagugugaauagguaacauuagugucauuagcauuugggcagugacauuuacuaaagcagugcauuaugaagaaauuccuuuuugccauuauuuguguauauguguguguauauguuguuugaggcacucucucacuguguagucuagguauuaaaccugugauccucuugccucagccuuccaaguaccuggauuauagauauguuucauuuguuugucacaaauaauuauuuuuuaauuuacuuacuugucagauuuacugaaauaggaaauacuugauacaaucucuauuuuguuuucugauauuuggaauucuuaaggaaagaaccaauuauuuuaaauagauuauauguauaacaaacauauccaacuuaaacagauuucuauaaaaaggguaaguuaaauguacauaaauuaguauaaucugcccuaaugguagauaucuuuauuuucuagaaaggcaagcugagauacaacuugcugcuuuuuguggucacaugguaagcuuaaauacuuaaauuugauucaagaauuuguucuucuaaguguuuguuuuggugugugagugcaggcacaugcaucugcauuugggcagaugucagagaaagacauuggguuuccuguccugucacucuguuuuauucccuucauacauacugugucucacugagccugaagcucauuguuuuggguagagugccuaguuagcaagccccugggauauaugccugucuuugucccuccaacacugagguuacaggccacaugcuuccaggccuaacuuuuuuguaugugcuagggauucaaacugaggucaucgucuuuuuuuuuuaagauuuuuuuuuuuuauguaugugaguacacuaucacugucuucagacacaccagaagagggcaucagaucccauuacagaugguugugagccaccacuugguugcugggaauugaacucaggaccuuuagaagagagucagugcucuuaaccgcugagccaucucucuagcccgaaacugagaucuucuuguuuacucaacaaauguucuuaugcauuguguuaucuccccaacuccucuaucaagaauuucuuaaucucagguuuauuuguaguugaaaucacuuaaaauugacugaugucauaugucaauacuuaggugacaacauauauaaagucagaucugcaacuugaugggagacaguucuuucaaccaaaagguaaguugcuucaguaacugauacucaugugcaggugauguauaauuacauuuuauaauacagugugagagaugguccccaucuuagaacccuagaacuguugaaauaacaaaugaacugauaagucaaguagaaaugaacuauuuuaucucuuuuaacagaaauagcuacuguuuaugucaguauuuuaucaguuuguuauauauuaucauauagauuucuucuaugcuugugcaagcauuuauuaaaaauuauaaaagaauuauagcuuuuucuugacauucuuucauauauuaacaaugacagucuaaguguguaugugugugagagagagagagagagcauacaugcauguuuauaugcaugugcugcauacuauauuaguuuacucugguuuucauaacaaauuaucaugaacuagaugguuuaauuugguagaaauuauuuuuggacaguucuuuaggcuagaaaguuaggaccaaaguauugcuaugcuuuauaucuucuguggguuuugagauaaaagcucugggccucuuauaaauggucaauauugaacuugugacugauuauagccauauuauuaagaacaugguggaauguuguccuaauuuugagucaaaaguagaaauggcucucuuuaguauaauagaaaauaauacuuagaaaugauaaagauauuguuuaaauuagaaccucagauaauuucuuuuguagucucacuaucuuuaugucugcacaagugccacugaugugcaucuacauggccuaggcaaucauauucaugguuauauuaguugaggcccuuaaugcuguuuuccuucucgaucuugccucccucuguucuuacauuuccucuuucuccauugcagccugaauuauaagugcauauaauuaaagagucacacagucugaaaggcuuuaauuagccuugccaaaguuucauaaaguuguuuguguguauguauguguguauaguguugcauuaucaauuuaucuaacagcguuauauaauuaaagaugaauguucuaacuuucuuuuaaaaauguguucuuuacaacuuuuuauuuauguguaugcgugugucuugaguuuaugucuuguguauugagugcuggaggagacuagaagaggacauugaauugaacuggagcuggguguugaacucuggguguugggaauagaacuuggguccuccagaagagcagcaagcacucuuaauuuuuggaccaucucucuaguccuuguuuuagcucucuuuuuauauauguauuuauuuuguuguuuuuaauaauguguaaugggggagguacuuaaguucauguguaagugcucacaaauuacagaggagggugccagauacauugggccaucugcaauauucucuucacugcugaguaaccuuuccagccuguuuaauuuuuuguuuuguuuuauuuuuaaauuuuucuccccugcccaagacaggguuucuuuguuagccuugguuaucuguccuggaacuuacacaguagaccaggaccaugaauucaugaguaucaccugucuccccauugcuggaauuaaaggaauguacccccaccaccccaacugugaucuuaaaguuaauuuuuuaauccuuccuuuggcuuccuagagaaguccuccuaacaugcugcuguccugcauccauaccacuuauucucuagaccuacugacuuacucucuccugugacuuuguuuuguauugaaugucaugcauggccugugcaccuuauguguuaguauguuaguauuuguucauuauucucuguguguguguauacauguacauauaugccaagguauaugggugggaagggaggucagaggacaguuugugggagucuguucuuuuccaccaagugggucuugagaauugaacucagaucaugaggcucggcagcaaaugacuuuauccacugagccauuucaguuuuacucuguucagacauuauuucuuugaugccuaaccaguuucuuuucucuacucuaccucuuucuuagaauccuuuuaauuuauuuuacuaucuuuuggucuuuuauauagaacacuuuucuuuguaaaauuccuagugcuuauugauugcuuaaucuacauuuaagagagugaugguaccugaucagaauuucucuauuuuuuacugcaugcauuucuuugaucgauuccuuuaggggaaauguguaauuagcugcauuugagauacaccugacucccuucuuaugucugcucucauaccaaaucgcagccccugcccucuuuuuaacucugcauuuuccauuucuaaaacugguuuauucuaauuuguuuuuucaucuguggcuucuuauucuucaucuuaccccucuucucuuuuaaagauaauggauaggauauaauccuuuuuuuuuucagaauuaauuguucuaaauguaugaauaaaauuaauuuugacuguauuuuuuaccugcucuaaauaaacauuaucugucucacgucuacuaguuaaugacguagcaggaucucaguuucuuauuguuacuaucauguacucaucacagacaccaaguuaaacauuguuacuaggauuauuaaaguagauuucuaauaugcugcauauagcagauacuuuuuaauuaaaagacaguugcuucuuuuaaaaauuagauaauuuaaaaauggcagaacucuuuauggaaugugaagaagaggagcuagagccauggcagaagaaagugaaagaagucgaagaggaugaugaugaugagcccaucuuuguugcagagauagcaaguucaaagccagcuauuucaaguaagcagauacuuugaauguaggcaguuugaaaagguuuauuuuuaggguuguuuugaaaaauauccuuauuccaccauaagaauuugggaauaaaauacuuguuugaaagucaggguugacccugaguggaguuugagaugggauagaagcaaaauaccagcagacgcaacagggaauuuuccaugguuggcauuggaggucuucugagaguaggaauuaugauuuuagugauaaugaaaaaccaggcuaucugauuuuauuuccuuuuuuccucucuuaaaccuagaauuguuuaaaggaaaaauuuagaaugcuuaguuuuaaauuuugggauauacuaaaaaaucuguuagucucagaugaaaucucauguccaggcuccauuguaaugucaucuacacaggacuacaaaaugcauagugauagugggucauaaccugaccacagcugucuuucagcagcuaguuaauuugugauacagagagguguuaccgcuagccauuguauuuuuacuacguuacaguuagcacacucauaucucaggcuuuuuaguagaauagucguuggagucuagcuuucaguuagagugcuuggacuaaacagugguacaguguuaaaguaagaaaacugauggaccacaguaaacugucuacucaaaaauauuucagauggagccagguguggggagcacacuuauuuacaauacuaaggagacacuggggagacagaggcagguggauuucaguggguuucaggccagccuaggcuauauggugagaucuggucucaauggaaaaaaaauauagucuucaaaucucaaagauaaaaauaaucuuucucauuuuaauugcauguuuguuuuaagcuagaagaauuugucaaagaauguuaaaguguucagcauauuaguauuucuuauuuaccuugguuaacuggagagaguacuaugacauuuucugauugccuucuugcuuuucuuuucuguaggauuggaauggcauuuauauauaguuuuauuauagagagaacaauuuaaccaagugaaaugucaguauuauuuuuugugauagauagguaauuucccauggcacauuaagugggauguuauuuggauuauaaaaugaguuuaguaugauagugugcauauugcuaauaccagaauggucuuauuucuuauuuccuggguauugauuaccugacauuugaauguuauuauauuacaaaauuauuuaaaaucucuuguugaaaauaugacaagauucaaguugaauuuauacgauuauagaugacucuuaauuguacucaauuauaacaaucuacauuuguuuuuaaauuauucuguaagaguuugaccccagauguuuuccugaauugugaagaugaaaaauugaaauaauuguguuacuguauuucguggaagccacacagaauuucaacauaggauaugugaauuaaauguuuaagaauucaucucuuauagaucacaacuacuaaaauaguauaccaauaguuauuugauagcuugaauauuaauuuugguuuucugagugaaaauaauaucaaguuuaauugcuuuuuuaaaaaaaaccugauguacuugauuuuuaagcacugcauuaacaucacugcaaaauuuuaacuauuuuaaaaauauguauauaguuagguguauauguauuugccuguacauauguauguauccaguuaguucccaaugcccauagaggccagaagacgguauucuauccccucaaaaccacuuuacaggugguugugagauauuaugugaaugcuaggaauugaacuguguccucuguaagaacagcaaauaacgcuuaacuacugagucaucucuuuggcucugaaaaauaaccauuauguguaccuuuaugcaauuauuuaguggcaucuaguuauuuucuacuaugaagaaaaaugaauuuuuugucuaugaauuucagugcaucuuuuaacuuuuucugaaaaaagcaaauuuaagcaaaucuuuuuuuuguuuuguuuuguuuuguuuuucaagacaggguuucucugcauaccccuggcuguccuggaacucacuuuguagaccaugcuggccuggaagucagaaauccaccugccucugccucccaagugcugggauuaaaggugugcaccaccaugcccggcugcaaaucuucauucuuucagauuuuaguuugauuacugaguaagcuagauguuaaaaacuuugaauauucauauguauauaagaguaagaacuucaaaccaauucuucaaagucaugccuaucuugacuucugaugugauagaucaaaauccccucaauguguaagauaaucagguaaaccuuagauucaauuuagucuauaacuucuaguaauuucccuuuuggaacagagguaaugauauaauccauuggagauucuccuuuguacaacuuuaggguuuuuagagcuauagaauaaaauauggaggcugggucacaguuuaauuuuaagucagagcccaaauauauacauacaguucuuuccccguaccaaggaagguguaaacuucaacuccaugcaaccauauuuaaacauguuuuuagaagauuuuuauggaaacaaaauuucuuuacuuugaagaagguuuugcuuauaugcacuuggguuuaucgauauacuucugacuuuuggacauuuaguuacaaugagaaauauugugcuuauucuauaaaacaguuaauguuaauaaacuauuuucacauucgugauaacauuccuucuaauauguucaguuuauaaauuuuaauaucucaguauauauugcauucaaacaaauguaaaguaucauuauuuuuuuagauauuuugaacagaguuaaccccagcucucauucaagaggaauaaagaaugguauacucaaucgagguacaguauugcuauaguacuugaauuguaaacuaaaauaucuugaaaaaguugauuauauagaaaugcauucaauguguuguguaauuuuaaaauacagguuuuacugcuucauucaagccuacaagucaacgcugccugaauucagcaucaaauccuguggcugccuugccaguaaauuuucauccugaaucuagaucuucagauagcucuguuauuguucagccauuuucuaaaccuguaaguguuuuugaaauuacauagucagcucagggaauauuaacgauacucaauuaaaauucuacauuaucaacaaguaguuaucuaguuaucagaaaagguuaccaucuguaugauagcuuaauuaguacccacccuucaguaaguuggggauaugcuuaaacugauuagguauaacuuugaaaacuaaggcuaucaaaaugucaauagaagaauuguaaugaguaucacaugauagcaaaauauuuauacuuucaaacugggccagguauuuuuaauuuggaaauuauuaagaagcuuugauaguaguguuuuauucugagaaauguaccuucacacuuuuuaaaaauccuuagugaaaaguaauauugguaauaauuacaauuuauuaagcuaguaauagacauaaauauuugugcuaaaugcucuacauaaaugaaucucauuuaguuuuuaaauauaccuauaauguaggcauugcuacuucuucuauuucauaguugaguaaauacugagguuuacagggauuaauucacucagaucuauagcuaggugggucucagaucucaguguaggcuaauccguaguuuauauacauauauacacauauauaucuuguauaugaguaucuacuuugaaaaauggaaauacugccccagcucagcauucucaggguaguguauuugggauucaacaccauugugaaaauaauugaaaacacuuucuuuuucacuggccuuugcauugaugauauaaaacaaugcugaaaagguagcugcuggcuuucugugagucgagacaagcacucaucuguaccagaguuucaaguagccacccagcugugcacuccuaaugaaauacuccaguuauaggcacuuccucaaugacauuuugcaauguauuaaacauaaacuuccauuaauguuauuuuguuaacuguacccuugacuaugugucuuauauguucuguguugaaauagguaguguacauaaagcacuucugugucuuaaauaucuugauuguguuuaggaaaagcaugauuggcaagcagaaauaccuguugcauuuuaauugaacacauuuaugcuugaaauaauggcugauaagcuguuuauuauuuuuucuuauuauugccaaaaauuaugugauuugaagcaauauacauuaaguauccuaaagucuuauaauuucuguugguaggaggcagaucauagauuaacucgauccucuguuuuagggucugauaggaucaccauuuaagaugugauccucaaagcagucucaucugaagcacuauugggaaacaucucccaaguccagguaguugcugguacccuuaguucccuaagggucagacugagucucauuauccuuuuggcuuuugacuuaauuccuugccaauugggucuucccaaaauggcugcuugccuccugaaaguaaggagaguucuuuuuuuucuuuucuuucuuuuuucccccuucuuuaaggcagaguuugucuauguagcccuggcugcccuggaacucacucuguagccaagcuggcaucaaacucaaaucugccugccucugccucucaagugcuaggauuaauggugugugccuccaugccuggcuaagggagaguucuuauuagucucuuuuugggguagggugguucaagacagaguuucucuguaacagccuuggcuguccuggaacuugauuuguagaccagacucaccuugaacucaucaguuucucuggcucugccuccccagugcuaggauugaagguguguaccaccaagacaggcuugauuuuauuacuuucaggcaacagucauguccauaaaaugauguuauauaccuugccaccuuuaccauguuguguuguuaagaaucaauucagcugucagccacauuaaaaggaagggaaucacauaggguaugaauauuagaagaugguaucauggaauucacuuuagaaugcuauuauucaguccucaaauuugguacagauuuccucaaaauugaacaaaguacaccugccccuucaucacuuaauggaaaacagcugguaguaguguucuuucuuaccaaugauaaaauuugaucuaucaagcaaaaaucaagauuuggaaagcuuuaaucugccauuuugaucuugguugcuuuauaauauuucaagacuucauugaaugguaguauaaaugaauuuuuaaugauauauuaugaauuauuucaaaaccaauaguuugcaaauaaccaaaguauauguuacagaaacgucugugaauacuuaguguacuguggacuaaugauuucaaugggacaggauaccaaaaguucagaugaaaaagucucagauuucauagugauacaccuuuaagaaaguacuggcuucugaguuuugauaagaucagaguaguauauccacagugguucauacugcuaaaaugcuccuucucucaauuacauagucaugaguccuuauucucuuuugagaauuuaguuuauuuguuagagaaaagagcuugccuaguacacacagauuucuggauucaggcacauagagcuaaucccaacacuuggugauacagacgcagcaggaucagguguuagggcaauauauauuauccuuggccacauggugaguuugaggcuaacuugggauaccuaagacccuggcucccaaaauuaaaauaaaaaaugcaaagauauaaaauaagacuacuuucaugccgauccauaauggauuuaauauaauuuuaaaauaaaguaauauuuaauguuuucugcuucauuuucugcuucauuuucuaguuugauaaauacuaauagguaaacagcaaccaauguaaaaagugguuugggguuuagucauuuuuaaauguguaaaaucaucuugaagcuggaaaguuagguuagcacugauuuagugaauaguaaacuuccuuaaacuaguuuauuuuauuucugugaccauuaaaaacgccacaauuaaugguuuguaauccugaaacuucguugugucaguuggguuguaugggagcuuaggaauuauauauuuaaaucucacuuaccuguguggucaaagcuaaaaucacagacuuuuaaucuggaagaaauuaucuuuuuuaagaggauuucucucuaaauguugaauguuacugguuuuaauaaaguaucacuuuaauugguuuuaguuuaacgcuuuauguuauguuuuguguguuuaauuuuuuauggaauaucuuuguaucucaacacauuuuucaggcaaggauugaauauauucucguuaauaucauugauuaaguuacuauauggguaaugagcaugaauuuucauuauuauuuagacuuggauuauaguuucaacaccaucaguaauaaaagaugcuguauugagagccuuccucaaccaccuaaccuuagccuaccaaucuauacaacuggaagaaauauugucuuuauuaaugccacugugauaacuauuugauacucauuuacaguggagagcaaguaaauuuacuauauacaauuuggcuauuuuaguuugaaagaugaaugacuugaagcucaaaagugacuugccccagguuaaaugguuaaauaaguguaggucauccuaauucuguuauaguaccuacuuuacucuuauuguugcauugaacaaaccguucucagguaguucauuuuuagauuauuuugaacuugcauaaggcaucaaaaauugucuauuugaaaagcuaguuacuuggugacuacugagcugccuuuaugacacucugugggugaguuuaaguugccuuuggagauguguuuaacaggauuagcuuuauuauaguuuuguuaaagagcuuuuuuuuuuuuuuuuuuuuauuaauuggacacugcuucacuaaauagccuuugaggaacauguccuacuuuucaaaaacuuuauaguaaugguuauaugauagcuuguagguuuagcucuuuauuauugaaaauauaggauuuaauuuuugacuguuaucaauaauucuccauuaaacuuucuuuaccauaaaauuuugaaaguagaauaaaggaucuuuuagauuuugauagcuacugguaaaguuuuuauucaaagucacaccaauauauaaccuagaguuugccaauagugaauguuauccuucuuuuaaucuuauuaaaaaguaguauuagucuuauagaaaagagaguucugauauuucccaucuagcuuaccuuaugucuuaccucuuauauaacaguguuaaccaaacuuuagauucaucauuagaauuugaacaguuuuucuacugauuuucuagaucuuuuuuaugauuccaucuugcaguuauucuuaacuucuucauagcuuugcaguuacauauaucugucauucaugauccuagcaauaaaacauugugaguaaauuaauuugaaguagacaccauuuuuaaauaaugccuguuuaauuguuaaauauuuuucuuuguaucuuuguguccaguaaguugaaaaaagggcauaucauucauguuuuagauaggguuguucagguggacuuugagcuugcuauguaguuaaggaagaucuuucuguuuccaccuccugagugcuaggaucauagacguguacuacugugccuggcuuuauuuuuguuuuuguuuuuuuuuuuuuuguuuguuugguuuggcuuuuggagaagaggaggggaucaguuuauuuuuaagcacugcuuaacucaaaaauccguggauuaugcauuuuaacaggcugaagguucagaaaucacuaagagcuuacuuugcaccgugguuguuccuuauaaguaauauuggaguuauuuaugugugugugcauauuaguauacuuguuauauaguacuagaacccuucaauuguauugaccacuucguaaugauacugaauauguauaugcauacaguuacauaaaaacuuacugcucuguucuugaccacauuacaguccaugucauauuuuucacuaugcucuuuuuuuuuucuuuuuuuuggguuuuuuuuuuuuuuuucuuuuucuuuuuugguuuuucgagacaggauuucucuuuauagcccuggcuguccuggagcucacuuuguagaccaggcuggccucgaacucagcaauccgccugccucuaccuccugagugcugggauuaaaggcgugcaccaccacgcccggcuucacuaugcucuuaagaucuucgugcuagcuuggcuaaaaauuucuuugagcuauaguucuccuggagcaagccuauugacugagguauuuuaucaacagcuucuauccuagucccuuucugauuggcgcuguuaguucacugcaaggcccaaguuccauuguuuuugccuuaugacauuccacauuccuuagcuuagcauagguuucugugggacaauuagaaaagucaagaguucacuauuuuucuuuuugacuacauaguuauaaaguucuccaaaauagaugguuuaaaaauucauuuuauauaaaaauauucacuuucaacauuuauuaggauuuauuguuucacuguguuucuguugugcaauuuuuauugauuucucucacuucuugaugguaauacugcaauuuuagaacuucuaagcauguguuggcuuuacagcuauaaauuaaauuugcauuucuuguacuuuuaaaacauuguauuaaaauuugccauccacauuaggugaucaguuuuaguugggcaaaucggaacaaacaagcucuauuugcuugcuuucaguuuugauagaugauaauuuuguccaacuaguaauuacuuuuguguuuuuaacuuguuaaugauuuaaccaucaagcaauauuuaucuuaauaauacagauaugcuguuaaauugcucucauacauguguguaaaacaguaguuauaacuauguccaauaaauguaauauuauuucuucaauuuuaacaggguuauguaacaaauucaccaagaguucugucuaauaacucuucagaguuacuguuugacuugacccaggauacaggauuaucacauuaccaggggggaccgacacuuucuauugcagguuuguuuuguuacuuuuuuccuuauaauuguuaaaagaaacaauggguaaucauacagaguuaaguuucuguuuugaacuccacaucuuuguguuaaaauauuuguauauuuuaacauggacuccuguuuuuugugaggcaguuuuacuuaaaaucuucauuaaaccaccuuguauucuuuuuccuauggaaccaaccuuuaaaaugcuuuaaaacaucagugaauuagagaagguauuagauacuauaaacauuguuaguaaauaauuucuauggccacucguauaaaaaaaaguguaugguuauaguugaauucuuaauuagauuagugucuuuauaguucaguaagugauuucaguauauagugaaguaugguuucauggugcuauaaaguggccguaauaaagaaguacucguuagauuagugacaugacugagcaggcaaagccacuugguuccaagcauaauggccugaguuccaacccugggacucacauaguggaaugaaagaaccaacuccuagaacguuauccucugaccuccacauguguguuguggcauguauauaucuaccaaaccuucauuuuuccucccuuucucucauaaauaaaggauaauuuaaagaagugguucuugaauguggugguguacaccuauaaucucagcacuugagaggcuguagcagaaggauuauugucaguuugauuuuaacuuggaauauguaauaauuucaaggccaucuuaugcuauauaguaggacugugucucaaaacagucaaguaucagugauuuagacauaguacaaagugaucuuuagagaguuaauacaauuaguucauaugauaaguauucuucauuaauuuaaaguauauuaacacaccauggaggaauuuugucuuugugaaaauuccuggaaauuaaggaaaguuaauuuuugaacacuagcaauuuguauauauucagguauuuuaacuaaaauguacaagaaaauuuggagauguuuagguuguuuacuaaauagauuaaugagguguuuaccaaacuauccugcauuuuuuuuucauuauagggcuuaaagugcuuuuccauuuuaaaaauaccuuauuugauaaacacuucucugaaugucacuuacauacauaguuuacuaaaauguuuacuaauaucuuguuaauaaaauagguacaagcgaaaagaaacggagaaaaaauauuuguauuaaaucuggcauuaggaagcucauagacuuuacucauaggaaaagucugcagucuugaaacuucugggaagaaagaaacaauaaagacuccuauucucccucucagcuuucuacuacagugagugaaacuucauuaagugggauaacuaggaaguuguagguuugaaccucugcucuuaagaauguuuagucuuuaucagaucaacugaccucuucauacuuuugauuuuuuuuuauauuauuaagagaucgggcuauuaauuuuuuuuuguguguaauucauucaguucuccacaccuggaguaaggcaccugaagauaucauuuugacucuuucucugguucacacagggcuuuuuugaugcccaaauaaguuaagugaaaugugaaaauacaugucuaagguucaaaggacuugauauaaauaucagugucagucagugcuguucauuuaguaccaugauugacagauuacugucuguggagaugaugggauuuugauuuuugaccuugaaagaaauuaggauuuuuccuggcagagcuagaacuguuuggagauagagaauagcauaaaccuaacaaaacagauaaagagacagaauuuaaaauacauacacagccaguugagaugacucagucaguaaaaggauuugcuuccaaguuucacaacccgaguuugauuccuggagccuacacaguggaaggagagaacagagucucacaaguaguucucugaguuccacucaaauaccaugcguuuugcauacucauauguacacagauaaguaaauaaauguaaaauagauugcaaaggaugcagagugguuuuauuuaauguugagauuucucauguuaaauucugacauuaaagaagucuauuuuuaccauuuagucuauuuuauaauugguugcuuaauucaaaaugcuaucacccuuuguuuuccaaguaacauaaacauguguuaaugagauugcacuaccagagaucuuuuucauguaccugcaauguaucugucucugaccaaauguuuugaaaacaaggaaaaaucauuacuuugucuuuaaagaugaaauagugaauuaguauaaucuuauuuucuuggcaaaacaaaugauaggcaaaucuauuggaauaauuuuuacccuuuaaagcaagugaaaguauaaaauguuuuguuauuuaugauaauuguuauuuauuauuguuuucuguguaccaaauauuuuaagguacuuuugaauacauuguuugaccuuaaaguaacuguaaaauaaaguauaauaacuuuacagaaauagaaacugaaacucaaaauaauuaaauaaaaauacauaagcagagcccgauaagaaucaggcuucuaacucaggcuucuaccgcuucuuuaaaugccuaggaucucucuaaugcugcuuuugcauaugguguauagaugggucuguuuaauguguaguuugcaaauccuuuguacaaaguacauuauguguuauuuuuuaaaaagacuuuguuugcucuaguuauugucuaauugucccuuuuuuuuaagccuuuuuuuuuagauuuauuuauuauuauaucuaaguacuguagcugucuucagaugcaccagaagagggcgucagaucucauuacagaugguugugagccaccaugugguugcugggauuugaacucaggaccuuuggaagagcagucggggcucuuaaccacugagccaucucuccaacccccuaauugucccuuuuucuauugcugauacucuaagacuuaauccuuuaguuuuauggugauuuuucaaaaggaaaauuauuuuuaagaaugaaaucucuauauaaacaaagacuuaaugcagucuaauaacucaaaugcaaguguuugucagacaucccuuaauauauuccaauaaaacgggacacagcucccuuuuauaugcccuuucauuugagugaguaaaauaucauccaggaauagaaguuucuacuugguacauagcaauaaguguguagugucacaaaccuugaagagaugacauuguuaggugggaaaggacugacaucacauugggcauuuuaaguaguuuuaaccagguguagugaugcacaccuuuaaucccagcacucaagagguagagaggcaggcauaucucuggaguucauggccauccuggucuauagaaugaguuccaggacacucagagcugcacugagaaacugucuugaaggggaaaaaaagaaagaaauuuaaaggauuuauacguguuuggaacagauuauugugcaugugugcauauauguauuaaaacuagaauauacuucagcaucugaagauaauugguuuuaggacuucagaauaucuucaauuuuguuguuguuuuuuucaagccacacugagaauuucuugcauagaaagauaauuucacaaauugauuaaauaaaugcagucccuaauaguguuuaugcuauuuccuuauacucucuaaauuuuuaacauuuaguuccuuaguuuuguuugagacagggucuuacuauguagcuuugccuugcuggcuuggaacugguuagauagaccagguuggccucagauucacagaucuuucugccugucucugccucauaaacacugggacuaauggugugugccaccacgcccagcaaugauuucuaucauugacauagcauaguucaauuaugucauauauuuuaguucccacauauuuagacuuaacuguuuaugaguaguauuuuuauaauauuucuaaaaucuuucccccacuguuuaaaccauuuuagguuugaaugaaacuucauuuuuaucaaaacguccuucugguucugacauaagcaguguuaacccaaaaaagccuaaacccagugaaaauacuucuggaauagaugccucuucuguaaucucuucagaaaaguccccaucagugauaucucuccaaguggugccaucgcaagguaaaaacacuagccuacaaaaaagaaauucuguaguauuuaaagauaaguuuugcaaaugguuacaaauuaagaaacuaauagugguuauuuaaguuaaaaagugcuaaauuugggggcuggagagauggauuauuggcuaagaacacuuaaaacuuuuucagagaaccuguguuugauuccuagcacccacagagaguggcucucaaccaacagcuaaguccagcucaggggaccugacauucuccucuggcacccaugggcaccaauacaaauguuauauuuugcauacaugugugugcaccuaguaauaaauaauuaaaaauaauuuguaaaaagcaacaagcaaaaaacccugaaaaugaugcauuuuauuucauaguugaucugaauuuauuuuaggugcaaauuguucaucaagucaaucuaaaaauggaacaacuuuuccaagagcaugucccaagugugauauucacuucaaucuuuuggauccucuaaaaaaucacaugacgguaaaucuuuuccaaaaucuaauuuugaaagcuugaaaauccuuaaaaauaguaaugacugauauauaguaaauaaguaaguuaggaaugaaaucuucucauacuagguauauccauagaccuuagguaaaaauuuauauucaaaaucacucuacguaaaauuccuuaguucauauauuuacaauauauguuuauuguauucugauuuuaaacacaauaauauugauuaaaucauauuccuauuuguaaaacguuuuacugugauuucaaucuuuuuauaacuuaaaauucuauagcuuauauaugcaaauauguauuccacauuagauaaugaaaauaaaucauacauauugucaguauucagacauuaacuucaaauguucaugcuuuucauguaaaauaauuguuuugauaaauccagaauaguuugcauaagcauacauuuguguaaaguuuuuauugagguaggaagcuuuuugauuuagauuugaagaaaauuucaaaguaugugugaaguaugaaguuuagguaacacuuuucuucaaauauuagcuuuuauugugcuuuccugugccuuuauagaaauguucuguaaucuccuuguuccuacuaccaaugacaggaaggaggcaggggagauaaaaacagcacugcguauagaguacaaaaggauuaagaagcaaugagguaguacaggaagaguccuugcuguuucagaaacuuacaauuuuuaauucaucauuuuuaaaaacaaauaaaagcagaaugagccgggcgugguggcgcacgccuuugaucccagcauucgggaggcagaggcaggcggauuucugaguucgaggccagccuggucuacagagugaguuccaggacagccagggcuacacagagaaacccugucucgaaaaaccaaaaaaaaaaaaaaagcagaacgaacugacuggcaguugauggagaaagguagacauucuuuucagugauauaguuacuggucaaguugcccauacuccuguaaauaacccuucacucguaaaaguaauccuagucaaacuuauugaaaaaaaaauggagaaagacagcugaagacaggaggaagacuuccugggagcagggaaguaggaacagggacaagaagggguaaugaggguugaguaugaucaaaauauaucaucuaugggggugaagauggcaucgggaaacccauucuuaugaagagcuauagacaaauaagauagaaaaauaacuuaaaaauuauaaacacaucuuuauucagaauugcguuugauuuauaguacuuccagcucccacaguguagcauuaaggacugaacucugugcuuugaucauacaggaaaauuaucuuguccaacugauuucaccuucuuuguaauguuugauaagacuuaugacacuauuuguuugauauuagagacagagagaaaaaaagaaguacauuaguuauucuuacucaucuuuuugacuaaguaauaaaaucaugugacucaagccuacacagggacgcaacugaggaggcuggcccgacucauaccugucuaguuuauaagguggcucucaaaaagaauaacuucauauuaguuugcuuuauauacucuagguuuguuuuauuguuguuguguguaugugcguguaugugugugugcguuuacagauaaaugugaauguucuuauuuucccucuauuucaaguacaaauuguaucauacuguguuaucuucuuggccuaauuaacuaucuuuuccugugauaaaaacauuauaaccaaagagguguagaaagaaaagaaauguuuuaugucagcuuacagucaguccaucaugaaguaaaaucagugcaggaacucaagggaggaaccuggaggcaggaacuaaagcagagaccaugaaaagaaaugcugcuuccugguuugccucccauggcuugcucagcuggcuuuuuaaaaaacauuaaccaaaacauuucuguauuugaagaaauuggagaccuccauccuaaaagguuuuuacaaauauuuaaaaagcauuauuuaugauuacuuuuauuggaaauuauaaagguuaucauguaacauucaaauauuagaauacuauagcauuucauaaaagcaacauaauucauauuuuaugaauguauauauuuuguucuccuauauauuccuuguuucauaguggauauauacaucaucaaaucuaggaaggguaaguucaaagucuuggggcaauuuuucagucacagaaaggcaaauacuacaugaucuaaaaaaacaucucagaaggugaaguaguuuacuugaggcuaaggagguuaaggaagauguggagagguuaacaguuaguacugaauuauagauaggagguagguuccuuauauucuauaggagcacaacacuauaggaugaauauaaucaaaagaacacauuguauaucaaaaaaaggaaaggcuuuuugaauguacuaauaaaggauaaaacuuaagauaauggauauaauaauuacugauuuuugaucauuacccaauguaaacaugagucacaucauguuaaacuucauuuuuaugaaaaugcaaauucucagcuccacucccccaaaagauuuaggagccugagagauaguuaaguggcuaaagcacuugauuucucuuucagaagaccuggaucuuguuccugccacuuacauggcugcucauagcuguguguaacuccaguuccagggguagccuuacacucuaaucuggccuccagggaacuacuacacacaugugcacauacauaaauauaggcaacacacacacaugaaauaaaaauacauuuuuaauaagaauuuaaauuacaggaacuuaaacuagauugauaagaaugaaguauagacggugucugauaacuugucagacagacuacagaccacaauacugaaauauucacuagguacaaauggcuaucucauaaaauuaagacugaagugaaggauuacagaacagaccuuagagccaaaaugguuauaugucccaacaaaguuuuucaguugauuuugaguccuauguaguugugcccuguguagcuuauuaucuuuauauaaaaccuaauucagggggcuggugagaugacucagcgguuaagagcacugacugcucuuccugaguucaaaucccagcaaccacaugguggcucacaaccaucuauaaugagaucugacgcccucuucuggggugucugaagccaacuacaguguacuuacauauaauaaauaaacaaguuuguuuaaaaccuaauucuaaacuuaguccuuguuucucaaguuguacuuuuugcauuuugaauguuucaggauauuuugacuuuccucaaaagcaauuccuuacucuguuuacuguacuugguuuuuauugaccauuuguucuuuaucuguuuuuauuaaggaucuaaaucuaaaauauuauugaagagguauuaugaacaagaauuuugugcuacuuuuaaaacucugauccugucuuuuuuguguaugaaagaaaauaaaacaguaauuaguugcucauuuguuauguauauaauuuaugagcaucuuugugaaaccauuaucuuuuauaaauaguaaaguagaaauuuacaccuuacucuuccaugggucauuuuauagcuucagaaaagaaucacauaccaagaaucacauggaguggcuucuccugaaagccagaucuaacauuuaggguauaccaucaauagugaccauuauuaauuggaagacugaauuaaagaauuuuuaaauucuaauuuuccugagacuuuugucauuccccccacccccuuaggaggguuuuaaauaagguuaguacuuuguuaauauaauaaccauuauuauacauacuucauacauauacuuuaaguaauuucuuucuucuggucucccucuuaacacuuuaauccagggccauuugcuugcugggccagugcucuaccacugaauugcagccacagcuccugagugauuuuccauaguguaguauaguagcuuauuccacacaaugccucauuuccuuaaaauuaaaaguagcauuauuucuauuagucuuauaaaaagucuuuagaaauagcuugauuuuuuuuuuuuuuaauuuugaauucauagauguuacauguaccucaugaaaaauccagaaauaaggcugggccuuuuauccaaagacucaggcaaaagucugaguucaagggcagauuuagcaaaucagcucugucucuaagaaagaaaauacagaaacauaaguaacaaagccuuuucuuaccucucuuuuauuuaauuuauuuauuuauuuauuuauuuauuuauuauuuuuauuuugguugugguucuauucuacccaaggggaaaagaucaucuuauuaggauacuaauauacuuacuuuuuuuucucuuuucuuuccuucaagacaagacuucacuauguagccauggcugaccuggaacuuacuguguagaccaggcuggccuuaaacucauagggauccaaguggcucugcucucugccucucugccucuccgugcugagauuaaagaugugagccacuauucucagcaaauacacuuauuggugcaaccucaacuuguaaauauaaguuaguuccucucuugugaaucaguuuuauucaguauuuuuccuacuucauagauauauuuuaaaugugguuuuguuuuguuguuguuguuguuguuguuugguuggcugguugguuguuuuuguuuuugcauuuguggauuuagaaauugaaaagauaauucuggcgaucaguuccuuucaaaaguauuugaaucucuagaacccauauuuuaaaagguccauguggugguucaugccuguugauccaagcuagcuggaugguucuugaggaaugacacuaagguucauucucuucuaauguuguuguccagacaugguaaauaacuuuuuugggauugacuaaagcaugucaucuggccuccauauauguauacaugugcauguacaugugcucauacccauauguacacaccugcauuuacauaaaugugcauaugcauauguacaagcacauacacaguaacacacacaauguaaagauaaaacugacagugaaaugaaguagcuguacuauuauaaccuugcagaagauguuguagaucacaggcugagcuccucacauuauacugaguguuucaugaaugauaaugauccaaagagucacauguggcagaagaggaaguggauguuauaaucauagcauggaauaauuguguuccauuacaaauccugauuuagcacacuaaagcgcuuauguuaugaaagaauuuccuguguuucuuguuuuaagccuucacuuguaaaaauugcaguuuagguggucugaagcagugcuaggaauuaccauuuaaugaauuauuacagauuuucuaauacagguuuuuuuuuuagguuugcccucaaagaaaaacucauuuaaaaaauucuacaacuaaacauuauguauaauaaauaaaauuagcuauaucuugauuuuagaaagcucguauggaaaguuucauaucgcaaucagcuuuugugacuuuacuuuuauuacugagaaguaauugucuucuucaaauauuuuuagcauucaggauuccacgauauacuagcugcauuugucuccaugucccaauaauuuuuuaguucuaugaaucuagagcauggcaguuuuagcuguguaaaaaucuaguuuuaaccaacuuaggaaguuuucauuuaccugauacaucaaaggauguaacauucaccugcuguacuguugacaugguaaugaaaugaaugauuuuugguuacgauacaaaugacuauuaaacauguaucuaagcagguaaauugcaugggaaaaguuuaaauagucaaauccuagucuuaaggcuuuuuucaucucuuuuuaaauuuuuguuuuguuaagauaauguuuaugggcuggcgagauggcucagcuguuaaaggugcuugccgccaaaccugacgacuugaguucaaucccuggaacccacgugguggaaggaaagagccgacguccgcagguuguccucugaccuccacaagugcacuauggcauucacacccauacagaacacauacacuaaacagauaaauagucuacuuuuaaaaagucuacuuuucuaaacuuguuagaauauccaccauaggcuuucacuauucuuccagauaucuuaucaagcauaguuauacaugguuuggccguaguugaaaacauaauuguuuuugcuguuauuuuguaauaaauaagccauuuuuuucauucucuuuuaguauuguuguccagacaugauaaauaacuuuuugggauugacuaaagcagacaauuuaaauucagcaaaugaagcuaagacucuugaaucagagaaaggaaaauugauaauguuaguuaaugacuuuuauuacggaaaacaugaaggagacguccuggaagaacagaagacucauacaaccuuuaagugcuucaguugcuuaaaaguucucaaaaauaauauuagguauguaaauauauauuuuuauuucaaugaaagugggaauaccagagauguaaccacuguugucuuucucaugcacucuugucauucuagaugagcaguuucagcgcugucuccuuugauguauuucagccuccucuuaagucugcugcuuugucuuucuuucauaugacuuaagaaaggacagagauuaauuuggaacaaaaugaacuuauuuuaucuuuugauucuuauuuaggaauuuaauuguauauuuuugauuuuucauauaucugaauauaauaaauuuuccccauacaaaaaggccuucucuggaaguuggcagguugacaucuuccuuauuauuacuagucgaugaccagagcugcauuauauuuaucauguuuagaaucuccguuuugugggaaauauauucuuuaucagugauuaauuaauuccaggagacuuguauguuuucauuuuaaauuaaaauuagauauuucauucucgauggaauuuuaaaaauugucuauaaauguuuuacauuuuagagacuuauacuuuauaaucuucuaguggcacauguuauaaaaauaucaccuguaagaagacuacuggaugaugguuuuuuuuuuauuuuauagccuagaauuuauauuuuauuagacaagacuuuucuacccuucguaaaaacuuucaaacauucaucacaaaacugaaaguuugaccuugcccccuugcuucuccccgccccucuuuacuuguuucacuguuugucuuucuccuuuaaacaaucugaguuuuauaaauuaauuaagcuauugauaaaaacugauuauuuuuaaauguauauuucaaaauaaguuacaugcaugaguauacuuauuuuagauaaguuguacuuuaggaguggaugugggucaaguuuggggagagggugagaauauauuuaaaacauagaaaacuugaucuccaaaaagacaaauuaaaagaagauacuguacacaaauacacauguauaucuuuuauagauacuaaaagaacuuuccaaauuagcauuuuguagaccagcaguuauccucuugggccccugaguuuacucacuucugucucguguggcugcugcuaacaugaugcucacaggccucuuugugcauuccagagcucuuaaacuauuucacuccuucaagaacuaaugcucccaguauuuuguguuugggauguaauacugaagcagcauugaaauugaccuccaccaccuagucccauauucuuauuguuacaagauucagucagggaaagguuaaauguguacaaguggguuucacugucuuuguuaacuuccuuguuaaguauacauucugcaauuuauuuuagcaaaaguguuguuugucuuuuacuuuuacgauuagcccauuuaauauuagacaugaaaaauaacuuuuucuaggaauuauuuuaggacauuaauuccauuuguuuauauuagaauauuuagaaaauuuaaacauaugacuuuuaguaacauaaacugaacauugaaagcuuuuacuugggaaauguacccuuaaugguauaguaaauaccuugugacaaaggaauuaaagauagaguguuuugucaguaaaauuugggaaggcaaauuuuuuuuuguuauuuugcuuuuguuuuugagauaagauuucauuguauagacuuggcaggcccaaacaaaaccaagagaucuaccuucuuugauccugaauugcuaguaugugcaaguauuccuggccuugcaguuguuuauaauuuguauaaugguacaaaacauaucaagauuuccauuugauuucucauacagguuuuuaguuacugcuuucucccccauuggguaucacuaaaaacagaucauuguaagaaguuaccauauauugucuugggaacuaugcauuccaguuaggucuuauguaaacauugagagaaaucaacuaguuaguuaauacauuacuuuauauaauuauacuuuagugcuuuaagggcugagcucagaauuuacuagcucaugcuguuuugccuauaugcaaauauuuaaccaagacuagguuuuuaaguguuuuguagagcucauguuaaaaccaaaggggagccaggcauuguggugcacaccuuuaaucccagcacuugggaggcagagacaggcaaauuucugaguuugaggacagccagggcuacacagagaaauccugucuugaaaaaccaaaaaacaaacaaacaaacaaaaaaccccaaaggcaaaauaaagauccuucaaaguguauuacaauuuguguugaggagauacuguucuucagagacaggaaaaagaagagauagaugucauagcuuucauggugucuguucucuggauugauaacauuuucauauaguuucaugcuuauuuccuuugaagccuccaacuggaugauauuuauuaauuuuauuggcccagucuaaauuuucuuuugaucaaguaauacuacuuuuuauuucagccaaaagcuuuaguaagcuuuuaaaaauagauauauucccauuuauaccacacuuacaaaggucauaguucuguugauaagaaaccuuguagggaugcugaaauagcaaaguguaaaacugaaaaauggauguugccuuacaaagggcacagucugcaaguuaaaaugaacaguuuaugcuuacuauaaacaauaucacuaaauaaaugaaaaguuccuuguacuuguaggcauuaaaacuguuauuauauguacuucaaaacaaagauacagguaagaauacuaguagcuagaauuuauuguauaucuucagggucucaaagaauuucucccaugacucuagcuacuuuugcugacaggauuuucuuucuuucaauauugaauuuuaaaauauaaauaguacuucacauggcaaaggagaguuauuuuaucuaaaaacaaucaucugaaaguagugacauuugaaacaaagauggaaaaaaguaucuacuuagccauuuguggucauuauuuaggacaugcaguuuccuagagaaggacucuagguuuugaguaauaauucacuuuuuuuuuuuuaaauaguggguuaagauauggugggaucuucuuugauuuuuuaauuugaaucucuccgccuguugccauuugcagguuuaugaaccacaugaagcaccauuuggagcucgagaagcagagcagcgagagcugggagaagcacaccacgugccagcacugcuaccggcaguuccccacgcccuuccagcuccagugccacaucgagagcacccacacuccucaugaguucuccagugaguuacuucucaggauuaaggaagcucagcaaaucuugagaaaacuguuacagaaauaagaacaagaaauagacuuuggauuuuggggccaaaauuacaaaagcuaacuuacuucaggcuucaguucaaaucccagauguuugucuugguguaguagcuacauaaguucaggcagguuauuugguacugagacaauaggauaacagacaugccuuugugguagugcuaaaagaggaauugacugaguuaugcauguguauauguauggcugcuuaccaccucuaauacugccacuucugcugacaaauuuguugacacuguuauccaaaugagcuuuuauuauuuauauauuaaaauguuguaauaacucuuccuuucaucuauagccauuuguaagaucugugagcuaucauuugaaacugaacagauucucuuacaacauaugaaggauaaccauaagccuggugaaaugccauacaucugccagguacgucauguuuuauagugucauuaacuguuguuguuuugguguuaggauuuguagcaggguuuuugguuuuuuuuguuaggaccaaacaguaagcauuucauauuagagauacuacagucucuaucacagcuagucaacucuccguuguggcaagucagcaauggcaguaaaggacugcaaggauguaucuguguucuacuauauggauuucaaauuuuaaauucuauauaauuuucauguauagugaaauauauuggugguguuuguuuuauuuuugccaucuagguaaaaaugguaacuaaaaaaguaccuccuauuuaauuuacagugaaaagucucuuagcacagcucauauauuauaugaggggaggacagugaacuagauuuggcucagaaaauguucuuugcucccaaucacuagaaagagagagcccugaaggaaaauagaguggauuuccuuuacucuagacagaucacuauaaucauauguccaagguacaaaugcuuaguuaugcagagcccuaucacgugcuuugggacauguauuucuccagaauuugaaggaguaggaaagcaaaagaaagaugacuugccacaguaauaguuuagaggcaguauuuauaaucugauggacagugcuguuuuauguagaaauaaaguauuuuauaggacagaagaucuaacguuucaaaucaagacaggaugggaugauaaauaaucugauaaaaauaaagguaccuguuacauuuugggaaguagucuucagcuuugaaggaucaccuuuuucugcuuuuuuggugucuaccuuaaugaauuuuaaggcauuggagcuggguugacaguauauuuguaguugcaaaucaguuacaaaauuuccauuuaaacauaaccuuuuuauuucuagguuugcaauuacagaucaucauuauuuucugagguagagucucauuuuagaacaucacaugaaaacacuaagaauuugcuauguccauucugccucaaaguuauuaaaaucgccacgcccuauaugcaucauuacaugaagcaucaggugagguuaauaauucucauuuuuuuguguuaccugauuagcacucagaauauuugguuuucaaagagaguggauuugauccacauaugaaauguuuacugaaucauuugugaaacuuccacuucuuccauuacuucuuuucuagugauacuuggucucuaaacaguugacaagacuuaaaaauggcaagaaauaggaaucauaggauugagacagaaaagaggcuaauagaauaugggaaagauuggacuuuacggucuugguagauguaggaaugauuuugaaguacccucucaagaggaggugaaaaaaugagucugaacugaaaaagaaucaagauagaaaauuucuuagucuuauuuucuucuuuguuuugaguuuuuccccacuguccagacccuugguauuauaauaagacaugucauuauugacguagaucaauguuuuauaguuauaugacaaaggaaacaaguguuagucaauauuugaacuuggccagagcauagcuuguuuccuguaugacuuuugcuagcuuagcuauauaauuuuuggcacuuauuauuaguuguugaaucuuccuugcauuuuugauguaaugcuuauugguucuuuucuuggagcaauuaaaccucccuuugagcugaaaauguugcugcaacauugauaccugacuuuuaguagcagugcuuuuguuggaaucagaaagccauccaugucugcacuggaucugaugguggugucagguuuugccagcucacugaaaagcucagugcauuuguacuuuaucguguuugcacaucagguauuucccauuguaacauuguuuuuaguuuuuuuguuuguuuuuuggggguuugguuuggguuuuuuuuuuuugguuuuucgagacaggguuucucuguguagcccuggcuguccuggaacucacucuacuguagaccaggcuggccucgaacucagaaauccgccugccucugccucccaagugcugggauuaaaggcguguaccaccacugcccggccuauuguaacauucuugucugucauguucaauuaaucagaaaauuaacuuauggaggguuugguuugguucuugauuuuuuucaagacagcguuucuuugugugacccugacuguccuaggacuuccuucauagaucagacuggcuuugaacucagagauaaaccuuccucugcuuccaaguacugggauuaaagauguguaccaucaccuccugucuaacuucuguuuuuaauuaguagagaaugugaaaguagaauuuuccaauaaauuuugggucagcuguauugugagugugauucuacagaucuuugaaaauuuccaacaagaucuucuauucuggaauauccuuaaacauuguucuguugguuuuucauaugauuuuuccucaaaauuuguuaacugguauauuugauaaauaccagauuuacaaaauuaaagaguuuuauauauuaaaguagaauuucucagaacuuagcaaaaacauaguaugcauccuuuuccaauuuaccuggcuaccagacacuuuauuugagaaauagcuauuauugaaucuuuauuaaacagaauucaggaagcacuauucauacucuuucaucuuuggguuuuaauuuugaaagacaaauaaaaaggggaguauauauaaagaaaucucuuauuacaaggcuuucaauuuuauuugcucaaaauuacuugcucacuuacuucuggagugagauacagauacaggaaugaaugauaaucaagguguauugacccugcaucuaagcuguguaauuuauuaacucuucacaacuagaguugucuuaacuugccacacauuucggcuuuguuuguuuguuuaugggauagacagcaaccaauaggggucaggcuguuaaucaggaggauaaagaacccuuaguguacuuacaacuuguauguuuaugaaaaauuggaaaccauaaguaggagagaugauaaacuugaaacugaauuuauauuacucauacacuguuagguucuaagaacaguugauucugugccuuuaauauuuuugaggaccuuagauuguauuauaucaaguaauacuaauauuuauauauuuguguguaugugugugguauuauauuugcacagaggcaagaaaagggcauuguguguucuccucugucaauuaccuauuucuuugagguggguguuucccuagaaccgaggcuuucuuagcuagacuggaaauuagcaaucuccuauuucugccucacucagcugggacuauagguauguguagcacguuauguaguugcugguucucauccaccaugccaucucucuagccuccaugacagcugauuuuagaaccaacaaugcaguuuauauaacuuguuuuauuuuauuuuauuuuuugagauuuauuuauuuauuauauguaaguacacuguagcugucuucagacacuccagaagagagcgccagaucucauuacggaugguugugagccaccaugugguugcugggauuugaacucaggaccuucagaagagcagucagugcucuuaaccacugagccaucuuuccagcccauaacuguuguuuuugaaaaaguaucucauauagccuagauuggucuccagcuuuucauucagugggaagaaaaugucaaggcaucaaaggacauaaguggaagaaauuuuuaaaaauuugucacagugaggaccagugugguagugauuauuggagauauaaaaaagagggaaguguguuugccagguuuuauuaauauauuguguguggggugaaggcauaaccauuuuuauucuaagcaguuacaagaauguuuucauauuccagacuacagaaaagacuaaaggaagaucagaauugagaggguggaagcagagaauuagacguaaaauguaaaguucauucuuauucuugacaguuugaagaguauauuagacaucaagcauucucaaugcagugagaaaacacaaugaccaaggcaacuuacaaaguauuuaauuggacuuaaaguuuuagaagguugaguccaugauggaggaauagcauaggaagcaagcaguuuguugacuggaauaccaaagagcucagauuuugauccacaguagggguagagagagagaaaccgacagagaaagacagaugaaaacgugagagacugacugccugcaugcucauguaaaccacaggaauaauauuaaauacaugaguauacggcauuuaaauuauggacugagauguuaguuauagagaaaaacauuucuggucaguaaacucaugugaacucucuuaccagcuuguuuaguuucugauucuuaacuacauuuucuguuuuaauucauccuuuuugaguauacaauaaauggauuuguauuguuugcauuuguaaagacaaucuaguguaccaugcuuauaaacuaaccuuaagaugaaacuagagcuauaagaucuuauuacauaccucuuugaguguuauaacaguugucuucuuuuaaaauauuuuuuaaaauauuaaaacuuuaaaaaaaacucuguggauguuugccuuuauuuaagucuuguauaccauguguaugcuuggugccugugguggacacaaaaaugcuucuguugggaacugaaguuguaguuauguaccaccauaugagugcugaaaauugaaccuggguccucuggaagagaauccagugcuuuuaacugcugauucaucccuuuagccccucuuuuaaaauacuauauugacauguaacaguuguacacuuugagguauacaguguaauaauuugggacaguuacauaguguguaauaaaaaaaucacaauaauaacauuuuccccaguccuuuuacucauacucaauaaccauggugacuaauggcagccauguuggacagcacagccacagaauacuuucucauuacaagaaguuuauugaagaacacuguuuguuuauuuggggggggggguguuguccaguuuguuuuagagaggucauuucaucuaccuauugaccaaugaaaaauagcaaaaauuuuaaaguaacauuuaaauuuuuuauauguaugucugugguuuuauauauaugcauaugaugggaauuuaacuuggguucucuggaaaagcaguacgaccaaguaacugcugagacaucucuccaacccacaaauaauguuauuuucuacauaaaaagauaguguaacuaauguuagcaguaccaggucuuuaagcacuuggcuuauaaauaaaagacauuucacgugauaauuacuaggauuuucucugucuugguuuuuugaggcaguaucucacuauauagcuuuggcuguccuggaacucauucuguaguccagacuagccucaaacucaagcgguccaccugucucugccuccugaguguugggauuaaaggugugucccaccuugcuggcuaggauucucauuagaaucuuuuuauauaauuuucauaauuuuguuuguuuuaaagauuuaucuuuuaugguuguuuugcuuucauguaugucuauacaccacaugcauuuguugccugcagaggccagaaguggcuccccuagaacuggaauuaaaguuguuagcuacccuuuuuuguacugucagucaaucccagguccucuggaagagcagcuagugcucuuaaccagugaccauuucuucaacccucaaaacuuucauguuugauuacuucauagcaaauaaucuugagauccaauacuaauaaauguuuuuaaaaugagaugauucuuugauuuuuuuuuuauauacuaaagauucauuaaaauuaaauucagaacuuaggauuuguagcuauagaaauuauuuuccuuuuuuucuaauagaaaaagggaauacaucguugcaccaaaugcagacugcaguuuuugacaugcaaggaaaaaauggaucacaagacucaacaucaccgaacauuuguaaaacccaagcaacuggaaggacuucccccuggaacaaaagugcguucaaaugcaugguguucugucauuuguagaacuaacuccugccuaguuccaucuauggagcaaaauaucuuagaaaauaacuucugauuuucauuaagacuaauuuuauauuauacugcuuuuuuaauauauauauaaagaaaagcguguuuugaguucuguguuggauguauuccuucauaaaaagugcaauuaaacuauuucauuggucaguggguuauuucaauacuguauggcuauuugaacuuuucuaguuaguaguauauguauuaguuuuaguagcuauaugcuaagcucauugauaucaggaauuauucuuucauuuaucucuguaccuccagcuuuuuuagagugccuaaugcuacagguugccagauguuucuugaaguuguuauugcugagucuacucucaacgaagcaaauauugcugcuggacagcauugugagcaaacccuugucugacuguaaauugaugauuguaauuuacuguucccuuuuugccuuauguacaucuguuuucucugaccucuuuauauacagucagcucuugaauauuugcuccaguggagggaaaacagaggcauggauaauccaaagugaaacaauacccaaaacauuuauauuugccuuuggguacuuaccuuugaauguggguaugucuuuuauuugaauugacuaaauaauauaaagccaugcucugaagacuuagagcaagaggagcuagccagcauccuucccugcaguccauucauuucaugcugggacuacacaugcagaauacuaauguaagcagugcaguccucucauuucuuccuauauuaguaguaauaauauuaaugauacuaaauguuuuucuagcaccuuagauuggcauaauucuaaguguacuuuuucauauagucuuaccuaauucauacaacaauaaauguacuaaagucaauauuacccuauguaguagauuugaagaagcuuaagauucaguuacuuuuguagcuaagaauacagauuuaaccucaggauuuuuuugauuuuuagucaaguguuuuugcacauuacacaagugugugaguuaguacgauuucaucauuggcuacuccucagaugugaggggauauaaucacacgauuagugaaaauguugggagguaauugcauuuucauugucaaccaaaaaauguaacagaauguuucugaacaguaaauaauaaaccuuacuaguucuuuuaaagacuuaaauguuauauucuucuuauaguauaaugaauugauacaaccacuugccuaaaucucaggcagugugcuacagaaagaauaagucacucuccuauagacauuuacuugauaauauaacuuuaaaggguaacaggccuuuaguuuacuuuuuucagucuuuuauuacuuaugauuuagacuuuaugggaauaacuuuuagucauaucacagcauaaauauaacugaaaucugaucuuauauucauauaauuucuuuuaaucuuauuaauaacuguuaacauacaacugauuaugauaucaauugauauuuuaaaugagcuaauacauuuaauugguugaauauuuaaagcaaacagaugacuacacucaguuacuuuaucuguguuucuaaaaagcacuuaauauucagcuuauuuuauacagugauuaauuuuuuuaaggaaaauuuuuuucuucauuuuuaaagguuacuauucgagcuucaguuggaccucuucagucaggaucuucaguuacaccuucuaucagcccaagcacuucuacccuccagcucucaccuccagagccugacaauguaacugcuaaaaaucacgugaaguugacuacaaguacaccaaacacaaccauaucugaccccaguaaagcuaaugagaccaagucuaauggcaguaaaucuaaaaacaagucaaaagucuccaacaugcagaagaaacaaagcacauugucuaguaguaauaaaaaaagcaaaguaaacacagcacuaaggaacuuaagguaaugccucacucugauacauauucccaguuuaaacucaaguauagcaacaugcuauuucauaauaucccucucuugacuauuuuuguuuuaaaauauauuuuuuauuucuccacaagguuacgucgggguguucacgaguguauugaguguucuucugaaguaaaagauuuugcaaaccauuuuccuacauauguccacuguaguuuuugcagauauaacacuagcuguagcaaagccuauguaaaucauaugaugagguaagaugaguucaguguuuugucuauuauaaucacaauugaagaagcuuuuguuuugaaaacaaauuaucuguauuagaggccuuguucucugauauaaaaaagcaaaucaagaaauuacuguauauaaugguuaauuaagcccaaugaaguuaaaauaaauuuguaauuauuauucuuuuggauuuauauagucccugaaaugguuauuuucaaacauaaauuuaaauguuuuaaauauauuuaacuggcaaaucgguguauucuuauggaugucauucucuucaaaucagucaaagagacuugaggauuuucagugaugcuggcaacaucauugguuuuguuucccauccccccaucuuucucuguaaucuauccauuucucagccaucuguauguccauaucuaaagcuguaugugcuuauaucuauucagugaaugucaugaugcuacuuuggaauuuuuuccaacauugcauuuauucugcauuggguacccaacauuugcucuaugauaguguaguucucaugagccacguguggauauuauuacaauuguuguuauuguuguuaguaguagucuuauugaacacauuauucuucaaggguagacuuuuaaaaacuguauuuuaagauuuuguuucuauuuacaugugugugucugucugucugaaucucugccacauguguaugggugccuguggagaucagaaguaguguugaauucucugcagcucguuauuggcaguugugaauugccuauuugaaugcugagaacuggagccuggguccucugaagagaaacaagcaccauggauuuuuauuuuauauuuuuauuucaguagucaaaguuguccucauuucagugacccugauagauugcuuuucagaaugaugcucucguggguuuuuuguuuguuuguuuuuuguuuuauuuuuguuuuucuaaauagaauucauguauaucuaaguuucuuuuaggucauaggucauaucuuggcuuucauguugcuuuuugauuauugucagauacugcuuucaaaggucaucccaccuuuuuagguggcuucaguacuuuccccaauuuccugucuuugaucaucaaccuggucuccugguuccagcauuuacaucaauguuuaauucuucucucuuagcuaauaggaccauuugaaugcaugccuaugcuucguuucuuugaauucccacuaguuuaugauguucagcaacuauuaucaucagggucauuuucaguuuuguuauguuuucucauuuacucuuuagucaugcucacuugacauaaaggccaccauaauauuugagcccuuucuccuuuccccuuuucuuuguauuauguucaauucugaaauguauaugagauucauaccaaucucacuuuauaaaauaaaauuucaguguguuuauguuuuugugugcauaugcacgugcauguacaugucauauguacuagggaguuuuacuaagguuauucacaggagcuugggugauauaaucagucuucuuauuuuuguugaggauuauuuggcuaucugagcucauuugugcuuccagauguagcuuaauauguuuuuggguuuuuuuguuuuguuuuuguuuuugcuuuuguuuuuucugauucucugaagaauaguauuagaaucuuuauuggauugaauugaauguguauauuucuuuuggucaaauggcuauuucacaauauuaauuuuuccaguuuauuagcaugcaaaaucuucagguuucuuccucaacuuguuauguuuuacaguuuuaauuacaggggccuuugcgucucauugucccgggaguugcacagagacuuuacauacuucuuuaaggcuguuagacuagcaagguuauuuccaugccugaguucuuuuuuucucaacauguuuccuuuuucuuuauuuuuuuaaaacuuuuuauuuaaaacagguguuuucacuguguagcccagauggcuacaauuuaaacuucucaugucucagccucccaaguucuagaauuacaaggugugugugucaucacaucuggcuuucucccccuuuuuuuaauaugcauaauucaggaauuugucuuucaaaucuagguaauacaaaggcaauauaaauucuuuuauuuauaacuaggggucagauagauuaaguugacuuagauaucuuaaugaugcaaauuuuagauauauuugaaagccaccagaaaaaccuuaaaguguaauuuugaucuuacuuuccuaauaaguaaaaaagcaaaaaagguauucuugucugaaggaaaauaauuuuuaaauuuuauuuuuaagguaguauuugauucauguauuuuaugaaucagacagucuuagacucauuauucaaagggaauaauuauauauacaaauaauuuugagucuucucaacuuguuuauugaaaaaacuuuauucuugugauacuauuauauguauacauauuaauuguuuacuaauacuuucacucaaguugaagaaauaacauuucaacuccugagaauaugaaaucuauggagaguauuuucuuaauuugcugcaauuuuucugaauacgcagccuguguucuauggaacccauuuaccugggcuugcauuauaaagcaucacugccagaaauuaauucagcagguuugugguaaucugagaauucacauuucuaaauacauucucaggugaugcgggugcuguugugugugacuucccuuuuagaaauaacugugguaaccuagcccuggcuuucuaauacgagacagaguuaaaagggcguacacaacauauggucauauggcuaacaguguaguuagugaccuuucuguucugugcugagggagacauugguuuauuuuaggaguccucauuuucauuuuguugcugguaaucuaaaacacucacauugaaauauuugacuuuaaacauguaaacagcagccucuagcucaauuuuugaaauuaauuuaaaucauuucaguuccucccuauuucuguaagcacacuaagacuuugaaguaguauauuauuacuccuaaccauaauauagugaaaauauauauaaaaguauagguuuauaguuuuuuauauaacagugagguauucaucaugaauaugcuuagggaaauauaugucaauagagaauauauuaaaaaaaaaaagacuuucagaauacuaggauucuguucccaguacucauguggcaguuuccaaccuuguguaacaucuguuccaggggacucaggcucuucuucuggacuccaugggcacuauggacacaaugcacacauauugguguacagacauacauacagacaaaaugcucauauccauaaaauaaaaauuuaaaacaaaacaauacaaggauacagucacuuguggugauauauccuuuuaguuucagcuacucccagguugaagagggaggccucuuuggcccauguuuugagaccaguauauagagaucccauuuugagaggaaaauggaagauuauaaugaauuuaauagaaacucaaguauagacuuuaaauguuuuuauaaauaacuuacuguccaguaaaaguauugugguaauaaauacauaucauuuucaucuuuucagcuuucauaguaaccguccaaguaaaagauacuguauauuuaagaagcauucagaaaaucucagguaaacaaguaauuuuugcaaaaucuuucuguugaacaaugauugugauuuacuuuuuucuuauguguuaucuuuauugagcuagaauacccauacuguguuaguuacuuuuucuguuccuauaaguaacugacaugcaucuuaaggaaggauuucuuuuggcucaguucuaggguacucuguugugguugggaagucagguagcaggagauuggggugccugguuaaaauugcgucuguacucaggaagcagagcccgaugaauacugucacuuagcacccuuucggguuuuuuuguuuuuuuuauucuguccaagaccccagccuuccauuaauaaucaagauuaaccauuauauacaccauguucuucauguguuuaaaauguaaccuugauaaacuauauuauguucagcuguacaucaaucaucauaguauguguacauuucaguacuuaaaacaauauuccguuuauuagcaaucauucccauuuccuuucaucccccugcccauauccaagcaacuauaaguguguauuccuguugacuagcccauuuuggguguuaugugaauuacugaaaugauauucuauguguuccuuagucacugccuaugguucauccaugaugaauaauauaucaauacuuacuuaaauugaugaguaguauuuuuuauacaaauacuauaguuuauccauuucauugauuuuaauuuugaggucaaaauaaauaaugcugcuaugaacauuauuauuuuuuacaaauuucucuuuuguguguaagauuaaguuugcuggguugaauuuuaacuuccuuuugagaaacugauagacuguguuucaucauagugccacuguuacauacucacuaguacuguguaagaauuuuugcagcagggcgugguggcacacaccuuuaaucccagcacuugggaggcagagacaggcggauuucugaguuggaggccagccuggucuacaacgugaguuccaggacagccaggggaacacagagaaauccugucuugaaaaccaaaaaaaaaaaaaaccacagaauuuuugcaucucuucuagcaccugcuacuuauuuucuauuacaugcacucuauacuugaucuuugucaaaaagccaagaagugauauuauaggcauucuaacagauacaaaaugcuuugucauugugguuugcuguaacuuuuuuaguuaaacgaauggcuagugugucaguugguugcuugugacuagauguuacagaguuguguuacugucacuugauaucagagauaugucauaguacucaugguaacuucauuguauagugacaguuggggcccacaugaaguacaugaccauuguaaaaugagaacagaaagaaagcuuucccauaucuaaauaucacagucuucuaugaucuguaggaauggaaauaauguuauaagcuuuuuaauauuauguauuauuguguguguuugcauacaugugcccccaugcuacagcacauauguacauaucagaagacauuuuuuuuguuucguuuuggguuuuugguuuuuuugguuuuguuuuuguuuuuuugaggcaggguuucucuguauagcccuggcugaguuguaggugaaucagcugcauagcuugaaacugucagguaguuaggacuaaucuuguaagaacuugaauuaauacacugaacaugggauuuauuucauaccuaauucugauuuuuacaagcuuugucuuaaguagaauaauuaagcuaauucuagcuaaagggaugcuaauuauagcaucuacuuuuaauuauuguacaauuuagauaagauaaugaugucugaaaccagcuauacaaagacuuacugcuuuacuaugauauugugaagugcuuaacagcaacuguuuuaagaaagaagagaaucagacuaguuggagccucaaaaucaggugaaauggcauuaaaaaagaugagcugagaggauacuaauuugggaacuuuuaguuuguuuuauuaguauagccuguagaugaaaauacacaauauaguagaguuucaggggagauaguaugagauagccuacuuuuacauccaaaaauauuaguacuuuauuauguguauggguguuuuaccuucacacauuccauauauguaccauguuucaugccucaugcuugcagauaccggaagauggugucugcaccuuugaaacugguuuuauagaugguugugagccuccauaugaguguuagguauugaaucuggauccuccagaagagcaaccaguacucuugcuaagcuaucucuccugccccuagcuucauauuuuuuuacuuuaaauuuuuuguuuguuuguuuucuaaggcaggguuucucuguguagugauggcuguccuggaacuugcaaugaagaccacacugaccuugaauucagauccaccugccucugucucuugagugcuggaauuaaaggcuugugcccccauggcuggcuauuucccaucuucaaacaugcauauuuuguuguuaaacugacuguaacagugcuuacauugcaugauaauuuuuuuaaccauaagcaaaauaauuuauuaaagagauucuaaagaauucuacaguccccucaacgaauuucaucuagaauuaauaagagaaacaaagucauuugaaaccaacuuuggucuucuuuaguuugacguacuaagugucuugcuuucucugggccuaaauuuucuuuaccuuuucuucagcauaugaacuuucccuauuaaagucccaaauguaacauuugaaaccuccacauuuucaaaaucaagaaauuugaguauaauuuuaaaauucauaauuaucacauauuucauuuuaagaagugcaguaaucaagcuuuggaaaagaauaguuuaucuccugacagacaggcagggagacuaguuaaugaugcugccauguugaacuauucaggcauguauauuccaguaucuaacuagcuauuuuaugcaauucagcauuuagugaagauuggacuacuugugaugaguagcaucacauagccuguaucugauaguggcugucaugugauccaucuuuggagccuuuacauuguucuaguuuuuaucuuugacuaaaugaaagccuagauuguaaauuccauuggaaugugggcuauacuuccuuuuugcucaccaauauaacaccuagcaguuugguaucuaaagagagccuuccuuauucaguauauauuaagugaaugagugcuauaccucacuuuuuuauguggcuugccuacauuaaacaagcucauagcagagccaagaccaguguuugacuccuagcuuuuuucaguugauacaaggagugaaugcucuuaaaacauuauuacuuuuuggggaggaaguacagggaaugaacucaagacuuugaguauucuagguugugcucuacuucuaagcuuuuccuuuaucuuugaaacaugaauguuuuacauacauaauuuggacauagguaugccacuuucaaacuuauauagcaaagugguaaguuaugacacacaccaaaaaaaaaaaaacccauaaaaaauaguauugaaccuauguauaguuucguaaaaaaaaaaaauaaaaaccuuucauuuuauuucuauuuuuuuaauaggggcauuucucuagugugccuuaauugugauuuccuaacugacguuucuggcuuagauaauauggcuacacacuuaagucagcaugaaacucauucuugccgaguucuaguagagcaagguauguauacauagcugcuguuucagauacuuuauacuuauuauuauuuuuggaaagccaaaauguggguucuuuacuaagucauuuuauuucacuaaucauuguucauaugcuuauguaaauaugaaacuuuucuucugauuucaguuucuguuuguaucccaacuucugaacgucuuucugaguaaguguaauauuuauuaacugaguuuuucuuugguggauuuuagcacgauugcauucuuaaguaugccuuuaauagaaaugaaaaauacuggucuuguuuuuaauuuuaagcugcuuguugaaauagguuccugcucuguggagcucaugacuuggugcaagagaaguuggaauuuccuaaauucaaaguucugaaauauuacuuacacauaggcaguuacacaaguccaugauaccagugcugguuucagcuugcgcaugugucuagacuccuguucugccucaccuuugugucagauucacaugucuuaacaugucuuuuuccccgccuccauuugucucucuaaaaauaacuuacuacuguguucuuuucuuugcuuaaaauaauuuguguuuucacugcucuauuugcugccuaaguaauauauuccaaguacuauagcuguuuaccuuuuuguuuguuuugucuucucucuucauaccuuaugccuuguguuuuuaggccagaugguugucuuuuuccucauucguugucugucauugugcuauuuuucuuauuuuucagaugcagaagcagcccagagauuucaaaacauguccaggguguaccuggacaguguccccuucgauggacacaagugcugccuguucucucuuucccaggaaugagaaugaacugacugugggaccugcucuagguucuggcuucccaucagacugaggcugaucuggccagaaacagccucaaggcccaccaaauaagcauagcucccauugguggcuuuggcucuuauuucuuaagcuuaugggcaauugugaacaagaaaagcccaucaaaucaaugcuuugauacccaaauuaugauuuagucauuuuggcugcugcucuuaaauguucuucaagcacaaaggcagucuagaacaucuagacacccugguuacggggagauaauggcugucugguccucagaaaacaguucucauugacauguucuaaaauugcaguuauuuuuacugucauucaauauacauugucccauauuaaguauaauuuuaauaaaauucucagauucuuuuauuuuuuuuuaauuuaaaucugauagcuucaucucuauucucugaauuauuaaugucugguuuucucuucuaaaaguuuaauggcaggaaucucuugaguucauguaguuuaccuguuuuuagcucuuaaguuuagguauuguuuagaccauuaugcccucuucuucugucucucuuugaggacuacuaauccaaguaauugugaauuuuaagguauaacaaacuugugagacuucuuggaaauuauaaaaacaaguuuuaaaauagcauuuaauauuaaugagccauuaauaucauuucuuuggguaaaaauaauauuaaauauacaaugucaccaauaauccaguuuuuucccacuuacauauuaaacuugucucucuuuuuugcuagcuacauugaucaauuauuuugaucuauuacuuucauagaucuuuauuuguuucagaaacuauuuucuaaugaauaguguuuuuauaaaauuauauuuuauccuacauguaggagcauugcuuuacugcuaugugcgucuggugauuggcaugucuccugagaauauacccauuuaguagguuuguguucucuucagcccaacuacaaaaaagccucuguucuugcaggacugauucuuagauuuuggagaugaacaaagugcuuuucauaaucuuagcggucagaucagcagacucugaaguuauaguuuaauccuauguuucuugcaucuuaaaaauauuuacccaucccauuaucagaacuucauuucugcuuuuggaccauauucagaugaccacuucuuauuuuauuguguuccuugcaauuaacaagaaaaaagagguugaauccauuuguuuuacgcuucugaacaauuuuguacuauaucugaaagcauuucuaaaaaccuuaauaacagcuucuuguuuuuuagcggacuugauacacuggucuuuauaauuuuuuauacuuuauaauuaaaaaaauaacuagaaaaaagguuucuuuccauuuuuaacauuaauucuugauucauuuugagaugagaggauguguucuuccuugguccuggcugaguaugugcacacugccaccacuuucacagaacuggguuuauaauguguaccaacuucauuucucuuucugcuugugguuuucuuucuuccuuuuauuccuuuuuauaaaauuuuaaaaugcaacagucuuguuuuguaagucuaaccugucuuuaccauuaaguuuaaaaacuaguuuauguacuggucacauaaagccaucaugucugugugcuuuugaguuacaguugaauaaaagguguaguuuguauacuuucaauccauugcccuuuugaaauuuuuauagcuuugcauucuuaaccauuuuuuggaauagcaucauaucucuuggacuucauuuguccauucauaaaauauuuauuaaauauguacuucaugccuggcucuguucauagccuagaaguucuguccuuguggaauuuacacuugagugguaaaacagacaauuaaauguauaauaaacagcaugcuagaguguggucaauauuagagaaaaaaaaugaaguauagaacaaggauuaaaggaaauauaaagugggauuuagaagggugcgggugccauuuuaguuuuggugauuagaaaagauccuacugagggcaaugacauuggaguaaagauccagauuuggagaggaaguacaaggucuggauacuaacuugcuuaugccuaagugucuuuuucuucuucuucuucuucuucuucuucuucuucuucuucuucuucuucuucuucuucuucuucuucuucuucuucuucuucuucuucuucuccuucuucuucuucuucuucuucuucuuaagaggaguugaauucagaaucuggcauaucacucuucccaaaaauaccaacagaaauucuugaugaacacugagaaacuaaaugcccauuuuacuuggaccaguuuaauacuauauguauucuuauaaaggguauccucuuguauacaaauaaacgcugacuggcuccauaucugugcuguuuaguucauuuccaaaauuuauauauggucuggaggaaaauuuuucaaaucaaggaaauauaaguuaaauguaguuuuaguccuagcacuuagguaaaaaaggcaaguagaucucccugaguccaggccaacuauguaaugauuucaaggccaucuagggcuacauagugaaaccuugucuaugaaagaaaaagauaggggggagauucauucaugugauuuucuuuuuuuuaaauucuguaugugaauaucuuagagaauuuugaccuaucuuucaauauuuauuuggcauuaaucucuaauuguuuauuauuuauuuauuauuaaaaucuaauaaaucauguaaucuccuaauacauaaauuuaucauuuuucuucauuggauauuaaaaaauaaaucauauuaguacuugguuuaagauuccuagaaaaugcugaauugcauauaagguguaguauauaauuaaaugcuagcaagugaauauauguugucccacuuauuagaaaaaauuauauccuuguuauauuuauaaaaucaaaguugugcauaacagaggcaaaccaauuauuaauuauuucugccucuuuagguacaaaggaugcuuuuaugcaagggcauggcuaccuuaguauccuuuugagacuuauuucuagacuuuacaccauauguuuuaaauuuucuuuaauuuuuuuacuuuauaaaguucuacuucuucccuguguggcuuccagacuugauuccuagcuccacauuaaucuuucucagacccuuaaacugcuucuaugaaguaguagaguguagauauuguaguggauuguagaguuuggaguuccaccuuuuuuuuuucucuuauaugugaaugguucugguuagguuaccugaccucucuacuccgaauccucauccucacaauguaaaucacagaagaaccuguuuauagagcuugagggaauuaaaggaauugcuuauggucucugaaaguacauaacacacaggagauaguaugaaagugaccauaugguuguuacuguuguuaagucaacauccaugguuuuauguuggucuacauuuuacugaaaaugaaucuuccugauuuuuaacccauuuuucauucuagccuacccauauuauuucaaaaaucauugcugacaauucucuuuuuuaaaccuguauacuaaguuaguguuguagaacguuugucauaccguuagauuuugguauauuuaagugcacuacauuauauuuugaggaaauauuuaugaaugcucuauguucauuuuagauauuuaaauuuuaucgcaauuuuccacuaaauuauacugccuuauccuugacuacuuuaugacccaucucauacuuugaaugcacuugugauuuugugauccuccugcagcaguacucuuaccagcuugguauuugacuagcuagacaggcuuacugcuccuuucuguaucuuugaaauaugagauccuagugaucuuaaucuuccacacuaaaaaucuguuuuaucugcaucauugugauggauggugcuaugaaaggauuuuaugccugaaauaaaguagacagacacaggcauagauccuaauuaaauagucuguagcuucaguaaaauuuagcccuuguuaagccucagguuucuuaucacuaaaagaaacauaguaauucuuuauagggcagcuauaaacaaguagaaaccauguauggaaggaaaucagugggucauguuacuaacucaaauaauucaccuuaacauuuaaauuauuuggcacuggagaaacuaggcacuuaguaaauguacauuguugccacugcuaccucagcugcugcuguuucugcuucugcuccugcugcugccccagcuguuacuacuucuguugcuguuauuucuugaugacaggagacccugcugacuggauaucuguggaaucucauggcugagaguuuuagugacaguccaucuguacuguaguuauuuauaguuuugacuuacaguucaguuuugcaguauauucuucucaacuacuggguaauugacaucacagugcuguaauuaaauauugugcaguuuucuaucaccagaauugcguaugauucuguuugcuuugucuaaagacuauggaacaauucugacuuauuguaaacuaguacagaacccucucugcuuagaaggacaucaguccuuuugagcugacauuuucuucuguaaagacaaccuuuuuauuaauugacaucaaguaggcauuuccagaauuccauagcugcuuauccaacccaauuuaaugaauacaugguacuggugagcaguauuuuuauucuucuaucgaaugcagaagucaucuugaaaaguagcacauguguuucuaguuuuaggucauaauugaacucagccaugaaauuguuguuguucccccuuuucucugucuccucuccauguguucucuagggugcuuauauagacucaacuguauaaaacaaaacugaagucaacucuuguuuuauuuucugagaugcuuguccaugcugaaaaauugagaauagaaagaucauucucacccaguguggugguaugugccuuuacucccagcacucaggagacaggcagacagaucucugugaguuugaggccagcuugguccacuuagugaguucuagcaauccaggacuacauagugagauuuguuucaaaaaaggaauaaggaagaaaggaagucucuuagccuucuucauggcagaagaauccaugguaaauacauuaucuauagcucaagcuuguaaagagagucuaguucauugaauaaaauauacuauaaaauaccuuuugagauggcuuucaguaauuacuuaguucugagugugauuacuaagucugugcuaagcagagaccccacuaucacacugcugugguaaauuagguugaaaguuguguuuguuuuguagaguuaaaugauguaaaaugcauuuauagauacaaauauguuuacuauucuuuauuaaccccuugaauuuaaagacuacuagagagaaauaaaaaucaaaaacugaauuuucuugaauuccuccaucuaauuucacaauccccgaguacugacuuuuaugcuuagcaucagugguacucaguagcuguuucauggucuggugcaggcaauuuccuauauacucacgacacugaugcuaguuacccaccuucuguacacaaggcugccaggaauuggaauuguaaacauuacugaaggguauggucugugucccuaagguaguauagaaaaaggggccagagcaguaaaauagguagucuacacugaaaccauguuccucacagggauacauaaucagcugauuucuaugauuuuuguauaauacuacaucaaaaguaauccaaaaagccuuacauuugaaaauauuuuuuaaaaaggcacucuuacuaaaucugugggugugugguauguaaggagcuaguucauuauuucuuauuaauuucugaccucauuuggagggcaguucugaaccuggucauaauccaugucuaaaugucauauucauuucauaucccgaaguuagugagagguaagaagaaaacuaggcucaucugugacacauucauuuugggcucuauccuucugugaacuucuauauggugacugauaugagguacugggagaucuuucuagaucucagucauuaagaucacaaaccaaaucucaagcaguguuuccuuaucaaaguagaugcauuacauauaugggcuuugugggaaauuucaugucauagguaugaaaugugcaugaagcuaaaaugguuucugccagcuuagacuucuuccaugacuuccuauaauaagcagggaagagugagagaccaagugggaugaaaagauaaauuaacuucuuguaguucauccauuuaaggccaccuaccagucucuuccauugauuuugauugaucuucccuaagacuagccuuuuuuucucuaguaugaaaugaucuauucauucucaacaugagggcuugauucgaucaucuaaagcuagaugauccauugauaaggacauucuuucacccuucugguacguacaggacuucauuauaggugauaaaucaagagugggauuccacagacgggguguguguguguguguguguguguagcuauugguggucuaguuuuuguuacauuuuugcacacauuguguuuuauuuguuccuuaucugucaccuuuaaaaaaaaucuagaaugauuauuucuacuccuugacauguauuuauuucugugcuugaggucagaccuagaguuuggaauauguuagcuucuucucagcuguuuuccuagccaaguacuagagccauaucccuaccacugaccauguucccagucuacuggacagcugaggugaugucuagcuguagaugaucgaaucaagcccucauguugagaaugaauagaucauuucauacuagagaaaauaagacuagucuuagggaagaucaaucaaaauuaaugccuaauauguuuuaauuaugguggaagcaugguagaagugaagaucaucaggugcucaaaguagccaauuuuguacagucucaaguucugagccagacaauugauuucagacuuuuuccaugguaauaauaauagguaacacuuauugaucauguuaaguaugccagauacuuuuaaaaaaauaguuugcauuuauucuuucucaggaauuguucuguguucuuauuauccugagauuauggaaaagaaggauauaguaagccaaauaguuugccauaggucauguaacuguuaaauagauaaucucaauuuuaguuuugacuaucugccuucagaaguaaaacuacuaaguuuuguuguuucuuuggucguaucuaugauuccaggacuggguaagacuuaguuucucuuucaacagaagcgcaagugauaagugacacaauagcacugggacaguaaucuaaucccccacccccauguguagggcaucauucugauacauggcaacaaaacaaaaauaucuagaaugauauuucugcuccucaacguguauuuauuucuguguaaaacauggcaaagagucacauggaauuagucuuuuaccaagauuaacacacucauguuuuaggaucaaaaccacuuugaggcagggaaauuuuccuuuuuccugacaugguaguaagagagccuaauuaacaggaaaagggacuguuaagaaacaguagaguagaagugcgcugugcaggccauaugcuuaaugugcucugugcuuuagcuuuauugcuuuaauauuuuaggccucagauuucucaucuguaagauaacggcaguuguauacugaaaucuucggauuccaauguauuuaucagcugauugaaagaccaagaaaaaugggagcaucuuguucuggguauugauucugaaguuaccuggauagaaacaaugcacggagugguggugccuacauguggcuguucugcaggcaucucuuccaugugcucaaaacugaguuuaucaucuguagaaaucguucauacccuaugaguuucuucuuuuaguuaaugccucugacauuguuuugacuugucaaggcagauuuuuaugguggauuguguuucuuucuucucauaaugcuuugucugguagacuuacauucucuuguuuccaauuuacuuguguucuaaacuuuuagguuuaguauggccauuuaaccgucauggucuuccccuggaguaaccucugccaucucuucaauuuugucuuuucacuacuguuuuauuuauguucucuuugugagaugagucuguacuguuacaguaaugucacugcuaucuuguuucaugauauuuuuauuuaauuuuuuucuauuggguuagccuuucuuugcuaacuccuauuccucccaaagagccaagguucauuguacacucugcugucccuuucuugucuccugagcauaguguuucaugccuuuaagaagccauuauaccauauagauauuucuuuucuaaauauuuauuucaguagguuuccuugacaaugaccuccucaagaggagagacugucugauucuugagacuagaauacuuaacacacagguuugugcacaguaugguaaaugucuagcuaaggcaucuagcccaugcaucaaucuguucacacacuacagaggaaaauggucagaaagauauucuuguguuucacuguucuuucauagucugaugcugucuuuuuuaguccuaccugaagugguucacguuacuacuuuagcguaucucccuuuugcuucuaacuugcuugaaaucugaguucaguccccuugugcaugggcagaagcaccuugcucacugaggaucgccacagcccucuuuuaacaaaaauccuuccauugaaguugacauuuguaaagcuagaaugugggacauuuaaaaugaacccuucccuugccucauaucauguauguguaauaguaugaaauaacucucagcauacaacuauaauugaaucacaguguucaccucaugugaagccauguguuaagcagaugaucugcgaaaaaugauccaugcauuuuauuuaaacuauagagaaaaggguuuuacuuauagaaauuauuuuugaguuauuuauuuuauguauaugaguacacuagcugucuucagagggcaucagaucccauuauagauagcugcaagccacuaugugauugcugggaauugaacucagaaccucuggaagaacagccaguguuacuaacugcugagccaucucuccagcccuaacauguugaauuuaucagagaucuauuucagcagguuuccauagggaaauaguaauaaaaauuacuuauuuucaaaucauguugaaauuaacacuaauguucuuuguagugaaaucuucaugcuuguuuagaauaguauacuacauucuauaaaaagcauaguacauacucaagaguugucauauaauuggcuaguagcaggucauauuagucagaacuuugagcuuaggaaagugacuacaucucaaauuauaacuauuucagcaaguaucuuuaauauauuuaauuuagguaacaauucuuuuucuuuuccauaaauaugagugaaauguuaguguguguauucaaguuuaugaaucuuaaaaaaaguuuaugacucuuaauguauguuuuguuguuauaaaaucguaguauacuuuuuauugauaaguuuauaauuguggaauuuacaguauauuucuaauuuauuuuagaguuguuuuucugaauccuaaugauuauuacauuuuugccuuuaaagagauuacuaguauguuaaaugcacaaagcaggaggauugagauaauaagcucuuagaccuaguuguuuuaauaacuucuuaguuucuuagcugguaaaaugaagaauagugaaagucuuuaccagccuuguguugcagagguugagaggacucacuuugaccaagugaaaugcuauagacaugucaaggugauuaacaguggugcuugcuaggacuuccuauauuagaguagaauggaaaaaucuuaauguuuuuuaaauucuuacuuguugcaacagcuuguugugguuuuucagacuaaauuuaagauauuuaaaugcuuagaaaugaaagucuuacaauagauuaauuucaaaacuuaauaaaaaguauaaguuuacuuuuucaggcaacuauuuucuuuacauauaaucuuaaaguuuucaaauuuuuccuauguacuucauuaaaggaaugaaguuguacuguauaauuuacauauguauaccauuauguaauuuaaaaaauuuaauccccaaaacaaauagaaauuaagguguuuuaauuuucuuugugcaaauuuuaguuuuucaauuuuaaacuaauuguaaauuauuaaauuaugcugggcgguaguggcgcacgccuuuaaucccagcacucgggaggcagaggcaggcagauuucugaguuccaggacagccagggcuacacagagaaacccuguuucgaaaaaaaaaauuauuaaauuauacuucuagcauggugguucagcaaaaauuauucauuuuguuacacuuuuagcuaauagguacaacauagauacuuucuauauuucuuugcuaauaucuaaaaaagcauuaacaauuauaacuuuuuucuccuuuuuggugguagcacuauggauuaauauuaagugcagaauuuucuguaugugaaacagauucuuuagcacuuagcuauaaccauaugcacauacccugauuuuuaaauuguauucuuucaagggaggguguagcuaauacuccauguuucacugacuagcccugggaaaggcaggccauuaggauaguuuauugucuacuagauaccuucaucugugugcaugaaaucuguuguaauagcuuuauguuaaauguuacucuuuauauauaacuauuuagucuuuauaaaauuauaaaucacuuuaacuuuucuuaauguauuucaagucagguuaccucuauaugcaucuuaaaaucaaauuuaauuauuuaguccucaagaguuucuaaaaacaaagguccuuuuaaaauuuagaauuuugcuuuuauauuauauugguuuuuaaaagcaaaauaugaagaugccaugugucaguuaaaauuacaaaauuuuuuagcagucaagaauuuuuaaaauauguuuugaaugguggauuuuaugagaauuuacccucaaaauucuuuuuuuucccuuugguuuuggggguuuuuuuuuuguuuuuucugucuucagaauaauuuauuguauguauauugcaauagguuugucacauuugaguuuugcacuuugaguagaucaaaguuaucucuuacuuuuuaugcccuaaaaucaguaaaaucuaguguaaauuguacauauaggucuuuugguugcuuuuuauucuuaaaguguuucuuggaaguuguuuuacuaauauguuuuuucuuuaauuuuguaacuaacuuagcaaaaagaaacaguuuuuuaaauucuauuuuucuuagacaggaaggaaauccauguccuuuuucuugaucuggagauuauagcagagggccucacucacguuuggcaagcacacauucauugagccaggguccuguccugaaguacagucagucauucauuuagcacagacauucugccuguuguuuguuuucaguacuuuauguuuacauuauuaagucuuuacagcaucagucaguucuacuagagacuguacauugcuuuagauuuacauuuuaauuaagcaugccaaaaaaaaccuauuucauauuuucuaacuguaaguauaauauaaaauaaucaauacuuauuuuguuuuuaagaauaaaaacugaagcucccacuaagggacaagaaccugugucuaagguaaaguuuguuuuauuucauaacuucauaaauuuuuuucauuugaaagaauuguugccacaauuuugcaaaaauuucaguugcaaaugaaugucaguaacaauuauuguuguauauaguaugaaaauaauugagacuacaaaugucucauuuuaaaguaaaauugucagguguuuuuguuuugacaaagagaucauauauuuugauuugucuguugcuuaguuaaacuauugagugaugguaaauuugugaguuaaauuccaaccucaguaaaacgucaggcauuuaacacaguaaaacuuaguacuuccacuuggccuaauauuuuaggacauuuaaaucggcaaagaauauaacaaaguuuuagaauaaaaggggugugugugugugugugugugugugugauuuucaguaugacuuucaguaugucaguguagaaucaccauguaaacaccacucgcuagacggucuaguaggucuuccugaucaucuaaaaguaguugugagcuucccuuugcuuuuuuaaggugguuuguuuuuaauccuuuaauuuuuuggccacuuaguagaaugaagagagucagauugagcguuuguuuuguuuuguuuugagacaggguuucucuguguagcccuggcuauccuggaacucacuuuguagaccaggcuggccucgaacuuagaaauccgccugccucugccucccgaguacuagaauuaaaggcgugcaccaccccgccuggcagauugagcauuuuuuaaacaccuuuuuuuuuuuuuuuuuuuuuuuuuuuuuuaaaaccauagaaauugaucuuugggggccggugagauagcuuagcaguuaagagcacugacugccuuuccagagguccugaguucaaaucccagcaaccacaugguagcucacaaccaucuguacagcuacaguguacucguauacauaaaauaaauaaauaaaucuuuaaaagaaagaaagaaagaaaguggucuuugguuuaaaagguuuuuagcuacaaauaauugucuuuuggauguugcauuuucagauugguuucuucgugaaugaguuucauugguugugguuuuuuaggaaucuguccauguuuaccuaggaugcugaauuauguugaauauaguguugcuugugcugugucugauuguccuuuuaaauacuugugggauguacagugaugucucuucuuuugcucuugauagugacaauguauccccacacauacacuguucuuguuuuacauuguuauacucuauaauaaagacagagaauguaauuuugugcuuuaugugguuaaucuuuuagaguuauugaaaacguaaaaguugauuauauguuuuuauuuuacaauuuuuaaugauuuuuauuucuuauuaaaacguuuugcuuuucucuuugauuuaaagaccuuucauuauaucucauguuauacagcuuuuuguuauuguuuuuauuuuaaaauguuuucuuuuuggaagauacuucuguuggauauagauuucugguuggagaguuaucauuuucuucaguuguuucgaguucuugacaagaugucugaucaucauuucucuauuuauacuaggacauuuuucuuggguuuucccucaagauuuuauugucauuugugaccuguuaggacuugaugugccuaagucagaugcuuuugcucauuuauaugcuaaucuaguggugucuuuuuuauauuuaugguaauugauaauuucaacugucuguuaucugcuaguuuucaguuuacaucuauuaaagcaacuugauguuagccuuuguaagccuugugcugguuuccaguacccaacucauucauucuucuaauuuucauuuucuuuguuuuuuaguuuggauauucucuguguccugaccacccaaauugugcaacuggguuuucaguugugccaguauacugacaagcccauccaugagugcacguuuagcuuuaaagcuuaguguuugaucuuuuuucugauuaucacuuaguauucacuuccgaaauuuacauauugcccaugcaugcugcucuuucuccccccucccccccccccaguuaaagcauuuaaccaaucaauguaauuuaaacuuuuugggcuggagagaugucucagcucuucuuaagagcugcucuuggaaagaacugagguucaauucccagaagccacauauugucuuaaaacccucuguaacuccaguuuaaggaaaucugauguccucuuccagccuucauggguauuaggcaugcacaugguacacagacauacaaucagacaaaacacccauacacuuaaguauuuaaaaaguuuuaaggggguggguggguagauagauggcauacagacacuuacuuguucuuguagaggaccuggguuuggguuccagcacccaccuggcaggucacaaccaccuguaacucuaauuccaggguaugcaacccccuuuucugaccucugaauaccacacauacaugugguauacauacauauauacaaacaaaacauuaaugcauauaaauaaucaaucuugaauuaacguauuuuucugucugaaguacuuggaauauagcucagcugguaguguuugucaggcaugcaugagguuuagaguucaauccccaucagccacauaaagagccaguugucauagcacacacuucaaaucucaucuggagguaggcagagacagguggaucucuggaacuugauuugagccucaucaguaaacuccaggucccaaagaaagagccuguuucaaaaaauaagguagagaacauuugaggacaauauucuaugcugacucuagccuccacacacaugcucauauauuuauaccuucauccaugaacaugcacaggcacaaaaguaaaauuugucccucugauaauuccucuaucuggauugugcuuggucuaguucuuugucaucuaacaguaugccuccugccccccuugcuuuucaguuaaauauuugguuggaagacauuauguguaauacauaccuucuuuuguuuuagggcauucacaaggggcuugggacugucuaaucaggcacugaauucaaguugaguuuucucauucuaaugggcaucccgcgagaaacagggucuuucuaugggacuucggguuuacugaugaggcucaaguccaauaccaauagcaucuccccuuuauucuuuccuguuagcauuuauauuuagcuggaauaaaucaucaaacauuuauuuaauuacccugcuuuugguguaagggaagccacuuuuucaauauacaaaucagauuucuuaaguauauauaaauauauguauauugaaccuuuuguugcauuuuauuuuacucguguguauuugugucuguguguaccuguguguucagguacgcaaagaggccaggaggcagcaucagauacccuggaacuaguuauaagcauuuaagaaccaucuacugugggugcuggaucagaacucuaguccucuguaagaucagcaagcacucauaacugccaagcaaucgcucccguuccucuugccccauacuuuucauuuauuguauauuuugacacugugacaacuguuaugguaauuaaaauuuuacuuauuuagaccaccuccucugucaucuguuccucuauacccaucauuccacagggauagaauuagagcaagccaaaugaggccuucacaucugggccacaagugaagagaugaagucucuuaaauuaaguacuccuuuaauucacuauuuuaaagcaucacacuaagugcagaauaauucacaaugagcauaaucugaaauuuuuaaagauggaaucuuguuuuguuuuuauauuuccugccucuguagggcagauaaugaaagagacccacuugcauuugacauuuuccucugaugcuccuuguugagucaugagagaagcuggcagguuguucucauugaucauagcuucaaucuguaguugugcuaugcaaacagaaacauucauuuaauuuacaaaucuuuguugaauuuuaauacaguuaguaaguguagguaguaguuauauaguauaaaugcaauuuuauuuauuaauauaauugacaugucacaaaugucacaaaugaaacuuuaaaaaauguuaaauaauuuuugaaaaguuacuuucuuaguaggaaaauugaccguuucucuguuuacagcagugauuacagccauaugugagaugguucaaaacaggcaguguccccaucccuccagccuggcuuucccauacaaagacagggucuuuuacuccaucugggguuuucucuacuauaaauucauugaauacauuucuggguguuguuuauuucuugguuacuucuaaccuauggauucuuggcuuuggucuuuuucaucaugucccagagcuaccuagauuuuugauaaaacuugguuauugcuuuucguuuguuuucucuuuuaaugauaucugaaugcaauauguccuuagcauuguucucuaucccuacugcucuguucucugcuucaucuaguuuguuugugauaaguugcauugugcuuauuauuuuauuauauuuuucauuucuacaguugccuugcuuuuuaaccuuucuuguguuucugaguuguggcuuauguguccauugggaugaauaucuuucccaguuuacuuagaaguaggcagccuucucucugaggccucagucuauaguacuacuccaagaauuaauaggcaacaaaacaaggcauggaaauagaauucaaaucaauuaaagccagugacuaauagaaaauaaaauggcacaggccagcaagguggcuaucagguaaaggcaugugccaccaagcccauagacagacuccuacaaauugucuucuuaucucagcacaugcacaugauaaacacgugugcauguacauacaaacaaauaaaauagugagugguguugaguaggacauaaaguuagaaauuacagucaguuaguaagaauaaacaugaaauaaaaggacaggcagguaaagagaaguguuaagcuuguguaaaaggggggaaaugaagaauacaaagaaaaagcaaaaaaagagcaugaagucagagaauacaauuuuuuuuuaaagaugaagaauuuuuuuuuuugaguccucuaauacuggaggagacugguaacugaugguuugaacaagaaaucuauucucuuuuccacucuucuguccuaggcucagugucuccuaguguugaauuuucuuuguguacuaggaaccacugcuggccacaucuuaguucuauggacugaaggcuagacacguucuuacuugcucccaauaccucucagucugugugcccuuugggugaugagcauccaaguugaggaauuuucuuaagagcaucaaagaguaggggaaacaaacuaacacauuccaaagagaucugagggaaccaagcaguuucagagccugcuuagcaguggaucaccccagggaaugggaaggaggcagcuuaaguuucucauucuugcuagcaucagaccuuacauagcaagaagcaccuccagagucugagcaaucugccaauugcaggccaucaucuccccagugauccccaguccccacauuguuauauacgggaggucacugaccauugacccuuccuugcugccuaaacuacuuagcauauucguacaucuugcauucucuucucugugucagugucuccaggcucccugacuuacgauucucccuuggcuuuucauuuccagaguauuucagucccaaacagguuccuucucaggcgauauauugugguguaguauggggguguuguaaaauggauuucuucuccagugcugcuccugccauacaggaaaaguuaaauuuuccuacuaaaauuucuuaccagauuuaagauuugugaagauuguaggcuuauccugugcuagaacuaucuugucuucagcaguuugccuaccuggcugucuuuguggauuuagcuucuacuuccuucucugggagggaugugcuagaacugaggucugcuugcucuuguugcuuauguaguuuuuugugucuccagcacuacagcuagccaucuuucuuacuuaauucuuaauguuuugccucuuccucccuucagaguaaaaucuacuggucacuuacagagucacauguagauugcuucuaagaaccugccuuuuuuuuuuuuuuuuuuuaaauucccacccccucccccagaaccugccuuuuguuuuguuuuugagacaagguuucucuguguagcucuggcuguccugaaacucucuugguauaccaggaugaccuugaauucacagagaugaaccugccucugccucucaaguauugggauuaaaggucuguaucacacauggcuagcuaaaacucugccauuuuuaauccagacguccuguauuauauuuugaguagaucugugguaaaucaugugcugaugauggaaaguguucuuuguuuuuugucuuuguauuuuugguuuucacugauuguuuuuuacauucugaaugguuucuauagaauguugaugugcuauauuauaugucagucuuacucauuaauacuggccuuaauuuuaucugugaugcauaggaguuucccagaaauaaaaguucuugcuugauuuuuguuguuaacuguugcaugauaugucaagcucacuuuaugaaauaucuacugaauaucaaaauaaguauaguuugguuuucauuuaaaaugaaagugacauuuuaugggggcuuggggggguugaguucaguucacaauacagugauagacucuggugcuuuaaauauaugcacagaauauugacaggacaugaauucagagacugaaaccuaagguuguaggguauagcucagaagagcuccacuguacagugcacauaguccugggcugauccucagcacuuuaauaauaauaauauuucuacuuguguuuaguaauggagaauacaguggcugcugguacauuuuggguguuuuugucuugauuugucuuauggugccagcauuuuuauuccugcuagcuagucuuauauuaagaauugugacuuuacuuaauuccugaaaacuaacaugaauuucccuggaugucugugaaucauauuuugagaccuauugaugucaauuuuaaugugaauuuaccuccugaauuugugugcauacaaccuucauacuuugcguggauauuguuuagacuuugccgcagugaaaucugguugugcuaaugcugaggugagggauuuuaugaagagauuuccccuacacacagucuuuaaagggagcggguguuuugcggcugauuagugucuccaaucaaaauccagguccucaugcuguucuuuguuguucugauucucacguaggcuugaugagauaguucagagagcugacuguucguucaccucugugguaagggaggaagcucuaccuuuugugaguuggagaaagagcaguuagauucccagaaguuccugugcaucaguuuuuccuuuuacaugcucagcauuagaccagguuucucuaaaagccucgcucaccucugagccccucuguccagagcaacucacucucucauggcccuccugccagcaucugcugagcccucagcauuucagccacuugccagguucugaaacauugcugacuugucuuuacuaauaaguaugguugguauuuucuuguuuuuuuauugaguaaaauugccuaauucucagguacaauuuuuaguggaauuggguguaaauaaggacaugugugugacucgugucacaggcuugaagcagucugcuggggcaagaccucugccauaggcuauguccuuggacuucgugcucccucuacuucucaguuguacagacaucacuugugauaucucacguguuggcuaaaugaaacucaauguaauucuuaguacacucuacacagugucugugcuuggaggcuguugcuugucagggccugagaaccgcucccacuagacgaagguauucaguauuccuuccucaugcucaacauuugaaauaagcagaauguuucuucaguauaucugucuuuucauacuuguggcuuaacaguggaagaauuaacauaauucuuaaauaugaaauaaaaacuucguguuuuuucuaaguaucugcaauauguguaagauucuggagggugguaucuuauucauauucaaguuucaaguaguuuucugcuugaauaacuucuacauuugaaaaccuuaguaaggaaaauaggcaacucuguggucuuuaguguucuggaacucaguauguagaccaggcuggccuugcacucacagagaucugccugccucugccucccaagugcuccgauuaaagaugugagcuacuacauucagcuaggaaaugguucuuaauaaagauggguacugcuuuuuuacuuuaauucaaaacuuuaugguauacugaaaacauuauguauuugaaaaaaugccuauucuauuaaacacuuaagauugaaaaauucauucucuguuccuuugguguauuagccugcacaguuaaauugcucuuauccagaacauuuagugguggugguggugguggugguggugguggugguggugguggugguggugguggaggaagaggaagaggaggaagaggaggaggaggagcaguuguuguuuagccaugauuguaaaaauguuauuguuucaggaaacagcaagacauaguagagcugaaggagagccaggagcaucacauucuggaaggugaggcuaaaggaaaacugagucuugaucaaguuuauugaaacaaauuaguacuugaacuaaauuauauuuuacugacagcuggcaaagaguuaugugagcucauuacuuuuguaaugacuuuuaaugaaaguucaaacuuuuauaaauuuaaguuucuuaaaguauuguacauaaaauaguagcauuuugaauacuauacuaaauauuuuaaaauauuuccucuauuagaugaaaaaaguuauaagauacuacagauuaugagauucaacaguuaaauuauguaauuucucauuucuaucuuuauauuuuauaguaggcuauuuacuaaucuguugagaauaacauccuaccccacaaaaaaaguaaaauauugaggccuuaucaagguguuuuuuguuuucacuaguaaaauaacuggccuccuuacaucuuuauccuagaguucuuagcaaagaaagaaguuaaacaaaauuaauuuuacaaauuugaaaggaagaaaaauguggguuuuaucuuugacuaguaaacauaagaaaaugagcucagaacaaauaauugaugaguuauaauuaagaugguuggauguaauagucaggaucuuucugagagacuaauaacaugauugccugguacauggacaaaaaugucuuuuacaguagcaacauaaaugagacauggauggaaacaagcaaauguuaacuaaacuagcuuucaugaaagaccauuuuucauauacuuuuuccauguaaucaaugauuuaguuuaguugaaaaucucaaugggguguaguugaaaacuaacaguauuuccccaaggguggucuaaaugcagaucaauacagcaaaguaaauugcagagaaaaugcuuuguauguuuaguguucucauaguagauagcacccgauauccucacugggguagccacucaacacguugaaaaaaaaguguucaaauuaggaauauaugguaauuuguuuuuguuaaaguaaucauccuuaggucuacauaaguggcucuacuauuuuaugauucauuuaauuauuucaguuuacauaccagggucagagaaauauguguacauacaccuaaauauguauguacauaaacauguacucacacauauauacauuccuugcauauguuuucaaguauaugagguuauccaaaaucaggaaaauguuugcaaaugcugauuugauuuuauauaggaaagauaaucuaagcauagaguauauaaaacauaaaagaaauuagacuuuuccauagauugauuauguuagguacuuuuacugaauauuaaggacacuuaauuugauccagacacugucagagcuugaucagacaauagcagucacuccuaggacaaagacagcuggaagacacucaguuuucagguuccuuuuuauuuguggcuccagcauuucuuacgaguuuugccuuagccuucucccaacuucuaagagaauagcuagggcuuagggaccuaucuguuuggguaguaaagucucuuuaacauguuuuacaucugaguaugccuuuauugggguuacaugguuuuaugaacggcuaauaagcagcuuuauuuuucaguaagcaggauaaaguuccuucaucagaagaaggcacugggugugaugcaaguguaugugaagcugcagcagcaacacacugugaaaaagauguaacgguuucagauacagaaaauguaagcagcucaaagaacaucuugagucaugauccagauguuggaacagauacuauggaaaaggaagaaaaaacacaucaugcuugucaggaaauggagcugaagguggaccagaguucagaaagcacaaaucccacugaagcugaacugucuucagagacucgucaagguuugcaguuaacaucaggggauguuggcauugaucaauuucugaggcaaggagaugaaccuaaaucugugaauucugaugcuagugacccaggcaguguucguuuggaaccuuugacgccaucagaaguacuugaguaugaagccacagagauccuccacgacggugaugauccuucagcuaacaccagugacacgguaucugaucaaacagguggcaguccuggaggaaguaacccuuguagagcagagacagcaguagaccuggcagauggagaggaaagaagcugaagugacauagucauuucaaguuucauucccaacagcacuuagaacaauagugucuggugagcucaggagugccgugguaaagggcagccgagggagaucugaggaggucugucauacacuucaccuguguguucaaucuuauuaaaucaguuuaccaguaauagcaugguuaguaugaauuuccacauuuaaaaaaaccugaauagaacuuuagugaaaacuaaguuugucauccaaaggucucuuagcacuuuuugauaaaaucuuguuuaccaauaugaaauuauuauaauacuaauugcuauguucaucagacuuuuccaacuuucauuaguacuaaaaguccucaucaccugaauauuucuuuuaguaaacuuaaaggaagagauuuaaaaccaugcauuuuuuaaaaauaccuuuaaacugccuaucaacuguuacuguuaaugaagacuuuguuuuuacuaugauccuggugauaaagcaugcuuagagugcuaaauuggccuguugagaacuuggaugaauauaaaaauuaaguuuggauuuaauauaacauuccaaucugucagaagcaugcaaacagaauuuuagaaucugugcaccuccauacaaguguuagccugccaggcugucagcuuaccuuuauuaaacuuucagugaaagugaaauuaugaaaauauaaguuuauauuugugcuuuuagucaguguauaagcugugcagaaccccaccucagcccccaugaacuaguuguauaaaguagaaaucuguuauugaagcucuuaaauagcuacuaugcuuuuaauauuauuucaaugauuuuuagcaauagacccauaaaaauggucuggaaaccaaaccaaaguaugguagaauguaggcaaaaagaauugaccuaaaaacaugccuccgcauguacucaacuauguuaagggacuuccuuaauuguaaaaguugaaacuucaaaugggacccuaaagcauauguuuaaaaacaaaaaaaaaaaaguuuguggaaauuagccuaauuuaucagcuauuaaguugauuuuuagauauagaaaugaauauaacaaacaauuucauuuuaaguacuaauaaaauuuuauuuuaaaugcugcauuuuuaauucuuaagauguacuuugaauucuuaaacugucuaauugaauguuaaacguuuucaaggccuguuaaaauucuguuguauauaguaguuuuugagcagauauuugcaauaaaaaccugucuuugaauaauuuuauauucag

SEQ ID NO: 5182 - RNA, 1753 nt, Mus musculus
uauuucaacuaaaauuuuuuuuauuugcuuucauaggauauuacaaaugaagaccaucaaaaaauugaaguguugaaaucagaaaacaaaaaacuagaaagacaaaaaggagaauuaaugauaggguucaagaagcaguugaaauugauugacauuuugaaaaggcagaaggugagucuaacaauagacgcuguaucucagauacacuacagacagaccguucugccaaaaaguuuguuuuuacuuugcuuauaaucuuacacauaaaauuguaucuaaagaugcacuguauacgugugaagucacaucuguguaauacauagugagguucacugguuuaaaacacacgcacgcacgcacgcacgcgcacacauacacagauauguuuguauauauauucccucccaacuacagaaaguaccauucaugagaaugacuaauuuuaguggauuaauuuccucuucaaacuuugagcaguaauucuaaaacacauuguaucuuucuugaaacaugaaaaaagacaauucacagcccucucucguuacaaagaucagguauaaugauaucaaauuauucuuuuaacaguagcuuggucuucauguaauaucaauuuaaaguguuacacuugcaugguuaguauguauaauccaacaauagcuuauuuuuuugauagcauauuaacacaaacaaauuuucuuuuguuguguguccaucucuaaauugaacaauauauauuuuuuaaaaacagaugcauauugaagcugccaagaugcugucuuucagcgaggaggaguuuaugaaggcucuugaguggggcaguucaugagugagcaacugcaaugggaugcucauuugauaucaaguguagucuucuugcuguucaugaguaauaagaacauuugugaaauaaaagaguuagauaaugaccuggugaaauaaacagaauguuugggaggauguuggaagacaaagccagacggcaacucuggccugacuuccuuuuucauuaguaguuaugaaauaaggaagcaagacuucgacucuuaauuaucuuuuaugaccuacuagaccugggagaggacagagaagauggcagggcaagauucuggagauccccagcugcagcugcugagucugcugcaggccugugugcugugcacggcugcugcauccaacagcagugaugcaggcugggaccagaggcuguugugcaggggcuauguguguguucucuuguucagugguugugcacacaggagacaaaauagagauggaaacagggacacacuuacuguaccaaaggaucauaaguauaagugauuaugaacaauuuggauaacacagaauguuuaauuucuggagauauacuaccaagaauuaacuaagauagaaaaaccuggacacacccauaguaagaagggagaucaaguagaucaaauccauaauaaaaagcucuauugggagcuggugugauggcacagugguuacggagggcauugcugcuauugcagaggacccaaauucaguucccagcacccacagggcugcucacagccaccuuuaacuccagcucuagggguucaaggcccuuuucuggccuccauugaccucugcacaaacgggauacauagacaugcacucagggauacacauaaaauaaaaauaaauauuuaaaaaaauaaaucuccucaaagaaaaacacaggaccugacggcuucacugccagcuucuaccaaacauuuaaagauuggca

SEQ ID NO: 5183 - RNA, 876 nt, Mus musculus
ucucucucuuuucuuuucuucucuuuucuuuucuuuuuuuuuuuguuuuuuuuaagaagacuuuuucccuucucaguaacuucaugauugaaaaaaaauuauauguguguguaugcaaauuucuauuuaguuuaaguaacaaaaaguuuuaccacccaccuccauuuguuuuuugagacagggucccucuaauguaguucuggcuguauuagagcuugcuauguagaucaggcuggauuugaacucacagagauccuccugucucugccugucuagugcuaggauuaaaggcauguaccaccacacuuggcuccuuuucuuuuaaagauguuuuacuugaaaccauuauagaauugaaacuuuaaaaaaaaaagaauacaaaacuauauauaagaucucuucugucuucuuguauguagugguuacaccuuuaaucccagcacuugggacacugaagaugaaucccugugauuucaaggccaaccugagcuacaaagagacccugucuccaaaaaaaaaaaaagaaagaaagaaagaaagaaagaaagaaagaaaaagaaaaaaauguagcucagggguagagcacuuauuuagcuuguauaaggcucuagguuauccccagauacuugguaccccauuaaaaggaaggaaggucugaaagaagaaauguacaugggugggaguggcucauauuugcuauuugauuguaaucuagauaauaaacuuuuaccuaaaaaaaguaaaaaagaagcccuaauacuuaauuauagaaaauauuauaauguaauacacagaaaauuucaauucuaauggcauuacuuucagguaagaccuugugucuuuaaacaguaagacguucauuauucuaccccuuuu

SEQ ID NO: 5184 - RNA, 876 nt, Mus musculus
aaaagggguagaauaaugaacgucuuacuguuuaaagacacaaggucuuaccugaaaguaaugccauuagaauugaaauuuucuguguauuacauuauaauauuuucuauaauuaaguauuagggcuucuuuuuuacuuuuuuuagguaaaaguuuauuaucuagauuacaaucaaauagcaaauaugagccacucccacccauguacauuucuucuuucagaccuuccuuccuuuuaaugggguaccaaguaucuggggauaaccuagagccuuauacaagcuaaauaagugcucuaccccugagcuacauuuuuuucuuuuucuuucuuucuuucuuucuuucuuucuuucuuuuuuuuuuuuuggagacagggucucuuuguagcucagguuggccuugaaaucacagggauucaucuucagugucccaagugcugggauuaaagguguaaccacuacauacaagaagacagaagagaucuuauauauaguuuuguauucuuuuuuuuuuaaaguuucaauucuauaaugguuucaaguaaaacaucuuuaaaagaaaaggagccaaguguggugguacaugccuuuaauccuagcacuagacaggcagagacaggaggaucucugugaguucaaauccagccugaucuacauagcaagcucuaauacagccagaacuacauuagagggacccugucucaaaaaacaaauggaggugggugguaaaacuuuuuguuacuuaaacuaaauagaaauuugcauacacacacauauaauuuuuuuucaaucaugaaguuacugagaagggaaaaagucuucuuaaaaaaaacaaaaaaaaaaagaaaagaaaagagaagaaaagaaaagagagaga

SEQ ID NO: 5185 - RNA, 3266 nt, Mus musculus
ugaacaggugauuuuuauuuuuagaagcaacauaugagaacacaaaacuuuuccaauuauaucauuacugaaaacacuuucagucuugaaauuuuguucucaacuauuaguacauuuuuaaaagaauacucaugauaaauuaauuuucauccuuugaaggcaaauuaauuuuuuuauaaguacaguguccaucuugaagacagguuguguuacaaauguccuuuuuguaagucagcugcuuggaaaucauuccuguccagaaacccuggcaagaggacaaggcagaaagcugugagccguuggcagaggcuuuccugggugcagaugcuaggaguaacgcugagacagggccaaaggaagcuguaagacugaguucaaagagaaaaacaguaauuacagcauuuaauagaaaaggagaggaucaaaaaugaaggauuaucaaccagagauugcaaaggagaauuccuguguuuuuaacuucuuccuagccucccucccucccucccgcaccugcacuaaguuguagcugaugcaaagcagagccuggcuaagggaccaaaggcaaagugcaauuuuuaucuugcuuuuucuuucuuucuucuuuuuuuuuuuuccugcuaucuuacuacucuuaaaaaguauucucagugacacuuuucaaaaugccuuaaccuuagucuuacaaagaaauucugcuucuaaauuucucuaggucacacuggaauaaucauuaaguaacaauuaaaauaaugguucaauuucugguaagauuaaaaacuuguuuuccccacauaaauuaggcuauggagugguuuuagcaaauauuuauuagguuauccuuaugagcuaaauauuuaaauuaugaaaauuuauuaauuucauucuaaucacagaaagggguaggaauuugcuggcaucuaauacaauguaaaacugcucuguuggcauguauuuuucuuaguguuccaacauuuaugauauaaauaaucuuuuuaaauugucugccauuguuuacuuaacugaaauuggccugguuaaaccauauuuuaagauauuaaacucuuguugacagagguuuguaaauagaagucuguuacuuugcuuuguaaauaagcugugaauuaauuagagugugcugcaagcuuagacacuuuguccagcagauggcuacacauucaaagaaacugaguaaugcggccuuccacaagacaguguuuaguuuuagcuuuccuuuguguuuauuuucaggacuuaaaggaauuccccagccuucugcuuuuauaccuacagcugaaaguaauuccuuucaaccucaaguaaagacuuugccaucuccaauugaugcuaagcagcaguugcaacggaaaauucaaaaaaagcagcaagaacagaaacuacaaucuccauugccaggagaauccucagcaaaaaagccagaaggcacuacagccaacggaguggcuaaucuacccaaugggaacccugcgauccuuucuccccagcccauugggaucgugguggcagcugucccuagccccauuccgguaauauuaucacuagaguuuggccuuacugagaugguaggaagucauuuauuuuauuagaaguaacaggugagaagauggcaagggucauaagcugguuuuaugaccagacuauccuuggucauucauccaucuaucuuucuuuuucuuucuuccuuccuuccuucuuuucuuuuuuuuuuuuuuuuuuuuuuuuuugagacaggguuucucuguauagcccuggcuguccuggaacucacuuuguagaccagacuggccucgaauucagaaauccgccugccucugccucccaagugcugggauuacaggcgugcgccaccacgcccggcuggucauucaucuuucauuccgaauauuuauugcuaaugaaaagcaaacccuaaaguuuauaaaacuaaagauacaaaagaugaagauuuguaaagugugcauauaagcauucagaauuucaguaagauuaaauuuauuaaaaaauuuuuaauauugauccuggcuggaucaagaaucuuuugggagccuaaauguuuuucuuaauauugaacuagaucaaguuauaauauauuauuaaugauuuuauacuugaaugugggccugcaucuuugguuagccugcaucuggguagauauaggaguagaagauuguuaaggucacucucacacaacuaacauuauagugaaggggauuuucaaaugcaaguguauccuccuaaaguaaagugguaaccuuaaauuacuauugguaugauuauuaaggagauauuuucucuuaauuuuucuugguaucauuaucuuucaucauugcuauuccauuaaaauuuuuaauaucugauggccauacuacucaccuaagagcagauuucaggaggccuacuguggauaaggaaaccuaguagcuaguuacuaaaguccagggcaaacuugagcuguguaagacuucccaagagugaacugugcucuuagauacuugagagcuuaccuuucuucaugauuguauuccuucucacuguaacgucuuuaacccacucauuagacaaauauuuguuauagguaugaaguauuuuguuaacuggaaaguaaaccuaacuuuuuucccauguguuacuguauuucauaaguauauugcuuugugguuauacuuguuaaaaauauguguacaaaaugauacaaaagaacucucuucuaacauuauaaugaccuuuuuucuuuuaaauuaacacuuaauaaauccucuaauacuauacacauguacuguuguacccuagacuuauaaaauggacuuuugauuuuuuuaccuuuuugcagguccagcggacaaggcaguuaguaacuucaccaaguccaaugaauucuccugauggcaaaguucuuccccucaaugugcaaguggucacucagcacaugcagucugugaaacagacaccaaagacuccucagaacguuccagccaguccugguggggaccguucugccagacaccgcuacccucagaucuuacccaagccagcaaacaccagugcgcucaccauccgcucuccuacaacugugcucuuuacuagcagucccaucaaaacugcugugguaccugcaucacacaugaguucucuaaauguggugaaaaugacaacaauaucccucacacccaguaacaguaaugcgccucuuaaacauucugccucagucagcagugcuacuggaacaacagaggaaucaaggauuguuc

SEQ ID NO: 5186 - RNA, 3266 nt, Mus musculus
gaacaauccuugauuccucuguuguuccaguagcacugcugacugaggcagaauguuuaagaggcgcauuacuguuacugggugugagggauauuguugucauuuucaccacauuuagagaacucaugugugaugcagguaccacagcaguuuugaugggacugcuaguaaagagcacaguuguaggagagcggauggugagcgcacugguguuugcuggcuuggguaagaucugaggguagcggugucuggcagaacgguccccaccaggacuggcuggaacguucugaggagucuuuggugucuguuucacagacugcaugugcugagugaccacuugcacauugaggggaagaacuuugccaucaggagaauucauuggacuuggugaaguuacuaacugccuuguccgcuggaccugcaaaaagguaaaaaaaucaaaaguccauuuuauaagucuaggguacaacaguacauguguauaguauuagaggauuuauuaaguguuaauuuaaaagaaaaaaggucauuauaauguuagaagagaguucuuuuguaucauuuuguacacauauuuuuaacaaguauaaccacaaagcaauauacuuaugaaauacaguaacacaugggaaaaaaguuagguuuacuuuccaguuaacaaaauacuucauaccuauaacaaauauuugucuaaugaguggguuaaagacguuacagugagaaggaauacaaucaugaagaaagguaagcucucaaguaucuaagagcacaguucacucuugggaagucuuacacagcucaaguuugcccuggacuuuaguaacuagcuacuagguuuccuuauccacaguaggccuccugaaaucugcucuuaggugaguaguauggccaucagauauuaaaaauuuuaauggaauagcaaugaugaaagauaaugauaccaagaaaaauuaagagaaaauaucuccuuaauaaucauaccaauaguaauuuaagguuaccacuuuacuuuaggaggauacacuugcauuugaaaauccccuucacuauaauguuaguugugugagagugaccuuaacaaucuucuacuccuauaucuacccagaugcaggcuaaccaaagaugcaggcccacauucaaguauaaaaucauuaauaauauauuauaacuugaucuaguucaauauuaagaaaaacauuuaggcucccaaaagauucuugauccagccaggaucaauauuaaaaauuuuuuaauaaauuuaaucuuacugaaauucugaaugcuuauaugcacacuuuacaaaucuucaucuuuuguaucuuuaguuuuauaaacuuuaggguuugcuuuucauuagcaauaaauauucggaaugaaagaugaaugaccagccgggcgugguggcgcacgccuguaaucccagcacuugggaggcagaggcaggcggauuucugaauucgaggccagucuggucuacaaagugaguuccaggacagccagggcuauacagagaaacccugucucaaaaaaaaaaaaaaaaaaaaaaaaaagaaaagaaggaaggaaggaagaaagaaaaagaaagauagauggaugaaugaccaaggauagucuggucauaaaaccagcuuaugacccuugccaucuucucaccuguuacuucuaauaaaauaaaugacuuccuaccaucucaguaaggccaaacucuagugauaauauuaccggaauggggcuagggacagcugccaccacgaucccaaugggcuggggagaaaggaucgcaggguucccauuggguagauuagccacuccguuggcuguagugccuucuggcuuuuuugcugaggauucuccuggcaauggagauuguaguuucuguucuugcugcuuuuuuugaauuuuccguugcaacugcugcuuagcaucaauuggagauggcaaagucuuuacuugagguugaaaggaauuacuuucagcuguagguauaaaagcagaaggcuggggaauuccuuuaaguccugaaaauaaacacaaaggaaagcuaaaacuaaacacugucuuguggaaggccgcauuacucaguuucuuugaauguguagccaucugcuggacaaagugucuaagcuugcagcacacucuaauuaauucacagcuuauuuacaaagcaaaguaacagacuucuauuuacaaaccucugucaacaagaguuuaauaucuuaaaauaugguuuaaccaggccaauuucaguuaaguaaacaauggcagacaauuuaaaaagauuauuuauaucauaaauguuggaacacuaagaaaaauacaugccaacagagcaguuuuacauuguauuagaugccagcaaauuccuaccccuuucugugauuagaaugaaauuaauaaauuuucauaauuuaaauauuuagcucauaaggauaaccuaauaaauauuugcuaaaaccacuccauagccuaauuuauguggggaaaacaaguuuuuaaucuuaccagaaauugaaccauuauuuuaauuguuacuuaaugauuauuccagugugaccuagagaaauuuagaagcagaauuucuuuguaagacuaagguuaaggcauuuugaaaagugucacugagaauacuuuuuaagaguaguaagauagcaggaaaaaaaaaaaagaagaaagaaagaaaaagcaagauaaaaauugcacuuugccuuuggucccuuagccaggcucugcuuugcaucagcuacaacuuagugcaggugcgggagggagggagggaggcuaggaagaaguuaaaaacacaggaauucuccuuugcaaucucugguugauaauccuucauuuuugauccucuccuuuucuauuaaaugcuguaauuacuguuuuucucuuugaacucagucuuacagcuuccuuuggcccugucucagcguuacuccuagcaucugcacccaggaaagccucugccaacggcucacagcuuucugccuuguccucuugccaggguuucuggacaggaaugauuuccaagcagcugacuuacaaaaaggacauuuguaacacaaccugucuucaagauggacacuguacuuauaaaaaaauuaauuugccuucaaaggaugaaaauuaauuuaucaugaguauucuuuuaaaaauguacuaauaguugagaacaaaauuucaagacugaaaguguuuucaguaaugauauaauuggaaaaguuuuguguucucauauguugcuucuaaaaauaaaaaucaccuguuca

SEQ ID NO: 5187 - RNA, 97234 nt, Mus musculus
cauggacuuuuuggaccuaggcccauccagucucgggcagaaacaacagcauugugaauccaguaccacuuuucucuucagaguuauugcagacauuugcuaccuagaugaagagcugaugcuggcuaccaugaggggugauggcugggccaccaacaaagaccagcagcauuggugcugaacuuggcaggggggugggaggguuauccuggggggcauauaucaguaccugcauguccagugcuaacuuuaaaugaaugcucauggcaagcaagcacaauuaaugauucauaacccccccacccuggggagggggaugaaaaccugagucaccaauaggcaacaacccagagcugcugaaugcugcccaagggugggaacacuuggaaugggugggaauagacuggagacgaagcauaccaaagcugcccugagaccaguuucuucgagggaauacaacagcucauucucugaccccucgccuauugaguuacgaaacaguuaaaagcuggccaggaccucacagucuuugggauuggcugaacuaaguagggagcagaaaugaguggaucagauuucucuuccacugugccacguucuuucagcaaacucccugagguccugguuguagccaucggcuauguggaggauuagucuggaagccauuugcucggcgcugugcuuucucuuugcccugggaccucagggccucugcuauucuagaugccugcagcugccuuuucagcccuucuacacacacacacacacauacacacacacacacacacacacacacacacacacacacacacaagcaaacuucgaaaugguagagaguuuacacccuaguccagggaggauagaaacuagcaggcaaauauuccuccuggaaaggacaauucugagauaugcucuagguccaggcucuucaaagagucaggacuccacucaagucaagcuccaugucccagaaccuuugcacuaacauugcucucugucccacguuacucuucccaguccccuacuggcacuuucuuguaccaaacacaugaugauaauuguuuaguuccugguacucugcagggaccuucucaugguuuguaggguuugucgguuaguguaacacaugcugcaagggguuccgauuacaggcuuuccccauguuugcaacuagagagcaaaugugcacagcugguccuuggaaggcaguguggugagauccugugucuucaccaguagggaaggugccucagagaaaacugagacgcuguaacauuuguguuagaagacugaaaagacaaagggcuagcagccaggguuauaauuagaaagaaagaaagaaagaaagaaagaaagaaagaaagaaagaaagaaagaaagaaagaagaaagaaagaaagaaagaaagaaagaaagaaagaaagaaagaaagaaagaaagaaagaaaggaagaaaggaaggaagaaaaaaagaaaugaagaaaggaaggaaggauuaagaaguugggguggccaggcaugguggcgcacgccuuuaauccuagcacucgggaggcagaagcaggcggauuucugaguucgaggccagccuggucuacagagugaguuccaggacagccaggaaaccagagaaagaaacccugucucaaaacaacaacaacaaaaaaaccaaaaaacaaaacaaaaaaaacaaaacaaaacaaaaaagaaguuggggugaugguucaguggcuaagagucuuugccacucuugcagagggccccaaguuuucuuggcuguguucuaccagccauguugguuggcucacagcagccuguaacucaagcaauagaggaucugacacgcucuucuggccucugcaggcaccaguauacaggugugcgcacacgcaacacagacaacuuaaaaccugaaaaaaaccuuuuuauuaauucuuugugaguuucacagcauguaccccaguuccacucaucaccccaucccuucauauccacacucugcccuugcaaccuccccugccaaaauaaaaaauauauacaaaaaaaaaaaaaaaaaacuaaacaaaacaaagcauagaaaacauuucauaauggaaacuguaguguaucacagcgugucccacagcacacccuuuugcccacacaucuucacuugcaaaugugcauugcaaugagucauuggucuggcucagagccucuggcuucugcuacaucaucaauacuggauccucacugaggcuccucucaguuauccugugguuguccugugucccagagauucuguuccuuuggaucagcacagcugacccuuucacacuauccacaguucauagauaagguagauuuggguuggaucagcucaaagcccuggaucugggccugggugguagcagugugggucagccugccugccagcucuccagcacugccccagcuaggugacccaaggacacugcugccagcagggggcaggaucagcucacauggcucacuggcacuuaggauaccagagccagcuccacugugcuucccagucaacguggcgggucuacucucccaagcgccucggcagaggggcugggccagcucucccauucucaugacguuggggcuagcucauccaugccuuccccaucggggacauuuucacuguguuggccaggauuguacugcagguggugagggacagggacagcucucccaacucucaacugcugcaggaggcaaagaaaggcugggaucaacucugcacagcccuuggacaucaacaugguccuagaccauggaagucugcauggucuuuaguggugauaugaaccagggacaucgacacugacccuugcugcugcauaaucguguauccagacauagcccuuagccauagcacagucugggacuucaccauaggccccaggggccaggcuggcuacucacaacaggcuacuccucugugcccuagugucucugguuccaucucuuuucauaaugcucaaacuguugugccuuuuucucucccauuugucaccccacacuugcacauucuaguggcuccacucaaggcaggccaugcacguagcuggcaggccucugggugaccuccucugccugcaccaugugguguggcagcaagcgggccuguaggugucucaugccugcccauguggcauaguggugggcggaucuauggcuaucuuccuuuccucucccccucugcauggcauggugguaagccggucucuggguggcuuccuccucccuaguguuaugugucaacaggugggccucuguguuuucucugucaggccucgccauguggcauggcuacaggagggccuuuguguguuuuuggccugcuuguguaggcuggucucuuggaguuuucccccucccccucucccccaacugcaauacacacacacacacacacacacacacacacacauuuuaaaaauauauaaaaacaaaauagaaugaggaacaaccugacaugcuauguaacucaguaagauguggauaggaggagaugaaagagagagagagagagagagagagauuuugaauaauuggguacaauuucuauuauauaguaaacugguggagaacagaagagagggaggcaggaaguaugaauugaaggaaguucaccguguccuugggaacuggauagguaaugacgucauguccagagccaggcaucaggcauauuccaaugcacuggauuugacuguucuucaugauaucccaauagagcuagcuaguguggaacacaggccugaagcuuaggcaauacauagaaaacagagaggcugugcuuuuucauauuacugugaaaacauauuugugugugaucauguuugugugcacgggcacauacagaggccaggagacagucccaagugaccucaugagccauucaccuuguuucugagacugggucucucauuugcccacugagcaggcugagguggcuggccaagccccaggaauccacccgucuccaccuccccaccacaggguuacaaucccucaccuguuuguguugagggagugugucugaacucagguccccaagcuugagcaacaagcuaucuccucaguccugcugaaguuucucaauaaugauuuaguguucugggaaaagccugccaucuucucccucccucccgccaggccaggcaguggcuggucuucccguauuacugcccacagggcagucccccucugcggucacuuucaguacagaccuuugaccuuccuagugugaggaaaaaguaaguucaggagaggcuuucauagccuggauuuugaaaacaaagaggcaaagaggacaccagcaggagacugauuuaagugggggaccaauaaaagagguagcuuccccaaccccauaagaagccagauagauggguguugccagggagggagggcucccuuccuggcccauccucacugcugugugucagugugggacaauggcuguguuuccugauaacuguuggaggccuagaaggaacggaggucugcuacuuccugcgugagcuuuacacaguucuuuggcugguguacuccagcucaguagcugcccacaaagugacuguaugguguucaugauuuuuaucucuagggaagucggaaggagcuucuaccauccccagagguggaggggacaggcugacugccagugaagcaggagccuuuagagauggguugcccacuagagggugauggaaaagccaacaacagguauguaaauucaguggagugagcagacuaagaugauaggcucucaucuccauggccauacaguguaaaaguaauuugggcuuuuugaugcccacucuaggucccuuacaaaagacacagagacuuuauauuuauuaaaaaagcuuuuugcacuauaggugggcuuaucuauuuuaaucuuauucuaaccugucuaugacugccugcuacccagucacaugccccauuauuugucaacuuagucuugcugcuccugguccauggggucaaagccaaucuccuggugaauuaaucucucuucucucucucucucucccucucccucucccucuccuccccccucccccccucccuaguucccaccagagacccucuucccuggauugggagucuagccuucuccucuccugcccagcuauuggcugaugagcuuuuucuuaaccaaucagaggugauggaaaacaaguuuuacacagcauuaagacaggaaaugcuugacauugccaaaauuuggacuacaaucagaucuuuggauccagaaaucagcauaugaauacacagugcacacaaauaucccccgacaauacauagguuuccugugcugagauuugagucacugaaaaauuaacaacaggcacauuaacauuucaggguucauuugagcaaaggcugguuuauaaauugggugacagaaucuacaaaggcucagauaacacccccugagugagugagcagaauggacaaugagugcuuugguuuuuuuguuuuguucuaauuugguuuggcuugguuucugcuuuccaggccagguuggccucuaaggcacagagaucugccugccucugccucuugagugcugggauuaaaugcaugggcuaccacgcccagcugacagcuuuuaaaaacuaaauacgaaaguaauuacuugagggauagcccggucuacagagugaguuccaggacagccaggccuacacauaucaacccugucuugggaaaaaaaauaaaauaaaauaaaauaaaaagaaaggaaggaaggaaggaaggaaggaaggaaggaaggaaggaaggaaggaaggaagucagcaagaugguuuagcaggcagcucuugcagcugauccugauguucugaguuugauuccugggacccgaacuguggaaggagagaacugccucuugcaaguugucuucugacuaccgcaugccugugcacacucacgcauccucuuagucaaucaauccaugccaaaagaaaugauuugguuggcuucagcuuggugucugcauuacauacgaacuaagacaggauggaaaacagggaagaugguggacucaggaauauucaagccacuuagcagaugagaauggagaaucccggcagaagagagugggcucaguggguaaaaugucugccuugcagaugugaggaccuuaguucuagucccauaauccaugucaaagaguuggcuuuggcaguguaugcuuuuacuccugggcaccagggagaagacagaggaauucugagaguugcuggcagaucagccuuaccuacccagggaauuccaggucagaaacaauaaaaguaacauaauaggguggggaacagaagaaggagaaguugucggaugguacgucuaaggugaaccuauggucuccauacaccaugcacaccaacacucacacugcacacacacacacacacacacacacacacacacacacacaugcacaaaagacauccaacacaacuagcauuuucgugaggacuuuucccacugcccagcuauaagccugcaguuuauuaugauuccucucagaaaccucaguuacaguagaagaaugugucccgacuccuugugcaagccuaguggcuccugauuuuaucuuaccugacuguaaugcuguaauucagggaaccucuggagccacccuagaauguuacuuaacaagaagagagaaaaaagggcuucuuagcaacccuuugagauguaaccugagaccaccagaaugauaugcauacagcuuauacacuuaagccgugcuuuucuuugagaagcccauacccacgcucuccucuaugcuuuauucucucuucuuuauuucuuucucucccaagacaggguuucucuguguagccuuggcuuuccuggaacucgauuuguagaccaggcuggccuugaacucguaagagaucugccugucucugccucccaaguacugggaucaagugggugugagcuaccgcucccuggcuucuuguuucuaguuuuaauaaacuccaacucugcuucacacagguuaguccugaaauucuuaucuguggccaaggaucuaguuuugccccaagacaggucucugcagaccucagguugaugcaguggacagugugaaaccuugucuuccucccuguggcuacugauuggaauuaugugaaaaguaacucugcggagaucccuugaguaucugauuggguaagcugagguuugauccgccagguuccagugagcuucaguuugcuucuuaagcagauaagguggcuggagccuuccauggcuuuucaaggacuuauuucaacauacuuauaagagaauaaaaaaagaaugaucugaguuaaaaaucugaaccaacucgaggucuggaauaccuccaucacuauucuuaaaaauuaccaaaaaaaaaaauuaccaucaccaauuaucacauguauuauuauuaucggcucuguucuucagaagaacauguggcuacgugaaagggagcaucaugagguacuauguucaaucccuagaauucacauaaagauggcaacagagaaccgacucuacccaggcaugaacacacacacacacacacacacacacacacacacacacauacacacccuccgaaaaaaucccauagagcugaggaauacagagagaaaagggguuuuccauuuaaauagcuuccucaacuugagguuagauauugaaccaccgguuaaccacuucugucuuuuaaguuccuuuuaacuucugaagcuaguuucacaaggcccucccccugccuucugcuacaagagaacaagcacucucccuuucagcacaugcaagcuccugccuacuuaguucuuccuuaugagucccauuuaauggaaagaagaacugugauucgaauaccaggauuuggaauuaucauuaucaaauguuucggcucauaaucucaugggggauuucucaaugauccgacugccaauuucaauuucuuccaccauuaaauauuaauaccaguaauggaauugacuucugaucuuguuugaaauaacaugaauggccuacuuaagauuaaauguaaaaaauauacacagugccaggugugguagugcaguuuuaauccugacucucagggagcaguggcaggcagaucucuaugaguuugaggcuauucuuaguucuacauagugaauucuaggaaaauuaaugcuacauagugagagacucuguuuuguuaaaaaaaugcaaugaauuauuaggagaaauuaugauuuucaaaaguaaaagacacauugaauauauucagauuuccuuuuucuucuuccuccugcuuuuuugagacaagucucacuauguagcucuugcuguccuggaacucaccacguggaucaagcuggccuuuaacucagagauccuccugccucucugccuuuuuagugcuguuacuaaaaugugggccacuaugauuggcuuauuuuauucuuaagaucuaagaacacagaugugugaguuuauaaagcaaaagaguuaauucuacaaccaccuguuuacuuauuugugagacugggccuccaauccaggccuguaugugcuagagaucacucuacuacuaauuuacacugcuagucaugauaauguuuggauuuaagucagcuaacauuccugauuauucaggaauacucuauccauaauuaguuguuacaucuguccuaacacaaaugauaaaauguggauuacauauuaacagaagucugacagcuaauaugaaugaaauggauucugccaaaggcaauuaaauauuucguaaacaaccaauugcucacaccuaucaacauuuuucaaacggugacuaguuuagaguucagaauuaguuuaauucucuuggggaaaacuaaaauaagaucuguaaaaaauuuuauuuauuuauuuauguauuagguagguguguuggucaagagaacaauuugcugcagucaguucucuuuccuccaugggguuuugggguauaggccucccgguuguugcccgagaaggccuuaaucuccuuagcuaucucgcggccccugcaaucggauuuugagagucuaauuucugcaguauuuucccacuauagaaaaacaugcuaugcuuuuggccuguaauguaggcucagggccgugagucagaacgaugcagagcuggaggcuagccugugagccccgaccagccaugucucaaaaccucggagcagcggcugucuucuucccacccccaccuuuucuucagggccucgcugccgcgcugucggcggaggcucagcuaugcagguuuggauggccgacuccgccagccuaguggcuggccuugaagccgacacccccccagauuuaggccugcgcauuccuucccggguccuauggcgggcggcuuccgaucggccaggagcacgcuuuucaaauguggcuuuagguugggggcuagcuaaaacgccuaaucuguaggcgacaggcucgcguggcgggcucccagggagaccuguuguucgagcaaaaccgcaagguaguggcuuugcggaagagccacguuucucggcccuucccccacuccaccccacccccgccuccuccgggggcugcggggccuccgccgccaaccucgcccgcccuuccccccacccccgcgcgcgcgcugccgcccccgccgcgggccccgcgacgcgcgcuccggacgagcuccuuguuucuggagucccgccacgcuugcuccaacccagccccccaagccucgcgcgcagccgcagagcgggucccgccccuucucgccgcgcgccccugcaccccagcgcgcucccggagugggccuccuccgccgcagcgacgccuccuccuccucuuccucucuccuucucucucggucucucgcucucucucgccgcugcagccuaguaggggcgcuucguccagcaugagcucggacauggcagccgacgagucggaggccccaguacucucggaggacgaggugcgggaaggcugcgugccgcgcggggguucaucguggcgagggguggccgggguggguagcggggguggcgggcgaucggggcccgaauuuggccccgcgcuccggagcggggcaggcggugagggggagauggagagaggcgcgcacgaggccucugcgggagcagauuccccgcuugcucgccucgcugcucggggccuugggccucccccggggggccuccgggggccuuuggcugcggccugggcgcgcucgcucacccucuccgggagggccauggcuuggguggggcggccucccgagacucagcaucccgcuccugccgcagcgggagccgacagaacuuagcgacuuugccacuauggcuucccgagggccaggguugggaacgaagggggguggggggagggugggauuccuucgaguccgcggccagcgucggauguggaaaguucacacuuuguuuccaggccuuuguuaguauuuuuuuuuaagugaaggcaaaagaaauagagaaauacuuuaaaagaacacccagcagcuguuggcuucaaaaacugcagcccaaggauucguggcacgcaaaaccgucuguuacagaggaacaacuuaaucgcgacuuugccucgcgcucgcugaaagugaggcccucuugagggagggcuucgauggagcuggcggucgucucaaauggguggggcauuagagacuucgaaguguuuaacagugacccuuucagauugugugugugcgcgccugcgcgugcgcgccugccugugugugugccugugugugccugugugaauccaaucuccggguuucuguuacuuaaucuaguggucacaugugcauuuuaucaagauugggcucaauuagcuagaaauuccuaacccccccaauuuuuuauuccuuucucagguaccuccaaacacuauuguaauggcgcccuccaauuuuuccccguuucccuaagagcuuuuuguuuaucuauagugggcgcuucauuaagauaauuauugcaacauauuuugaaaacguuuguguguucacacccgugcgugugugccugugugugcguguauguauugugguuggaauuuaauuuuuuaggcaauccuguuuuuuuuuuuuuuuuuuuuuuuuuuaaacauugguggacuggaggacauauuaaaugaacuaagcccggccuagagagagguuacuugagaucucauggggaaucuagaaaguugcuauuauaaaaguuguuaguaaagggucugaagagguggcucgguggccgagcucuuguaaaggaccaguguacagccccaugguggggccccucauaacaguaauuccagcucuggaucucuguggcaccagcacacauggcauacauucacucucucucucucucucucucucacucacacacacacacacacacacacacacacacacacgaguacauuacuggagcuggggagagcaguuggggaagagaggccaaagcaaaggccagugagaguacugagucacaguagcuguaagcucugcugggcuguuaaaugcacggugggcugaaugcuuauauacuuuggaaugcuacaagaugggcuguagagaggacuuaguuaagagcauuuggucuuucagagaacuuagguuugguucccagcacucacauggugguuuacaguccucagaaaugaugcccucuucugaccucuguggaagucagcuauagacauggugcacauaagcacaugcagcaagacacacacuaaauaaacaaacaaaccaaccaaccuuuagaaaaaagcccaguucucagguaacauuuagaauaugguaacaggcagauacagaagguucuagguacucagaagcagcccucccccuccucuagccaggggugacggucugcgcagugcccacuauuucauaggagucaggaguuacuguugcccuguggcuaggaugccuuuccucuacccugccugcugcauacccacucaauuuggaagaucucaaguugguauccuacucuggccuugggcuucuggcuggcucguccagcuaccucuuccagcagagcuagcuggucacagacuaaauaauguuaaaguuaucuuucucugucucuuuucucccucuuggcccaguaucuguuuuccagauuguccuuuucaucugcccagcugaaauaaagaaagaucuguguggccgcuagugggugcgcagcagcagcuggggcucggagcucccucuguaguaaggacuaacugaacuuagugaaggaucuauacuucugaagagcuuaugauccggggccuguuacauucccaugauaaagguuuagauguggguucugggacucaaauuuuucuccccucuuucugugucuacuuugugcucacuaagggagagaggcaggaagacagauaggguugugagcgucuuccacugcggggcuaauuggguuauuaauauucacucagcagacguucauuaauguucugugugccgugugccaagcaccagggauacagaggauaaaagaccagccuccaaggagcucacugucuggugaacaagcuagaaauggcucguuugcugguugcagcuggaagcucauuccucucauugggcauuuauuuauuuauuuauuuucugguuuaucacagaaccaaauggcagcuuggaacacagcccaccccacacacacccaaauaccacaugcccccccccccacaccacgaacacuacuacacacguacacaucacacacacauacauacauaccacaacaccccccacccccauacacauuuuguucuuuauuuaaagauggaaacauggcggcugugucaucucuugagcucagacuagucagaguaggcagccugcugcuguugauuaaaaguguuuggacuggggugugguuuaguugguugagugcuugccuagugugucugaagccaugguugaauauccugcauugcguacaacggauguguuagcccaugcuuuuaauaccagcaccugggagacaggcaagaggaauucugugaguucgaggucaguaucaucuacauagcaagguccugaacagcuaggguuacauaaugagaccucucagaggggggaaaaaaaaaggucaaaggucauguagcaguacgucagagcacacaucugucauggcaaguggaaacggagggccagaggcaugagcgccugacuaagaccaaccagagcugugcugugagcgccugucuccaaaagaaggaaauggauucaaacaaaucugaaacaaggagaaagaugaauagaaauggcacagaauguagagaauuguggcuuaaucuuacagagcgauuaggacucacugggugaugugacggaggguauuaaagcaugcugaaauuggaucuaauaccugcccccuuuuggaugaguuuuaguuuuuuggguuuuuuuuuuuuuugguuuuuuugagacaggguuucucuguguagcccuggcugucuuugaacucacucuguagaccaggcuggccucgaacucagaaauccgccugccucugucucccgaguccugggauuaaaggcgugugccaccacgcccggcuugaguuuuaguucuuuuauguauagccuauggaaagagauucuguuugcagaaauuuuacuauuaggacauuagcuaaaugaagaaguguaauauaauuuacaugguuugcucugguggccacuuaggauuaacuacagaaaauaacucauuccuuuugcuuuuuuugaaacagggucucgcuguauaaccuggagaacucuguagaucaggcuggccgggaacucagagagcugccugccugcuugcugugagauuagaggugcuaggcauuguccccagagaaagaugaaagaaaggaugagaggaaggaugugggccuggggguuauuaccuguuguccucccagggcacugccgacucuuuuuuuuuuuuuuuuuuuuuuuuuaaagauuuauuuauuuauuuauuauauguaaguacacuguagcugucuucagacgcaccagaagagggcaucagaucucauuacgggugguugugagccaccaugugguugcugggauuugaacucuggaccuccggaagagcagucgggugcucuuacccacugagccaucuuaucagccaggcacugcccacucuuuagaggcugggaggcuggagacuuuucccaguuagaguugugagaaguagguuuccuauuaagaugcacucacugaagauggggggggauaaaaaagagggguaucgcuuuggcuuuuucugcugauaagcauacauguaugcagguugaauuuuucuacaauuuuuucuacaguuuugaugacugcagagaagccucaguaguuaggagcgcuuacuguuuguguagaagaccugaguucaguuucuagcacucacuaggcagcacacacacaagccuguuacuugaacuuggaggauccccucacucugcuggccuccacagagccccacacacagaugcacacgcacacacacacacacacacagagacacaagcaucuaauuaaaaauaaugaagggaaaccaugacaaaaaagagugccaaugucugaggcuggauuuguagcuuaguuggugaagugcuugucuagcaagagcacuggguuuaugggugugguggugcauaccggaaucccguaucuggaaauggaggggugggguuaagguucaagaugcuccuggcuacauguaugaaugcagagcauccuguaugugggcauauacucuacuaacuuagcuaugucccuagcccugaaucuuuccuacuuaaauucauagaaauauuaaggaauucuucugaaaaucuuucugagauuuaacaaauuacauuuauuuacuuguuugugcgcacgcauguguauguauucgugugccauggugcaugaauggaaguuagaagcagcuuuuaggaauccucugucuaucaugugggucucaggaauugaacuugagucaccagacuugucagcaagugcggguggggagguguggggggaagggacauggagccauuuugcugacacacucuugugaacauuuauuauuuauuuauuuaagacagguuuuuccucuguguagcccuggcuauccuggaacucacuuuguagaccaggcuggccucaaacucaaaaaucugccuaccucuguauccuaagugcugggauuaaaggcgugcgccaccaccgcccggcuucuugugaacuuuuuuuaauuuuauuuuuucaagacagaguuucucucugaacuacugucacccagugaauuuuguuucuuucuuucuuuuuuuuuaagauuuauuuauuauauguaaguacacuguagcugucuucagacacuccagaagagggagucagaucucguuacggaugguugugagccaccaugugguugcugggauuugaacuccggaccuuuggaagggcagucgggugcucuuacccgcugagccaucucuccagcccgaauuuuguuucuuaugcuuguuguguaagauaguaauugggugccauuguuaauguugucuuuuuacauuucaauauggacucuagucauuuaauaagaccacaaaaauauaaggaguuggagguuggaauuauauuggauuuauauauuacuuuggagaaaauaggcaacuuauuaaaauuuuucaucaacaagcacagagaaugucuucauuuauuaguucucuaauguccuucaacaguguuuuuaauauuaucaguugaaguuuguuuauuuuguuucuguaucuuguacaauuuuaaacauauguauguggaaaaauauguauauugagacaggauccuacuguguagcaccggcuaccuuggaacucauuauauaguccagagaucuaucugcuggcuucuaacuccugagugcuggcauuaaaacuauguacaaauaguaggggaaggcucuuaaugaggaauuaucugaaucagguuggucugugaacagauguguggggguugucuuuuuuuuuuuuuuuuuagauuuauuuauuuuauuaauguaaguacacuguagcugucuucagacacuccagaagagggagucagaucuuguuacagaugguugugagccaccaugugguugcugggauuugaacuccugaccuucggaagagcagucggguacucuuacccacugagccaucucaccagcccguggggguugucuugaugguuacuucauauaagaagacccaguuuauugugaguggcacucagcucaaguaacuuauucucaccugucuuagugucuuauugucugagagacacuaugaccaacagugagguggggaggaagggcuuuacuuagcuuacauuggccacauugugguccaucauugaaggauuuagagcaggaacucuagguuuugcagguaccuggaggcagaagcuacuguagagcccacuuacuggcucgucauucauugcuugcucagccugccuuaaagcacccaagucuaccagcauagagguugccuggcccucucacaucaaucacuaauuacaaauacuaguuuacaguccagucuugggacauuuucugccuauauugagguuccuucucucaugacaauagcugugucaaguucacauauaacuagccagcacaguuagcaugagucuauaaaaagagaaugaacacaguauuaccaggcugugcacugaguuuacggaagcuugcauuauacugaacugucuuacagacauuuuaggcagggguuccaaacaauguaagaggaaagcugacugaugggcagcaagccucugcucgugacugaguauauaugagagcugcuucaauucuugccuugauuucccuguauagccccagcuguccuggaacucaaauccaccugccucugccucccaagugcugggauuaagugcgccgccuggcggacugaauguuuuuaagccaaauccccaagguugcuuuuuauuggaauauuuuccccaguaucugaaaugaauccagaauaccuacccuuuuuugauuuaaacgauuuauaaucuguagguuaagagugcguacaacaguguaguccacagcuuggagacauuaccuacauuugcacagacucacauccaacuuuuuauuugcugagccacuugagaauaaguuacagaauuugugccauuuucugcugaauacuuuguuauucaucacuuuagaaaguauaauauuuuuauuauuuuguugagaauuucacaacaauguauuuauuuuuuuaaauuauggguaugggaguuuugccuggauaagacagaagaugguggcggaucccccggaagugauguuacagauacuugugagccuccauguggaugcugggaguugaauccgaauucccuggaagaggagcacgugcuguucacugcugauccguaccuggagcuccacaacguauguuuuuaaauucuuauuuaugcguauggguguuuuguuuguauguaugccuuuauaugguguguauuccuaguguccauagagacuggaagagggccucuucagaccuuagaccuggacuuagagaugguugugagcccccguguaggugcuaggaauugaauccagauccuuuggaagaacagcuaaugcuuuaaacugcugagcuauuucucaaccccccaaauuaaugaauuuccuuugaggcaggaucucauaauagcccugacuagccuggaacuugcuauguaaaccacgcuggucuugaauuguucuagugcuggcuccaagggguuaaaguggcuuaucaccacaccuagccauagacaauguaaugugaucauauuuacccugccaacuucuccccccagcuacccucagaugauauaucucuuuuaagacaaggaaauucucccaugagaccucauuccacuguugacaugcaagaucauugguauuugacauaucauaguguguucacuguuauuuauaaacuguuuaaugguacuuaaaaacuaccuuuucuuuguaguuauuacaaaugacuaugagcuuuugauuucaugguaugaacacagcaacagugguaacuuccuuaguuauaauuugucauuaaaaguuuauuauaagaaagcuaaauuagggggcuggugagauggcucaguggguaagagcacccgacugcucuuccgaagguccagaguucaaaucccagcaaccacaugguggcucacaaccaucuguaacaagaucugacucccucuucuggugugucugaagauagcuacaguguacuuacuauaauaauaaauaaaaucuuaaaaaaaaaaaaaaaaaaaaaaaaagaaagaaagcuaaauuacuauguguaauaacuugacuuuaguucuuugguuuuugugugugugauuaaauguaucuaaaaauuguaaauuuugucuuuauuuucuucuauauagcuuucaaucagauuacuuacuuuuaaauauuccuuugaauuuaguauucucgugacuauuguauuagauagcuuguaaugacaugaaaauaaaacaccuuuuuguauuuuaggaugacacacgaguugugagagugaagguuauagcuggcauaggccuggccaagaaagacaucuugggagccagguaaauaacaaugcaugagcuugggguuuaaggaaacaguauugcuuaguuucuuucuugaacuuugauuaaaugaaaaucugagugauaguagcaaauuuugguacacagugagauccuuacaggguaaguggcugauuauuuucuugguaucugaaucaaugaauuugcaaaauuaaagacaguuguaguuauagauuuacuauugaguucugcccccagaauuugauagcauuuuaauucucuaaauccguuagcagauaauaaccagcauaaucucugguuacaguagaaaaaggagcucugaguaucaagugagcagagcggggcgcacuggguuggagcuacaugggagagacccagugguguggcgggguucccuuagaggaauuagucagccagggagaauuacaaccugaggcagggguugguggucuccacagccugaaaaccuggagcagggguuggacucugguggagaaaugagagauuggcaggaagccuggcagugguggggauucuggaagagaaagaguuggccucucagcuggugucagaagaucugagcagagagugagugucuaaacaagauagauaaacacagaaaaaaacaacccagagucucuguaacucagcuuacaauguccacgguacagcauguagucaccuggucuguaaagagcaagggaagugggacacacugucaaucaauaaggaauaugugagcagaaugugaugggaggcacucacggcuagucuggucuacauagugaguuccagggcugcauagcgagacucugucuccacgaaacaaaaacugggugggaaagaaagaaaaaaagaaagggagaaagaauauaugcucauugucagucaaaacauuggaaaucucaggaaugaaguagagacauaaauagauaaauaaauaauaaaauaccggggaaacucuacaacuaaaauauaauugaaauucaaguucuuugguuggccgugauuucugaauggauacauagaacaaagaugaacugaacauagauuaauggggaucauuuaccaauuagaagaugaugaagaagaaaggucuguuugaacuacaucccagagagauaaauaaugaaauaaaaucuuuuuaaagaauaagugucuaaauuuggaaaacgaucaaugaaauauacaacuggacuggagaguuggcucagcaauccuguauugcuuuuacugagguuucccugggaacugccugugaccaacuccaggggaucuggcgcccucuccuggccuccacaggcacugcacacauguacacacaacuuaaaucuuuuuaaagaagaaauguuaaagcagguuaaagcuccuggugaagagaaaggaaaagaccaucagaagugauaaauaccuggaaucuacagaugcuuuuuuuuuuaauuaauuaaaaguuuuauuuuuguguguggguguuuugucuucauguauauguuugaacauuugauguccauagaggucagaagaggauauuagucuccuggaacuagaguuauaauuggcugugaucugccauguuugugcugggaaucaaacuugggucccuugcaagagcaguaaaugcucuuaaccuuauacagggcccauuggaaucaugauucaacaaccuugucuuacggauucauauuagauaaaagggaugaaaggaaugcuuaugggaauaacagcauaaaggauaggguguguguuugcugugacccugcauggaaggaucgugugguagaaagcauaggcaaagugaaucauuaaggguaugaaauagaaaacauaaucauaucaacauuucaacaguaaugugaagaauuuuagguuuuguaagagcagaaauuuggagguuuuuuguuuuuguuuguuucuuuuugacaguuucucuggcuauccuaaaauuacuucuguagacuaggcuggccuugaacucaggacugccugucucugucucucaagugcuggauuuaagggcaugugccaccaccaccauagcuaugcaagcauaguuguacucuagagcuguaaaagcagaaauuuuaaacugaaguucuugaaacaauuaaaaagucaguacaaaacaauucuuuuuaaaggggacaggacaagggaaggaaaacaugaguuaauauacuuguauccaaucauguaauaauuacaagcacccacauuagcuggcuuacaacugucuguaaauccagcucacggagauccaacacucuuauggcuuuggcaggcacauguacacauaacacagaggcauacacuguaugcacauaaauuaugaagcaacucuuuaaaaaacauacuuaaauucaaugauauaccuagguuggggaaaauggaugcaaaaaugguaugauaaagauuaacgugaauacgagccaggcaguguggcacaugucuuuaaucccagcuaucaggaggcagaggcagguagaucucugacucuguaggccagccuggucuacauauagcauucuaggaugguuagggcuacacaagaguaacccugucaugaaaaaaacaaaaucaaaaacaauuaaaaucugcuaaaauaagggaaagguauuuucaaauauuucacaaugauaauaaaaucaccaggaauguauuaggcagaaauggguaugugccugguaccagaacuugcagauguauggcucaaaacuugacagaauuaaaggaaaaauuaaaaauucuauuuuggauaaagacaccaaugccuuuuucaaaauuguuaaaacauaauuuuugaaaaaaucagaugaggcuggagagaaagcucugucauugagaguucuugcugccuuugcagagccccauguugauuuccaacuuccaugucugguaucugguagcuaacagcugccucugacuccugcaggcaccagcauucauaugcauagcgccccccaacauaauuaaaaauaaaaauaaaucuuuaaauaaaugauaaaaauuguacaguauuaccaaugacuuuggcuuaagaacacauccuaaaggcugcagagcaaacauucuuaacugcagaauagauguucaaauguauacaguacauugacagucaugggccugugaggauuauuaccuuuagcugucugguaauauuaacaauagcuucgugucucaacaagcauguguucauuguucacagucugaaugauucagaagccccugagccuucaccuugauccacuguuaauggucucacgaaggaacucuuguguaucuguuucuaauuugguuaugaggucucaagagggguugucuguaaacucuagaccuguccucaugaugcuccagagaugucacugaguuuucagaaugcuuuugugggucuucacccugugauagaaccuccagucaccagaugugccucaggagauuugcauaucuuggccaaugcccugugaccucuggucugaucuggguccagguucuucauucccacaaaggagcccauuuccaggagagaagaugcauucaggaugucauucaggugaacacagggaucaccucaacaaaaucagagauguccauagcugaauagagaacaauggccucaccaggcaaggggcagcuggggagccccagagugugcuagcacaugugggugagagcauuuggguauugcccaugugaauuucuucuuuuuaaagauuuuuuuuuauguauaugaauacaacauugcucucuacagacacaucagaagaggguauuggaugccauuacagugguugugagcccccaugugguugccgggauuugaacucaggaccucuggaagagcagucaguccucuuaacccacugagccaucucuccagccccugccucugccuccuaagugcugagguuaaaugcaugugcuacuguauccagcaauucuuaguuuuuauuuggaggggcuguagcucaguuugccuaggacauacuagguucagucuguggaccaugaagacugguugugaugcaugucuguaaucuaagcgugaggggagaggcaagaaaaucagaaggucagcauccugcucagcuacagagaguuuagggccagcgugggcuacugaugaccugucagggagagauggagagaaagaauacaaauugagaacgguguaggaacccagacauaaguauuucaaaccuuuuucagaguagaucugagaacagacagaaagcagaugggauuugaagagcuguugugggggcgaaguauggcuaggggguugcuguguugugugcuccuuccuguggaggagugcuguagucucagccacacucucucacugcuguguagucuguacaacuuggagaaaacgacaguagcuaacccugauccacaaaaacuguuuggagcaguguuugauguggaguaauuucuauguaaguuauuaccaacuuucucuuguaacuuuaacugagaagggaagaaaaagacauuugcugcuuuccuagaaggaguuaacaggaauaaggaauagaggaguuucaaaauguauugcuagaucaugaaaagcuaggacaaaggagguguugaaaugggcugacugccuuccaagguggaucaugcuaggcaagagugcccugugucuccaaacuguccuugucccuauuucccuggggcugcagagaugagacgagaucuugcuacgcuugcagagaaccugaguucuguuccuaguaccuauuuauguuagauggcuguguaacucuagcuccaggggaccugauaccuucugauugacauacaugggcaucuguacacacacacacacacacccacacacacacacacacacacacacacacacgagucauaaacaugaauaaaguaaacuaagccuuaaaaaaauggaagagcuucuacaacauguuuuuuguuuguucugagacagggauuuaaccauguagcccuugcuggacucagauuuccucugccuucggauugcuuggaucaaaacaugcgucccgcugugcuuggcaagauacaauuuuuugguuuuuuugagacaggguuucucuguauagcccaggcuguccuggaacucacuuuguagaccaggcaggccucgaacucagaaaucugccugccucugccuccuaagugcugggauuaaagguuuuuuuguuuuuguuuuuuucaaaucucuuuauugguucuuugugaguuucauaucaaguaccugaguacugcucauguccauuccuuaugucuguauguccgucccuucccccuuucagccuccgccucguccccaaucaaaaaaccacgaaagcaaaugacaaaaagcauggaaaacaucucaucgugaaagcuguggugugucacacugucccacacauuuccacuuguaaugagucauuugacuguucaggaucucuagcuucugugacaccaucaauauuagaucuucaucagcacucuucccaguuaucccguuguagcccugugucauggagauccugcagcuggaucugcagaacuagccuugucuugugucucagcuugucucagauggggugggccaauuucagaaccucuggaccugggccugugugguagcagagcuagccaacccaccagcuucuucuuuaccuggaccaucaguacaaacucuccaggcuugcucuggcauggccacccaaugcugccguuggcaggaggcagggcuagcucuccugcacucauacccuuagcuggcucaccuguaucuaggccuccagagccaguucugugcugcccagucaaggcauggggcccacucucccaaguucuacacuaaaucuuuggucauucuacagaugugguaauuaaaguuuuuaauaaaguauaaauuucuauaacuguauacagaucccugguuuuuaggguacaaagcaauagaaauaauagaacugaaaaucugauaauuugaacaguuggacuaaauuacuauuaguaacuacuaaaacuuacuuguuuuuaacuuuuaacagugauccuuacguaagagugacauuguaugacccgaugaguggaauccuuaccagcgugcagacaaaaacuaucaaaaagguuagauuuagccagcuuucaaagauuuuuaauaaacuuugcuuuuucuaugacaagucauucuaaaaaauaaauuaugcuacguuuauugucuuuuagucuuugaauccaaaauggaaugaagaaauacuguucaggguaaguauuauuuuauuaaaaauuuuuucuuuguagguaccauuauguagucauuuacaauaucuuaaaauaacacuuugaaaugugccuagaggguguuuuuuaugagacaggguuucucuguguagcccuggcugucuuggaacucacucuguagaccaggcuggccucgaacuccgagauccgccugccucugccucccaagugcugggauuaaaggagugcgccaccacugccuggcagaaagcaugguugcugggaauugaacucaggaccucuggaagagcagucagugcucuuagccucugagcuaucucuccagcccuuacacgcccuucuuaacucaccccaccucucauccuguccugcuauucaagcucccaguagagugaggggcacacuucugcccuuccuguucccuggaggguggaggaaaugcauuuccagucucuuggcuggaucauuucugcuuguauuuuccaucuuuuuuauuauuuucauuuacauuucaaaugcuaucccaaaaguccucuuauauuuuccuuaaaaugguuuuuuugugccucgguuucccuuuuuucugugggcuuauacuaagccaguauucuuuuuuuguuuguuuguuuguuuuuguuuuucaagacaggguuucucuguguagcccuggcuguccuggaacucacucuguagaccaggcuggccucgaacucagaaauccgccugccucugucucccgaguccugggauuaaaggcgugugccaccacagcccggccuaagccaguguucuuacaaagauaccuuuucauuucauuucugcuuuuucaauaugcuuuccacagcucugaucuugcuuacaacccaucucacaacccagcugccaggccugucugcucucuuaccuuugaugcaaugugcuucugagucaauauuuauuuuauuuuauuaaaaaaaaaguucuuuacuaaaaagaaugggugcuggagagaugcuucaacggguaagagcacuggcuguucuuccaaaggaccuggguuuaauucccagcacccagaagguagcucucagcuguuuguugucaaccaaacugcugguuccaggagaucugacaccucacacagacauacaugcagacagaacuccgaagugcauaaaauaaaaaucauuuaaaaaguuguuuguaugugaaugcaacugugucuguaggcuucugugaaaucccuugguuuuagucagggaaaaggaugcuacuugucugaguuguacauucaguguugaugguggagaacacagcagggaagaaguugcugagguaagacucgugagucugagguccagugcagcaccagcaggugcuucuggcguucauguucagaggaaggucucuacuuagcauaucagaacuagcucuugaaaccagucugagguuuuagagucuagaagaaacaccucagaguuaguuagucauuccaaggaaagugaaacuaaguuuagguuuacucuuucaguccgaggcuacuguggccgccuugggcaguuucuuugcauguugcuuagaauuuucccuuuuuuuuuuuuuuuuuuuuuuuuuuuuuuuuuggcuuagaauuuucuaagaucuuccaaggugcucaguugcuuauuuaaauuauauuauuacuuaacuuacuguguccugcucagaaaugugugcauuuuucagcagaccaacuuuuuuuuuuuuuuuuuuuggcacaucugcucuuguuuuauuuugauucaggacagcguuucucuuuguagcacuuggaacuugcucuguagaccaggcuggccuuaaacucagagaccugcccgucucuacccccaacgugcuaggugugcagcaucaccaccuggcuauuuauuuguuuuugauuuauuuacuuauuuuuaaaucuauauuauuaacuauuacauguuauauucauuauacuuuauuuacuuuugauaacauuugcuuguuaauaaaaguacuaacaaagauacuauagagaggaaugaacuaaaaacuaaaauuuaccaucucuacuucuuuugagauuauuucuuuguucuugcuuuuuaacuguaagaaaaugugaacauugacuauaaaaauauccucgaugacuucagaguauaagacaaucuguucuuucaauugauuuuuuuuuuagguuaacauauaagauauauuguuccauaaugggcuacucaaacauuugucaucauucuuuguucucaguuaucccuuccacagcccuuugcaguacucacugccccucccaggcuggcucccuuucccuccuaccccccauuuacuuccccacuuccuguucuacuuucuccccaccuccucccccccaccucccacucacagacaggguuucucuguguagcccuggcuuuccuggaacucacuuuguagaccaggcuggccucgaacucagaaauccgccugcccuggcucccaaguguugggauuaaaggcgugugccaccacugccuggcucccuguuuuacuuucuuagugcaggauuucuauuuauugcccucuccauucccugcccuuuuuaggaucuuuuccuuuccugcaggucuaauuuugugaucugaacauguaaauaaauacacacauaacaaguuuugcauagaagacaaaacauauaguauuugucuuucucagugacuuucacuuauacuucuaguugcauucaucuucuugcaaacaccauguuuucaauuuccuuuuuuuaacuuuuuguuaauuuuuaccuaauuauaaaaagaaaaauaggggcuggugagauggcucagugaguaagagcacccgacugcucuuccgaaggucuggaguucaaaucccagcaaccacaugguggcucacaaccauccuaacgagaucugacucccucuucuggagugucugaagacagcuacaguguacuuacauauaaauaaauaaaucuuaaaaaaaaaaaaaaaaaagaaaaauaauauaugaauacauauaaucuauauacauauacuuauuguuaauacuuagacuucucauuaaaaugauuuuuccuuauuugugaaaaaauaugacuuauuaaauggcauugacaccaacuucucuguagaugcccucaauuccagugucaacaauuccuuuucaaaggcagaagacagaaaaauuuagcauuugccaaaccagucaccagagagggaaaaguagcuugugguaaauaagucaauuuucuuuuaaaauuaaaaaaaagccccaaauuauucccauuauuucauuuuuguguguguguaugaaauaaucuguuuuuagagaaacuucuuugaaauaauuugugccuuaacaaugagacccuaccauuaaacauaguauacaugagaaauugaguccuccacugucacuuucuuauauagauauuaaaauauauauuacuuaaaauauauuacugggaagguaguuuuaaguugauuuucaauaguuguaucaaauguaaagcauuaaaauaaauaaguaaauaaaaucaagugggcugguaagauggcucagugguuaagagcacugacuuguauucccgagguccugaguucaaaucccagcaaccacauuguggcuaacaaucauccauaaugagaucugacgcccucuucugguguguuugaagauaacuacagggcuggagagauggcucagcgguuaaacgcacugacuguucuucugaagguccugaguucaaaucccagcaaccacaugguggcucacaaccauccguaacgagaucuagcgcccucuucuggagugucugaagacagcuacaguauacuuaaauauaauaaguaaauaaauuaaaaaaauuaagaaaccuuaacuaagacaggccuuaauauuuaaaaaaaaaagaagacaacuacaguauacuuacauauaauaauauaaaaaaaacuuaaaaaaauaaaguaaccaagacucuauaaagcuacugcuuagccuggcgugguggcgcacgccuuuaaucccagcacuugggaggcagaggcagguggauuucugaguucgaggccagccuggucugcaaagugauuuccaggacagccagggcuacacagagaaacccugucucgaaaaaccaaaaaaaaaaaaaaaagcuaaugcuuaaacuuuaggaaaugucugccuacugcuuuguuuacuagguauauagguauugaaacagaggaaaaggucccuggccgucauguuuugcaaacagucuuuugacuguucuauaaauagagcugcagaguacucauggccaaguccagcacuuagcgcacacuguuguaaagcaacaagaagcuuuuuccuugucacgucugggaggaaacaguucugacacugcuccuugacagugaacucuaagauaagucgcagaacagugacuggaagaaagccugcucacuauaaaccauuuacccccagagcuccgggagacuuugugcaguggaggagcgcaguauagagcagucagaaugguaaccgaaggaacuggucuauguaggccaaggcacccucaccuggaaggcauagaguccacuguauguggaccacauauuuuucauccacucaaucuguugaugcugcugugaaugagagcagugaaugugggugugcuagcaucucugugggguaguaacuuacuggauauguacucaggguuaaauuucaaacugaccagcaccugaggugccuauuuaacauaucaaaguagaucuggcccagaucaugcugaagaacauucaguguucuugaccugugugucaucuccuguccagaucuggugagguuuuuuguuuuguuuuguuuuguuuucuuauuuuuuucaagacaggguuucuuuguagcacuggcuauucuggaacucauuuuguagaccaggguggccuggaacucagaaauccuccugccucugccucccaagggcugggauuaaaggugugugccaccaugcucggcuuuuguugaguuuuuaauuuccaacauuucucuuucucaaaaauaugaauuuucucacuagauuucuauuucacucacagugcuggauugauuucucaucuguugaaauagauaguguggugcgggauggaagugugcgggauggauagugugaugcgggacgcagcuggaaguucuucacccauaguguacacgugcaugaugaggaucagggacuuuaaagauacaaaccaucaaagcuuacuuaagcagaaauagguuguccaaauagucccgucuuauaaagaaauugaauauugaaguuaaaaacauuuagccaagaagaauuugaucccaguauuccuacuuuugaauuaugucauacauucuacacaauguuauaugaaaaaauaaaaaaggagggaucauguagcaauuuguuuguaaaaccagaaguacucucuuaaaaaaaccaaguguagacugugagagaauagaacugaacaucauuaguauucuaguuuuguuucuguucuuuuuuuuuuuuaagauuuuuauuuauuauuauauguaaguacacuguagcugucuucagacacaccagaagagggagucagaucuuguuacggaugguugugagccaccaugugguugcugggauuugaacucuggaccuucggaagagcagucgggugcucuuacccacugagccaucucaccagcccguuucuguucuuuaaaucagacauuuuugugaaaccacaguaucagaaaaugucacuuaaugugauuucuccuaucucucuuggauaucaguacuuucuaaauagguaggagagaaccuaauagaucccugaaaggaaauaucugguguuuggacaauggauuuuucuuacuccuccauuucuguguguaugagaacacgugcacauguccuguguuugcagaccaaaggacaacuuugaucauugaaauguaggugcuuagggugaggagagaaaggcagggcuuuaguguaaguacuuacauaugcauguagacucuaguguaagccuagugugauggugcauuacuguauaguagauacaggaggaucacaaguucaaggccagccucuacuauauagugacuuugagaccagccugggcuaccuauccuuucuagaagaauggacuguuacgguauaccuguaaugacagcuuucuaggagcugaagcagaaagaucacuugaaucuaggauuuugagauuagcaggucuaacauagcagaaccccagcucaagcauauagguaugcaaaauaagaccauuauauuuuauuuuauuuuauuuuuuuaaagauuuauuuauuuauuguauguaaguacacuguagcugucuucagacacaccagaagagggcgucagaucuccuuauggaugguugugagccaccaugugguugcugguauuugaacuccggaccuuuggaagagcagucgggugcucuuacccacugagccaucucaccagcccccgauaagaccauuuuuaaaaaauguauuaauucuugauaggugggcuggagauggcucagcaguuaagagcacugacugcucucucagagguccugaguucaauucccagcacucacaugggggcucacaaccauuuguaaugggaucugaugcccucuucuggugugucugaaaagagugauagcguacucauauaaauaauacuuaaaaaaaaaaguaucuucaaaaauaaaauuccugauagguauaguuacauaccuguagccccagugcuagaggcagaaacugcucaauagucaauuagccuauucaaaacgggaaguucccaguccugugagagauccuuucucaaaaaauaauugguugaauaaggcacccaacaugcacuucucacuucaacacauguggcccaggugagcacucucgcauacacaugcacacaugcauacaccacagggacauaugcauacaaaaugucauaauucuuaucuaacgguucauaagaaaaaaauaagugcugaacucaguuugauuugcuaaucauauauugcccauucuuuguuuuagagaagagaagcuuaauucuuugauuagaauuugcucagaguguuuuuguuucuucaacuuuguauuuucuucuauauuuugagcaccuaccacaaauucaccuauuugaaucuagcagucuuugcucuucaguagcucucuuguuuugugccugugaguguucuaagcaucagaguuuugauaagugguugcuauuguuuccuuagcuacuuuguuuucuaugggggaacaucuaugguuuauuuuuacuuugauuguuuugacucaugugagugugugugagccugugugaguuuguaugugccaugcagaggccagaagaggguguugcauccauggaacuggacuuacagucaccucugaguugucaagugugugcugggaaacggaacucgguccucugguagagcaucaaguguucuaagucacuggaccacucuucagugaugaucuagucauauuuaaguuguaaaaugaaaaaaacuuugcauugcuucuguauauaaaauguauuaacauucagagauuacauuuuauagcuuuucauuucuguugguauuuugugcacugaaacugcauucugaggucaauaccuuccucaaaucagauacaaagagaaaaucccaaauaaugguguguguuuguuuaugcauguucgcagaugugugaccauccauuccagaggcuaggauggcacaugaagcacucuccuuuguagaagggcccccuucaguuucacauuguguuccuuggcugcuguuugacacagucuaaagucacuugggaagagagucucagugagggcuuaucugaauugcacgccugugggguauugucuugguuaucaguugauguaggaagauccagcccucuguggguggcauuaucuccugcgaaggagaucuuagauuguguuaaguguaagucuucacaguugcauagcacguacuguagccaggaaaccccaucugaaauauauaaauauauauauauaaucuucaaccucugguauauuaaaaaaugguuucuuuuauguuuaguaauaaguagauuuuuuuuuuugguuuuuguuuuuuuguuuuucaagacagggguucucuguauaacccuggcuguccuggaacucacucuguagaccaggcuggccucgaacucagaaaucugccugccucugccucccaaguucugggauuaaaggcgugugccaccacgcccggcccaguaaauuuuaacuauugaaauauuucugcaaaaaugggagacauuagcuuugaaaaauaccacauaucauuucaacaacaaaaaguguuggaauaagugugacuguggguaacgugagucuugccuauucuuugugcaauugaacugcuuaccugggucaguaaguugcucauuuugaagauguuucuuggcaucuacaggugaauggauauucguguuuuuaaagaaagcuuguuuucuuuuauguagguccuuccacagcgacaccgcauucuuuucgaaguguuugaugaaaaucguuugguaaguucugucacacugcaugaguguguagguugcauugauggugaacuucaggagagugguggcaguugggucaggaaccugagaucugagacugaucugagagacuucugagcuacuaauggggcuaugguauuuuucuuucuccuuuccuggaguuaacccucccauuccauucuguucugaaggaccuguccugcuuguuaagacuguaaagucucucucaacgccuaugugacagaagguggggaagggaagccguuuuuccucguuuuccaugccguguacucugaaucugcaguuguguguacugugugucugcuacagugcaccaccuaccggguguguguguguguguguguguguguguguguguguguguguguguguguguguguguguguguggugugugugugugguguguguguguggugugugugugugguguguguguguuucugucaguuucaguccuuaggcacaucauaacuuuuguuuugagacagggucacauuggcuuggcaccuugccaggaaggcaaagcucgccaccucugaguauccuggaagcuguaugccuucaccucuuaucucccagugcugggaauacaguguguaucacugugcccaucuuucuguguggauauugggcaucagaacucaggcccucaugcuuaggaggcagcuccugugguggcuuuucuucagguuuccaggccccguuuuacuguccgucuacucucuucuacgagccugucuacacugagggagugagcaucauucacaaaggcuaggacagagccaaccugagugcuuucauugguuuggcuuugguuuuaguuuuaagauagggucucccuacauaucgcuggcuuucuuggaacucacucuguagagucgacuugcucugaccuuggaacucagucugcaggucaggcuggccaugaacuuacagggacucuccuauuucugucuuccaagugcugagauuacaggccugaaccuccaugcucagccugguuuucuuucauuuuuauaaaauggccauucugccucuugguuuccugaaaaacaucuggaaacuguaauuuucucucuuuagggucuuuuuuuuuuuuuuuuucuuuuucuucgagacaggguuucucuguauagccuuggcuguccuggaacucacuuuguagaucaggcuggccucgaacucagaauucugccugcuucugccucucaaguacugggauuaaaggcaugcaccaccaagccuggccugaaucacuuuuuugacuaacagaaaaacuggauuugggguuggagaaacggcuuagugguuaaaagugcccgaugggcagcuaugaaaaccagauuuuggauuucauuaccaggauagcaaaccagguauccuaggaaugccauguaaauuccagcaacucccguucagaggcgaauggaugcaggaagauugcugcugcuugcugguauuuagcccaccagagaaaacaugugaccuaggagagagacccugccuuaaaggaggagauugguaggggaacacacaucacagccucuauguguguaucugcauacacauguauacauaaacucacaugauuuuaaugaaaacuuuugaaaaagaauauuguuacauuguauaacuuuauuuuuaagaaaugauaauugagucuggcauggaggcacauauuuguaauccuagaacucuguauugagacuuucaggcaagcuggguagucauucgaaggcaaaggcaggcagaucucugugaguucaaggcuacccagugaguuccagggcaaccaaggcuguauagcaaaaccugucucaaaauaaaacaacaacaaaaacaauaacacagagauagauagacacacaccacgcgugagugcgcgcucacacccacccaccagccuuucuagagaguuguaggcaagccuguacuaguacuaggagacccugccucaaaaauaguuaaaaacaggaaaugauaaguuguacuacugacugaugaugcuccguugaaaaaucauaauaaucaaagcagcguuuuuacuuuaacuucacucccugugcuaauguucaugcugaagugacuuucuuguuuguuuguuuguuuguuuuuagagacaggguuucucugaauagccuuggcuguucugcaacucacucuguagaccaggcugaccucgaacucagaaauccaccugccucugcaucccaagugcugggauuaaaggcaugcccugcugaaguaacuuucuucuugauccuugggugucauucaaguuauuuaaauuuaauccagagggcaagacagcuccuuuuauuuuccaccacgugugguuguuugguccuuccuuccagugacuuccaugggaugugauugcuucuucauugucagcaucgguguugucaaacauauuguuucauuaacacauuugagaauuuauaugugugugguucuguacugaguauaaugaucuuggaggggcagugcccuugguauuaguggguuaaacacuguuagaugauaaauguggcacuuccaacuuuaaagcucauaagaaaagguguuuucuuuuuaauuuacucugugucugugugucuggucuguguagcauuacucaguguguagcuuugugcagugcccacagaagguagaagguauuagaucuuccuggggcaguugugagcugcccagcauggguaugcaagagcaugugcaguccuagcugccgcuccaucucuccagcaccaaagcuuaaaaauuuaagauaaauccaaagcuguguauuaguccagaucauacagaucccacagcaaggacucuggaguuccauuagggucucagcucucauuugucacauuagugguaaccccagacaaaucagcaaacaggacauggaagugugugccugucaccgagugcuugagaagcagaggcaggaaaacucauuuuaaggucauucucagcugugcaaggagccaugcuaccagccugggccuguaggagagccuacauccaaaaccaaauuaauuaguuaaacuaaaaguaagacaagggcugggaaaacacucagaaaaauauuuuucuuccccaagacaagaucucacuauguagcuuugucuauccuugaucucauuauguagaccauacuggccuugaacucacaaauaucuuucugucuuugucucccaauuaaguguugggauuaaagguauuuaaugccacaccuggcuguuaauauuuaguuuaauuuaguuuauuuauugaggcaggguuucaugugucugucccaggcugaguuaaaacucccuaggauagcuaaggaugaccuuaaauaucgaucuuccugccuccaucucuccagugcugggguuacauguaugccuccacaucugguggcuuucugcauauuagacaucagucugccaacugagccuuguccccaucuucuugagaauaccgauuuaaacuguuuuaacauuuaccaugguaccuuauuuaugcugugaguaucugcugugacagucuucauguguccuggaauagagcuuucucugaaagugaauuugagcagccagcaggggucggaaauaacgagagcagugugcugagcaccacccacaccucagcucauaacaaguuuagaaaucaugucgaugcauuggaagucguagccacugggcuggccaguccacagcagacucccaacacuauaaacaucuauccuugaaaacauauccuagcagaccucuuuggaaagagaaaggugaagagcacaaguauaauuuuuuacaaaauaauuuccaggcgucuggaaaauguuucccgaaucauguaucauuccugcuuuuuuuuucuuagcugguuuuaaggcuugaggugaugguggcagggguggucuggguccugaugauuaugaaaugaaagcaggcaggauuucucuacuggagguggagagauggcucuuugauuaauagugguauagaggaucugaguuuggcugucagcacccaugucaagcagaccacaacugccuguaacucgagugccagagggcucuuauuccucgggcaucuaggacacggcaccuauugcauauguacaaacacaccugaauaauuaaaaauauuaaaaauaagucuuaaaaacaaguuacauugccucuuuaugaaacacgccuucucucuugagaccuucagcugauuggaugaggacuguucacaucuuggaaggccaucugcuuuuacugaaaggccggccacugguuuuccucuucuucccgucuuuagaaauaccuucaacaauguguagauuggaauuuguucaaacagccucgugcccuaauauaguagucagaguuguuaauuacagcuacuuaccacaguaugucgguguucaagguucaucugcaaucauuagcaucccgagcugcucauauagcauagaugaucacuuuauccuauguguauauaaccagugauccagcagcucagagugagcagccaagcuucuuccacccugggguccuguccauuucucuucagacucuggguuucgacaagacagcagaauacucccagaugagggcugccagcacuucucauuccucuggcuugaacuuggaguugauacuggcccugguaacuacgguguguggcucugcauugccugaggucugagccuacaauuugggcuauucagcauuuugggauuuuaagucaugauugucuagccuuauuccuccaguuucucaguuaucaaagccucucaucuaucauugaaccuaacaaguaaucauucagaagcagccacugcauggaguuaauaucucauguggccaggcuuuccucaaacgcuccauacacugaccucugaucccccuguuuccaccucccaaaugcugggauugauuagagguguguuaccccauaccauguuuauagggugcuggguguguuauccaggaccuugugaaugugagguaagcacuuuaucaacugaguuucaucuucaccugugagucaacuuuaaaaaucaaagcaaacacacaaacaaauccaagcuugguccuugguccuugcuuuauguucaguagaaucagaagaagggaaaaaggggaaaaaaagccugcuuguguuccucacacucuggaagauuaaaucuuaccgaaaagcuguuuguugaggagaaaacaugucagauauucagcauuguuuuauauuaauaaucagagcuuuuucucacuaaguuuuauuccaaggccuguguacuuagccgguacugauugucugacuacaagugaccuauugaauauggcaaacgccuaacuuaauccaaaaaaaaguuagaagaagaaaccagauuaggacuuugcucccauacagaagcagcguaauacacggcaguguuuccugaagucuguaaaggcauaacgggcuaagcaaggguaauguccauuucagucgaacaaaaccuaacagauuccagucuguuaugguuaacugguuaaaaauacuguuagaaaauuggaauucaaaacagaucugacuuaagcaguuuucuuuuuuaaacaaaguauauguuugacacauuugcuuuuacuuaggaaaaaaacccuuaaguuagaaaaaauacagcuuggguguagugccauguaguguaaauaacucaacuauuuugcuaugaaugggccaguauauacuuauugcuggaguucuugcuauaaaauucagguaagggguuuaaauauacccuagaguauuauuuaaaaauaaauuugcuucuuucaaauagaauaccaaccuuggucugugacauuugggagagaaauuaaaauauuaagccuuuauugccgaguaagcugaaaauacaguaaagguuauguaaacauaaaucagaaauauauaucuauauauacagagaaucaccaccucugaaggacaagccgucuacuguucucugcugugagaguuuuaucaguacucguaauucuaccucagaggccaugcuagugggcaaagauguaaacaagggccugccuuguuuauauuaugaaauauguggccugguuuguaugucuugucuuuauaggugucuaacagcugccuggguuguuuuaaagcaccaguagggcccgcagaggacucuccgagaacaggauugccauugagauauguuuauuugauguguuaaauccuuuuuaggcuucuuuacuuaccacaacacucucuuuaagugaaugaauugcacacaguggaauaaaauauccaauguguucagacuauauugggguguagcuuuucugucuaaucugcauauguuuuuaauggaauguuuacccaggcuauuucuuggcaggauuuuaauagucaaaauauaaauggcaucauuuaaagacuguacuacuuggcugcauuaaacguuaaaauuacaggacaaaaugguuggugacagcuucuccucagccuuuuuuuaaaaauuuccccuugaggagguuauuugguguuuacaacaauguuacugggcucguuuuguaguucaguuugucaacuuucacuuucauaauuguguuuugcuaaaauauuuaccuuguucaauuugacgguuaggcuuuaugccccucaccccacguuuuuguauuuccaaguuauucagcuguuuucauuuacucauuccugaaaaaauauuacaguccgcguagucccugcauuaaaccugacuaaaucucucaguauggccauauuuugaaauucaaucuuuaauuugauacucaaucacacagguuuuauuuguacccauuuccuguaauccuauagcauucagugaaaauauuagcggugaggaucaccgggggaaguuguaggcacugagauuucgggaguuaaauguucguuuuguagggcuggggugaaaaacuagguuucccaguugaaauugaagaagcuuguuguucuugcguuacucauucaugcaaauuggcgaagguauaauugaaacaagguuggcuguguuugagucagggcugcagcugagcucagcuuaaaggucgcuggaaaucaagugcuuugucagugaaggcguucugacucccggcgauucuagacacuuggggaacgucaaucucgggcaugggucguccuuuucuaugaaaucugguaucugaaguuaaagacgccuccccacgagcuuuuucaacaccgccgaugguuuuuuccucuggaugcagcacagcugcgcuagccugacuacagacagagcucuuuguuuugacucucagcccugaacaugcuuggaaaugagaacaaauggcacagaguuuacgacugcacuuugccgccagaagaagcaagacuuacccucugucggaacccucuggagaugacuuggauagccacguugacacacacggccagaggcggccccggaucucaguggcuagugugguucaaaugaggcugacccccagacaggcgccacaggcuccguggguagagcauagauccucugaaaguacugacaaaaagagcagcugccugcagaucucacugcagcccagauacggagggugucuuccaucugacacugucguggcugauagggacaguacuuccucuaccugugcuucaaaggaugauguuugcagcagcaguggaauugacagugagcuggacaauggcagccucaguaacuucucagccagugacagugggucuuacagcagcaguggcagugacugugggucuugugcaagccucgcaaguggaggcuccuccaccggcaguggugucagcgacaguaguggcuaugagaccuuuuucaguggaaauuuaccuucugacaacgccuccaacagaagcgugccagucgacacuacaccccgugaaguuaugugcggaagucccaguagacuucccuuugcccaggaggaccuggaucguggaguagagauuaugaaacugccagugaguaggaacgcaaaggguccacugaagcgcugcacgucuuuggucauuuuccccaggaguccuucaaacaccccaccagcauccccgacgagcagaggugccuaccagaccucacaccaguugguuguaucaccuacugaaacugcacaucaugaagauggaucuggcaccaaaggcuuucugucaacagcugucaacgggcuucgauuaucuaaaaugguuuguacuccuggagaagucagagauguacggccacuccaugccaagggcucauugcaaaagaaaauugucauuucaaauaauaggcccaaacaaacugugugugagaaguugccagaaggauuuuccuguguuuccgugcacuugacccaacaaaaaccaacgacaucagauugugcaaacccccgugguggcugcacaucagagagguuagaacuucagcugcagucugauuuggaccauggcaugcucaaacagagggcauccccuugcuugccaaccgcaucagacauggguuaccauuuaaacauccguggagaguuggaaagaccaaauucaccgauaagcaaaggccaugcugcuuugcaaagaaguguuucgcugggugggacauacccaaauauuuccugcuuauccagccugaagcacaauuguucaaaggggggaccaucucaguugcucauuaaguuugcaucugggaaugaugguaaaguugauaguuucuggagacagagagacuugacaaaugaacugucugauguuuguaagguaagauuccucuggucuugaaaaaauacuuccuggaauucuuagcuauacugauuauacuugauuauagcacuaucuguuccuuucuguggcccuuagugaggaaguuuuuagaaagcuucaauuuuauauuuguaaagcucuuucuuauuuuaccaauggauaaacuacuuuuaaaacaaacaaacaaaaaaaaaaccaaaaaaaccuuuccuuggugauuuaaauccuaaaauucuuccagaacuggcucgaugucauaacacucgaucuugggauauuuguucuucuuaccuucagaaaugggauuuucuucucccucuuaaaacacauguauuuguaagaucgcugaucaaaaagacuauuauauugaauguuucaagcagaggaaaaguaagugggcuuugcauuuacauacacccuagccacaggaaugcuguuugcacccuauuuuuccugaguucccagugaucgcugucucccaaaauguaacucacuuuuucagcaguauugauuucuaaguuuuauguguuugaauuggcuuaaacguacuagguaguuucuauaauuuucaauuuacuacacuaguuuauuguucucacaauguugcuuuauuuuauuaguaauuuagcucuaacagaucuuagccagauuggcauuuuauguaauuuggccuuuucaaauuauuuacaaucuuuaaaacuaaaguagccuuuaccaugucuguauuuggaagguuuugcaaaauuccaggaaauuuaauuguuuuucugacgacauuagcucuagauugacaacacauaugcuggcuggcgugcucuauuucuuucuugugaagggaccuugcuucuuuucauggcaaugccuguauuaaauguuggaggaguguggggggaauccagauaaugucuagacagauggaguuagaaaauuagguaauugggcucuuuuuucucucuuuugaaaucuggaaaauauaaucauuguguccacccaagguuaaucuacgcagcuacuucacuggggauaagagaagauuagauuucaaaguuugaucuuuguuuuagaguuauucauuccacuugcaaaauuuuucuaaaacaguuuuuggaacauuauaaucgguuuaauucucuuccccaaagugcuggguccuuaaagcagcauuaguacucugccaauucagucgauguuacucacagagucuacauucaaagaaaccuaagaaguuaugaaucugaaaagaauucuagaaauaguccagagacagucguuacuguggcagcacuaucauuugccacugaugcuuuccaaagagguacuuuaaauacacccagugaaguauauaaacucaaugcuguuugcaucgcuaagaauguuuucacaggccuuuaaauuuucuagcaaacuaacaauuacugcuuuguaacaaccuaauccuagucucuuaguuguaaaaaaauacagaaggugcuauuugucugagaacuuuaaauuguucuucaacauguauuaaacauaaaaauaguauaagugacauaaguuauauuuacugucuacugugucuaaauuaauucacuuagaaaugacaaauugagugcuuaugcuaauuccuuuucuaaacacggaguggccacaguaaugacauuucagaaguaauggcauguuuaucaauaauauauuaaucuaauuauagugguuuauuguaacuagcuuauaaauaaacagcucccaaaauauuucccaugucuccaguuagucuggguucguguucagaugugcugagacugcauccacauuuaacaaguugauacuggagucgcccuugguaaugucagccaucuguacugaguagcagugaaaucagauaacagcuuuggucagagacccuggugaggcagagaggucucaagucucuucucuuguauuuggcuaugagcucacagcagccucuucucgaguuuacagcucucuuauaauccuagcuuguaaaugacuaauguuuaauguguaguuaggacuuuuuaccuguaucuaagacauaggcuauccucugugcuuacagcugagacugaaaaaugguuuccuaaaaccugccucagugucuauuucaggugcagcaaaaaacaaccuuugggggauuuuuuugugguugggucucuuuuugcuuuguuuugugcauuucaaaugcaauacuguguagguaaaaauauaugguggccuuugaucugccaggagaaguuuuguguuucuuuggucaguaugguaguuugucaguuuaaggagccaaggugacauacacaguucugaaaaugaauacugaacuuucuaaagucuguaguucgcuuguuuauuauuaguucacuuuucccugugucguauguucuaaaucucauuguuggugcugagaccuuccauugccuuguuuagaauccuuccagcuccacccuggcuuggaugugcuuuccuuccaucauccagaaaugcugugcuuuuuguuaugaaaggguuuccugcuccucgucuaguacuuaacccuagauaagcauauugcuuaguccuaaaggaauagauccugaaauaguuuugucuuuuuuuuuaaagauuuauuuauuuauuuauuuauuuauuuauuuauuuauuuauuuauuauauguaaguacacuguagcugucuucagacacaccagaagagggagucagaucucauuacggaugguugugagccaucaugugguuguugggauuugaauccaggaccuucagaagagcagucagugcucuuaaccgcugagccaucucuccagcccuaguuuugucuuaauuauaauguucaccauuaaucuccagaugauacaauucaguaauuuuaaaauaauucuuucugauaucaaaagcccagauggguauuucagggcaggaauucuccaacacuguuuauauuuggagccagguaaauuuuuuuguggguggggcuguuuuuugcacucuagggugucaagcagggagcagccugaccauccgacacuagaugccacuugcacaccccaaaguguaccagucaaaaauggcuccaggcauugccacguguccucuugggcaaguugccuccugguaagaauugcuacuuuaggcagaagucuugguguuugaaggccagaaaugugcaagagccuuagguuguaagucacucagugugacucacgggagaggugcagaaggccugggggagccggggggcaugaugcuuagguuggagcuaaaguaggccugcaaagaaguccuuuauguccuguuaacagaccacacuuaguaaauagacaucuuuauguuuuuuaaauaaguguggggguaucugugugucucagugucuguggguuugccugccugccugcaugucugugguagguauguauaugugaguuuagguguccugagacuagauaucucgaauccucaggagcuggacuuguaggcuguugcgagcuuucugcuuucuguguucuggggaauccaacccagaccuucuauaagagcgguacauacauagucuuaacuacugagcuaccauuccagccccaucacuuuugugcuuuaagauaauuauuuguggcaccaggaauuuaagcuacucuaacuuuucuuaccuugugugauuggauaaacacugaugcccugaaguaagggaguacaggagguaagaccagccugagccugaguggugcagcagguacagugagguccugguagugcugcuggaggaaugggagcugagcccauagaggagcucggaaucuccaccaauagggaggacugugcucaaaggaucaucucagcugggccaugcaucacaugaaacacaguggggaccacuaauuaugaggacaggguaaaagaagauaaaagggagacccagugagcuccuagacuggccaggagagguugaugacaugcaggcagggaagggccagcagaaagcauaugccucuacagagaacuucauucuccauugcaugcaguaguuaggagcucauuggugacuccagcaaaaguaagcuaggaaaaucccaggguuagagcccaaggugaaaugauaacauagcugagaacagcaagcauagaugccauccuacaaugagugcaguguagaauagucagguacgguuuaaugauuguuacaaauaagacucagcauuuugugauuuaagauggaauaagacaaacuacaucccuacaaagaaagugcugucuuccccaggaaugggaggacagggcucuccgcucuucaccuuggcaccuuagauaggaaaguaugggugguaaaacccagacuggauucugucaguguuaugugagggaacagaaaacuguauaugggaacucaggacugcaaugcauagccacaauuccucuuuaagaauaucauauuuuauuaagagaauuucaugcuuugaccauuaucaccccuuugucucaauaacuccuuccagaucuacuuuuacaaccucuucccccucccaccuuuguauccccccucccuuuuuuuuuauagcccacugauuccauggguguggccauccaccggaguaugugaacaacauugcuuugcuuuucucagccucucaucugacaccaaaaauaacauagagcugacaagauagcucagcagguaaaggcacuugcuguugaccuuaguuuaaucccuggacccgcaugguagaaugagagaauuaacucccacaagugugcucucaauuccacauaugcacucugacauacuccuguguguccauaugcaaauugauaacuauaauaaaacauuuagagaaaauaaaaccaaguagagccucuauguagaauugagccaagguuuuuaagguuauggccuaaaaacuuugggauagggagccugcccgagcuagcuguuguaaacuuuacugcacugugauggcugacaagacaagauuagaccugggcuugggagcuuggccaagcaggaggcuuggcagcauugcuggguguggccaggccacgugcugagguugagagcaagauuaagggaagggaaggcugggggguggugaagcaguuaucugucagcauaucuucggaguguccaaagccuugcugguaucuucuucaggcuuuucuugugggaagguugugacaggugcuucaagaucaaagaaaaauguuugaaaacagccuaggagcugucuagucugugaucugaucugggggcugucaacauggaagugguugcugaaagcagccucagcuuuguuaagauuuaaaaggcuucugggauauaaucccaccuagcagcaggucugaguguggaaagagaagcauuuggcauggcacugaguccuguagcucagcucaccagcuauaggaaacaccucucaggaggcagcucacacauuuuuagauagguucuuagacgccuaugggagauaguacagagccaugagccauggugcuuucuagaauaaauacguugccaaacaaagaauuugcauuaagaauauuaauggugaaugaaaaugaggacaugagcauucccgagcaugguugaggauaggguuguauuguuggccugagggagagcaugccuagagacagccacaggguccagaauaaacuaggucaugaaaacaguggggagagaaagagaauggaggaugaaagcagaccaagaaaggaucugccugcauuugucugaguaugggaauaacugaguuccagaaaagccagggcuguguagagagaccuuuacucaaaacaacaaaacaaaacaggguuucucagugcuuagcuucucuaauguaccaggaugggaugagucugauguuucugucaacacuuagcacugucuacauucacgcucaagaauuuagaaaguggacagcuggaauucaugauugaauaaaacaguuucacagaagagagaaaauaggaauuuaaagaauggguguauuacuacucagaucuucuagacauaagucagugcugacuggaggggugagacuugaaaagauaagcaaccuucguaacugguuggaauugauggcuuuuuguguguggcaauuuagauuaguuuccugauacuguguaaguugaccaacacucagcuuauauucagauauuuagacccugaguauccacagcagagaggcugcauuuguguuugguuuguugucaaucuuaaugacaauaaugcuauccagacuuuacaaccuuaaaugguuaaguauguucuuaucauaugguggcauuucauuugaauugaauuugcucauggaaauaguugggcacuaaccaaaaucugccauucggaaacacuugugguauuuuauuuuuuucauuuauuuguuuuuacuugauauaugugagugauuugcugccaugcauguuaaguguaccauguucaugucugaugucugcuaaacccucucucuagccccauugugaguuccuuuaagaaugguucuuauguuacauuuucccuuuucaacacgaggacuguuggcacguucuguuuucuuuaacucuucuggcuuauuuaagcaauguuuacauccucgaagcauucuucagguguggcagucaagauaguacugagacugguuaacucuuuuuuuuguuuuuuuuuguuuuuguuuguuuuuuguuuuauugagacaggguuucucuauauagcccuuucuguccuggaacucgcuuuguagaccaggcuggcggcuggccucaagcucagaaauccgccugccuccgccuuccgaguggagugcugggaucaaaggcgugggccaccacgcccagcugagacuguuuaacucuuaaacugcacuauguaaucacugagacauuguauacucuaugugcacaguuguggcuuuuccuuuugcuacuuuaaaggagaaaguugaaaaaucacuuuuuuuuuguuuuuguuuuuugagacagguuuucuuuguauagcccuggcuguucuggaacucacucuguaggccaggaacucagaaaucugccugccucugucucucaagugcugggauuaaaggcaugcgccaccacugcccagcgaaaaaucauuuuuuauacuuucauaguguuaaaauaauauauuacuuuucaacucuaaaucaacguuaaaaauucuuagaaauugcucuuucuuuagagcagcuuacaugacuuuauccagggcugcuaggaguuggguucccagcacccacaucuggcagcucacagcugguaguucacauugaaaguguugauuacugaauaaagucauggccccuuugggaugagguggagaggaucuugcuggcuaaggcugagcugacagccuggcagggacagaaaaccaaucuaggcuauuuaagugaugacuggacgguucuccuaaaugaauaucgugucccugggcugagugccaauggaauauugugauccugagucaaggauuaguuuccacaguagacucugauucauagccugcacauuccacucacugguaaccuagaacuuggugucugcauaaaagccccagaucaaguuuucugcaaggaaaauugaauggagaaagacuugaaaggacauuucagcaaaggccaucaggcugccucacaguuaucauuguucgaguuccuccaagccugaagcugggauccucugaguaggugcuaguuucaaaugacuauuuuagcuaagaaugaccuucgcccucuuacggggucauagaccuuaauggacacucaagucaucuucaaagcaaaugcguuugacuaaaguauuuaccagaaacugaacaccuuguauuauugcccaauuuuuagacacagugauggacacaggaaaauguuuucucucuaugcaauauauaacuguauuaacuuaggguaaaacguauuuuaaaaaguaauauuuacuuaaccugauucucaaggugcuugugggaauuaauuugcaauacauaaaauuaccugaccuucacauuuauugucugauuuaccuagguauauucuggaaguauaucuaguccucgugacuaauucaaauaugucucauaauauuaaaauauuauuuuuuuaacacacacugugaccuuuugcauucuugacaauaugcuaaguauaagcaugcauuccugccacuuacagccauagaaccauuuauuagaaauuggucagagccgggccaugguggcgcacaccuuuaaucccagcacucaggaugcagaggcagaaggaucucuuugaguuugaggccagccugugucuauagagagaauuccaaaauacacaaagaaaccuugucuuggacaaaaccaaccaaacggaugaauguaauagaacaagaugguucaaucaguaaagugcuuguugaauaagcaugaggacggaccugaguucaagucccaccucacauagauuaaagugggcaugguagcauaugaugggaagcagagauaggcaggucgcuagggcuugcaggucaguuagccuacucaaaugaugacgcaagauucuggugggagacacugucuggggaaaaacaaagaaagaugggugauggcuggggaaugaaugaauuugagaguguccugugguuuccauauauauaugcacacauauacauucccuucagaguaagacuaggaaagguaccacgauggcuuccugcuaggguuugguuugggaugcuuaccaucauuaugucaaaaagacucagcuagaauuuuuaaucuugaaggagaacuugccauauuguuccacagagaguuaauuggugcuuguauuucauauucuguguuuuagaaacuugccaaacaguuaauacuucugcaugggaaaugaaggguuaaauaaauguucacaugccugacuugggccccacagacugaagcguagugccuccauggucuaauaguguuccugcucuaccacaggcaaacagcacuuuaccccugcaguaggagaacccaacuggggcaagcugcuuagaaaagguuauuuugguaaaaaucacaccagaaggaaaaaacaagugucuggaggaaaaauuccaucgugaugacuccgaccugaugaauaaugucccagcuggguagcguguggcgcaggucaaguccauccuuccugcaguuguugagugacaggaaaggcuggagaugucagcuacuguucccggauaauuaacuucccuuuuaccuguuugguuguuuuccccaucuuguggccaaaggagugaaauaguucauuuuguugauuacuuucuguuuuucauguguguggaugggcaugugcuuguggacgcucagguuaauguugggaaucaucucaguggcucccccaugcuacuucugagauagggucucucaauccagccuggagcuugcugggaguuuugcucccagcucguuugaaggagcccuacuucuucccaacauugaaauucuagguggacagccagggcagcuuggcuuuucuguagguuccugagccugaaacucugggcuucacacuugcucugaugaaccuuacugccuuuacugcagccagccagcuccaucacuuacaaccucgucuguuaauuccaggcucaugcuccucagggucucaugagaacugcuauuccuguuuccaccaauauuauaauaaacccuuuuaauauguacauuuucagaauacacaagaaaguauaagaaauaacauggugaauggauguuucaccuucaaguauugucagcacuuucaaucauuuugcccaucuucugucuucauuuuuuuacuuacuaauuuugucuuauuacuucccuacaucauucuucaaggauuaugcaugucacugcuugucccaacaguuaaauuuugcuuuuuaauauauuuugcuguaaaauacuucaauaugucagccuacauaaaaaaccaaaagauauuuuauuuuuuaagauuuauuuauuauuuuuauauguaugguuauuuaguugugcaugugcaacauuugggacauguauacaugaguauguguguguaugagagugugugugugugugugugucugucugucugucugugcuauucuguuuuucuaguccgugagacaggguuucccuguguagcagccauggcugucuaggaacuucucucuguagaccaaggaagcuuaaaucucuucucuaaaacucggagaucugccugccucugccucccaagugcugggauuaaaggcauccaccaauacugcccaguuuuuauuuaaaacuugcauguuacaaaugaagaaaggaauagaaacuagauugacacaagauuggcaggacauaguccugaucuaagccuucagaaguccagucugggguacacagagaacuuaccaaauuaauauaguaucguaucauugauaacccuuaaaugaacagcacuguguaguccacuuguguucacugcucuuuaauacaggucugcaggucacuagauuauggauuucaaguuuguugacuuguaaacuggcaaugaagauagaguuaaccucaguuaaauaaugaggucauacuaugugcagugugguguggcuuacaaauuguuuuuuguuuguacuuuuugcacauaccguauucaugagagugcuccugacgucauggugcuugugcacauggccacagguugauauugaauguuuuccucuacuccccucacugaaccuggaggucacccauuggaccagacugaauggccauugaguuccagggacccuuccuguccucugcucauagugcuagacaauagguucagagucccauagccagcuuucuuuuuuuuuuuucagcuguauuauuuuuuauguguauggguguuuugcuugcauaucuguguacacugccuacggagccuggaaguuggugucauauccccugguucuggaguuacaggcauuaguugugagcuaccauauggguucugagaaccaaauccaugucaccaaguacucguauugcugugcugucuaccccaacacaacuaaucuuuauguccgcucuggggaugcaaaugcagaucuccaugcuugcauagcaaacacucucaacccagucaucuuacaagcccaaggaauuaguuuuaaccuuuauuuuaaauauuuaguauucuuaguugaagaaaguguaaaauguuuuaucuugaguucuaaauuuuaccugucaaugauguuuuuuuuuguuguuguuauuuuuguuuuugagaucaguguuauaauuucagugaaguugaugcuugcuguauuauaggucaacuucaugaccuguuaauauagccuguuaaucuguccgacuuuaccaacaauaugcagauucccuguggcuguuuccaucuguuaaagauggagcugaggggcuggagauaugaaucagagguuaagagcacuggcugcucuuccgaagguccugaguuuaauucccagcaaccacaugguggcucauaaccaucuguaauggaaucugaugccuucuucuggccugcagucacauaugcagccagaaugcuauauacauaauaaauaaauaaaucuuuaaaaaaaaaaaagaugggugaggcucguggcacuagggaacagggacagacaggcaugucuaggaaacacauggaccacuuuuuguaaagauaaaacccuauuuagaccuggguuuaauucccagcacgcacauggcagcccacaacuguaacuccaguucaggggaucugauacccuuacacagacacacaugcaggcaaaacaacaaugcacauaaaauaaaaauaaauacuucuuaaaaauuaagagagggauagaggaaagcacccuguuucaacaugucaaucuccagccucagcauguacucccaccuguggauacaccgccuucaguuuagguaaacuuugugugaauuguaugucaaagcuuuuaaaaaaaucuuaauuuauuuucaauuauuugucuguagguauggggcgagagugucagagaguguagaacugggguuacagguacaaaugugaacgugggcaggcucgggugcuaggaacuuaauccaggucuucuacaaaaggagcaggaagcuggaagagggcauaggacccucuggacuuggaaucucagucguuguugcuaccaugugaaugcugggaaucaaacccucaggcccuuuugaauugcugagcaaucucuucagcuuuuguguuaguucucggcuuugaacucauggccuauagcuuguagagcaaaugcuuucacccacucagcugcugcccagccuacagcuagugacuuugaugcucuuucccucuuugaaccugaccuucgcuccuaugccuuuccuuucacuuugugcagugcuuccucccacauguccuaccagcccaccgacggcaaucuugucucuugucauccgccauaagccucuuguuuuccuuuuaauuuugaaggauauuucuuugcuagacgagaauucuagauacuugauguacuggcuaguuuugugucaacuugacacagcuggaguuaucacagagaaaggaacuucaguugaggaaaugcccccaugagauccaacuguaaggcauuuucucaguugaucaagggggaaaggccccuugugggugggaccaucucugggcuggcagucuugguucuauaagagagcaggcucaacaagccaggggaagcaagccaguaaggaacaucccucuauggccucuacaucagcuccugcuuucugaccugcuugaguuccaguccugacuuccuuggugaugaacaguaguauggaaguguaagccgaauaaacccuuuccuccccaacuugcuucuuggucaugauguuugugcaggaauagaaacccugacugagacacuugauaaacagcauucuuuugucuucuugcuuucaguguuuuuaauggauaaccugccauuauuuguauucuuucuuaaauuauguguauaugggggcuagagagguggcacaaauggcuaagagcacuagcuccuccuucugaggauccagauucaacucccagcaccugcauggcaacuuacaggcugcaacuccaguuccaggagaucgacaccagcuucuggccucccuagacacugagugcauauggugcacacacauacauacauacacacacauauacacaugaaagugaaacacucaugcacuuaaagauuuuaaaaauugguguguguguggggggggggguguggggguccaugugagugcagaugccuguggagaccagagaaggaaucagauacuguggaggaggagguguaggcaguugugagccacccaguguaggagccaggaaccacccugggguccuuagagaaagcagcaugcacucuuaaccccccagcgucucuagccccaccauguauauuuuauuuccugugugcagugguuuuugguguuuuguuuuuguuuuuaaauuugguaucuuucaagauuuucccguaauuucuagcauuuaauaaugaugugcuuauucauucauaauuaagaguuaucagcugucaguuuauugaaauuuaagcuuuuauuuucucaaaccuggaaaaacuuugccuacuuugaguuuuucaaauaauuuucugccuagcuccucccccuauguuguauguuucauugcguaugguuccagauggagaggaaguaaauugugcaccuuuucuuggaagacuguugacucucagucucgcaaacuaacuaacuuacuggguuacauugccugagguuuauacucuugucuuuugaaucuugugccuuuaaggagggcgguucagggaccauugagggucauugauuuuuguuuuuuuccugcgcuuucuugccuacuuuucuauuguguuguuaguuccacacuuggcuuucccaccgcucaagccugaacuuugcagauguuugcuuaaggacugaacaguucaugugugaugugugguugugugccugguuccuccuaccucuacugcuauucucuugugcguuggugugucuauacuugccugaguguguagugauuaucugcaggacuggaguuucugcugugccacccgagaggguaccacaucacucugcuuuuguuugccauugacuuuccauggaugcuucaguggauuuaacaacuuacuuuuguguguauguaugaugguuucucaucaagugaauauauucguaaugcucuuuauccuuucuuuuacagacaagagaugauuuccuaggucaaguggaugucccucucuauccuuuaccgguuaguauuggcauccaugguuuuggguuuuguauuugugauuuuuuucuauuuuaauaacugcuaaugugaaucuuuaguauaucagcuguuuccugaaauauaucucacuuuuccuuuucacucaucuccuuuccuuacgugagcuucaagaaacugaaccacagggauugguaggcaagauggagccuggauuuuaagggcuuggaauuauccccauaaacagcaagaacuugggcucacauacuggaugugagagacuaagagaccgaaggaccauuaacacuccugagaauggaguuggaaacacaagagugggaaaggcuuagguagccuuucagaaucaaaugucacugggggcuugcagagauggcucagugcuucaugggacugaucagaggccucaguucccugcacucaccugccagcgcccagccaccagaaaccucacuuguaugggauccggugcccucuucuggcuucucauggauccuguacacauucagugcacauuuuggccauauuuaauucugauaagaaauuguagaaauuugaaaguuaaugugggcaguuaguagcagcauauaagaaaauuguguagggaaaagaaacaggaaggguugagcguucuuggugucuaaaugaaggaccaggugcaaaaccuuagucaacauggguggaucaaaagaaagucagaagacagaguagaaagaaccaaagaaaauacuuuccaaaaacuauaaggaaauagcuucugauugugcauggucuuccauguaaauacuuggaaggaggcuaaggcaggaggauuacaacauugaggccagccuggcuuuauagugagaucuuucauguaaauaacuuucaaggcgcagaggguagcaaagccauagagaaguaauacaaagcaggggguugcugugggaagguggccgcccacacuccucucaacguuggaguuuuugcuuuuguuuuagaauucucuguauacucuuaacagagucaagcugcugacauaguacauaucccauguuccuuuggggcaggguucugcccauacuguacuguccucuacugccuggguccugccugcucccacaucucagccuaccccccuacuuccccgcgcucccuccccucugcuuguuccccccuuaguuauggaguuugcuggaguuccugugcaggaagccaaagccaugugguuaccagcugacucuuaacaaauuaaaccuucuuuucucguucuucagucugccuuucauuauaguucagcagugcuuuccaaaguacucaacccccuuucucauuuuagacugaaaacccaagaauggagagaccauauacauuuaaggauuuuguucuucauccaagaaggucaguaaauauguaagauuauaguuuauuaagguuaauaguuuugcgauuuuauuuuuauuuuauguauauuagugucugccugaauaugcaccauguauaugcaguuuccaaggaggccaagagaaagugucagauuccuauguggcugcuaagaauuguauguauguucucugcaagagcagccagugcuccugaaccauucagccaucccuccacauacaguacacauacuauagauuugugucuucauuaaaccuuacucuccucuuuaaaaauccaggauuuaaacacccuauaaacaagcuauuuaaauaaauuaauauuauuucuuuuaaaagcuuuaguuauuucagacuauaaaauaaacucaaguggcuggaaaacauggcucaauuguuagaugugcuugcuacucuuucaguggacccaacacacaugcacacacacauacaacacacaugcacauacacauacaacacacacacacaugcacauacacauacaacacacacacacaugcacacacauacaacacacacagaaucacaguguacuuuguucauauuccaaauaaaauucuuaaauagacacaaaaauuaggaaugauuugucccccuuauuuaucuaauagcuguauuucacguaaaacaaauguccagcuugaucgguacaaaaacaaauucagaauuaacuugaguauauuuugcaaaauuuaauuucaaaaacauuuuagaagauucccauagagaaacuagcaugaauagugaauaaaauuuaaacccaguaaguacgcuuggaauuccauuuuccugaacugaguuacuugguuccuuuuuuuaaacuaaauuuaaucuuuaaaaaggaccuacucacuuuauuuaauguguaugaguguuuuaccugagugcaugucuuugcaaugcaugcauucggugguaaaggaggccagaagaguguaugagauccacuggaaugggaguuagagccauauucgagccgcccugugggcgguggaaacugaaccuggaucccccgcaaggucaaaaggugcucgugaccacggagccgucucuccagcccuccacauuuaaagucuuaaguucuacaugcaacuccuuauggucuuuugugccacuuggccaauuaaaaucaauuuagaauguguaauuaauuaucacauguaaaaguaacccaucugggaaaaccauagcacuugcuuuaugcuuucuaacaaagaaaugcauugaacaguguauuauggacauuuaaaucuuuuucauuuaaaaauggcugcuuuaaccuagucuuuguaauauaaauauuaaaacaacauaaaggauuuuugguuuugugguugcuuauucugucugcgagagaaggccucuguuccugucgaagucuaggaauugaaucucuuuucuuccucucguuuuggaccgauugcaauaugugcauaccaagaauaacuaagcaaauauuuucccgccuguuuugcucgcccugcucucugucccucagauugcuguaaagacauuucccgaguugcugcagacccuaaagcagauaaauccuuucuuugugguguucaaguuucauuaauaauuguuuucuuuccuucccacagucacaaaucaagaguuaaagguuaucugagauuaaaaaugacuuauuuaccuaaaaauggcucagaagaugaaaaugcagaccaggcugaggaguuagaggugagauucccaggaauguuugcuuaggcugaaauggggcugucugauaucguucuugguagaaaaccaugguuuucaaggaaacugaugcaugcaaugaaaaucaccacgauguugauuugaccaaauguuccuuaagcaguucucucucugacaguauuucuguagagugguuguuauugguagacuuacagguagaaauaggaaaugcaauauuuaucaaugcagguguuuauuauaauuaugucauugucuuuagguuuuuuuuuuuuuaaaaaacuauguccuagucuacuuuacaauaagaaaauagguguuuguaagcuaaaucuauagacaucguacuauguuaaaauugcucuguuucuauauacuaauuacauuaguauaaaacucgaaggacauuuaauucauuuugcuuuucuugucauguuuauuugaaguacauuuuaguucaugguucucacaggugacaggauuaauaaagaaucaaaccaggugccugaacagagccacacaucugggcacugaagaguagcaggguggcuugggcuuugauagcuagcugagccccuggagcaagcuagcucugcuucccacagccaugugaccucugaucugcuagguuuuucuuuugugggggagaaggacugcaccaggucgccuuuaggguuucuucccuggcuuuaaaaagacaaaaccaccuccuuucuguggugcccuuagagacaguucaucaaaagguuuaaauuuaaacauuuauucuaccucacacuguauguguguucugugugugugugugugugagagagagagagagagagagagagagagagagagagagagagagagagagacagaggcagagagagagacagaggcagagagagagaaugugcaucuaaccugauuguucuggaagguucuuucuuguguaugcuuucuuccaggcuugucucucuuugguugaggguuugcucuggucucucagagcugugagaccaggggauaucccugaggugugggcucuagcucaugugcuugggugccuugagcaggaaaugaauuagcaaagcuuuugguagucuauguguuagugagauuuuacuuuguaggggaauguuugaggguagaaagaaaguuguuuuuuccuuaaauaauagaugauagaugaccccucauugaugacugaaacuugucaccguucucuuaaauaaauagauauccccuccuugauuaccuuuucugcugaucuguuugucuuuguuuuuaauuuuucuaauauacauuuauuuucucugaauauuuuauuucuuuauuuuauauguguguuuauauguuagguuaguguaugcuugguacucaugaggucagaggugcuguuuuagauccacuuggucuggaguuacagguaguugagagcugcuaugugggugccggaguugaacccagugaguggucuuaccugcugugucuccagccccuguucacauucauuccuuuuuccuuccuccacggagugugcucguggguuugugcuugcucgugugcauggguguuccguagaacacugcagaagucagaggacagcuugaauguccccuccuuccacugugaggucucaccuucauucacagugccuuuauuguggccaucucacuggcccacauugcaagcuuuuaagagauuuuuuugggguacaaaugucuguccauggccuugucacgcagagggauucuuacauuuggauuucugcuugaaaugaacuuugcuaugaaggaagaaaaggcuuucccagagacuuugaaguuuagcagcauuucauuacaugggagcucgccccagcuuugcuugagcaugguucacaggcaccucauucaugguuugguuugccucugugguguagacucgccuugcuuuaugcuuuggccucccaucacaauguuugaauuccuucagaggccaccuuauaauuucgagagauguaagcgugucguuuguuuaugcaaaggccgaggaauucagacccacgaaugugcuuauuuaucuucugggcagcgagagaccagagacgucuugccugguccugugauguguaguuugugacuacauauuucaaauucugcuauuugaaaaaaacaacaagugcaauuuuggagggaggugagcucugggcuucuuacauuucugaguauaguguggcucugauuagcuguguguaacguuucauuuuguguuauuuacgaucaucuguaugaauucuacaagauuaggauaaaauguuugucuaaguacuuuguacuugcuuucuggcccuucugacuccauuaaauuguagguauuugcauauuggcuuuaagacuaguaguuaggauuucuugccuuguagaaaauuauuuuaugaggaaaauagauaauccauauuucuuagggaagacagaaaauauucuuucccaguaguguuuggggguauaguuguacuuucucaaacuuaaaaccauuucuuuuucuaaagcauuaaaauaagaaauuaaguaccuuuuuuuuuuuuccauuuuucuuacugaauuuacaugggcaacacuaaagcagaucuuuaaaaaguaauacacauuuucaaagaaaugcucuugugccagggaagcagcuuacuggucacaagccagaagcuccaaguuuaagcuccgucuucagcccacuugaucguauuccucagcaagaugaauccccuggaagccuaaggcccagcuagcucagugccagaggcagcaagaaggaacccugcauaggagggggaaaggaaaggaccagcuccuacaguagguccucugacccccacguacauggcaugcaugcacccuuacacacuuggaaugugccaaaggccaucagcccucccugcacugggcuucaggccacuggugagucaccuggugugagugcuggagauggaagggcaagcucuccuaaccgcugagcugucccucuguagugucuuguuuucauguucagcagugggaccuuucucuucuuuucuuuuuuuuuuuuuuuuuuuguuugcuuguuuguuuguuuugagacaggguuucucuguauaacccuggauguccuggaacucacuuuguagaccaggcuggccuugaacucagaaauccuccugccucugccucccaagugcugggauuaaaggugugcgucaccacugccuggcgugggauuccuuuuuaaacagccuuucuuguugaugucacggaauccuagaaggcugcuuuucuucugacgugucccuccguacauguaauuuaucuugaucacagucacugccacuaucugccuucagcucccucccccuccccaucaccuuuuccuuuguaauccaccuuugugucuucuuuuauucuccuuaguaaauucacuuuuauugauaagacccuauuuuucugagagcaaaauagccauuggccacauucaauaaagaaaucccgggacuggugagauagcucagugguuaagagcacuggaugcuuuucuagaggucucagauuaaauucccaguacccacauggugccuuacaaccaucuguaacugcaguuuccuggaacacaaugccuucugccauuuaccggcacugcaguguauguuaugcacagguacuaacaucuaaacacauaagaaugaauaaaugaguaauugagaaaggaaaucuugagcuaaacagaauaccagagacuguuaacagacuguaauaaacucagaucaugccuucugagaccaaguccugagagaugcaguuugacuguacacaggauuagaguucccuuuauaaaguagcacauuuugauggucuacaagaaaggaagacagaaaaaaaauggagaugaaguaagaggaaaagaagagaauagaauuuggguaucagcucccauagcagugaaacgagaaaaagagaccacacgugaugggguccaacuuuagcuucccacauagaaugcccucccaguaauucucugguccucccuccauucccuaaacucccucuuccucucagccuccaccugcugcucuuacugucaggugcagccuccaagcauugggcugcucuucccagccugcaucugccuguacgcucagugccagcgcagggaguagaagcccagucaguaugcugggguggaucugucacaguacugaagaccuuuccuguuucucugcuuuuccauugauuuagcagggcuagggugugaauauguuuaugaguucccguguccagugcagaauucuucuccuuugugcuuucuggauuugccgucauguuucaucgcuucccacucuggggcauacugcuuuacauuucuccaaauuuguucuaacacaccuuggguuuguuuuuuaaacauuugaauauuacucaauuuguuguauaucuugguauaagauacuagguagggaugugaauuaauuuuuucccaacaaguaccuauucuccaaacaaucuucccauuucgccauagauguaaaaugugcuuguugaugccaaguuccucugaguuuuguucuguuucccaguugucuuuugagcuaugugugugcagcuuagaccccgacuguuuucuaugacagaacuguccacacaucucuucucccuuagaaugguguugguuaugacugacuuguuuguguuucuacuugaacuugagaauuagcucucauuauuuaaaaaacaucuguaacauaauaauuguaucagaauuuugacagauuugcccucggaaauugauccaucaugccugcugucuguggugucugggauggaaugcaggacuugaugcuugcuauucccagacucuacgaacugagcuacacuccgcagccgugugugugugugugugugugugugugugugugugugugugugugugugugcgugcgugcgugugcgugugcuugcauaugugugcucgaguguuugacugcauuuaucugugaaggccaaagauaucagaucuccugagacuggaguuacaggaaguugucagccaccugauagugguucugguaaccaaauucaggcccuccgcaagaacaguaugugcuugaucacugagcaaacucucaagccccuguuacaagguuuuuaauaugaacgcauguuaauacuuaauaacuuuuccacuuaauuccuuacuauuuaacucccauaggguuuugugcauuuuguuucuuuaagacccaaauuccugggcauuucuucuuuuaaaauuucuuguuugaguuuuaugacuuggccacaaugcuuguucuaggguuaggggagaaauagaaaaugcagaccccagucucacagugacaggucugucaucucacacucacccacacauacagucugaguagugacuguuucuuagucacucucacugccucuguugggcuucucaggguuggccucaguggacagcuuuucaugucucuagugucuguggaucucuuucccugcuggcuucagcugcuuguggcugagagaguggcuacggucauauggcuccaauuggguuccucguuucccuagcgcccccaugucacagccucauucaguuaugaaggguuuggucuuguuguccguguuguccgucguuuuuucaggggguuuauugucucauucuguuugucuguuuguuuguauguuuuguuuuguguuuuacgcuuuuuggaaauaggcauuuucaaacaacuuuuaaauguuucugcaggaaagccuugcuuacaaaguauucacauucuuugagaauugagcauggacuaauucuguuaugcauauuucugaaauugaacauaaauucucuuuuaauuuccuuuauuuuugcuuuuuauuuguaauuuguagguuuuuuguuuuguuuuguuuuugagucaaacaucagaucaagcuaauugcuuccauucuguuuuucagccuggcuggguuguuuuggaccaaccagaugcugccacucauuugccgcauccaccagaacccucuccccuaccuccaggaugggaagagaggcaggauguccuuggaaggaccuacuacguaaaccaugaaucuagaagaacacaguggaaaaggccaagcccugaguaugugccagucugcauagauuuugcugcuccuuggccuguuaaugcugugauucgaguaggcguauagugguauagggaccccugaacugucagcuaaccaccauugaaaaacuuaguuagcugugauuuuuaaaaaaugauuugauauuguuuaaaaaauauuuggaggccagcaagauggcuugguguaugaaggacccuugcuacccagccugauccccaggucccacauaguagaaggagagaagugauuaccaaaagcuaucuucugaccaccacaugugugucaugccaugcucacaucuauauacacacauguaauaaaaaacaaagcauaucuugaaaaacaauuuuaggcuagagcuguggcucacuugccuacaggagacccugaguuccgucuccagcaucacauaagacgacauacgguggcgauccucuaaucccugcacuugaagguagaggcaggaucgcaaguucaagguuauucuuaacuuucugcaguguuuuugugcugcuagaguuuggagccagugccucauuccugcuaaacaaguucuuucccacugaaccacaacccagcacuucauuuuuaaaauagaaauuauuguuaauucacagugaagacacuaauggguccuuuccuaacacccuucucuaauuuagaugguagacauagaucuucccacaugcagaugcaaggcagaauaaccuuggauauguucaugcucauagcuccuuaguggcuuuuuuuuuuuuuuaaguauaaaacugcacugugaucucauuuggaguuagagguuuaauucacuaggaaagugcuuggcuagcaagcuuaaggccccuaguucaaucuccaggacgaaaacagaugaggaaacuaacaacaauugugcauguuauucccagaaucagauauccuccugucuuccuucuccuguagccucacguggcuguuuucaaucuuugagugcuugacacauccuuaucauuuaucuuacuaguccauucaccuccaauacaucugauacuuccuaaaaauuuuuuccugucuguuuucaaacccuccaaaguagacuaguggucacacucucaagcacauggccaucaggaucugcgcgaucacacaccaaguacaaagugggacagucugucaagcuacccuguugucuuugacagacaggcagaccugccacacagaaucguguguucuacugguggugucgauuucagguggcaggaugcagaugcaagaaaaaaaauuaaacauuucuuagauccauuagucacaauuuauguuuuuacaagccacaauagagaaugauuuucuuguggcugggggguacgggaggugaugcuguggacaguuugauauaguucucauguucugugaaccgguaagguaucugugguugguaaugcuguauugaauguuuguaaaagcaaacgaggaugucacccagaagugauaugaauaagugauauguacgucaagcacucccaucucuuuauacacagucacuaacagugugugcacccauggaccacauagcaccccaaccuguccaauguccugcuuuuguuuuuaauuuuuacuuuauuuuguauguauggcuguuuugccuauauguauaucugugcaaaagacaguauaagagcuccuggaacuuuuggguuuuugguuuuucgauaugggcuuacucuguauagcccugguuguucuggaacuagcucuguagaccaggcuggccucaaacucaaagagaucugccugccucugccuccuaauugguguaauuaaagguguaucucauccacuauggcaaaaauuauauuuuaaaagaacugauuuuaaaaauggaaauaguuuaggaucguuuagaaacuaucuuggucuaauaugacaucaaacaaaugaauauuuugggggccauuaagauggcucagugagcuugauuccccugaaccaacaagauaaaaagagagaccuaauuccugcaaguagguuucuggccuccacacucaugcccagggcacacacauguauaaacaccuaacacauaaauacuuaaaaaauuuuaaguuaagauuuuuguucccgauuguaugaauaaaauuccugauuugucucaauauagacagaaauaacuaggcuauuguaaccuagacaugccuaaaguuugugcuuuuccuggacuuagaucucuauuaaauuuucagccguagggugcuuguacugccugccauuccucuucugcaugccugcauggggaguauggcucccugcuaagaccgagcccaccaguuaauccauucaugaggcauccuguuacuuuagaacugccuuggguuucuaucucaggcugacaugguacaagaauaauaaacaaauuucaugucaaacaucauuugugccguuaguuuucucagcugguaagaggaacuguaguugaggacuugucuucauaugugccuguggacauguccgaugggcauuuucuagguugaucauuaaugugagaggguacaacauacuguuggcaguggcaacccugggcaagugguccuggguuguaugaggaccagauucuugcccuuggugaugacuggagccuguaaaagaaaaucgccuuuuccuuccuggguugcucuuggucaggguuuuaucauagcauaagaaucaagcuagcacagugaugaacuaaauaucagcucuuaacacauuugcaugagauuucuacuuccaauguacauuuucuucugcccuaguuucccagaccaaaguguugacagugugauuagcuuuggucagaacccaugaauucaaucuagggaugaguaagcacagacucuuugauuaugauucuaacuguaacaaggcaggggugacgccuucuuacacuucugcccuagcgaugaccucacggaugaagacaaugaugauaugcagcugcaagcgcagcgagcauucaccaccaggcggcagauaucggaggauguggauggcccugacaaccgggaguccccugagguaugaacccuuccuucucuuguucccguguccggcacauguuaugcaguggaugaguguggacucugcucuuuucagaauugggaaaucguacgagaagaugaaaacaccgaguauaguggucaggcuguccagucaccuccaucgggucacauugaugugcagacucaccuugcagaagaguuuaauaccagacuugcuguguguggaaauccagccaccagccagccgguuaccagcucaguaagaugauuuagaucuugucaugaauuugugauaccuugucauacauugauguaacagcguauguuuuauguagacuuuugucuucagugacaugccauaguaacauguugggggcuuucacuuacccuuccacuaacuccguggagcagagcguggauaguucuaauggacccuguguucucggguccuucacccacugccaccagaaacacggaagccacaagcugugguucuuggucguuucacacaaagaaucauggacuggcagugagagggugccagcgaggacgguggauuugauuccuuggggaauuuuaaaagagguugggggagacaggagacuacucuagauguugucaggaaguggaaagaauuguguuugaauaacucagaucuccuccugugaggacacaacucgaugaggagaaagaagaguggacaugacaacuguuugguauuuugcagcuuagguaguggguuuguuucauuuuguuucuugguuuuguuuuuuguuuguuguuguuuuuccuauguucagacacaauuuagacggcaacuugaauuugccaugacucugucugugugugccagguuaguucaugagugguggaaacuacuucucuaucuugguugugugaguugacauuguuuuuugggguggguguuuuuuguuuuguuuuuuaaagauuuuguguguguguguguguguugacugcauguauguguaacaugucuaugcuugauacccucaaaggcccaaaguaacugacagauccccagcaacuagaguuagagacaguugugaacuacaaugugggugcugggaauugaacccugguucugcuuuuacgcacuugaacuguaucucuauucccuguaugagguuuuaacauaaaaucacagaugucacccauccguacacauguguagauuagaggcauauugguuaaaugaggagagaaguaaugguuucauucacugucuacaggguccacaaacaagcaccccagcaugcaucuaccaccccugugggagccucuggcuggccagguacaaggugccauaaccacucacucacugagacuucaucuguccuaaaguggacagaacaccuugaucuucaggacuucauucuagugcagggucauuacugcgcccugcgugccaaaucugcagcugccuguugccauaaauaaggugucaauggaauccagccauuccuacuuguucauggccauguucaaaccacaucucagagccaagcaauuagaacuagcauucaguguugcaccucagcggguaauuauuugcuaaguucuagcuccuuccucaagaaguuucaccuaugggcuggugagauggcucagcugguaagagcaccgacugcucuuccgaagguccugaguucaaaucccagcaaccacaugguggcucacaaccacccauaaugagaucugaugcccucuucugaugcaucugaaaacagcuacaguguacuuauguauaauaauaaauaaaucucuuaaaaaaaaaaaaaaaagaaguucuacauaguuguaugucccuaccuacgugaguauccgucagguugccucuucaccggccuccuuuucuuucuuucuuccacagccuauucuuuuuuccauuugcuuaaucaauuaauuugucaggggucaaaggaaaggauucaucagauuuacagaauagguauggggagaugacucagaaaaguauuugccaugcagauaaaagucccugaguauaaugcccagaacccauguaaaauaaaaaccagaugcagcagugugcccaugucaugcuuaggccuucuaugaguuaccgucaccuguuaagaauauucuugaaccauuucaugaauguguugaaaccugagacaguauugaggcuuacaaaguaaaaaaugguucuuccuucuuccuuccgaauuacauugccucagugacuacuaaugguuuuaaauguagugucuuaaacauuacauauuuauucauaaacauacauguaugcacauauaguuacauaccuuuaaaguuuuuuauagaagauuuauuuuaauguguaugugugcauguuuauauguaucuguauauggguuugugcacauggacacaugaguguagugcccauggaguccagaagagaggacaucaaaucccuugaagcuggaguuacagguaguugugagccaccugauaggugcugauuccaagauauguaccucuggaagagcagcaagcccucuuaacugcugagccauuuuuacaaccccuauauguaauuuuaaagagugugugugugucuaucugucugucugucugucugucugucugucugugugucugugucuguguguguugcuguucuguguuuuuguggguugguugauuuggggugugaggaucaaauagcuuuaugugugcagagcgugugucucaucuccaagccacacucuaguucccuguggucaucuuacacaucccuuuugguuauuauuuuucacuugcuaauugaacuguuuccauggauaucaauguacuucuuuuaaaaucacuaaaacuaguuguccugaaaauauccaccauuuccuguugugaugaacuuauguuguuuaaucauuuguguuaucauaaacaguacaguuugggauauucugauuuuauguauguguauuuguaaguuuugaugccauuuaauaacaaaaauaagauauuucaguuagugguuaaugaucacggugaaggggaagagagaauggauuuccaggaaauaaguuaucagaguggacacccaguggugggcugugaguccagaagugucgagaugaggaagggccagguucugagcgggagcacaguguuuggugcugaacauccaaguacucgaugaaauuuuguugaagguaguaggcagagaacaagcguguuaaauccagcccucuggcuacagcuggaaaucuggacaugcagaaaugaggguugaagcaggaagcccuugucacugucagaguaauuaaggugacaaauggugaaauuguuuuauuugggucuagcaagaaaagccauguuugaacuugcuaggaaugacagugugaaggaaugaguuagaguggguauccgcagggaaaauccaaguccagucgugucuacaacuacauuggaggaccagaagguggaagagccaggguggagggcggggagagaaggcaucccccguuuuagccaccccacccuccuggcaugcuugcugucuccuacagugucaacuguacccucccuacauugccugugcucugagugcaaagcuaaaguguuacuuguuuccuccccuuaagaaucauuccagcagaggaggcagcuugcagaccuguaucuuugaggaacagccuacacuuccuguggugaguuuucuccucugccucagccaagaaugaaagaaagauucaaaaccucagcuaauuuuuuugauacuuguauaucacaacacugagugugugacugcuuagcaagggacuagggagacauggggcacaaccuuggaagucaagccucaagagaacugucucucuuguaaagcaagccccgugcucaugugaugguggcaggugggauguggcuucucagcugggacccugcugcucagaggugaugggccgcugcuaccccacaugugauacacagcaugcagcuguguacugacaugcgccacacagccauaucugcccuuuguguggguugucuacccagugcccucuaucauuugguccaguauguggcagccaggucggcauuuucaucucccagcgucucccuuggcagugcucugauucagcacagaccgcccaucuccacagugcuucucaccucuucuuccuggcuuuccucucguuaugccaaggucucacuaccucauguaaucacuuuacuuugcuugugagucgaccucauaucucccaacccuucgaugcccguucuuccucgugcuagaauuacaggcaucgugcaccaugcuugauuuacaaagcucugaggcucccgugucuucguucuacccuuucccuugccugcuacccgccaccuuggcuccugucuguucucuuccaaacaccugaauauccuccuuuuaauucucuauugacucaucugauaugugcacaucccauuacuccucuuggaagucccuccucacuugcccccuggucaguacaccuuuaacugccauucuauauaucaguuuugaggaaagagauggggggccgaggcucaggagagugucuuaucugucuuagaaaaggauucuuuccaguccugugcugaguucaccugacucugaagaccacuggccuagucaucaugacaguagaucguaggggucaagaagggacuccccuguuaucuuguuccgguguccauacccuggcuugucuggccuccuuuuagaccacagcaugugcaagcaaaagccgaaucucacuacaguccuggagcucacuugguagaucaggcuggccucagacucacagauccaccuuccucugccgcccagcaccaagugaauugcuauguuuuaaaaauauguuuuaaaauaugauuuaaaaugugguucauuguucuaaauuuuaaaacaagaguuguuucagagcaccagcagugaagaaaggcaggaggcuucugucagaaauuccuccugguuaacacugagggguuuuuuugugucugugcauauuagcuuuugccuacuucaucuggauugccaccagguugggaagaaaaacaagaugacagaggaagaucauacuauguagaccacaacucuaaaaccaccacaugguccaagcccaccaugcagguacucugaacucuuagcuugucuuugguaagcucagaccucacacuucuagagcaagagcagagugaugaccugcuccuucagugauuguguuguuuaguuuuggcaugcaugccucugugugugugugugugugugugugugugugcgugugcgugugugugugcgugugugugugugcgcgcacgcgugugugugugugugugugugugugcgugcgcacauguauguguauguacaaguggguauguacacgugugggguuguguggggggugcguaugaaagacucauguggaagccuagaguugacacugugaauuccucaauugcucuucauguuauuauguauuuagucagggacuuuggcugaauuuggaguuuucucuaggauuuggucucuagcucucaggcagugggaccauagacuggccgccaugccugaguggcuuucugugugugugcugucgaucuguacugugcucuuuacacuaaugacaagcauuguauccacugagccagcucccugggcacuucuucagauaguuugcuaagcuaaucuugcugacuagugucugugcaagaaguuuauaauuauggggaugaagagucggcucaguguuugcugcuuuugcagaggacacacgugguggcucauucguaacuccagguuuagaggaugcgaugcccuguuucagccucaugggcacugaauacauuugugugcaaccauacacgcagacaaaauacucauucagauuaaauauauaaaacuguaaaagaaguuuaugggccuggagugauagcucagugguuaaaagcacuggcuuccaaagguccugaguucgacucccagcaaccacacaguggcucauaacccucuguaaggggucagauguccucuucuggugugucugaagacauuggcaguauacccacauacaugaaauaaguaaauacaucuuuuaaaaguuuuauaguuguaauguuuauuuuaucaccauuucuuucacugaaauuuuuucuuuucacauuuaauuuuuuauggggauggauaccauaggguguguaugugugugugugagcgggggucagaggacaacuuacaggcguugguccuuccuucugccauguggguucuggggaaucaaacucggguccuuagguguagcaagcaccuuugcccacucagccaucucacuggcccuaaagccacuucugugcugaggcuguucccacugugacucuuacagggcaaagcgagcuuucugcugugggcacuauaaaccucccaaccccuuucaggcuacacaggcugcuacucuggcuucuuggacagauauguucacagcagucaaaucuuacugcguguuaauuagcugagaaaauuguuauaaauuaguugacuaaauuauuauaaaugcaaaguuugauagaaaauuuuauuuaaaauucaggaaaaaagauuuuuuaagagugguuuaagagcaccugcuggucuucccgagaacugaaguugugcccacgucaggaccucugaccuccaugggcccugcaggcaaauccauaugcaggcaugcagggccacauaguaagauuaaauugcuacaaauuagccucagagguuuaagacuugcuugcaagugugccuucuguuuauagguuaagcuagcuauuuuaauucuauuauuugugaguucuccauagauguaaaguaugacguaauucaugugccaggccacauuggagauagucagcugccaucgagccagaguuccgcaggcccucagccagagcuccucaccagggacccugcuaaacaggcaaauccgcauucuaacacugagcaaagauuccuuucugaagguuggggagucuggcaugcaccaaucaaaggccuuucuuuauugaccacaacacccaagacugccaccuggguagcuuccuuccauacuccucacuuuaaauuuauagcagcaauugcuucucaauguagucacaugugcugguauaaucugccuuucuuucuuucuuuuuuuuuuuuuaagauuuauuuauuuauuauauguaaguacacuguagcugucuucagauacuccagaagagggagucagaucucauuauggaugguugugagaugguugugagccaccaugugguugcugggauuugaacuccagaccuucggaagagcagucgggugaucuuacccacugagccaccucaccagcccguaaucugccuuucauaagaaugaauuacaaguaaaaaucuugggguuuagauuuuguuuugguuuuuuuugguuauuugagguaaggucuuauguagcucagacuguucuagaacuugcuguauaacugaagcugaacuugaauuccugauuugccugcuuccaccuccuagguaccacacagaggcccuguuucuguggugcuaggauuuauuuuuauuuuauauacauugguguuuugccugcguguauguauaucuguuugaagaugucagaucacguggagguggauuacagauugaacuugcauccucuggccgagcagcgccaaucuuaaccacugagccaucucucuagcccuggaagccagggcuuuaugcaugcuaggcaagugcuuuccaauugagccaccucuccagcucuagggaaucuuaauauuauuuuauucaagguacauuuaugcuucuuuugacuuagauuagauuuuaugaagguguuccauuuucuaguuuuugguucacucgucuuaaaaacuuaggaagacuuuuaguaauaauuuucuaccucuauaugagacuuacuauuuucagagaacuuucaaguuucuaucucauuuauuaauacucccagaaagacucugugaagcuaagaugaacagauauuuauugcuauuauuguuguuuucagaauuuauuuacauuauuuugcauguaugacuaccuacauauguguccauggaggccagaagaggugucaacacuuaagacuuaagaacuauuuuaaggggcuggugagauggcuuagggguuaagagcgccgacugcucuuccaaagguccugaguucaaaucccagcaaccacaugguggcucacaaccaucuguaaggaaaucagaugccucuucuggagugucugaagacagcaacaguguacuuacauauaguagauaaauauuaaaaaacaaacaaacaaacaaacaaacaaaaaaagaacuauuuuaaaagcuauuucaaagguuugaauagcuaaaacaaaucuaaaagaguuuaauaacuuaguauaauaauauuaagguaauuauacuuuaacuaauccacauaaacugaacuugguucucuuuuuuuaagauucaaauagaucuuaguaaccuuuuuuagucuacccuucuuucaaagaaagaaaaucaauauucagauaggaccacaauaugugauucugcuuguuuauucauucauuuguuugaucacacccaugcaguuauuuauccuguaugugcacaugcaugugcacagcaucuguguggagaucaggggacaguuaacuuguaggggccuguucuauacuucuguucugucaugugagucccagguaucacacucagauuaucagaccugguaguaagcauuuagcccccugagccaccucaccagcccagaugugguccagucuaaugccaccaucuuauaccaguuucugugcagagaaaaacuugauguaguuuggguuccaauggacugggcagaauguucucagaggcuucgcagucggcugaaaugggucucaguggaagacaucacuccugagcccacuggggaguggcguucucacccaucaguaggaccucccagcaguaucuuccagaaguagaaauaagucacaaggaaaggaauuaaagaugaaguacagugagguggcacagccccuagcccuaccacucaagaggcugugcgguaggaacacgggaacuccagcgccagucugggcugugagcucuugucucaaaaagccaaaccaucgguguaaaugaaguauaaaagagaauuuuauuuauuucauuauuuuuucauuuucaugugugugugugugugugugugugugugugugugcuacacauguacauugccugccauccaaggcuagaauuagaguggaccauggugccugccugguguuugcuuauucuuagaauccaggcuucuguccucacuguugcauggcaaaugcuuuaacuacugagcugcuucuacagcuccaaagaguauuuuaaaaucuauuggcauuacaaagcaacuguagcacaaugacuggcauuauuuuaaaauguguaugucguuuuauuuaugacuaaaacaaauaaaggaugauccaagaucgaaaaucccugcucaucugagaggaaagacugacuccaaugaccugggacccuuaccuguaaguucuccugcugagcucacuucacuauuucagacauuuuguaccuugggaugcuggaguuacuuaacaacuauaacuaacauuguuaauaaguuauugaugccuuucguuuuaaguguuauguacaaauuaagcauauaugcaauaugagaucuucuauuucuguuucuuuuuuuuuuuuuuuuaaauaaccuguacaucuaagaccugguacuaaaauaauugcaaugaauguuuccuuacagccaggcugggaagaaagaacccacacagaugggcgagucuucuucauaaaccacaguacgugcugcauggcuucucucuggcaguuguuuguaguacucagguguggacaugaggaagaggaacagcucuuuucuuuucuuuuuuuucccucuuagauauaaagaagacccagugggaagauccucgccugcagaacguggcaaucacuggaccagugaguucuggaaucuggugcucugggucggggugaaacuagaggaacacccuccuccggccucucuuuucuuugaaaagauagugugaaagccuuuuuacccugcuccucaggcuuggacagccagaagcagucagggcugggcgcugugggggcuggggcaguagacugcccaguccaggcaggcuaaaguaacacacaaggcaucaggagcccggcuggggcggggugaguggcaccucccuuucaucuccaggaucacaccuugaacuagauuuuuagucaaagccauugcaaaaugccuacuauuuaagccuuauucauguuuuguauaaauauuucagugucccauaauuaugcugaucuugaguuagguuaauuuauaggaaacucugccauauagcuacuuguuuuuguuuuuguuuuuuguuuuucugaaacaggguuucucuguauagcccuggcuguccuagaacucacuuuguagaccaggcugucucaaacucagaaauccaccugccucugccucugccucccaagugcugggauuaaaguuguucaccaccacugcccagccuacuuuuuuuuuuuccuucagauuuuaauacacaaaauuaaucaaaauuggauauacagguuuuuggguuuuguuuuguuuuuuuaguaucuagcauguuaguguguacucuuuaaaugauaaguaaguaagggaacuccugggaguccaugggaaacaauguauuuuucaauguuuccuuuaacggagaaggcauuuuuuucagaaguagcaugagcugcgaauaguggcacauuguguuaacaacauaagucaaguacguugauugcugugacuucaaggcuagccuggucuacauagagaauucacagauagccagugauacauagagacucucuuuacaaaaggaaagaaaagcagccgcagagacugcugaaugcuauuuuacuuuuaagagaaauuuuuuaaaaauuaaguuuucuguuugcuuuucuucauaugaaacuucaauuuccaaguaauucuuuguuguuguaaauacucauuaaaauauccagggggagaauauaauguuguuuggaauaaaaacgaccuaaacuuccuucauuuuuuuuuuuuucaaauguuuucaacuaaaggcagugcccuacuccagagauuacaagagaaaguacgaguucuucagaaggaagcucaagaagcaggugggugacgucauaacagcugcucacagaaaaugguggugugugugugugugagugugugugugugugugugagugugugugcguguguguguguguguguuaaauuauuuucagagacccauuuauucagccuguaugaguguucuuccucaugcauaccuggucuggugcuuguggaagcaggagagggggcugggucugcagcugcaguuccaggaugguuaagcuguccugcgggccugaaucuggguccugugcaagaguagggagaucucugagccacugagccaccucuucagcuccaugauuuuuaaaagauuauuacuuuuaaaggcuggacauggugaugcaugccauuaaucccagcacucggaaggcagaggucggugccucuccaugagcucaggaacaaucaaggauguguagugacaccuuucaaaaaacaaaacaaaaggaacuacaaguuuaauugugugugagugcuguagcugccaaggugucauguccgcugucccuauaggugguugugagcugcuugccaugaacccugugagcugagcucaggucccuuacgugagcagugcgugcucuuaccugcugagccaccucucuaacccugggaugcguguauuucagauaacuuauaaguagcaugcuuacauuccuguguacuuuucaggagucuuuguaauuuagaaaaagaucaugggggcuagagagauggcucagcaguuaagagcacugacugcucuuccagagguccugaguucaauucccagcaaccacaugguggcucacaaccaucuguaaugggaucugaugcccucuucugguuugucugaagacaguggcaauauacuccuauacauuaaauaaauaaauaggaaaggaaaaaagaaaaaggucauaacacaguugcuguagucucucuccuccuguuuuuguucuuuguaacuuggugaucaggagauuuucuuucuugguguuuuauguuugauuguguuccaggcuucuggacccuugacuaccuuagguguuaauagccaucuauucucagcuuuaagcacaauacaugucaacacaauuuaaaaguuaacaguguggcuggagagauggcucagaccacugacuacucuuccagaaguccuaaguucaauucccagcaaccaccugguggcucacaaccaucuguaaugagaucuggugcccucuucugacaugcaggcagagcacuguauacaauaaauaaauaaauaaauaaauaaauaaauaaauaaauaaaucuuuuuuuaaaaaaaaguuagcugugaacacagugcagauguaugguauuguuacucauuuccuuaugcuuggcagauacguuuguuacucuuucccaugaccaaacuucauuauguuuauuauuaaaugcccaucauuugguauaacuagcauuuuaaaugccuuccucguggaauggucccuuccuccuuucccugcaguuuaggggcgaggccacuagguggcaguacuaguugugcuuuuuugagggguuccaagcuggugacuuccagggauucaaaaugguggguuagauaccagaguuuuucauuuacaaauuuaacaaaaugaaacacuacuuuuuuauuuuuaguguacauauuauauuccccaauaaaauuuuuacauagaaaaggccuuuuaaauucuucagaacuuuuuccuuaaacaauaacuuuguguauaaauuucuauuuuuaggcauugugauuuuaaagcauuugaugagggauauggguagauugaccucuucaguucgaggccugccuggucuucauagaguuccaggacaaggguuucacagagagacucgaucucaaguuaaaaaaaaaaaaaaaccacaagcuuuuuaaaauaagggagcuugggccugguugugcacaccuuuaaucccagcacucaggaggcagaggcaggcggauuucugaguucgaagccagccuggucuacaaagugaguuccaggacagucagggcuauacagagaaacccugucucaaaaaaaaaaaaaaaaaaaaagaaaucauaccacuuccacacuggauauggggaugcauaacaauaaguccagacuggguggguugggagugggcuuugaggguuucuaggcuacccggagcaagugaauggcaauccuggaugacaaaaauggacccuguuucuuaaagcaggguggggaaagaaaguucaguacaccuaagugggguuguccugguggccuuacuuaaagggaaaggguaucggugccuggugaagugugggaaacacacugggcuauuuuaaacaugucucucucccuggcucugcagacugacauuccaaacaaauuugaaaugaagcuucgccgcgcaaacauucuggaggauucuuaccggaggauuaugggugugaagagagcugacuugcucaaggccagacucuggauugaguuugauggugaaaagggccuugacuauggagggguugccagagagugguucuuccucaucucgaaggaaauguucaacccuuacuacggccuguuugaauauucugcuacguaaguuccugcugccucagccuccucauuugcuaagacucagccacacguccuuacacuguucauaaauacuuuaaauggcugugcacuaaauuauagucuccaaaacuagguuacauguuagaaagcaugggcuacgugaucggggccacaaggagauauuucagaaauagcuuuuuaaagauuguuuuauaggaccugaaaauuguauauaauguacauagaaauuaccauuuuaaccuuguguguguguuguggauugcacgugguaggcaggccguccuccacagaaugcccaccucacagaccucuguaagcacacacuuggcuggcguuucaagugcuuccuguauuguugaucucuguaccuuucccauccuccugaauaauucuacauucauuaaacacuuuucccaccauauacaggcagccaccagucugcuauucucugugccucugacuacauccauacauuagaugcaugggaccauacagcacugggcugaaguguauggauuaugucacuuaacauaugucaagugacauuuccuuggaaaacaugaacaaaccucucuuaccaaagauaggguaccaagaacagaccaaccuuuuauucuuaccaaagcccaacauggaaaaccaaugggcuaacuugaagaacuuuugagacaugugggugagggacucuucuggcaucaggcaugacucuugggcagcagagaagcccuuccuagcaugggugaggcccuacaaaggcugugucccuggagcucccugcaugaccacaggagcucuguuggucagagucucuucuccccugcugcugcuuuaccucacccaggggaguggcuuuguagaucuuuuacguuuucauaacuuccuggaucuuuguuuuuaguuucauuuaaugugaauaguuuuucaccugcauguaugccugugcaccauacgcauguaguacccucagaggccacaagggggcaacggaacugauguuccagaugguuguuaguugccaugugggugcuggaaauucaacugcagguaggucuucuacaacagcagcaggugcucuuccugggucuugugagccucugugucuuuccaggggcaguauuugaauucaauucagagaaauuguccaacaaccugucuuuaaagucuagccaugguauuccaagcagaaagguuuuuuucuuuauccuuuguauauacaaauaaaauaguuuuuaaucuaucuguuuacguguccuuugggacuauuuccaucuuuggacagaagugacuauuuaagaccauuaucagauccagugauuuuagcacaggaaaauaacaaaaggggagauuuucauaaucguuuauuuacauaaauuauuuuguucuaugaacuauugagagggucacaugagucugguuugucuuuccagggauaauuacacccuacagauaaauccuaacucgggcuuguguaaugaagaucaccucucauacuucaaguucauuggccguguggcugggauggcaguuuaucauggcaagcuguuggaugguuagcaucauguugcaaucuuuauguguuuauuguuguuguuuuugauuuuaaaaaaucuuaaaaauacuuuauuucuuacaaggguuuuucauccguccguuuuacaagaugaugcuucagaaacugauaacacugcacgacauggaguccgugguaggucucuuaugcguuagaauacggaggguucagugggcagaugauuucuugcagaauuggcuuaauggugguggcaccugcuuagugagugcuguaccucuaaguggcauacauaacccagauaauuuauauuaaaaacagaaauucauaaauuuuaauguguuaaaauauagauaggggcuaaggagaugggccaguggguaggagcauuugcugggcaccaaaaaaagcacaggggccggaguuuacauccuuucaccacagaaaaaguugguugugucugcuugagugucugaaaccucagcacuguuggggauggaagcuggaggauuucugggcuuugcuaccuacccaugagcucaguuucagggucagcgagaagccccaucucagugagacaacacagagggugacugagcagggcccgugugcccagugggugcaugcgcccacuacacacauaugcaggcacagucaucugcauacagaaauaugcagaugaacauuuccccucauagaauacauugaagggacuucgcagugaguacuugcaucucuacugucuacugcacugacuucauucuugcgccucuguccaucaguccaucuguuucucaggcacuguaacuauuaaucacaucuucugcugcaaccuuuuaaauuuacauagcuuguuuguguaugcauguaggcaccacauaaagagggagccaguuccauuguguagauuccaggauugauucugcucauuaaguggcaccugccuuuaaccacugagcccucuccguacacauuuuaauuagauuuauuaaauuuacauguaauuauuuuuauuacauuuguuuaguggggaagggaguguugcuuauaaguggcacacccgugaacgucaacagacacuuggccguaguugcuucucuccuucuguccugugggucucagugaugaacucagacuaccaugcuccgugacaguugccuuuacccacugaggagucuugcaagaccugcuagguucuuuaugccacauaguaguuagauaaucuuuugcaucacguuuugcgauauaguuacuuacaaugaauggcaaauguuuaaagccgucacuacaaaggcagaguguuggggcaggguuccuguaagcgaacagaagcccaaggaccaaguccuguguguggcucugugcaguguagauacacauggucaguuacaaacacuaugauuuuuauguuauguguaugaguguguguaugugcaccauauacacgccuggugcgcuuagaggccagaaagagaugcuguguccccuuaagcuggagcagcagaugguugugagcugugauguggccgcuuggaauuaaaccuuguucuucugcaaaagcaaccagagcuuuuacccgcugagcggcuagcucucuaggccccgauugauucuugugcuuuuucuuguuacuugagaccgugucuuacggagaacagacuggccucaacacacuauguagccagcgaugacuucugacccuccugccuccucuuaugggugcugugguuacagcuacaccaccacaccugguucgugcuuuucuaggaaucaaccccagggcuuuacacaggcuaguaagugcuccaccaguuuagugagccgcauccccagcaggagucuuuggauauuguaagagcacagggcuauuauuuggguugguuaaaagauaacauacuuaauuugaaacuuuugaguaccgggcagcagugaacucugacauuccacauggacucaucucacaguccuggugcugggagcugaggugugugcccugcgcccggcauuuccucgguuaugguggagaugcagacucagacccucauacuugugaggcgcacgcucugcugccugagcgucucccagcccgucaguguacuugucgugccuguugagguaucuuucuguauacagauuuuuuaagugaguuuuuccuuagggcuguagcucagugguaaagcacaugccuagaauauacaauucuaggcugaguucaauuccuagcacugcaaaauuaauugauuaauuaauuggaguguaauuuuccuucuaggauagugaauauuacaguucucugcgauggauucuugaaaaugacccgacggagcuggaccugagauuuaucauagaugaagaacuuuuuggacaggucuguggacuuucagauacuaaacauccuuugcaaaaccaauccugucaccuaauuauaggcgucaguacacccuugagacacuuuugggcucagcuuauacauucauucucuggaagcaaaagcugucucucagccagcauuuguaucugugcugacacaugaccacuucuguguuugucugaguagaacuuauguuuaagguuucuuagcuuuucacuuuugaguggauuuaauuuaaaacaccaggcuucugguguaauucaugugcgcuuuucucccauuucccuuacaaaaaccacauucauguuuacuuuagacacaucagcacgaacugaaaaccggaggaucagagauuguugucaccaauaagaacaaaaaggaguauaucuagugaguacuuaauuucuaaauauuuucuagaaauaaucccaugcugcuuuuuucuguuccuucuccuccucuuuucuucuuugagaagauuuuuccuuuccuuguucuuucuucccccgugccagaaucucaguucucuuaggacaagcacacccuaguucuccccgauucugcucagcuuuugccuugggcccagcuccagucucucuguuucuuuuuuuuuuugguuuuucgauacaggguuucucuguauagucuuggcuguccuggaacucacuuuguauaccaggcuggccucaaacucagaaauccgccugccucugccucccgagugcugggauuaaaggcaugcgccaccaugcccggcugucuguuucuuuuuuguuguuguuuuuuucaagacaggguuucucuguguagcccuggcuguccuggaaaucacuuuguauaccaggcuggccuugaacucagaaaucugccugccucugccucccaagugcugggauuaaaggcgugcaccaccaugcccggccagucugucuguuucuaagugguauaaacauguccuaaaauuguuucuugguuuguauugggggggaaauggaaagaaauguuuuguuuuguuuuuccuccuuuuagccuuguaauacaauggcgauuugugaaccguauccagaagcaaauggcagcuuuuaaagagguagguacacagcacucuugcucaccauacccagacuuccaagacccacacaucugagaggguaagauguggugggcucuguaaagucuuucucaauauguuucuaguuugauuuuauguuuuuaaaauaauauacauaugcacucauggagaucaguaaagaacccccuggaguguacaaguugggucccaauucuuucuucuagucccaugcucccagaaauaagacucagacccaagucuuacaaguacccuggccauauagcuagguucuucucugacuaggaucauaacuuauagauaacacauuuauuucaaucuuuauucugccauguagcugguuaccucugcucaggugcuauaugucagucucacuauauauuccugggcaaaucuuccugcucugacugucuucaagaauucuuagaaucuuagugggaagugguuagggaggcucaaagcgggauuaagcuggggacuagaggaacucagagaaaaagccaugagcaagcagcugugccagugagaacgagagucuucaguccuccaagugggggaaaguaaggugcagaggugcuaugguugggggcggaggccggaugaaugcaaguccaagggcagccugggauacauaguaugacccugucaaaaagggaguagggagagagauuguaguauuaagagcaggcugggagggcucaguggguuuaaggugugugcugccaaacuugaggacauggcuuugaacccugggcacauauaaucacuuaguggaaggagaaagcuaacuccugcaagcugucauccgacugccacacacgugcuguggaacauguguacccauacauuuacacagacauacaggcacaaacgugauguuuuagacaaaaaucaaauagaauagaaauacaaaguguuuaccagaccguuacagugcugaccuuggcugugucugcagcagggcagguggcagugugguggaggggcaguuggcguacaaaugacugaauuuagcuuugcacacucuguguacuugucugugaaaggaagaagugagaggugacuuugugcaggcuucagugggugaaggagaggagcagggagcugaggacacugcagaagccucugaggccuugcugaggggucuucccuccugcagugggcguggccaggguggggggaggaauuuugucugacucagucuccucaguacugugaacaagggagggagagggacaaaggaggcuguuaccagccacuuuaagaaauaaagaacagccauauugaaaugcaguguguagcggcaaagucuguagaagugaacgcgcuccccuuuaccagacgcuggagcauagcugugccugcucacuagcuuccgacgcguuuccuuuccuucuagggauuuuuugaacugauaccacaggaucucaucaagauauuugaugaaaaugagcuagagguaagaacuauuucugcaugugcuugggaauguaguuaaugagcgcugcaggccaugaguucaguccuuagcaccacuggugugggguagaggggauggccauuuguggaagggaugagggaggggcuuccuuagcgugugaagcccugggccccguccucagacaccguagaacgggugugguggugcacaccuguuacccagcucuuuggagguggaagcaagaagaccaauaguucuugucauccagagcuacacuguuugaagcuaaccugggcuacagggacccugucuuuaaaaagagaacuggagggcugacaagauggcucagugggaaaaguagaccgccaagccugacagccugaauuuggcuccuggaguggacauggacccccaaugaguuguccucuaacuuucucacucagaacaugacauacacaugcugauguugccauacauacauacauacauacauacauacaguuugauagauagauagauagauagauagauagauagauagauagauagauagauagauagauaaggaaagagaaaugcucuaugguuuuguuuuuuuuaagauauauuuuauguauaugagugcacuguugcugucuucagacacagcagaagagggcaucagauuccauuagagaugguugugagccaucaugagauugcugagaauugaacucaggaccucuggaagagcaaucagugcucuuaacagcugagccaucucucuagcccuaaaugcucuauguuaaaacagcuuuggcuggaugucccagcacugagggacagaggcagugaaccgcugugaguuugaggccagccugaucuauauaaugaguuccagagguacauaauaagacccugucucgggaaggagaaaacagcagagcuucgcccugguuuuccugcuuaccauucugacugccgauccguguaucugucugcagcuucucauguguggucugggagauguggaugugaacgacuggcgggaacacacaaaauacaaaaauggcuacagcaugaaccaccaggucauccacugguucuggaagguaaucuaagacauguacucagucgugcuaugccucugagugugaguccacccuugccaauagccauggguaagcagggagagcauucagggugcacugagaugggcacauuagcuuucaccaaugugggaacacucuuagaaugugagguaaccggcaacauggcuccucuaaaugcuuacagcuaugccuuucaguaauaccaauauaugcaacugucaaagguuuuuguuuugggggagggagggagggagagagagaagagagagaaugcuugcauggauuugugucaaugcgugcaauaguuguagaagccaagagggagcaagguuccacuggaagcacaguuacagacgguugugagccaacuguagaugcuggggacugaauccaggccaugcaagagcauucuuaacugcugagccaucucuccauugcugagagaaaagucuuagaaauaggauuuguuugucuuuguuuuuuugagaacaagaacaaacuuuagugauuauucucuaaaugcuaaucacuuuuugaguucucuguacaagacuacacagagaaaccuugucucgaacaaaaucaaaauaaaaaaaaaaaaagaguucucuguauagcuuugacuauccuguauccucuguagaccaugcuggcuuugaacucagagauccacaugccgccaccacugccuccaggggcucuaauggcuuucccagggcaguuuguuauuuucaguacucuugucacucuugucuagcagaagucuuucucuuuuucaggcuguuuggaugauggauucggaaaaaagaauacgcuuacuucaguuugucacuggcacaucccgugugccgaugaauggguuugcugaacucuaugguaaggguccugugcagagcucucagaaguaugcacacaccgacugucauugucauagcucaggcgucuucaggcuuccacuuuaguuuaauuuuuaaacaacuaaguuauaggcuugggagacaacaugaugguaaagugccaaccuagacuaccuggcaaacugcagguagguaagaggcucugucccaaaaagagaaguggaggugcugcuaccuucucauuggacagugacagaaacuggcacaugguugaguuacuuuccgucuugggcauuaagcugcguucucugugcugugguccuagaaacccagcaccuccagcccagcucugccuuuccaagcuuccucacgcugcagcccucugaggcuccuccugucaugcucacucuuuuguugcuacuucauaauuguaauuuugcuacuaucaugagucauaauauaaaugccuauguuuucuaguugucuuaggugaccucuauaauggggucauucaguccccuccagggugaaaacccacagguugagaaccacuacucucacugcuggguggagagagcagggaaauagcguuagcugacaucuaugcagugaguguagagaauacaccuuagaggauucgcagacuacacuaaagaaagguaaauucuccucuuacccaaggauucaccuuccgcuacuucaacuaccacagucauucaguccagaaauauuaaaggcauuuuaauaaacagcagagagcauacuuacaugccuacaugugagaugugcaugcaaagaccagguucaucacuauucacuauuuuaggcguccacaggggacuugaaacauucucuccacagguuaggaagaacucaacaauaucuuaggaacuuguauguaaaaaauaaaguuaaauuaaaaguaaguuuuuccaagcuuuguugauagacaaucuuuuuugugguuuggugugagcuguggaguauagagacucuccgaagggucuuuauucuuuuuucuuuuuugggggcggggguaguuuggguuuuugguuuuuggagacagaguuucucuguguagcgcuggcuguccugaaucucaccucacucuguagaccagucuguccuggaacucagaaauccgccugccucugcuucccaagugcugggauuaaaggcgugcaccaccacugcccagcaggguuuuuauucuuguggaagauggugggaccccagauaagaucacacauagcucccccucuacuuuauuuuauuuuauuuuauuuuauuuuauguuauguuauguguaaugguguuugugcaccgugugcuugccuguggaggccagaagagcaugucagauccccuagugcuacagggaggucgugagccacccaguguggcugcuaggagccuaacuccuguccccugcaagugugggcucuaaacagcugagcucucuccagcccugguacugaaagucguagcugugaucugaucaugaaggacaaauauagaaauuaugccucugagaaacccucuggcagccaugcaugcacauuuggaagugauuaugggauuuaaggagaagaguggaaagaaagucucagaucagguugugagcuugguuaucuggcgcuugggguguugaggauuggagagagcuaaguggaaucucugaaagaaaaaggcgguuucuaaaauguccguaaugagaaaaacuguagacuguguaacagggucacaugcacauaagaugcucuaaacucgcauucucaaccuguggaccgcgacccuaggaggcucacauacuggauauaugcauuacaguguaaaccacuagcaaaauuacaguuacgaaguaucagugaaauaauuguaugguugggggucagcacagcauggcaggcugugaaaggaggggggaagcugcccagaaggacucgggaaucccaggacuugggaaucugaaguacacagguugacaguacuuugaggccagccucagcuauauugugaguuccagcacagccuggacuaagaguaaaacccagucuugaacaucagacaaccaagccuugccgccaagcuugacggccuuaguuaaauccccagggcccacaaguggagagagaacucccacagcuuguugccugaccuccacacauggacacuaagguacagaggaaauaauagugaauaaguauaauuuaaauguuuuaaaagcuaaaagcuuuuacugugguuccguagugcuuucauggcauguaggaggcccuaaauucaacauugaaaaacaaaucaaacaaaagaaaaccccacagaaaccacacaaaacccuucccaggguuaccucaugagcuaagauugucaugacuuucacauccuucagcuguguuuuauucuguuauuuucaguuuuuacagugacauuacauaaucagggaaaaauuaaaacugguccaaugggaaucuaaagcagaaaggaaguccguccucccucccuguaccagugaagaaaguccuaauucaagaugcaacugggucagucuaggaaaaagccgagugucucaggugugccacggugggcagaaagggcucagcgcccucaggugaagggacagacugugcuggacgacucagcagugacuccucacacuggggaggcuucucugucucuucugagucguuuucugugugugcgaguuauauauggagaaguauguuuugaaaugucuacggacuuguggguaaagcaaauuaaaccacagaaacucaucuuccccacaggcucgaauggaccacaauccuucacaguggaacaauggggcaccccugauaagcugccaagagcacacaccuggugaguagcuguuuuacccuagacagggcauaguuucucccugcugguguaggggcagccccagcugugcccucuuguaauagguguguggcagccuuagaagacaggaaggacagaaacucggauccagaaacccauccugcuugggcucaaaauucaggcagcuaaagauagagaugcucugggcuggaggguuugcucagcaguuaaaagcacugacuguuccuguguucaguucccagcaaccacaugguuacucacaaccaucuguaauggaauccaauauucucuucuggugugucugaagacagcuauacucauacauaaaauaaauaaaucuuaaaaaaaauuaggcccaacuaaacuguuggccauauauauaucccuguuccaugaguaauguggucuuuuccccagagugccagaauauucuaucuugauggcuaacauagucaaggaacgcaguuaucuggagagggauguaaggacgagacugcaccagaggucgggagacuucccuggcuguugugaccucuaauagcaaugauggaacaugcucuugaccaaguagcagugggacuaugguuaccauggugacauuuccucccucucugucacucuaaccagauccucucaaucuuuucagcuucaaucgccuggaccugccacccuacgaauccuuugacgaacucugggauaaacuucagauggcaauugagaacacacagggcuuugauggcguugauuagauuacaaaaaaaaacaagcuguggugucuuguacaccauaguuucuaagcaaaagcaaaaacaaaaucacauuuuaacauuuuccagauaguuucuaaaagauggucacuggcucuucccaccgagaccagaggacaguuuauccaugauuuagccaccaccaugcugaccuguucacuuguccaguuacuuuguccaguuguugggguucauguguacggcaggaugugaguccuguacgccugaguucugacccuaucucaucuugcuaggcacauccuucugaaacuacugagauuccaacugugaaauaucuguaaugaguagcuggugggaaaaauuugaugcuuuuuaaagaugaaauuuggacaaagaaagucuuuaaugauuaguauacugcgacauacuuaguaccacaugucgcuacuuauucuguagaccugccuaguguaccuuaucgccuagaaccuugaagccgcuuuggaagauguaucacacguguuuuuagucacuuaagucacuaguguuuaaaaaaaaaauguacucuucacuugggaaguauuucacguuuguuagcaugcagcuugagccuuacaggcgauucuggagacaaguggagcaagcuuuuauugcaguguguagugagucuuaggccuccuuuuugccugugcauccuaaggcuagagucauuauguguuagugcguuagaauuccuucaaacacgaaacaagcuccacaacgcaguguuucuaagcaugccgugaagaaccgaguuccauguaugacuugcccuuaccagccacucuucacgcuugcagucacguaguacauacguguuuacggaguucauuauguuuacagauuaagcgaauuucuguaguugcauuuuuauauuuuuaguaucacguuaguauaaaaauuuguuuaaaauaaccaaagaguaguucaaugcauaauuuguaugaauuuguuaccaaguuucuuaugcuuucuaaaaaaauacuguuuccuaugaaaauuauguuuaaucaaaagucaagaacccuuggggcaaaaugcuacagguggagucccaccauagucaccuuugaggcacaggaagagguuccaugcaugaaucugcacacaugagcagugcuggcugcugugcaccgggcccuugggaugaagccaucagcacugacauccagccccgucuucauccucaggcuuagaaacaagugggauggugacuuuacagucagugggaaguaagagcccgcagaauaacaaaggcagaaggacaggaaagcgagguccgaguccgacugcgaggucauaucugccaaggcuccuucuagucagcuuacacuggugauuauacggaaaaugcucuuagauaugagaaaagcaauguggcauguaaugaguuaguguaagcuuguguuauaaacuuuccgaaugcuuauaaguagccugugggagcuguaagaaauacuuggggccauugauuuaagcuuguuggcucuaacaugacuaauaccugucagcccaugguagggauuucagugacaguaguggaaacgcuuuccacagaccacaccacuauguugaucggugaaagacacccccaggccagugcaugcuuccagaguguccugaucagucagccaggcauggccaccguccaguguugauuuuuaucauuagccagcugagccugcagcacggggcucauuuccccgucuggcagauguggauagcugggcccacucauucugucucucaaggcuaugguaaguucuuaaagggguacuuuucugcaagccaccagagucugagucagcuguccccucccaguaagcauguucaccuaaagugauuuagccuaggcgaggaggaucccuacuacgugcuggauuauguguguguucauguaaggauuucagcgucaaaaguucacuuccuccauaguggcaaaauaacacuaauaugggcugguguguuaucuggagugcccccauuguguggaacuaagggugaaaacagaacuguacacgguuguucagugucguccccagaacucauccccagcagggcuuagaaaacacgagcuuccuuccuccuucacacucauuuuccuuuggaugauucagugacaucacagaaccuggugucccccucccuaccccagguguguaguaaugguccgaagggacccuggcuggaacaccacagccccccaugcuagugcaugaaaacaucucguucauauucuaccacuggggcauuguggagucacauucacgaaacacgaagaccuuguacuucucuagaaaaguguuuuagccuacuuuuucucuaauccccaccccaacaaaugaaacacaaaauugcauuacaaaagcaaacccaaaugguauuuguuuucgauuuuauuuauaccgcucgaguuauuccuuauacguaucaaguuaaacucaauugguuuuaaugauaagcuauuugacauuguuuuuaaauuuuuucuuauaugguaaauguauauccagauuaagguaucgaaauuuauugcauaaacuauaaaaucauuuucaaaaucucaauuccacaaauaaaguucuauucugauuuuaaaaacaaagc

SEQ ID NO: 5188 - RNA, 20890 nt, Mus musculus
caggccgcggcccugagcccggcggagcccggcggagcccggcuaagccccgcgagcgcacggagccccgaggccucggcugccucccaaacuuuucaaagucggcccgcggcucggccggccugggcuccgagcucggccgggaggacuccagggaccgagaggaggacccggaggaucaggaggaggacccagaggaggaggggccgccgcaucaaagacaccggcuucccgcggcccgggggcgagccaugcgcggcggucgguaaugucagcggaacaggacaaggagcccaucgcgcugaagagaguuagagguaacggagcuggguugggaggacugagggagcucgggcccgugaggaagccaccggggcgacccgggccuaagugcgcggcuccaggcgcccgggguccccacuuugugugcagacgugcagcgcucagcaucccuuccuacccggcuccucuccugcuccccaccacacagcacaauagacaccucggggugaaaaagagacacccgcgaacaauacccacccccccagaaaacuaaguugcacugccagagaguugaggcgcuuggcggaaucaccucccuccaaaaggcaaacacauauucaguauauuuucuuuuaguugagagagaggaacuagauacauucagaaggcguuuucuuuauuaaccaauaagauuaagaaucaaaucauacaaaaacagcuuccugcaucauugguuuucuuccuugccuuacugucucagagaaaacagagagaagggcguacuaaacaaaagguacugcauguaaguuuaaaacacacacacauacucacuaccacauaccaucuggagauuuggagauaccugccagcccuuauuuccagcuccggguggguuucucagucugggagucucaaaguuuguucauugugcaaauauuuguugaacauguacuagguacuaaguacugugcuuggcauggguuaaaacagugaauaaagaauuuagauguucuuuacacaggagugcaccucucaguaaacaauauagaugguaaaguacugugcaaaauaccaaagcagggaauggggguagaaaagacuuccagggagcgaaggccaggaguguguagaaggugaccuggaaggugggcugaaaggaagaugacacaaucccugucuuaccuggggagaaggcacuccaggcaaagggaaccagagaugcaaaggcuuuggguuugguuugccuguguauccaagccgugccaaggcagcuaugguaacuuguggcaaggugagccaggaugagccgggacagccaggugugaugggcugagggugggugugucuugagagucauuaaggcuuugucuuuugcuaggcacggugggcaggccuuuagcuccaacacugcugaggcagaggcagguggaugucugugaauuugagguuagcaugaucuauacuaguaaguugcaauccagcuauugagacccugucaaagaagaaaaaaaaaaaaaaagaaggcgccgggugugguggugcacgccuuuaaucccagcccuugggaggcagaggcaggugaauuucugaguuccagcuagggguacagagagaaacccugucucaaaaaaaacaaacaaaagaaggaggaggaggaggaggaagaggaggaaggcagacaggcagacagauuuuggcuuuuacucugagaugggaacugcacaguuuuucagaaaagcaguauuggguuccuaagggguuugucuggguguugugcagaaaaucagacugaggggaaugacugaagcagagaggcuacugcguaaccuuuccauccaccgccccccaaaaggauaaagugcacauaagucggcaacauuuccuuuugccuuaugugaccacggacauccauugaugucuugguucagugugacuuccgcaugcacaugaccccagugcaguggcacccauguucuucucucaaauguuuagggagaauucucuuuuucuagcacuuggaggaugguucagugggcaaagcaucugcccaucaagugugaagcucugaauccaggugcccaagaccccaguaaaugccaggugggugugguggcucuccugucacuccagcaggugaaagggagacaggugaccccccagagcaaacuagacucugacucagugagcguggguuucagguaagagacccugcuggaauacauacguuagaaagcaaugaagaacccaccucuggccuccacgugcacguaaaaaggaagaaaaggagaaauggacucuuuaguuauugaaacaaaaguuuuaacuuagagcagaguguugcuuuuaaaggcuugaugucugacaaccuuucauuuggugaauuuuuguugugguguuguuuguuuguuuugagacagggucuuacuguuguagccuuggccauccuggaacugacuauguagaccgggcuagccuggaacucacugagcucugccugccuuugcagggggugcagggauuaaagaugugcaccacaguauuccggcuggugaaagauguaauccuguguuguuugugauuuagacuugcugaagccaucaaggaauaggcccuucugagaugcacuuuuccccugagauuuuugcaauagaaguuugccuguuauuaugaauugcuucaggguuuacggaaaggaaacagcucccgggguuguaccuuugaucuuagcagucuguccuaagcaaauguaacguuaauuggaaugcguuaguauuugauaguguggccaagaauacagauaauccuucauauugcuguguuugcagccacauuagcaguaggcaguuggcucaauuuucagcucaagaauauucuaagagugaagauccccaaauacaagaaaauacacagccaauauuuuuacagcauggagaguaucuuuauaauaacucauuuccagacauuaauuuuccagauauuuuuggauugguuccuaguccauaaaaguuuuguguuccuuuuuuuguuuugcuaugauuuggguguuuguuuguuuguuuguuuguuuaaucuuugagacagggcuucucuguguagcccuggcuguccuggaacucacucugucgaccagcauggccucaaagucacagagauuggccugccucugccuucugagugcugcaguuaaauuuaaagguaugcaccaucaaagguaugcaucauuguuuuguuuuuuuuaaaaagacucauguuaugugguccaauugguucaaacuccaggcagacuccugccucugccuucugaggcagaaacugcaggcaugcacgaacaagcucacccugcuucuaucugagcuuuucugaagcaaaauacugcugaaauuagcugcccuggaaccguuuuuuuuuguuuuguuuuguuuuguuuuuuuuugguaaauuauauauauauuuugagacucuuugcaagauguggcuuuugugcaguauagauucuagagccgaguuucccaggcuguucucacccacuuguuuuuccugguagaccuuagagugguuuuguguuuauuucauguguauuaaaagacuucauuaaauucaugaccuagggguguguauguguguaagauuugcauacauauguguguaugaaauauguguguguguauauauauauauauauguguguauauauauauacauauuucaauuuaaaugaauuguuuuuuaaaggagauuuauuuuauuucaaaguguguguauauguggaggggaggugccuaugcaugugaguaccagucaucuuaaaaccaggaggacauaugaugcccuggagauaacguuacaguugugagcaaccugauaagggugaaccagacucgcaucuucugcaagagcagugugugcucucaaacacggagccaucucuccagagccuuaaaugaauuguuaagaaaacaguacagccaagcagugcuggcacaagccuucagucucagcacucaggaggcaaaggcagguaggucucugaguuugaggucaguguggucuucauagugagcuccagggcugugcagagaaaccuuguuucaacaaaaguaauuuaggggcuggagagguggcuccucacucaguaguuuauauacuuacugcuuuugcagagaacccaaguucaacucccaguaacccaggucggauggcuuaacaagggccucaaauuccaccuccaggggauccuguggcucugguuucagagggcaccugcagucucucucucacauguacacaugauuuaaaaucauaauaaaaguaaaucuuuuuaaaaguaaguaagauggcucagcagguggcgguguuuguugugucagccuggugaccugaguuggguucaugggacuccaaaauaaaaggaagaaaagugacuuuaaaaacguauccuuugacugacacauguaugcuguggaacagcuacuccuccacacaugaugagugaaugaaugaaugaaugaaugaacgaaugagugaggaacugcaauagguagaacucggguuugacaaaaaugagaugucauugacugaggacuuugcuguagcgugcucuuauagaucaaaaacaucacaccuuuaaucccagcacuuggaauguagaugcagguggaucucugugaguuccaggccagccuugucuacagaguggguuucaggacaguucagaacuccauagugagaccuugucuuggaaaaaaaaauacccgaagacaucauaauaucuuguuauuaaaugcagauuuccauggggcuugguggauggcucagugguuaagagcaugggcugcucuuccagaggacccggguucaacucucaguacccacugucaguucacaaucaucugugacuccaguuccaggggcuccagugccucuggccuccuucagcaccagauacaugcacauagugcaaagacaaauaugucggcaaacagucauaugcauaagauaaaagucaaucaauauuuuuaaugcuuuuggagggguuucuucaguugggcagaauguuugccuaccaugagggaagcccuggacuucuucagauaaacuggaugaggggcacaggcuuuuaaccccagcacuugggagacagaggcagguugaucucugucuaaauagugagauccuggacagccggggauauuaauggagagacccgucucaaaaaaaccagagagaggcaagggaagguguguguuucaaggucauccaugguuaccuagugaguuaaaggccagcgugcaguagaugucucuccaaaaagaaaaacaucaauacaagaauucccauggaggcuuaaucuugaggggaaaucacaaaagaauugaggaagagaaacaaauucagagaugaggaauuaugaauaaccagaguuagcaguaacauaaggggcagggugacauuuacagaagugacagagaaguccuauaauguacuaacaggagguguuaccaauaggcaauauuuaguaaaugccccacugggauggaugaauggaggguuaggauugagaguggagaaauauggcagaaauuggcagaagagcuaguggaaggacgggagggaacaguuuccauguuuaacauuggacugugugugacucaguacaucagcagcaggcgucugagucuggcuguaagccuauuguucaacuccacccacacccccaggguuuuccaguguaugcagagaguauaccugacauggcuuguaacugaagcgagucgcuuaugucagaaacagagaccuggaagucguagguaaacaggugaauacuaauuaacaucuugggaacacacaagcguacccgagagaaugaagagccuugagguuucaaacguugaaaaauacuaacauuugggagacagauggagaagacugaagcagagcaagagagcugucaggaaagauggaauggugggaggaagucacacgcagaagaagaagagcgcacuuacgagggacacacagaugaaucuugguguuuuaaagaacauuuauuaggaggaacaacaauaggaacuaaccaguacccccagagcucccuggaacuaaaccaccgaucaaagaaaacauaugggugggacucacggcuccagcugcauauguagcagaggauggccuugucggucaucaaugggaagagaggcccuugguccugugaagguccuaugccccaguauaggggaaugccagggccagaaagcaggaguagguagguuggggagcagggggagggggaggggauagggaauuuuuggagggggaacuaggacaggagauaacauuugaaauguaaauaaagaaaauaucuaauaaaaaauuaaaaaaaaauauucuagaauaaauuugguggcacacgccuuuaauccgagcacucaggaggcagaggcagguggaucuuuugaguuugaggccagccuggucuacagaaugaguuccaggacagccagggcuacacagggaaacccugucucauaagauguaugcauuauuaugugcaagcaugcauaccugugugaauuuaugugcacuacguguguucaggaggccacagaggcaagaaggcuuuggauccucuggaacugcgguuacaagcaguugugagugccgagaacugaaaucagguucucuggaagagcagcccgggcucuuaacugcugcacacccucugugugugugugugugugugugugugcgugugcguguguguguuuuguuguuguuauuuuaaguagagucuuuuugcuuguauuuuucagacaguauuacuucguguaucucuggcuguccuggaacaaguucuguagaccaggcuggccucaaacucacagagaucugccugcuucugcuuuccaagugcuaagauugaaggugugugcuaccaccaccccaauaguagagucuuacuauacaacacugacaggccuggaauguacuguugagaccagacuggccuugaacucacagagaucugucuuccugagugcugauguuaaagucaugccacaccaccacucagcugguaguguguuauuauauaacacuggcuggucuggaaugcuguuuagacaaggcuaaggcuggccuugaauucacagagaucuaccacccuucugccucuggagugcugggauuaaagauaugugcugucuuuccccagauggaacuuuaaaaaaaaaaaaaagauuuauuucugaguaucugucucugucuuucucacugucuccauucuuccuacccccaucccuguguguguguguguguguguguguguguguuguaugcacucucuugcgccuguccuaugcaggagccuaaauguccagacuggagcauugucuaccuuuggguugcuggccuuuauaacacccauguagacacuggucccagacuccugugcucugacaacaguuaguguuuaacuguggagcccuuucuccauucugucuuuaacauguugacuggaagucauguguuuuaccucuugguuguaugacagaaacuccuuaugggaugaaggucuguuuugacucacaguuucagguuccauuguggggaagggacaguagugggcacucgugguggaggcuuggucacaugacugcagacagaagcagggagagcuagaccagaaucaagaauaaguagacucuuaaaugccccccccccucgggggcuggagagauggcucagcguuuaagagcacugacugcucuuccaaagguccugaguucaaaucccagcaaccacaugguggcucacaaucaucuguaacgagaucugauguccucuucuggaacagcuacaguguacuuacauauaauaaauaaaucuuaaaaaaaaaaaaaaggccaaccucuagugaucuacuuaugccaguaaacucauucccuuaaggcucuucugccuggcacacaagcugggcauaguggcacaaaccuguaacccucaguagguucaguaggcugaggcaggagaaucuugagucccaugcuguaguuagcucucgugcucucucucucucucucucucucucucauagacacacacauacaccaccaccacaacacaauacauaaauaaaugauuugguuuugauuuuuugagacgggauuucucugcaucuguucugaaacuugcucuguagaccaggcuggccucaaacucacagagaucugccugucucugccucuagagugccgagauuaaaggcauaugccaccaugucuggugauuuuuaucuuuuaaagauauacuuuaauuuuuuuauguauauauguauauagaucuuaaauauauuuugccugcauguauguaugugccuggugcugggaucaaaagcauauguggcaccacacccagcuuauaaauuaauaaauguaaugaaaaauuuuuaaaagacaaacaaauguaggaggagauauuaaaauaauaucuucaacuuccaaaacagagagugaaugaaucuaaaaaugaacaaaguccuggaaacauagcccaggaguagauuauuugcuuagcauguguaagguccugaauuugaucccaacaccauuuaaauaaauaaaauguaaggacaaaauauaacuuucccaacuuaaugaucuuuuuuuaaaaaauaguguucaugguucuuuuugaagguguacuuuuaaauuuauuuuuauuucauguacauugguguuuugccugcauguauguauguuugagggugucaaacucccuggaauuggaguuguagaccacugugagcugcugugugugugccgggaauugaaccggguucucuggaagagcagccaguguucuuaaccaugaacuaauuccccaguccuaagguaauguuuuuuucaaaguguuuuuucuuaaucccuagagcagugguucucacagguuggaggaguugucuaagacccuuagaaaacacagguauuuacauuucaacucacaacaguagcaacauuacaguuauaauaguuaauguaucaucaaaaauaauauauaguuaaagaagcagcaguguuaugguugggucagcacaacaugaggaacuguauuaaagaguucauagcguuaggaagguugagaaccaccucccuacaugagucuuuuaaaaacucucuugagcuggaaugugacucacuuaacaaaagugcuugcuuagcgugcagaaagccccagacuccauccccaacacugcauaauuucagagaggugacacaugucuguaauccgagcacuggagaggugaaggcagaaggaucagaaguucaaggucaucuuuaucuaccuggugacuuaaaggccaaccugagcuacacaagccccugucuaaaaagaaaagggagccgggcguggugaggcacgccuuuaaucccagcacucggugggcagaggcagguggauuuaugaguucgaggccagccuggucuacaaagugaguuccaggacagccagggcuauacagagaaacccugucucgaaaaaccaaaaaaauaaauaaaauauaaauaaauaaauaaauaaauaagaagaaaaggaaaggaaaggaaaaaaauaaaacaaaaaggaaaaggagacaauuucccuuaaugaagaaaacacugcaguuuauuuuccuuuaguuccaugaaauacuagugaauuuuaaauuuuaaugcuguuucuuaaaacauauugucuggugaggcuggagagauggcugucguuagagcacuggcugcccuucuagaggaccagauuagauucucagcacccacaggagggcucccagcugucugggacuucaguuccggaggaucugaugcccucuucuggccucugugcacacugcaggcaugugguacacagauguacaugugagagaaaaaaaacuauguacaauuuaauuuuuuuuuuaauuaaagacuuaaaaaagggcuggagagauggcucagaguuuaagggcacugacugcucugccgaagguccugaguucaacucccaacaaccacauggcggcucacaaccaucuguaaugagaucugaugcccucuucuggugugucugaagacagcuacaguguacuuccauauaauaaauaaauaaauaaaucuuuaaaaaagauuuaaaaauaugauuuuaugaaaguauuacuacguguuccucuguauacacagaaggaaaauagagccgucgacagcaagccgggugucugaagugaguuagagccgucgacagcaagccagguguaugaagugaguuagccucacgguugugucuggcuggugggacuugagaugcuuuucagucgaugucugaucuggagacagaaaccacagcagguuuuaacagucauuaccagauggcgaauauaagugaccacagcauggaaguaggauuuucauggcgguggcagcucuuggaaacaaccaccaucacugaagcuuucagacaaaccaagcaaggcuggagcuacuaaaauacgugaacuccaggagggaagcaugugggauauaaucccaacuucugagaaaaugaugcuacauggggucucacuccagccuugacuuggaggagaggggugaaguucugaggaucaaaccugggugugaggcaccugugaggccaaugcucaacuccaacccaagcccuccaagguuuuuaaaaaaguauuuacugggacaggggcuauuuacugugguguauuguuguaagccuugcagcucugagggggaagggcugucccaguggaagcaaguguugcugcucugaggggaaagguauccuggcaguugagagccaaaucacauugugcaacaaaccuccuuacauaagagguuuauugggaaagacacaagaggguggcugccucugcucaggugagaagcagcaaagaacugacccggagacagguuuuucuuuccagcagacuuuuccaggagauuuccagagcagugacugguaggauuucaagucgugaucuugggacaagcccaaggauuggugaauuuuugagcucagagauugguggguuuucaaacccagaagugagcucugacauuuuaccuuacacacucccccccccuuuuuuuguuuauuaguaauaagcuaucagguguaguacaaccaauuuaagcguaucccugauucgcuuacugaaacucagacuacgguuauuuuauuugacuuugacauuuggcagcugagguaggaucaagcaaggggauggagcagcagauuucagcaucucagcaucccuaaggguaaaugaauccugucacagcugcucucuuagucuuccauucugcauuccauuaagcauuaagaaugauuuucugcucuuugagcagaugaaagacagcuuucuuuaaaagucaguuuggauuagaucagauuguaauaucaguuuucacuuauagcauuuaaaagaaugguauggaaagucuugaggauuuuguagucaauaaggucuaguggcuaugcaaagacauuucuuuuuuaugucucagacagucucagagcuguucuuacauagcaggaucaacacauacauugccugucuuguugaucucaccaaucucccucuuuuuguuuguugccaaggucaucaggguggcuuccccggucaaaucuuauuaucaaugauuuggauggacgauacagcuucucuuuuccugucagaacaaauguaaaaccucauccccaacauaacauauuuccuuucucucauuuuggaauuaggacuuguauaggcugaucuaauucagcaguucuuucugaaauccgguguaucuuagcaauugugcuauuugucucauugacuuuuaaagagccuaaagucaacaaagcacguuuuaaaccaucuuuuggagauacuagauccuucuucuguucuaugagcauguucuucaaaguccuguuaggucuucuuauaauggcuugaccuauaggaucgugagcuauaacuggaauaggccucauccaugauguccauaagauuguuguauuuuaauggacauguaugugugagcaucaucaguuuuaaucuggaaaggcaucuccaagauagccaucguuucuaauaaaugugcaaucucagaaucaucccccucagaacuccaggcagaaguccauuggaacuccaaacauguaucaacuguaugaccuauuaacauguguacguaucuuaauacuccaaacuauaaaaugaaacacacaaucuguuguuuggcauuucucuaaguucugcauaagcagaaucuggauucuuaauucaauauauugcaucucucugggcuacuguggaaccuuucugccuggaacuaugcuuuuugauguuauuguacguuccagauugaauucuuuugagauuuaaagauuuugauuuaaauauuccuuuaaccucuguuuuauggucucuaguuuaguaucuaauuucucagucucuucuuucuccaagucuguuuuguucugauuucucccaaagaugauauacaaaacuguaaucauugaaaaaaacauagccauuuguaugcugauaagcaaaacaagaucacauugaacccggaagcacuguauuauuguguucccuccaucccaaauauggaaggcauuuuucuuuuauaauuucaaaacuucucccugaagacuuuauuucuuacauuuaaauuaaaauuuucucuuuauguuuuuuuuauauuucguuucccuucucuuuuauuguucuuuaaacucaauaccuuauuagugagauucuugggaauuuuuaguuuguaucuugugcuauguuagccccaccccagcuagcuuaaucaguaaagcaugugacuauuaaucucagggucauagguuccugccccacauugggcaccaaaauguauaaccaauuuaagcuuaucuacaacuagguuacaaauaaaugagacucagacuaugguuaucuuauuuggcuuugacaauuacuuaggggucaccccuaaucuacuuuucuagcugaugaccuggcuaccuccccagcagcguaccccagauacuugcuguuucuccuggccaagugguucucgugguuccucuccccucacaauuauuucuuccuuucugguucucccuccuucucuccucucuccuccaaccaggucacucuaacccaccuaccucuaaucccuccaguagucccuccaguaaaguagccaauuuuacauaaucaauaguuuuaaaccaaggaacaaguuuuacacaacaaaagcuuguaagcauaaaaauucacuuauaggccuagaccuuugggucuagaauuuagcauuacaauauacagcaacagaccaaaccucaacaaucagggcuuaggggaucauguuauuguuacacgacugucacucugauugggggcaccuagguccuuggggcaaacuugaccuucagugucaggguguuaucugaggucauaggccucugguccuauauuuaggggcugauaauccuguaauagcaacugguuacaaaucugguuagaaaucuuucagaucuuuagauuucuggugaagaaaucuagacaagcagauuaugagacaggguacaauuaauaguuaggaaaagaaggaagaggcaguguccaauuccauguuggauugucagugaugcacuguccagacacauugagccauuccuuauguuuuuuggagaucugucuggaguauuuuuuccuauacccaacugauugacauaaaaaucaacauucuucccugaggaagagacaaagaccacacuucuccacuguuaguaaaucuaauccuggccaauuuguagcccuacagcagccagugggccuguuugacccuggagggugaggaucugagcuaccuguuggagauccuagaugaacugagagaaaaacugcuaggaggcaguuagggauguaguuaguccuucuguuccaguggcacugccagaggauaaacccagguugugaagaaggauaagaccugaaccauucauuugucacucaugucaugccaguuuaaacucuggaaugggauugggcaagggcucuucuccagguuccacccccaauuuugggaaagggaacaccagggcacaaaucccagaccacaaagcggauaggcagcagagaacgugagugccacaggggacugagggguugugaauguugcgacaugcgggcugggggguagugcucagggucaagguaucaccacaguccgaggaaugcagugugcccauaaagugugucucugagggguugaaucagucugcgauaccccagauaaauaaggaguggggauuuggcugagagccguuacugagcaguaaggugugguagugaguaugauaguccagugggugauggugggugugaguuugacucaggagguacaugcauccagcacuuuccaaaguggccaggcaguguuauucaguagcuggucugcaauuaggauggcccacauuuguuccaugguaugugcaagaccauuaugaguaaccuuguuaaguuuuuggccacuuuuuauaguaaauuuccuuuuaguuauagagaaaacaggcaugggguguuaaccucuagugaaggagagauggauaaguaugggggaguggauuagcuuuugacagccgaauagagagaaaguuccugacccuauuaagaugggcuguugguuaccaguaggggucuccuggacauuaaacacccauauauaagagcuacauuggacagguguagauaggaagaaauagaggagagaacaaguuuugauauaaaaaaauuguuuuagaauaaagggggaaagcuuguugaguggcagaguugcugccauuggaaacugaucaugccaauuuuggccacugaacugucaugaagccaugcuguuuauaguaauagagugaggcuuuaauaagaucugugucuguggagggagagaggaagggucaaaaaaccaacuacagagugaguuccaagacagccaggguuacacagagaaacccucuuucgaaaaacaaaacaaacacacaaacaaagagaaaauucuacucuguuguuugguuuaguuugagacagggucucacucuguagcccaggcuggcuugaaaccugccccagacuucaaaaucugggauuauggguauggccugguugcaauuuuuuauuuuaaaucaugaagauucuagguuuguuaaauguuuaucugcaucuguugacaugaucacguguaggguuaccucccccuuuauacuaaaauaguugauuuuguugcuugauuuucuaucuaucuaucuaucuaucuuuguuuuuuuauuuuguuuuguuuuguuuuguuuuguuuuuaagacagaguuucucugccuagcccuggcugucuuggaacucacucuguagaccaggcuauugaacucagagaucccccugccucugccucacuccugagugcuggguuuaaagguucuaccaccaccuggcuagaaguuugaggacagccugagauacuaucuaaaaagcaaaagcaaagacgggaagacagacagacagacagacagacagacagacagacagacaagaaggaaggaaggaaggaaggaaggaaggaaggaaggaaggaaggaaggaaggaaggaaagaugcuaaccaaaaaagcaaacuaugaggauugugugaacauaacuacaggaaaccacuuccacauuccggauuuaacuaaaaugaagucggggucccuggaaccuggaggguuggagggauggcccuguagagucaagcccucaaagacuccgagauuuagaugcuguagggcuaggcuccugugcugaacacgugcucccuagcugggagugcuguuuuaggagauccggccuaaggggcugugccuuugggagcuguauguaucugguccucucuuucuuaauugcucucugcaucuuguuuuccuugagguguaacauuuccuccacccucgccuuggugauccagugcuugggccaagcagcugggagugaagcucugacaauugagcugaacacucagccucacuucucucaaguuauagccagcacuuucucacagcaagaaaguaauacaacagguuaaauauaauagagacugguuguuggugagacggcucaguguggaaaggcgcuugcugaaaccuaucaaccugagucugguccccugauuccucagugggaagagaaaaccuguucucucagguugucauuugaccuucacgcccccaccucacacacacacccauacacacacacacacccauacacacacacacacccauacacacacacacacauacacacacacacaaauauaucuuauauacacuuaaaauagucauaaggauaaacaaaaaugauaaagaaaguagaucuuuuuaguggccucagugaccauuccuuuaaucuuuuagggaccuugacuuaggccaaauugggacugguggcuuccaugcugaacaugaauuucaggauuacucagcaugaaguagaguuggagacuuuauuaaaaauauauuuuucaguuuucugccugccuguaugucugaucucauuauauaugguugugagccaucaugugguugcugaaaauugaacucaggaccuuuggcaggacaaucaguacucuuaaucucugagccauaucuccagcccccuauugaagauaucuuaauguagacuugaauucugaaaguuagggaaaaagaggcacucagaaaaaaacugaugacacuuccaaggguaggugugggcucaagaaagcguguauucagccgggcgugguggcgcaugccuuuaaucccagcacucgggaggcagaggcaggcagauuucugaguucgaggccagccuggucuacagagugaguuccaggacagccagggcuauacagaaguuaugucucaaaagucugacuauacccguuuuuguucauccuuugucuuugucuuguguuaagugaaguuauaggaugcuccagagaugcccugggugaaauuguacucugaugagggguugagucccggagagcuccagguucacugcuggggaggaaaccggccuucagcaacugcuaugcuagauuccuaggggaagggcuccucccagcuuccugucccuguaauugucccuguccuuauauccuccugccuuaaucauaucacaaugagaucugugaagcaguuucaccuccaagugggaauauuaugggauuuacuuuuuuguagguggugacaguggacuggauggguuaggagggcccaauauacaacucggaagcccagauaagaaaaaacgcaaggccaacacacagguaaguugacauuuuuuaaaaguauuguuauuuuuaagaucugguguuuuguugugguuguuuguuuguuuuaaagcaaguguuuaugugcauacguguucagguacuccaggaggccugaaguuacaggcaguugugagccaccugagaugugugcugggaacugaauucagguccucuggaagaacacuuaaccacugagcagccucuggagaccugaugguuuccuuaguaacaguuucacuuggggaucaagaggauaagugaauguuuccaucuggccauguaguuugcuuccugucugcuuuagaaccuaacagaggguucugcacucagugugcuguuugcuagucuaaccugucauucuuuuuaaagauuuucaaacaguuuuaacuugaaguaauuguucuguuauuauggcaaucaguauuguauggauaucaugaaguaauuauagcggaagucuuuguuguaacuugugauuauaauaaacacacacacagccauuuaugguuuucuauuuauuucuuaauguguuuguuuauaugugugugagcaccuguauguacggcuguauaucaugugcaugcagugcccuuggaggccagaagagggcguggaaucacccagaacugguuacaggugguugugagcuccuguggguguuggaaacuaaaccccagccucuggcagagcaagugcuguuuccuuggaucaucucuccagccugcuuuauaguuugauuugcuguaaacugaagcacucuucugcugauaaugaauaugaguuacuuugauagggaucuaaauuauauuuuguuuccacuuuggucacuaucugugaaaucuaaaguguaaccauuagauguguagagauuagggcuuugagaaugcuuuaauuauggcucuccugacauuaaaaaaaaaaaaaaaccacuuggaauuuguuuaucacuaaguagcuuuaugacuguuuggaguauaaaaaaguuuugauuggagcacgucaguguuuuaagggagaggauggcacugcaggcaagcacaugcauaaaagcuauggcaggccucugaaaugauugauuuguuuuuauuuuaugugugugagugaugguccgcauauauuucuguauaccggaugcaugccugguaaccauggugagcaaaagaaaauaucagaucuccaggaucugagcuacagacaguugugagccaccacaugggugcugggccuggaacccagguccugaggagcagccagugcucgccacugcagagcaucucuccugcccagugacgggcuucuugagagagcuaaaugaaguuugaaauagcgacgaguuugagcuagagaagcgugccucaucuccaucccuaaguggggaaaacguguuuuauacugcggguguguguaccugagugucagugccgggggaggccugaggaaggugucagaugccccggagcugcucuuguaggugguuagggucuaugugcugggcgccaaacuuggguccucugggagagcaggacguguccuugaccacugagccaucucugcagcucuguauguuuuuaucaaauauaauucaauauaaacgucggggagggcaauugaagaaacugaacuugcaucaggacucuuugucuauucuccuugcagggaucuuccuuuccuccgcugucagaguacgcgccaccaccgaauccaaacuccgaccaucuaguggcugccaauccguucgaugacagcuacaacaccauuuccuauaaaccacugccuucaucuaauccauaucuuggcccuggguauccuggcuuuggaggcuacagcacauucagaaugccaccccacgucccuccaagaaugucuucucccuacugugguccuuacucacucaggaaucagccccacccauuuccucagaauccguugggcaugggcuuuaaccggccucaugcuuuuaacuuugggccgcaugauaauucgaauuuuggaaacccaccuuauaauaauguacugacucaggacauuaacaugcccggucagcauuuuagacaaggcucugcugaaaacuucagucagauucccccgcagaauguuggccaagugucuaacccugaccucgcaucuaauuuugccccugggaauaauucaaauuuuaccucuccguuagaaacgaaucauucguuuauuccacccccaaacgcguuuggccaagcaaaagcuccacuucccaaacaagacuucacucaaggggcaaccaaaaccccgaaucagaauucguccacucacccaccucaccuaaauauggaggauccagucaaucagaguaacgucgaguuaaaaaaugucaacagaaacaacguuguccaagagaacagccguucgggcagcgcagaggccaccaacaaccaugcgaaugggacccagaacaagccccggcagcccaggggcgcagcugaccugugcacccccgacaaaagccgcaaguucucccugcuccccagccggcauggccauuccuccucugacccuguguacccgugcgggauuuguacaaaugaagugaaugacgaucaggacgccauucugugugaagccucuugucagaagugguuucaucgcaucugcacuggaaugaccgaaacagccuacgggcuccugacagcggaagcauccgcaguguggggcugugacacgugcauggcugacaaggauguccagcucaugcgcacuagagaggccuuugguccaccugccgugggcggcgaugccuaaguacggcugucggcuaacguggguucauuguucuguguagaacagagauuuggugacauaggauuuuaauguuugacauuauuuuuuuaaaggcauacacaaaaauauuacauuuuaguucuuacuaacaaugcuucauuuuauuguuuuuuguuuguugucuugaaaugagauuaauggggggguugcuguagagacauuuacaaauaaauguucauuguuauuuaucauaaacacaaaagccucuugaagcuucaaaauaauauaugacaaaaauaggcagguuguaacuuuuaaaaguuagagucauugaaaaaaauguauauuucagugcuaaacuuugacccugugaacguacauauaugguucaagaguagaccaauuuaacauguucucugaauacaaucuguguggggauaacauagggggauguguaucuuuaauagauuuuaaauggcuuuuuuuuuucacuucauuguuagaauuugacaccugauucuuccucuucuagggucuuugaaauaugugaauuucauuguguaaaaucagucuuuccaggauaucuauguaguuacuagacagacacuggucauagcauauagucuauuccaagcaguagcugcuaauuaacuggugggcugugccacaugaaauugcuaauaucagcucgcugguuuuaguaaaguuggcauaacacguuuccacaugugucguuuagaauuaugcuggcauuguguucucuauuuu

SEQ ID NO: 5189 - RNA, 30914 nt, Mus musculus
ccucaggggugcgggccguacgcaucuucgggagucguaguucuuuuugcucgccgcgagcuggcaggagacguaggaggaacuucaagucccagcaugccuugcugcgccgcgccugccaccgcuuccccgcugcggacgccugcgagcagguuguuguuuuuaugaggcgucacuggcgucuggagcgcggacgccgccacggugacagcuggcgcggucgggcggaagaggcgcugucuucggguaagacccuggggcgcaggucgggcugauggggcggccgcgggcugcaacucguaccuucgggcgcagcgccgggaggcuuucuccugguggaugccuugguccucgggcgaccucgggcggagggcgcgaccuggcagguguuaggcgcgggcucgcaggcugcagccccgcgagcucggagcugggcgccccgggauucaggugcagcugcauccguaugcugagaugccgcgugcgucacucugagccggcucggaggucccaggugucaggaauagaaaagugugcaccccagaaguauacuccuauucagccccgaagccuguucuccgcccguucuucacgcuuccccuccggguccuuaccagcguuuguuaggcugacggcuuguccuaaguagcagcugcgcgugugucguuuguguuuaccucucauuuaucccaacucugccaggggcagcgcccgaguucuagaccgcaaccagcugggguguuuuccuuaagggugaaccaucaugcacugcccucucccacuuuugcuuuauuggcuguauggggcugcuugucccuagaaagggcaaccaguugguuauucucaguuaggggugcuaugagaccuuuccagcaaggucacauaauguuugaaaugucagcacuaacuaucuuaaagacccaauauuuuuucuuucgccuuuuuuuuuuuuuuuuggaguggguggauuggguuuuuuugguuuguuuguuuuuguuuuuugagguaggguuucucuguguaucuccaccuauccuaaaacuugcacuguaguccaagcugaccuccaacucagaaauccguuugccucugccuucugaguccaccgacuaacuuuaagaucccaaucuuaauaggucuuagauuucucaggggauauuuaucauguauaacuggugugaguaguuugcuauucugacaagcucaagucacaggggaacugagaagguuguuaagggugaguuaaugcuuuuggcuuuuuuuucuugcuguguaucucuggcuguccugauacuaauauaucccaggcuagaccugggaguucucuugccuaagcguccuaggcacugugaucguaguuggguaccauggagccugcuguaaaugcuguuuuaacccuguuacaccaaaguugaaauuccaguuaaaggugguaccccagauauuuagaaacugaagcaggggaauggcaaguuugagaccacuugagcaauauaguggagagcauauuucuguauaaaaagaccggagaauguaguucuuugguacaguacuugcuuaauguaugugaggcccugaguuuaagccccaggaugaucagaacaacuccuagaaccaguuuuguacuguaagccaaagaauagacuguuguguuuccauuggaguuuuaaggauauuuaguuaugaaggugauugucuaggaugugaaacuaaacugaccucuuuacgcuuuacuguguuuucuggggaugcaccaccuuuuuuuuuuuuuuuuuuuuuuuaaaagauguguuuuuguauguuuugucugcuguaaaggcagcuuguguaugcagugccuguggagaccagaagaguugggaacuguccuccuaguauuuguucuccaccauugagcuguuucuucagcucugaaaucuuuaaaagacagcaucucauauagcccaggccagcuaccaguuggcuauguagccuugaauucuacaugcucuugccuccauuaucuuuagauucuuuaaguaugacuuucuaaaguaaaugggcuggcaaggugucuccauggguaaggggacucgcugaacaagucugccaucagagguucauuucuggaacccacaggauggagagaacugaccccccauaaguugcucacuguccucugaacacagaugcacagagauggggguggggggcuguggggcuggguguugggcuuaaaaacuaaaaguaaauaaagaaguuaguguaauggccuaggucuaacauagcuuaggaggcauaggcagaacaauuggaaauuuaaggccaaucugagcuacacaacaagauccaguuuccaaaaaaggacaaagcaguacacaguccaaacaggguagccggguggguggugcacacuaaucccuucacuaaggaggcaggccuuaccucaaaaaagcaaaucaggaaguaggaaaaaaaaaaaacccaacaagacacaugcaaacugaucaacaacaaaagaaaccaaagcacagcugggcagugauggcucaugccuuuauuaaucccgguccuugggagguagaggcagguggauuucugaguuccaggacagccagggcuauacagagaaaccuagucucgaaaccccccccaaaaaaaaaaaaaaaaaaaaaagaaagaaagaaacaaacaaaccaaagcacaauccucaguuauacugaauucacaaaccauauaugaauuuaaauggaaauuauuuugaggagaagggaaagagaccaauuaguugucuggaaagaauaaaaagcauccuaacaauaauucuuagcauguaugugucuuuugaccuguuguuaacuagaacaaaaaugaaacauaaaagauacuuuagacuagacaaaucuugguuauuuuaauacacaugcaaaaaaaaaauauguggaggggcaggagacagucuuacuguacccuuggcuggucucugauucacugacccgggccaccauguucagcugaaaacagcuuguuuauuuguaagcauuuacaagugggaguuagcuuggagugauagaacuugccuauaauccuuauacaugggaggucagaagaagaaucaggaguccacgguuauccuggcuaacagacccuguuugaagauaauuaaguaguaggcuuuauaugucugauaauuugagcuauauuuaauuuuuuuguuagauucagugugaacagauaaaauuauacaauucauuagucuacaucuuugcuucuguucuucuaaagaauagugacuguguuucgucauuagcgaccuuaggaggaguaacucucaucacuuugccuugguuauauuuuuauuuuguauguaaacagaggaaaggauaauuuaugggaaucucagacucaccaugugauuguguccuggaggucaaauucuggcugcccagcuugguggcugugagcccagguauaaccuuugaguuauaccuccguuuuguuuuuguuuuucugagacaggguuucuuggcgaaacacccuaggcuguccuggacuaguagaccagguuggccuccaccugccucugcguucugagcucugggauucuuuguuuuguuuucuuuuuuaagacagggucuuccucagcccaaggccuggagcuugcugcaguuuucugccuuagccuucugaguacaggugugagccagcgugagccagccuuuauugcuuuuuagaugguaguauuuuuguuuuuuuagguuguuuuaguugggagcuuuucuccacaugucaguuucuuuucaauauuuucugucuuuuacuuguguucugugugucuuguguggauuugugagcugccauguggauggugggacucaaacccaggucuucuggaagaacagucagugguuuuaaccacugagccaucucaccaguccaucuuguguugguuuaauguaggcuuuggguccauccacaggauauaaaaagcauuugugcuagaauaauaugucugagcugccaaauuccacaguguugcuauuguaggugaaauuguauuuuuuaaccaacuuaagaauuuuuuaaauuauuugaauguuaacuguaaaaagccacacaccgucauuuggaaaacaucaagaacguggccuucagggccaucacugccuccucuccaggacuuuauucuuaggaacaaucagauuuggcuagauuaaggcagggaaagagguugauuucagggcuuacuguuugccuugcucccuuaaacaggaccaaaucaucuuucaguuugaguucagagaaagagguuaguccuguacuauguaaggauugcauguaauauauuuagggauuuuuuguuuuguuuuaauugggcauuuagaaggguauuuaauaugugaaaaaccacugaagagucaguaggguuuucuguaagcuuuaggaagucaguaagaugaguugcagguuuccucuuucauuauaugagaacaaagucugauuuuucuuagugaguguugcugacagacucagcucuugaguucauauugccgaugagcuccagagaacguggaaaggaaaacaguguucagugaugaacaaggaucugagguaccaagucuuucuguuacuuccaagcuggaaguagccccuguguaccuucaagguggacuugggaagagggacucaggccuuuguaagugaccugugaaacugaguacacaucgugauggcagugccaugcacauucuuuuggagcauaauuuuggugaagaaacauccaggguuuugucugucuucuagguagagcugcguaauguguucuagucugaagaccaguuaguucccuuccucacuaugacuuagcucuucugauuaaaagaccuggaauuguaaaguggugccucugugguugggccuuucuguguuugucucagucucauaguuagauguguugagguccuuuguuugauuucaugggaaguggcuucuuuuuaauguugcccucaugagcagcaagacuauugagucugaaauccuccuggcagggaggugugaaagcccuggguggggguggagagaugccuucuccugggaaagucaguuauccauuagcaucuaacucugaguuugaccugaaguuaaguuaguuaauacagagcauuaauguaaagcagucuuuuagaaauuucuaaguucauuuggaaggcuuuaccaaagugacacaggucugugagagugaaggaaaacagauguguaaaauguacugugguuggguauccacucaggaucacuacaggacaguggggacccuucucccuuguaccagauauaaacuaauaaauagcaaccagaaaaaaauacauagauccuuguauuagcuuuucuuucaguuaucuuagaucauaacuauaagaaaauaagaguaaauuaucuuuugugagaacaucuaaaaaauauaauuauaguguguguggagagagagagagagagagagagagagagagagagagagagaacacacgagagagaacaguauuaagauaggaaacaaagccaaaaccagauagauuuguaaaaugaugaagccacccuggacucagugucccaggaagggcagugugcagccugcccaucuuagguauuaguuaacuaaaaugggggaggggcacuuuauuuacucuguaaguuccuguuucugggauauacaggugaguucccugccuauggaaaugggagguguuugaucccccagaagccacaacauaagcaguuuuuguaagccaucuaaugugggugcuggguaauucggguccuuugagagaacaguauugcgcgcgcugucucuucagccucauuuauuagcucuuucaggcuuuuuccaaaacugagcaguaacaacccuggacagccaggacauuucagaagacugcagauagcugaugaaaggcgguccucccugcucuagguggucuccccucgcuguuugaaucauuguuuucuuauuuauuuauuuauuuauuuauuuauuuauuuauuuuauguaaguacacuguagcugcccucagacacuccagaagagggagucagaucuugaacuccuggccuucggaagagcagucgggugcucuuaccuacugagccaucucaccagcccuguuuucucacuuuuaaaaaagauguggcuuaggcuguuuacuucagauaucagagcaaaagugguuuuugcuuccuaauuugcaaaguuacaucauagaaggaaguuuacagaguaaugguguguugccacauuucucuugcagaaaugauguucuggaugaaaagguauauuuaguauauauagcaggaguacauggguggacuguauuuauucuuuuaaaaauauuguaauugauuguuuuuaauuuuaguuuuuaaaagauuuauuuauuuuauguguauguaugagucacugugacugucuuuagacaccagaauaggguaucggauccuauuacagaugguugugagccaccagguaguugcugggaauugaacucaggaccucuggaagagcagucaguguucuuaaccucugauccaucucuccagcccccuuuuuuguuguuuuugucuguuuguuuguuuuuuuuuuugagacaggguuucucucuguagcccuggcuguccuggaacucacuuuguagaccaggcuagccucaaacucagaaauccaccugccucugccucccaagugcugggauuaaaggcgugugcccacugcccguuuuuuuuuuuuguuguuguuguuguuuuuaaagguggaguuucauguagcucagauuagcauccagucucacuacaaagacuagguuagccuugaacuucagauccuccuguccuagccuuuccucugcuaagauuugugugugacuacacuccguuuuuuuguuauuaaagacaggguuauaacucugugccagguuggccuggagcuugugggcagucuccuaccucugcuuuccucaguacugggauuauagugugccaggauugccuggcuuacauuauuuuuagugacagugucuuccuaccgcauuucaaccaggaaaaccugcuuuuuacggagaugagucuuugcacucacugauaggauuacuaugaccagagaaaaagagccuuauauccuguacuauguugacucaacucacuaaaaauccgguggguaaaacuuuaagguaacauguuaauuucguuaacuuuucaggagaaaaugcuucuugaauuugugccuuucacugugcuuaaaauugguucugucggggcgguuggcacacgccuaggcagaggcagccacuucugauuccugaacaggagagucugagucaggaagauaguucaaggccugccugggcaacagaagaauuuccagucaggccuggguaagguagugagaccuccuguaucaaaguaaaaaccacaggagcuguagccuggucuacagagugaguuccaggacagccagggcuacacagagaaacccugucucacagaaacaaaacaaaaacaaaaaccacugcuuuuguuguucugagaaagggugucagugugcaacuccugccuagaacuugcuaugcuggucucaaaaacuagguagcuuaccugccugcugggguuaaaggcauacaccaccacaggccuuuguguuguguaugugucuuauuuacuugcugugaagagacacccugaccaacacaauagaagagauugagggcuggagagaugauggcucugugguuagcagaacuuguugcucuuccagaggacccaaguuuaauucccagcacccacaagacagcucccaauuauuugaacuccaguuccaugggaucugaccgugaacaucauauuauguuggggagcauggcauuaagcaggauccugagcacaguucuggagcgauagcugagaguaugccaucuuuccaggacaccccucccuuuuguuacauccuaggccagacuaugacagcaugcaacccuaguuguuggagcuauucaucucuugucucagacuccaaguaauuaggauuauaggucugagguuuuguuuguuuguuuuuguuuuguuuuguuuuuuaauagaacagucuguuguaagggcagacaggcaugguggcucaugccuaaaaucccugaauuggagagucccagucaagacgauagaaaguucaaggccugccugggcuauagaaucauuuccaggccagccuggguaagauagugagauccucccuauagcaaaauaaaaccccuggggcuguagcucgguggugaggugcuuaccuagcaucuguaaggaaggccuuagcuuaacucccccgcacugaaaaaugcgcccacagacuuugagucucuccauuuucucucccucccuuccuuccuuccuuccuuccuuccuuccuuccuuccuuccuuccuuccuuccuuccugaguuagggucucaguccccagcucgguuccacaaucugucuucucacuugguuggggagcagagcuggguuacaggcccagccaccaugcuuagcugcuuuucagguaaggaagaccagguucugcugggccgccagguuagccuugagucugggcucaaacacuugauggaaauaaaguauacaugcaaucacguuagccuucagagcauucccuuuuuucucaauuaagaaaaagaagucauuuucauuuuacauaagcuaccuuucacaccccugaaguagcccggcaugguggcacacaccuuuaaucccagcacucgggaggcagaggcaggcugauuucugaguucaaggccagccucgucuacaaagugaguuccaggacagccagaguuauacagagaaacccugucucaaaaaagaaaaacaaaaaaaaacaaaaaacaaaaacaaaaacccugcaguaauuauaucaaauaaaaugaaaaagugaaaugucuggcugggacaggugacacaccagugccaucccagaacucgggaaaggagaaaaggaggauuaugaguuugaggccagccugggcuacauagcaaggcucagucuccaaaacagacacaggggcuggagagaacucagucacuaaaguacugucaggcaagugugaggaccugaguuugguacccagcucccauguaagacaguggcguggcggcucuuguuuguuuauaggucagaucaaguuagcuggucagucagccuggccugcuugaccuacuuggcauguuccuuuugagaugaaacucacuuuguagcccugacuguccugcaacucagcuuagguagaccaggcuggccucaaauucaaagagauccacuugccucucccuucugagugcugugauuaaaggcgugcgugacucuccuaagagacgcugucuuaaaaccacgaggacugcuugccacucuuguccuuuggcaucuuuaugugugugcaugcaugcagggacacguacaggcaugugcacccacgaacguacauauaagcacaaagaauaccuucauuaacacagcuacuuaauuagaauuagaaguaacauagccuuaguacugggaaagcugaugcaggaaagacccacauucuaggcuagcuuaguuauacagcaagauuuaggcuaacugguggcuucggugagacaugucucagcuacuuucugaucuccccaaaauuuguuuugaaugcucaaacugaauuggguugaaccuaaugccagauacauuugaaguaguugcuguaccauuaaauuacaucacagccacugaaccucauuuauauuagcuuguaauguauggaaauuuuaaagaggaggagcuagagagauugcucagugguugagagcucuugcugcccauggagaggaccccaguuugguccccagcacccacauuguggcucucaaccauuuguaacucaguccuaggaaacccaacaccuuuugacuuauaugggcaccaagccugcaugugaugcacauacaugcaggcacaacacacaugcauaugcaaaaauacuuaaagagaauuuuugaaagggaaaaaaaaaaaacuccacaagguuacucagcuugaucuggccaaacuucuagccuuaaacuuguucuucuguuuuggccuccuggauagcugggcuuacaggccugauuacagucagauucuggacaggcauccaaauggacucauggacagcccagcagcauugaccuaccucagucugugcuuagaaucacaggauugugagauaauagugccccauucuucucacucaugucuaauucuagaagauaaggaaauggaaaccuugccuucuucauaguaaaauguagcuuauuagggacaauguagggcaucaucagacuagguaacuugucuguuuugguuaaugagaaauguuguuguuguuuauuuuuucuauuuauuuauuuauuuauuuauuuauuuauuguuuuuuugagacaggguuucucugcauagcccuggcuguccuggaacucacucuguagaccaagcuggccucaaacucagaaauucgccugccucugccucccgagugcugggauuaaaggcgugcacagcuaugcccaggagcccucgaguuacccuugcagaacauguuuuuuugguuauuuugagacaaauucauacuauagagcucaagugcuggugucacaggcuaaaaccaacagaaucuauggaggcugaugcuuaagggagccuaccugcuucccucccuucugccuuucacccacccugccucccccaccccucaaguacuugcugucuaucuuaggcuggcuuacaguuggaagcucucccacuucagcuuucuuagugcagagcccuggaauugaagggugcucugcacugcugugcaggagccuugggaaggucauugccaagcuaugugacuagcuauucuuagagcagaggaggguggggcaacuucuuaagaguguuuugaauaccagguuggccuggaacuuacuacuguguagccaagagugaccuugaacuucugauccuucugacucuaccucagaugcuaggauuacagaugagugccagcauguuuaagucauauggugcuggaaaucucacccagcuaggcaugcuaccagcugagcuaugucccagccccuggauacaguuguguuggaaccacagccuucaaauuagaucuaacacuuugauagugucugugcacggccagaagcuaguuaaagagguggauaaucucaaggcuagccuaggcuagccuucguggaguggcaauguaaaagcuuuccagauggaagagcgaccaggcagcacugagcaagaugcugcuucaggacaaaaugagguccuucucagugucuuagguuuggaaccacccuuuauaaagccauuugagguauugauaauaguuauuuuaauugaaacuucucuguuagcuuuucacagcucacugcuguuugaaagugaacuuaguuugcugcugucuggucccaauuaaccaucugccagcaggauccuagguauucuucgccuuucagauacaacuucuguuggucgcagcagcacagcgggagguugccuuagcucaggaggguucccacagcuuaacgacuugguuuauucuuauaggugugcagucguauggucgguguggaaagccugugguggugucuguuuuaccuggagguugugcagugugguagagcuuuuacagacauuuaaaaacguguuacaugcaugggcuggugagauggcucaguggguaagagcacccgacugcucuuccgaagguccggaguucaaaucccagcaaccacaugguggcucacaaccaucuguaacaagaucugacucccucuucuggagugucugaagacagcuacaguguacuuacauauaauaaauaaauaaaucuuuuaaaaaacaaaacaaaacaaaaaaacguguuacauguuucauuguauuauagaccugaaaaaugucugaaaguuccagcgacagcgacucaucuuguggcuggacugucaucaaucaugagguauguucuucaauauguuguuagcagugacagaaacugcuuuaugaaggucaggguuuucuaggaaaguguggcuuccuuugucuguaguuggcuguuuucucacccauauuaaauuugccugcuaaaugccauugagcuacauacagcccuaggguuuaucuuuuuuuuuuuuuuaaacagacaaaauuuugauauagggucuuaauaaguugcucuaggcggucuuggagucagugugcaucucauacugaucuuccugagcuuggaauccuccugucucugccuccucaggcugggcugacaggccugcaccaguacacccagggcgugggguuuuuugguugugcugagacauucaagucucacugaguagccauggcugcccagaacuggccccacauccacagcagugcucccgagagcugggguuauagguguacgcuaguauggcuggcuuuuguuuuguuuuugagaaagccuccuucugucauguaggcuggccuaaaacucaaggcagcccuccugccucagccucccagguauggggauuagagacaugaaccauaucuagccccgaucacccucuuuuaauggaguacagaacuuaauaagaaaaaauauguguuuuagauuuauaugugugaggacagcaguuguucauaaucaagaggaagugugaacuucuccagagaagcauccaggauuuugggaacugcugaaaaccauagcuacacucuucuacauuauucuaccugacuuccuuaacuuugaggggugccucaaaguucuuugucaggugcugccugguacaacuacauucuuacguaauuuuuaaagaccuucuuugugguacuuuuuuuuuuuuucauuucuauuuuggggguguguguggagggaagaucagugucuuacuguguaacuaggagagccccuaucuaaauuuccacacagcccaggcugaaccuccaacccuugauccuucugcuucacuuucugagcacugggauaaaggcaugugccugguugucuucuuuguuguugaggaugguaucagauucucugggacuggagguacagaugguugugagccaccauaugggugcuaguaacugaaccuggguuucugaaagagcaaccaguguccuaaacugcugagccaucucuccagcuccaucagccuucauuuuuuguuacuguuuauggagccaggguauaguuguggcugggauggagccuacuacauaguuugggcugcuuuuaacuccugagcucucuccagccucauagugcagacacucaggacucagggguuggccuuuagucucauugaauagcacagucauccuguguucaccagacauugacuugaaggcuauggcuccauuuugcaaucuuccaccugcaggccuguauagacugaguugaacaaagccagucacgacagauacuguuuauagagugugguagcaucaggaacuuucuacauaucaucagugaaauccagucuuagggaggcaauagcuaaauuaauaauuaccacuuuccccuaggguucugauauagagaucgugaauucugccacagccagugacaacuguggacugacucuagaauguuccuuaguagaacaagaggagcugcccguucuuuauguagggcauggaggugaagguaaguuaaguuccuguuuuuuuuuuuuuuuuucuggagaugggggugucauccuugauugccauuggaauggucuuaccccagauguucaguagacuuguuuuaagucgaaaaccugccagcaagugucugagaauaguuagaagggugcugacaacugagagccuguaaugagucacauucccugugugaaauugucccuucacacuuacaaguaauuaaauuuguuagcaagagcagagggacuaaugauauguaggcugcacaguuaguguuuacaacaaaagaaauaaccauacguuuuugguuuuauaccagaaagcagcgcaaacaacacaucgucagugggagaaaccauguugucaucaaugagagaaaccaagucagcagcugagguaaacuuuauucuguucuguggauguuggagaagcacugucuuccuguuuauagcuaagcauucuacuccuaccaaaauuauaggaaaaucuaguggaaaaaaaucugucaguuuuaagguuaaagugaacuuuuuuggguuucagaacaggacucuaagcaagcgccugccucagguuacccucacagccaacugugacuagaagaugagaagcucuucugaguuagcuagcuuaucuguugguuuaaucugguuaaccacuuuaaggauaguuuaaacuauucuuuuuuuuuauuuuuuaauauuuuuauuaaguauuuuccucauuuacauuuccaaugcuaucccaaaagucucccauacccccccccuacuucccuacccauccacucccacuuuuuggcccugguguuccccuguacuggggcauauaaaguuugcaugaccaaugggccucucauuccaguaauggucgacuaggccaucuuuugauacauaugcagcuagagacaagagcuccgggguacugguuaguucauaauguuguuccaccuauaggguugcagaucccuuuagcuccuuggguacuuucucuagcuccuccauugggggcccugugauccauccaauagcugacugugagcauccacuuauguguuugcuaggucccggcauagucucacaagagacagcuaugucaggguccuuucagcaaaaucuugcuaguguaugcaauggugucagcgauuggaggcugauuaugggauggaucccuggauauggcagucucuagaugguccauccuuuugucucagcuccaaacuuugucucuguaacuccuuccauggguguuuuguuuccaauucuaagaaggguacauuugauaacaaauuaaauauuggcuguugugguugucuuuugaauacagcuacuuggcugcauaaucuuuccaugguauuguagucccuuccugcuaagaaagggugacauaaagaguaauucuuuucuggaagggccuggagacacggcccaguggcagugaauaucugcuacucaauccugagagccugaguucagaucucagcacacguggaagaaucuggguguccugcaaacacuuguaacuucagcuccauggaucuggugcccuccucuggcucugcacagauagacauguguauaacuuaagcagacacagaauuaaauaaagcucaggguuugaugaggugguucagcagguggaaaggucuuguugccaaguguauuauuaaaaauaguuuauuuuuggaggcuaggaaguucaagaagaaggugcuaauagcugguuuggugugugaugauuguaccuuuggccacauucucuguagggaaaaaaaaugcaauauccuuggauaacagaggaaggcaaugacugaauggcacugugcugagugccucuucaaacagcagcccccucaucucuucagagcucauugaguuuccauggugguuguugggguuuuguuuuuguuuuguuugcagggucuuucuacauagcccuggcaguccugggaacucauauguagaccaggcuggucuccagcucacagagguccaccugagugcugagauugaaggcaugugcuagcccaaguuuuaaugaauuuuaggggacauguucagacuguagaacauagccuauuuguugucagucugucacauacucccuagaaguaguauuuugugccagcaaacacaggacugcugaaguaagugaauucuugguguccuguggucauagcagggcugagcaguuucuuucugaagcauaaugggaggagacagacagucgucucaucuaauucuuagcaucauggauggcuuugaggucuccagcguaaagaaagugagccugugacugcauacuccuuuacuguuggauagaaauugcaucucuaggggcuagggagguguccagugguagaccggaagcacugcgugcacaaggacccgggcuccauccccaguauugaaaagaaaagggaaguggagagaacacaaaaagaaugacacuaggugucauauauuuugaacugugaagaaaauauaagacucaaacuuacugagcuuacugccuguaaaauuugguucuguagguggaggaagcaccuuccccugaagacaaugucuauuucggaacuacuagugacgauucggauauuguuacacuugaaccaccuaagcuggaagaaauggggaaccaggaaguuacaauucaagaagcgcccagcucagaugaccuuaacaugggcucuuccuccagcagccaguacgccuucugccagccagaacccgguauggagcuguggcagcagcgaaccucugacgucuuacuuuacuuaauggcuuguucucuagcuccagcuuucaaugucuuaaauaauuuuucugaaacucaagaaaauuuggauaaaauuuguuacaguguuuuccuggccuuuauggcugagcucaguguucuuucuuugacaccuuacuguguguguguguacgugugugugcacacauuacuguguguguacgugugcgugcaugcauguguauagggguaugcuggggacugaaccccagauacugcacaugcuaacuaaguaagcaguaugcuacauucaguuuauugaagucucaaguucucaaaagguagguacauuugucuuuuaauaucugauuaauugauugugguauagcagggucuagcucuguaacucuggcuguuuuuaugcucacuguguagcucaggauuugccucagacuuggcagcagucccacaggcaggugccgucauucccagcuuucacaagcuuuuucagacagaguuucucuguguagcccuggcugcauuggaacuugcucucuguagagcaagcuggucuugaauucagagaucugccuacguuugcaucuugaaugcugagauuaaagacccgugcugccaccacccagccucuucuacaauccuuaaccucugauuucugaauauuaguaucuuucaaagagacaaaauauuucgacauaaagucccuggaaaauguuaaaagagaagccuguggcuaacucaguuauuaauuaacccacagugauaauuuaaagauggaguguggaggccugugacucuauuuagaacugcuguuuuaauuuccuaaucugaugaaaagauaagaauauauaguuuggguuaguuccuuauauuuuuccaucuuuuaauaauuuguauacauuuggcagucagaaucacacagugacauuuuucauuccaacuuaagguaguaaaauaccacauugugcuuuuuggcuuguuuguugguuuguuuugggauaguaucucuugaguccacauuguccuugagcucacuguguagccuugacuagccuuggauuugugacagucugcaugcuucagcugggauuaugucacaaaacacccacauccucugucuguccccauguaacacgucugacacgugagugcuguguaaguuguuggggaaugguaauaaguguguauguauuaagagcagaaggagugucuucugaauauuuguaauccgucuuuuguugagccugggauacagacaggugugugacuauuuacaaaaaguugguacaguugaccuuggaacuuaacaaguacccagaggucaaggccuucccacacucggugcagucggguuccuuucagauuuucuaauucuaucauguccaguuuucuuccuuuugauauauuuauuauucaguuauaauugucugccucuggcuuaagaaacauggacucaggcaggguagccgaagggcgcagugagaggacgguacacauuguugaugggaacugcacccaaaagcccaggauucuggcuugaucuccucuuugaaaggccaagaauguuucagaacuaguuaacagaaauauuaagggugugugugugucuauguguguguguguuuuaguuugacacagggucccaugaugcaucuuuggcuggccuggaauuugcuauagaccagguuggccucaaauuuauagagauugacuugucucuguuucuugagugcugguaucagguguguauggccacacccaauuuaagcauucuuuuuuaaccuauugcaauccaucccaucaaaauugcuuguauaaagacaguguuuagaaauaaugauaaauuuuaggcuacagagucaggcaucauuggacgcugugucuccuuaguuacuccggucugcucuuccauucucuuuuuccuuacagcuuuucagcuucauguuuuugugugauucuaauagguaugcagcuuuuguuuguuuaagaaaacuacugccuuccauuggccaaccaacccucuuacccagaaggcgcaggugacugcuguagugaaguucuuguguauguuucuaauuagacaaucaugggguuuuaaucucauagauaauaguguuaacuggucaaaguuguauuuuuaaguuuuuuuccuuuauuauuuauaauaaagcuuuauauaucuuuuuccccccuauuuauucacaaaagaaagguggugggagaagcuguggaagauuccuggaugcuuaaggggaugggaugaucagcugagacuacguguuccuagccagcuugcucuccaagguggcgugaccgacgcugagcugagcggcuucucggcuucuggagcugggcuagucacauuccuauugaacugcugagugcuuuggagagucuuggucuaagagaucucacacacaggcuggcuaagcuuacugcaugccucugcauugcgugcugcuuagauugugggcuauuaugcuguacaggaaacuuagaaauccaaauacuuccaccauuacauguaugaguuaaagagagaagcauuagguaguuaauaucuacggggugguuuguucauguauaugaaggcaauaugcauuguagguuuggagacauuuuuaagagauuuggagaacaguuugcuuuuacauugacauggugugcuucugucagaaagcauuacuucagugcccagccgugaucuggauaccuuuauaucguguaaugcuugguugaagucuuccucuuuuucucucuaccuaagaaauguacgucacagcugaggcaguggcauggugggaaaacuagugaugaagaauaaccagucacaugcuaggcaugaggggcaugagguuaggacacagugaccccucaguggcucccaugucacgaagcauuaggauauguguucguucaguagugauggugucucuuuuguuaugggaacaugaacuacauucuccacgcucgaucuuuagaaagcauugccugauguagacaccagcuuuucuguggcauggacagccuguuuucuaaaagacuggcauuguuaguugcaugagugugugcuguuuuggagcucuguuaaauucaaguucacaucuucucuuuaccucuaacugaccuauagagauuauuauuacuaaguguucuugucuauaauucacugaaguaugggauggaauuaaggagugacgugugcaaaaagcugccagugguaucuccgaggauuguuccuggacuggaggugguuuugugucauuucuucccgugaaggagcagcacagacugcgucuuagcaugggggaagagcuguugugucacuuccucaggcagacauauuuacuagagggugauccacaaccuuccaguaagagaggcagcagaagggaggggcucaccugacuuccgggaacuguguggaccguggugcucuggacccgcacagugggguagggaccuguuguaagagaccagaaguacuucacaccuccugccccucaaguaacauugaaguugaaugaaaagacagggcuuuuuuucuccuuaacugacauguuuguuucugccuggguuugaucugguguugguaaaugaacagccuguuccuguuuaugcuucucuuuuggcuuucuuguguuaaagggcaugaaaggcuggcagugaugauuggcagauuuacuggcaaggcuuuucugagacuguguacuuaaauaucaacauuuuucuuuuuaaacuagucuuuucaucucagccuagugaugaggaauccaguagcgaugacaccagccacgagcccagcccugcuccuagacggcgccgcaacaggaagaagaccguuucuaucucagagucugaggagccuccacucgcugagccggaagaugagcccuccaaggagccaaguaaacgccacuuuagucguggucucaacaaguguguuauccuggccuuggugauugcugucagcaugggauuuggacauuucuauggugagugacugaguggaaacaccuugugccgaagccacuugcauauagcagcaagacaagauggcacaaaaggucaguguuggguucuguggccuguaccugcagucagcuacuuuacucaggaggcacaagugaagguugcugagucuucagaauuugagauuagccugggcaacauagugagacccuguuccaaaacaaaacaagaucaggcuggucuccaaccuguaaucuucauacaucaucaaaaucucaaguauaaauaaggacuaguaacauacauauuuguguaauguuuuuuuuuuuuuaaguaagaagacuggaaauuaaaaaucugaaguuggggguggggagguggcucagugguuaaaagcaguggcuaggcuauucuuccagaggccccaguuucagucuccuacaccaaacccauaugcuggcuguuucauaaccauugccauuccagcugcccucuucugaccuuuuagggcacugcaugcacauagugcacagacacacaugcaggcaaaacacgaauaaaaaaaagaucggaggugcugggcgugguguuaaauggcuuuacccagggcaggcagagggucuugaguuuggggucagacugguuuuugaaguaggacuuuacaccugucugucugucugucugucugcuugccugccuaucuaucuaucuaucuaucuaucuaucuaucuaucuaucuaucuaucuaugguuuuuuaaaacagggucauccauccauccauccauccauccauccauccauccauccauccauccauccaucuaucuaucuaucuaucuaucuaucuaucuaucuaugguuuuuaaaacagggucuuacuguguaacccaggcugagcucugacucaguuaccugagugcugagguuauagaccugugcugccuggccagagagguauuguaugcuugagaagucagugucuuaaaccuugucaaguucacaacucuuuuguuguugucugaaaaagcccuggcugucuaggaacucaguguguagcagcucacucuguagaccagguuggucucagacucacagagcuccaucugccucugccacccaagugcuggacuaaaguuuaucuuugccaucaugccuagcaaccugaacacucuuagcuuacuuauauaaacuacuuuuagauuuauuccuuuucuuggucuacauaaccuauacuucagucuucuguuuuaauaguucuuuucaacaguacauucuuucacgaaugugggaaagguauuugauagagcgugauauuggaaugagaugaucgggcagcccauacuugcuaaagucaaaguugcugaccuauguuuccuguguucagcuuggggugguauuugggcucguggggaggccugcccauguguguccugccaaguacuuacucgagccacacuagugugaugugcucucaggcacaaauuuuaucaaugguuuugaguguauuuuugccccccuacagguaaaaaugaaggaaacaagggaaaaggucuaaaaucuuuuuuucuuacuaaaagccaagaguugguuauuaacgugaauauuaauacagacugcacuaaaaucucacaauuugcaugacuuuggaauuuuuuuuaagaaaauacaguuuagaacaguucuucuaaaacuaaauuaacaaaauuaacacacuaccuuccuuucuguaacuuuuagucuuagccuuaucacagugugggaacacuggaugaugcaguauaugaagugaguuccauaucuaagcccugacucagugaccucucaguauuuucacgggcagugagcuccaugcugacauaucuucucugagaucuguaucuauaagcagccaugucuuauaaacagucuacuagaacacagccagccuuggcuuuguauaacugugggguuuccugucuguaguagaagagaaagcaaaagauagugacauugacaugauucagauucuaaaagugcaucugaacuuuuggaaaaagauaaaaauuagcagagaagauaaauaaucuauaagaaagcuaacaccaaauucauguuugaagugcuucuccguccuugcucaucucuccacacuuagguagaagguggugacagguuguccagccauucugaggacguaacuguaacuagaugagaaguuacacagcacaaagaggcauugaaauccauggcuauaucaacuuacucagucauccuugaauggguuuuucguaagcuuacgacaggcaggagggaaagcagaccauuccaggaauggcaacucuauaaacccuuuuggaaacaaaauuuaccuagauuaaugauaaaagaugucuuuaagggggcuggagagauggcucagugguuaagagcacugacugcucuuccagagguccugaguuaguuccuagcaaccacauaguggcucaucugaugcccucuucuagugucugaauacaguuuaggaugcugagugagaaaguuugauuuauggagcaacugaaaacaaccauuuaaaaaaaaaacugaaaaggaaaagauaaaaauaaaagaagcuagcggccagcuggaacugcuguggguuuuguaaucuguauacuagugcugaagucaggccuugaggauuagggugaaggaucaaggaagaggugagaauggggagggcacucgugguuuccagcuuagaguuucaguuugguagucuaucaacaauucaggaagugugcuagcugcuucacauuggaaguaaacgguuccuuaguggaagaguccugcuagacagugaaguagcuagaugaugugguaguccuucugcaacucagcugaauuuccacuccuagauuguuaagugauguucaaagugaguuucaagaccuguagaaggaauuaaaagggaugguuacauccuauguuuaaacuucugcaugcacugguauacccaagugucagauacacuuuuugguuuaguggugguuuuuuuuuucuuuccuguaugauacauguagcaggagcaugcaaacagcaugucuuggcaaaagaacauuuugaauuuaaggucaaauacgaaggaauuguccuaguacuggaugaccaccugggggcuuugcggaugguaguuagaggcucuuccacugcccugcucuauugcagacuuccuaauacauuugcuuugagggucuauaagacagcccaguggggaagggugcuacuuucaagccuguuggccugaguuugaucgccaaggucuacaugggaaaggggagauccagcuccucucaguuucccugaccuccacauuugugucauggcaugcauguucccuccuccaaaauaguauauguauauauuuuuuaaaaguaaucucaguauuuaaagaguagaagggauguagcucuguugguagaguguuugccuagcaugcacauacuccuggguucaagccuugcucaacauaaaaacuaggaauuggugcagugcuagcucccuagaggcagggacucuaguacagaagagguuguucauggucauucuccaggucauaguucauagaguccagccuggucugccagagacucagucucaaaaacaguuaaacaaacgaaaagccucuuugccaggugguggugguacaugccuuuaaucccagcauucaggaggcaaaagcaggugcucuguaaguucaaguccagcugaucuacaaaagguuuccaggguagccagaacaguuacacagaaacacccugucucauaaacacaaaaacaguagaagcaggagaaucgagguccagaucaucuucagguaaauagggaguaggacucuacccgagauaacuuaagacccugucuuuaaaagauaaguaaaauagaaaauugacuuugagaauaauggguguucuuaauuaggcauucccuguguuauauuucagugugugaguuguagccuguaggcaaauuauuaagaaacauuuucauuuuuuuuuugacucaaccuguaggaaaagaacuccaccaaugccuuauuuuucuguuuaaggagguugaaacacuuuacuucagcgaucucaaagcugaguacuguugguauagcaagaugagaagugguuuuuugggggaaggguggguuauuagaguggcccguguuuuucuuuggaaggguagugaacuacuuaagcgauccugugugcaugcugaaugaacgaagcugcaucguuaaccugcuugcccuaugcauuagcauccacuguuguuugaggagugacaccgugaauguguugggguaaagaauguccugcccuaguuaaggagcugguguaggccgagugugcuguguauuuauuuuccaguagcggcaguuauguuauguuaucccuauaaugguuuuuccuuucaggcacaauccagauucagaagcaguuagucagaaagacccacgaagaugagcuggauggugugaaggguuaucucucacagcgcaagcaggaacaagagucuuuucuagauuucaagguauguauuaauuaaacaucgaaaaauaacuaauaggugugagggcacauacacacuguaauccuaaccuggcacuugagaaccuaggcaauaugaaucaggccaaguucaagacuagccugugcuucuuagugacccccugccucagaaagccaaggagaagaagaaaaguagaaaccagcagugaaguaguuaggugucguuacaaugaagaguaguggacgagagaggugggccagcccccagccacaagcuguccacugaccuccacaugcacacauacacacaaacaaagguagucaugcauggcauaaauguggaaaucagaaaaucacuuucaggagucaguucucugaucuaccaugcugguccuauggaauccagcucaggucaucaggccuggcggcaggcaccucugccagcagagccggcuugcaaaauacaguuuuaaaccuuuucuuucuuuucuuucuuuuuuuuuuuuuucccuaaagauugauuuaggaaaacaacuauuucaguuguuucucauguguaaaacucuuauuacuuauuuuguuuguuuguuucugaauucaaguuuacuuggauuugggaaaguacuuaacuaugcuaaggauucaggcuguccucuguguacagagaugcuuccaugagauucuguacugacacacagcagccuuuucugccacccuagugcugggauuaaagguggguacugccacgccaugcugcucucugaauauuuuuuuauccucaucaguacugagucuggggacaugaggauacagauauacaaauagcugauuguggguuacuuacagaaggcaaugcaacuuacuuuaaaaucucuuaguugcuggguguggugggauagaggcaagcagaucugaguuugaggccaaccuggucuacagaauaagugauaggucagcuagcgugauguagagaggcccuuucugaaaauaaaaaauaaauagaauaaaauguucucuaaaccguguaggcaccuuuucaggacagcuauugugguaacaagaugggagggcuucccucacuuuucuagcuuagaaauggguguauuccgaugaugugucuguuugcagcacugugcauggacucuggggacuugggucugcuagucaguccuuggcuuuuaggcuguuagacacacauggaauucuaccuacuuguucuuguuugaauucuccuuccucaacaguguccuugauuugacaugccugccugcuucucguuuucuuccaugugacacuuucccuuucccuuucucuuuuuagaaugagaagccucuugaauauauggcaagugucauuaagcauuuauuuuccaauuuuuaacaccauuuaaccauacccaaaguauuugcgcacauggucauacacacacacagaggcacuaaagggcauggugguuacaugauuaaagauuuagauugaacuuuccaagcacuuaauauuucucuucucuuucauuaaaacaaaauuucuuuccuuuagucgcugaaagaaaaccuugagagguguuggaccguuacugaaucagagaagauuaccuuugaaacucagaagaagaaccuugcugcagaaaaccaguauuuacgaauaucucuggagaaggaagaacaagcccugucuucauuacaggaagagcuacggcaacuaagggagcagauuagauuguuggaggauaaaggcacaagcacgcaguuaguuagggagaaccagguccuuaagcaguacuuagaaguggaaaagcagaaaacagauagcuuccuuagggaaagggagaugcucuuggaggaggcaaggaugcugaaaagggaccuggagagggaacagcucacagccauggcucugcgggcagaacuugagcaguucaucccuggccaggcacagagccgugcggagucuccuagugugcagacugaagagaaggaaguggggcuguuacagcagaggcuggcugagcuggagcagaagcucaucuuugagcagcagcgcucggauuugugggagagacuguacguugaggcaaaggaucaacauggaaagcaggagacagacgggaggaagagaggaagcagaggaagccacagggcgaagagcaagucgaaggagacauuucuggggacaguuaaggaaacauuugaugcuaugaagaauucuaccaaggaguuugugagacaucauaaagaaaaaaucaagcaggcgaaagaagcugugaaggagaaucugaaaaaauucucagauucagucaaauccacuuuucgccauuucaaagauacuaccaagaauaucuuugaugaaaagggcagcaagagauucagggcuccaaaagaagcggcaacugaaaagacaagaacagcuuauaguuauuccucauacucacagcaggaggcaccaaaccaaaaccagaauugcaggcgcccuucugcacagagggauggagggagagaaaagcccagucacucugaagaaauuagaaagaaugcaaauucauauacauacaaggccaagucugacugcagaggcacccauuccaccagaaggguuuguucagguauguuugaaugugcuggacaggaagccauuagcccuguuaauaaggcgaguccuguuaggaugaaugacuucaaacagcugauucacugguacuuacucaaugaacuggagacuuuucaccacuggaaagaacuggaucaguuuaucaguccguuuuuuccgaauggugucuuuagacaugaccagcagcucuucgccgacuuuguugaugaugugaaagguuaccuuaagagcauaaaggaguaucgaguagaggauggcaaucuggagaaguuggacggauguauauauagacacuuugggcauguuuuugcccugccauucggacccaggucgguuuacauaaaaccauguuacuauaauagcuucuaaacagugcauaccauuuuauuuuaucuuuuaacacuuugagcuuuuggaaauuauauuauaaauuauaauuauugcaaacugaaaaaaaguccaugucaaacacuuagacuugaacaaaugauugaauuucuacuuuaaaaauuuaaaggauguguauguguauguauguauguauguguguauguauacacauacacauacacacauacauacauacaaucacaauuuaauugagccaaucuagcuuuuuucaguauaguuuauauaauuaagugaaauuauuucccuuuaaucuuuaacuuaggaagcuagaaacaaagacuuuagugugaagcccgggucauguggagcugcccagcuauaaucacugucagguuuauugaguuuaggaguacugguuacaggguuaaaacugagaagggugcuggacgcucaggagccacaaaaucccauaauguucuucaagacugucuguuguccuucagcuuuuuauucuguaacuguaaaugucuguuuacuuuugagagucaaguuccaucuuuaugaauaaaugcagugugccuauaaaauaaugagacugcuuucugaugucuuuaguuccugaagcggaugcuuuaaugagcaauguuggaggcugcuuuaaggaagcguggauaacuucuugcuguucaagaguuaggugugcagagagaggcaugaagguguagugaccucagguugucuagagaugguuagaaaaucuucaugauugaagugaccuugcaucuaaacuugcuaugaaacuagcuucugggagagaagugaggguuggugcguggauagagcagggccucccuggaacggaagguccuuugcagagguuggagagauggagaccuacuuuacagaaaccaggugagcuggcgugaucaggaaggucucccuuuugcccucaagugccugucuugugagauggagaauuucugaaggaucuugucacggggugggauggugccuaguccucuagaugacuggcagcagccaagaggguugauuggcaaggugugaagccagcugugguggucugcacaugagaaacugaugggaguuugaaugaggucaucagagguggugaggagcagacaagauacauugucaacaagucacauagccagacacuucuaccuuguguaagggaaguagaaaguaagugguguagguucaccuggaaugacuucacuguuggaugcugagauuacucagaacuccagaaggaagcucuaagcaagaggaaccagaagcaacuugauuuuggagguaucuguugacauuuauuuggagaggacggguugguagguacauggccauuucuacucacuucgaagccaguccccauuggucuagugcaggggacaaugcuaucugugcugguuagagagaaggcuaagcgagaagagugcagagugaugcacgugaacccagagaugucaagucaggugcuuagagcugagcgcugcagagcgcuugugugcagguccuggcguaaggcaguggaggagccagcaggcagagugggaagacagcagugccugcucacugcacuugccuggaacgggggaagguuggagacugcucugcgagcugugucucuucucucauugagggauaaagccgauggagacgaggcugguuguucuuaugcuuccuggagugauaacggaaacgccucauuauuuuaugguuacauuccugcuccucgucaccugucaggccuccccuuccggccagugcgggaguauugaugucugcccuuuuuccuucaguguugaaauaauaccccuuuuuccuggaauuagaguaggauguuauuuucuguuuuaucuuuuugcaguguucagguagauaaguggggaaaaacauuguucuuuuuacuuuuagaaaacugaacucuaacauagauuaaaaaaauguguuuacuacuuucagucgaccugauaaaaagcaacguaugguaacuauugaaaacgccaggcaccgaaaacaagagcagaagcaccuucauccacagccuuaugaaagggaagguaaauggcaaaaauacggucgcgcuaacggaagacacacggcaaaucuugagcuagaacuggggcaguuaccuuucgauccuaaguacugauuugugauuaaguuaggaaguuaagagcuguggaugcuaucuacuugguuugauguugagaugaacuccccaugacugucuuuauauuaugcaaaagcaaagcuuacuaacuugcauuuuccuguagcuuagguuuguuaaaaacaaaaacuuuuuuuccugcugggggggggugggggaaaugguaguuuuauuaaggaagccaggcaugaaauagucugugcaugaaacagggcuugguuugaggagcugagcucagcucacacaggcauuucgugccguguggaggugugcagcagggccugaggacugugcugaggcgggacuccgcgcuaacaucucuacucucacgcuuuugucucucuguggguucaagagcccguugguuugugaagagcuggcuggcuugucuugugaacucucuugcacaccugaaugcuauggaagaaacaauaaacugcaccgugaggaaaacuaaaggucucucucaagucuggcgccguauuuguguucucugagaaugccucaggacaguguaugggacagcuguccccaguggcuuccucucauuucacggucaccuacaguuucucucaguuaugccaacgucucugcagaaguccuuacaguucaguucccuccuguguugacccugccggguaaccuucgcucguagacguguaugugacuuccaguucggcgcucuggccagugaguguggaagaauguagcggcccucucguaguucccugaggugaggaagguauugaucuccugcaagcaaauaaagacauguuugccgagugcgacuucaaggaau

SEQ ID NO: 5190 - RNA, 30914 nt, Mus musculus
auuccuugaagucgcacucggcaaacaugucuuuauuugcuugcaggagaucaauaccuuccucaccucagggaacuacgagagggccgcuacauucuuccacacucacuggccagagcgccgaacuggaagucacauacacgucuacgagcgaagguuacccggcagggucaacacaggagggaacugaacuguaaggacuucugcagagacguuggcauaacugagagaaacuguaggugaccgugaaaugagaggaagccacuggggacagcugucccauacacuguccugaggcauucucagagaacacaaauacggcgccagacuugagagagaccuuuaguuuuccucacggugcaguuuauuguuucuuccauagcauucaggugugcaagagaguucacaagacaagccagccagcucuucacaaaccaacgggcucuugaacccacagagagacaaaagcgugagaguagagauguuagcgcggagucccgccucagcacaguccucaggcccugcugcacaccuccacacggcacgaaaugccugugugagcugagcucagcuccucaaaccaagcccuguuucaugcacagacuauuucaugccuggcuuccuuaauaaaacuaccauuucccccacccccccccagcaggaaaaaaaguuuuuguuuuuaacaaaccuaagcuacaggaaaaugcaaguuaguaagcuuugcuuuugcauaauauaaagacagucauggggaguucaucucaacaucaaaccaaguagauagcauccacagcucuuaacuuccuaacuuaaucacaaaucaguacuuaggaucgaaagguaacugccccaguucuagcucaagauuugccgugugucuuccguuagcgcgaccguauuuuugccauuuaccuucccuuucauaaggcuguggaugaaggugcuucugcucuuguuuucggugccuggcguuuucaauaguuaccauacguugcuuuuuaucaggucgacugaaaguaguaaacacauuuuuuuaaucuauguuagaguucaguuuucuaaaaguaaaaagaacaauguuuuuccccacuuaucuaccugaacacugcaaaaagauaaaacagaaaauaacauccuacucuaauuccaggaaaaagggguauuauuucaacacugaaggaaaaagggcagacaucaauacucccgcacuggccggaaggggaggccugacaggugacgaggagcaggaauguaaccauaaaauaaugaggcguuuccguuaucacuccaggaagcauaagaacaaccagccucgucuccaucggcuuuaucccucaaugagagaagagacacagcucgcagagcagucuccaaccuucccccguuccaggcaagugcagugagcaggcacugcugucuucccacucugccugcuggcuccuccacugccuuacgccaggaccugcacacaagcgcucugcagcgcucagcucuaagcaccugacuugacaucucuggguucacgugcaucacucugcacucuucucgcuuagccuucucucuaaccagcacagauagcauuguccccugcacuagaccaauggggacuggcuucgaagugaguagaaauggccauguaccuaccaacccguccucuccaaauaaaugucaacagauaccuccaaaaucaaguugcuucugguuccucuugcuuagagcuuccuucuggaguucugaguaaucucagcauccaacagugaagucauuccaggugaaccuacaccacuuacuuucuacuucccuuacacaagguagaagugucuggcuaugugacuuguugacaauguaucuugucugcuccucaccaccucugaugaccucauucaaacucccaucaguuucucaugugcagaccaccacagcuggcuucacaccuugccaaucaacccucuuggcugcugccagucaucuagaggacuaggcaccaucccaccccgugacaagauccuucagaaauucuccaucucacaagacaggcacuugagggcaaaagggagaccuuccugaucacgccagcucaccugguuucuguaaaguaggucuccaucucuccaaccucugcaaaggaccuuccguuccagggaggcccugcucuauccacgcaccaacccucacuucucucccagaagcuaguuucauagcaaguuuagaugcaaggucacuucaaucaugaagauuuucuaaccaucucuagacaaccugaggucacuacaccuucaugccucucucugcacaccuaacucuugaacagcaagaaguuauccacgcuuccuuaaagcagccuccaacauugcucauuaaagcauccgcuucaggaacuaaagacaucagaaagcagucucauuauuuuauaggcacacugcauuuauucauaaagauggaacuugacucucaaaaguaaacagacauuuacaguuacagaauaaaaagcugaaggacaacagacagucuugaagaacauuaugggauuuuguggcuccugagcguccagcacccuucucaguuuuaacccuguaaccaguacuccuaaacucaauaaaccugacagugauuauagcugggcagcuccacaugacccgggcuucacacuaaagucuuuguuucuagcuuccuaaguuaaagauuaaagggaaauaauuucacuuaauuauauaaacuauacugaaaaaagcuagauuggcucaauuaaauugugauuguauguauguauguguguauguguauguguauacauacacacauacauacauacauacacauacacauccuuuaaauuuuuaaaguagaaauucaaucauuuguucaagucuaaguguuugacauggacuuuuuuucaguuugcaauaauuauaauuuauaauauaauuuccaaaagcucaaaguguuaaaagauaaaauaaaaugguaugcacuguuuagaagcuauuauaguaacaugguuuuauguaaaccgaccuggguccgaauggcagggcaaaaacaugcccaaagugucuauauauacauccguccaacuucuccagauugccauccucuacucgauacuccuuuaugcucuuaagguaaccuuucacaucaucaacaaagucggcgaagagcugcuggucaugucuaaagacaccauucggaaaaaacggacugauaaacugauccaguucuuuccaguggugaaaagucuccaguucauugaguaaguaccagugaaucagcuguuugaagucauucauccuaacaggacucgccuuauuaacagggcuaauggcuuccuguccagcacauucaaacauaccugaacaaacccuucugguggaaugggugccucugcagucagacuuggccuuguauguauaugaauuugcauucuuucuaauuucuucagagugacugggcuuuucucucccuccaucccucugugcagaagggcgccugcaauucugguuuugguuuggugccuccugcugugaguaugaggaauaacuauaagcuguucuugucuuuucaguugccgcuucuuuuggagcccugaaucucuugcugcccuuuucaucaaagauauucuugguaguaucuuugaaauggcgaaaaguggauuugacugaaucugagaauuuuuucagauucuccuucacagcuucuuucgccugcuugauuuuuucuuuaugaugucucacaaacuccuugguagaauucuucauagcaucaaauguuuccuuaacuguccccagaaaugucuccuucgacuugcucuucgcccuguggcuuccucugcuuccucucuuccucccgucugucuccugcuuuccauguugauccuuugccucaacguacagucucucccacaaauccgagcgcugcugcucaaagaugagcuucugcuccagcucagccagccucugcuguaacagccccacuuccuucucuucagucugcacacuaggagacuccgcacggcucugugccuggccagggaugaacugcucaaguucugcccgcagagccauggcugugagcuguucccucuccaggucccuuuucagcauccuugccuccuccaagagcaucucccuuucccuaaggaagcuaucuguuuucugcuuuuccacuucuaaguacugcuuaaggaccugguucucccuaacuaacugcgugcuugugccuuuauccuccaacaaucuaaucugcucccuuaguugccguagcucuuccuguaaugaagacagggcuuguucuuccuucuccagagauauucguaaauacugguuuucugcagcaagguucuucuucugaguuucaaagguaaucuucucugauucaguaacgguccaacaccucucaagguuuucuuucagcgacuaaaggaaagaaauuuuguuuuaaugaaagagaagagaaauauuaagugcuuggaaaguucaaucuaaaucuuuaaucauguaaccaccaugcccuuuagugccucuguguguguguaugaccaugugcgcaaauacuuuggguaugguuaaaugguguuaaaaauuggaaaauaaaugcuuaaugacacuugccauauauucaagaggcuucucauucuaaaaagagaaagggaaagggaaagugucacauggaagaaaacgagaagcaggcaggcaugucaaaucaaggacacuguugaggaaggagaauucaaacaagaacaaguagguagaauuccaugugugucuaacagccuaaaagccaaggacugacuagcagacccaaguccccagaguccaugcacagugcugcaaacagacacaucaucggaauacacccauuucuaagcuagaaaagugagggaagcccucccaucuuguuaccacaauagcuguccugaaaaggugccuacacgguuuagagaacauuuuauucuauuuauuuuuuauuuucagaaagggccucucuacaucacgcuagcugaccuaucacuuauucuguagaccagguuggccucaaacucagaucugcuugccucuaucccaccacacccagcaacuaagagauuuuaaaguaaguugcauugccuucuguaaguaacccacaaucagcuauuuguauaucuguauccucauguccccagacucaguacugaugaggauaaaaaaauauucagagagcagcauggcguggcaguacccaccuuuaaucccagcacuaggguggcagaaaaggcugcugugugucaguacagaaucucauggaagcaucucuguacacagaggacagccugaauccuuagcauaguuaaguacuuucccaaauccaaguaaacuugaauucagaaacaaacaaacaaaauaaguaauaagaguuuuacacaugagaaacaacugaaauaguuguuuuccuaaaucaaucuuuagggaaaaaaaaaaaaaagaaagaaaagaaagaaaagguuuaaaacuguauuuugcaagccggcucugcuggcagaggugccugccgccaggccugaugaccugagcuggauuccauaggaccagcaugguagaucagagaacugacuccugaaagugauuuucugauuuccacauuuaugccaugcaugacuaccuuuguuuguguguaugugugcauguggaggucaguggacagcuuguggcugggggcuggcccaccucucucguccacuacucuucauuguaacgacaccuaacuacuucacugcugguuucuacuuuucuucuucuccuuggcuuucugaggcagggggucacuaagaagcacaggcuagucuugaacuuggccugauucauauugccuagguucucaagugccagguuaggauuacaguguguaugugcccucacaccuauuaguuauuuuucgauguuuaauuaauacauaccuugaaaucuagaaaagacucuuguuccugcuugcgcugugagagauaacccuucacaccauccagcucaucuucgugggucuuucugacuaacugcuucugaaucuggauugugccugaaaggaaaaaccauuauagggauaacauaacauaacugccgcuacuggaaaauaaauacacagcacacucggccuacaccagcuccuuaacuagggcaggacauucuuuaccccaacacauucacggugucacuccucaaacaacaguggaugcuaaugcauagggcaagcagguuaacgaugcagcuucguucauucagcaugcacacaggaucgcuuaaguaguucacuacccuuccaaagaaaaacacgggccacucuaauaacccacccuucccccaaaaaaccacuucucaucuugcuauaccaacaguacucagcuuugagaucgcugaaguaaaguguuucaaccuccuuaaacagaaaaauaaggcauugguggaguucuuuuccuacagguugagucaaaaaaaaaaugaaaauguuucuuaauaauuugccuacaggcuacaacucacacacugaaauauaacacagggaaugccuaauuaagaacacccauuauucucaaagucaauuuucuauuuuacuuaucuuuuaaagacagggucuuaaguuaucucggguagaguccuacucccuauuuaccugaagaugaucuggaccucgauucuccugcuucuacuguuuuuguguuuaugagacaggguguuucuguguaacuguucuggcuacccuggaaaccuuuuguagaucagcuggacuugaacuuacagagcaccugcuuuugccuccugaaugcugggauuaaaggcauguaccaccaccaccuggcaaagaggcuuuucguuuguuuaacuguuuuugagacugagucucuggcagaccaggcuggacucuaugaacuaugaccuggagaaugaccaugaacaaccucuucuguacuagagucccugccucuagggagcuagcacugcaccaauuccuaguuuuuauguugagcaaggcuugaacccaggaguaugugcaugcuaggcaaacacucuaccaacagagcuacaucccuucuacucuuuaaauacugagauuacuuuuaaaaaauauauacauauacuauuuuggaggagggaacaugcaugccaugacacaaauguggaggucagggaaacugagaggagcuggaucuccccuuucccauguagaccuuggcgaucaaacucaggccaacaggcuugaaaguagcacccuuccccacugggcugucuuauagacccucaaagcaaauguauuaggaagucugcaauagagcagggcaguggaagagccucuaacuaccauccgcaaagcccccagguggucauccaguacuaggacaauuccuucguauuugaccuuaaauucaaaauguucuuuugccaagacaugcuguuugcaugcuccugcuacauguaucauacaggaaagaaaaaaaaaaccaccacuaaaccaaaaaguguaucugacacuuggguauaccagugcaugcagaaguuuaaacauaggauguaaccaucccuuuuaauuccuucuacaggucuugaaacucacuuugaacaucacuuaacaaucuaggaguggaaauucagcugaguugcagaaggacuaccacaucaucuagcuacuucacugucuagcaggacucuuccacuaaggaaccguuuacuuccaaugugaagcagcuagcacacuuccugaauuguugauagacuaccaaacugaaacucuaagcuggaaaccacgagugcccuccccauucucaccucuuccuugauccuucacccuaauccucaaggccugacuucagcacuaguauacagauuacaaaacccacagcaguuccagcuggccgcuagcuucuuuuauuuuuaucuuuuccuuuucaguuuuuuuuuuaaaugguuguuuucaguugcuccauaaaucaaacuuucucacucagcauccuaaacuguauucagacacuagaagagggcaucagaugagccacuaugugguugcuaggaacuaacucaggaccucuggaagagcagucagugcucuuaaccacugagccaucucuccagcccccuuaaagacaucuuuuaucauuaaucuagguaaauuuuguuuccaaaaggguuuauagaguugccauuccuggaauggucugcuuucccuccugccugucguaagcuuacgaaaaacccauucaaggaugacugaguaaguugauauagccauggauuucaaugccucuuugugcuguguaacuucucaucuaguuacaguuacguccucagaauggcuggacaaccugucaccaccuucuaccuaaguguggagagaugagcaaggacggagaagcacuucaaacaugaauuugguguuagcuuucuuauagauuauuuaucuucucugcuaauuuuuaucuuuuuccaaaaguucagaugcacuuuuagaaucugaaucaugucaaugucacuaucuuuugcuuucucuucuacuacagacaggaaaccccacaguuauacaaagccaaggcuggcuguguucuaguagacuguuuauaagacauggcugcuuauagauacagaucucagagaagauaugucagcauggagcucacugcccgugaaaauacugagaggucacugagucagggcuuagauauggaacucacuucauauacugcaucauccaguguucccacacugugauaaggcuaagacuaaaaguuacagaaaggaagguaguguguuaauuuuguuaauuuaguuuuagaagaacuguucuaaacuguauuuucuuaaaaaaaauuccaaagucaugcaaauugugagauuuuagugcagucuguauuaauauucacguuaauaaccaacucuuggcuuuuaguaagaaaaaaagauuuuagaccuuuucccuuguuuccuucauuuuuaccuguaggggggcaaaaauacacucaaaaccauugauaaaauuugugccugagagcacaucacacuaguguggcucgaguaaguacuuggcaggacacacaugggcaggccuccccacgagcccaaauaccaccccaagcugaacacaggaaacauaggucagcaacuuugacuuuagcaaguaugggcugcccgaucaucucauuccaauaucacgcucuaucaaauaccuuucccacauucgugaaagaauguacuguugaaaagaacuauuaaaacagaagacugaaguauagguuauguagaccaagaaaaggaauaaaucuaaaaguaguuuauauaaguaagcuaagaguguucagguugcuaggcaugauggcaaagauaaacuuuaguccagcacuuggguggcagaggcagauggagcucugugagucugagaccaaccuggucuacagagugagcugcuacacacugaguuccuagacagccagggcuuuuucagacaacaacaaaagaguugugaacuugacaagguuuaagacacugacuucucaagcauacaauaccucucuggccaggcagcacaggucuauaaccucagcacucagguaacugagucagagcucagccuggguuacacaguaagacccuguuuuaaaaaccauagauagauagauagauagauagauagauagauagauggauggauggauggauggauggauggauggauggauggauggauggauggaugacccuguuuuaaaaaaccauagauagauagauagauagauagauagauagauagauagauagauagauaggcaggcaagcagacagacagacagacagacagguguaaaguccuacuucaaaaaccagucugaccccaaacucaagacccucugccugcccuggguaaagccauuuaacaccacgcccagcaccuccgaucuuuuuuuuauucguguuuugccugcaugugugucugugcacuaugugcaugcagugcccuaaaaggucagaagagggcagcuggaauggcaaugguuaugaaacagccagcauauggguuugguguaggagacugaaacuggggccucuggaagaauagccuagccacugcuuuuaaccacugagccaccuccccacccccaacuucagauuuuuaauuuccagucuucuuacuuaaaaaaaaaaaaacauuacacaaauauguauguuacuaguccuuauuuauacuugagauuuugaugauguaugaagauuacagguuggagaccagccugaucuuguuuuguuuuggaacagggucucacuauguugcccaggcuaaucucaaauucugaagacucagcaaccuucacuugugccuccugaguaaaguagcugacugcagguacaggccacagaacccaacacugaccuuuugugccaucuugucuugcugcuauaugcaaguggcuucggcacaagguguuuccacucagucacucaccauagaaauguccaaaucccaugcugacagcaaucaccaaggccaggauaacacacuuguugagaccacgacuaaaguggcguuuacuuggcuccuuggagggcucaucuuccggcucagcgaguggaggcuccucagacucugagauagaaacggucuucuuccuguugcggcgccgucuaggagcagggcugggcucguggcuggugucaucgcuacuggauuccucaucacuaggcugagaugaaaagacuaguuuaaaaagaaaaauguugauauuuaaguacacagucucagaaaagccuugccaguaaaucugccaaucaucacugccagccuuucaugcccuuuaacacaagaaagccaaaagagaagcauaaacaggaacaggcuguucauuuaccaacaccagaucaaacccaggcagaaacaaacaugucaguuaaggagaaaaaaagcccugucuuuucauucaacuucaauguuacuugaggggcaggaggugugaaguacuucuggucucuuacaacaggucccuaccccacugugcggguccagagcaccacgguccacacaguucccggaagucaggugagccccucccuucugcugccucucuuacuggaagguuguggaucacccucuaguaaauaugucugccugaggaagugacacaacagcucuucccccaugcuaagacgcagucugugcugcuccuucacgggaagaaaugacacaaaaccaccuccaguccaggaacaauccucggagauaccacuggcagcuuuuugcacacgucacuccuuaauuccaucccauacuucagugaauuauagacaagaacacuuaguaauaauaaucucuauaggucaguuagagguaaagagaagaugugaacuugaauuuaacagagcuccaaaacagcacacacucaugcaacuaacaaugccagucuuuuagaaaacaggcuguccaugccacagaaaagcuggugucuacaucaggcaaugcuuucuaaagaucgagcguggagaauguaguucauguucccauaacaaaagagacaccaucacuacugaacgaacacauauccuaaugcuucgugacaugggagccacugaggggucacuguguccuaaccucaugccccucaugccuagcaugugacugguuauucuucaucacuaguuuucccaccaugccacugccucagcugugacguacauuucuuagguagagagaaaaagaggaagacuucaaccaagcauuacacgauauaaagguauccagaucacggcugggcacugaaguaaugcuuucugacagaagcacaccaugucaauguaaaagcaaacuguucuccaaaucucuuaaaaaugucuccaaaccuacaaugcauauugccuucauauacaugaacaaaccaccccguagauauuaacuaccuaaugcuucucucuuuaacucauacauguaaugguggaaguauuuggauuucuaaguuuccuguacagcauaauagcccacaaucuaagcagcacgcaaugcagaggcaugcaguaagcuuagccagccugugugugagaucucuuagaccaagacucuccaaagcacucagcaguucaauaggaaugugacuagcccagcuccagaagccgagaagccgcucagcucagcgucggucacgccaccuuggagagcaagcuggcuaggaacacguagucucagcugaucaucccauccccuuaagcauccaggaaucuuccacagcuucucccaccaccuuucuuuugugaauaaauaggggggaaaaagauauauaaagcuuuauuauaaauaauaaaggaaaaaaacuuaaaaauacaacuuugaccaguuaacacuauuaucuaugagauuaaaaccccaugauugucuaauuagaaacauacacaagaacuucacuacagcagucaccugcgccuucuggguaagaggguugguuggccaauggaaggcaguaguuuucuuaaacaaacaaaagcugcauaccuauuagaaucacacaaaaacaugaagcugaaaagcuguaaggaaaaagagaauggaagagcagaccggaguaacuaaggagacacagcguccaaugaugccugacucuguagccuaaaauuuaucauuauuucuaaacacugucuuuauacaagcaauuuugaugggauggauugcaauagguuaaaaaagaaugcuuaaauuggguguggccauacacaccugauaccagcacucaagaaacagagacaagucaaucucuauaaauuugaggccaaccuggucuauagcaaauuccaggccagccaaagaugcaucaugggacccugugucaaacuaaaacacacacacacauagacacacacacacccuuaauauuucuguuaacuaguucugaaacauucuuggccuuucaaagaggagaucaagccagaauccugggcuuuugggugcaguucccaucaacaauguguaccguccucucacugcgcccuucggcuacccugccugaguccauguuucuuaagccagaggcagacaauuauaacugaauaauaaauauaucaaaaggaagaaaacuggacaugauagaauuagaaaaucugaaaggaacccgacugcaccgagugugggaaggccuugaccucuggguacuuguuaaguuccaaggucaacuguaccaacuuuuuguaaauagucacacaccugucuguaucccaggcucaacaaaagacggauuacaaauauucagaagacacuccuucugcucuuaauacauacacacuuauuaccauuccccaacaacuuacacagcacucacgugucagacguguuacauggggacagacagaggauguggguguuuugugacauaaucccagcugaagcaugcagacugucacaaauccaaggcuagucaaggcuacacagugagcucaaggacaauguggacucaagagauacuaucccaaaacaaaccaacaaacaagccaaaaagcacaaugugguauuuuacuaccuuaaguuggaaugaaaaaugucacugugugauucugacugccaaauguauacaaauuauuaaaagauggaaaaauauaaggaacuaacccaaacuauauauucuuaucuuuucaucagauuaggaaauuaaaacagcaguucuaaauagagucacaggccuccacacuccaucuuuaaauuaucacuguggguuaauuaauaacugaguuagccacaggcuucucuuuuaacauuuuccagggacuuuaugucgaaauauuuugucucuuugaaagauacuaauauucagaaaucagagguuaaggauuguagaagaggcugggugguggcagcacgggucuuuaaucucagcauucaagaugcaaacguaggcagaucucugaauucaagaccagcuugcucuacagagagcaaguuccaaugcagccagggcuacacagagaaacucugucugaaaaagcuugugaaagcugggaaugacggcaccugccugugggacugcugccaagucugaggcaaauccugagcuacacagugagcauaaaaacagccagaguuacagagcuagacccugcuauaccacaaucaauuaaucagauauuaaaagacaaauguaccuaccuuuugagaacuugagacuucaauaaacugaauguagcauacugcuuacuuaguuagcaugugcaguaucugggguucaguccccagcauaccccuauacacaugcaugcacgcacacguacacacacaguaaugugugcacacacacguacacacacacacaguaaggugucaaagaaagaacacugagcucagccauaaaggccaggaaaacacuguaacaaauuuuauccaaauuuucuugaguuucagaaaaauuauuuaagacauugaaagcuggagcuagagaacaagccauuaaguaaaguaagacgucagagguucgcugcugccacagcuccauaccggguucuggcuggcagaaggcguacuggcugcuggaggaagagcccauguuaaggucaucugagcugggcgcuucuugaauuguaacuuccugguuccccauuucuuccagcuuaggugguucaaguguaacaauauccgaaucgucacuaguaguuccgaaauagacauugucuucaggggaaggugcuuccuccaccuacagaaccaaauuuuacaggcaguaagcucaguaaguuugagucuuauauuuucuucacaguucaaaauauaugacaccuagugucauucuuuuuguguucucuccacuucccuuuucuuuucaauacuggggauggagcccggguccuugugcacgcagugcuuccggucuaccacuggacaccucccuagccccuagagaugcaauuucuauccaacaguaaaggaguaugcagucacaggcucacuuucuuuacgcuggagaccucaaagccauccaugaugcuaagaauuagaugagacgacugucugucuccucccauuaugcuucagaaagaaacugcucagcccugcuaugaccacaggacaccaagaauucacuuacuucagcaguccuguguuugcuggcacaaaauacuacuucuagggaguaugugacagacugacaacaaauaggcuauguucuacagucugaacauguccccuaaaauucauuaaaacuugggcuagcacaugccuucaaucucagcacucagguggaccucugugagcuggagaccagccuggucuacauaugaguucccaggacugccagggcuauguagaaagacccugcaaacaaaacaaaaacaaaaccccaacaaccaccauggaaacucaaugagcucugaagagaugagggggcugcuguuugaagaggcacucagcacagugccauucagucauugccuuccucuguuauccaaggauauugcauuuuuuuucccuacagagaauguggccaaagguacaaucaucacacaccaaaccagcuauuagcaccuucuucuugaacuuccuagccuccaaaaauaaacuauuuuuaauaauacacuuggcaacaagaccuuuccaccugcugaaccaccucaucaaacccugagcuuuauuuaauucugugucugcuuaaguuauacacaugucuaucugugcagagccagaggagggcaccagauccauggagcugaaguuacaaguguuugcaggacacccagauucuuccacgugugcugagaucugaacucaggcucucaggauugaguagcagauauucacugccacugggccgugucuccaggcccuuccagaaaagaauuacucuuuaugucacccuuucuuagcaggaagggacuacaauaccauggaaagauuaugcagccaaguagcuguauucaaaagacaaccacaacagccaauauuuaauuuguuaucaaauguacccuucuuagaauuggaaacaaaacacccauggaaggaguuacagagacaaaguuuggagcugagacaaaaggauggaccaucuagagacugccauauccagggauccaucccauaaucagccuccaaucgcugacaccauugcauacacuagcaagauuuugcugaaaggacccugacauagcugucucuugugagacuaugccgggaccuagcaaacacauaaguggaugcucacagucagcuauuggauggaucacagggcccccaauggaggagcuagagaaaguacccaaggagcuaaagggaucugcaacccuauagguggaacaacauuaugaacuaaccaguaccccggagcucuugucucuagcugcauauguaucaaaagauggccuagucgaccauuacuggaaugagaggcccauuggucaugcaaacuuuauaugccccaguacaggggaacaccagggccaaaaagugggaguggauggguagggaaguaggggggggguaugggagacuuuugggauagcauuggaaauguaaaugaggaaaauacuuaauaaaaauauuaaaaaauaaaaaaaaagaauaguuuaaacuauccuuaaagugguuaaccagauuaaaccaacagauaagcuagcuaacucagaagagcuucucaucuucuagucacaguuggcugugaggguaaccugaggcaggcgcuugcuuagaguccuguucugaaacccaaaaaaguucacuuuaaccuuaaaacugacagauuuuuuuccacuagauuuuccuauaauuuugguaggaguagaaugcuuagcuauaaacaggaagacagugcuucuccaacauccacagaacagaauaaaguuuaccucagcugcugacuugguuucucucauugaugacaacaugguuucucccacugacgauguguuguuugcgcugcuuucugguauaaaaccaaaaacguaugguuauuucuuuuguuguaaacacuaacugugcagccuacauaucauuagucccucugcucuugcuaacaaauuuaauuacuuguaagugugaagggacaauuucacacagggaaugugacucauuacaggcucucaguugucagcacccuucuaacuauucucagacacuugcuggcagguuuucgacuuaaaacaagucuacugaacaucugggguaagaccauuccaauggcaaucaaggaugacacccccaucuccagaaaaaaaaaaaaaaaaacaggaacuuaacuuaccuucaccuccaugcccuacauaaagaacgggcagcuccucuuguucuacuaaggaacauucuagagucaguccacaguugucacuggcuguggcagaauucacgaucucuauaucagaacccuaggggaaagugguaauuauuaauuuagcuauugccucccuaagacuggauuucacugaugauauguagaaaguuccugaugcuaccacacucuauaaacaguaucugucgugacuggcuuuguucaacucagucuauacaggccugcagguggaagauugcaaaauggagccauagccuucaagucaaugucuggugaacacaggaugacugugcuauucaaugagacuaaaggccaaccccugaguccugagugucugcacuaugaggcuggagagagcucaggaguuaaaagcagcccaaacuauguaguaggcuccaucccagccacaacuauacccuggcuccauaaacaguaacaaaaaaugaaggcugauggagcuggagagauggcucagcaguuuaggacacugguugcucuuucagaaacccagguucaguuacuagcacccauaugguggcucacaaccaucuguaccuccagucccagagaaucugauaccauccucaacaacaaagaagacaaccaggcacaugccuuuaucccagugcucagaaagugaagcagaaggaucaaggguuggagguucagccugggcuguguggaaauuuagauaggggcucuccuaguuacacaguaagacacugaucuucccuccacacacacccccaaaauagaaaugaaaaaaaaaaaaaguaccacaaagaaggucuuuaaaaauuacguaagaauguaguuguaccaggcagcaccugacaaagaacuuugaggcaccccucaaaguuaaggaagucagguagaauaauguagaagaguguagcuaugguuuucagcaguucccaaaauccuggaugcuucucuggagaaguucacacuuccucuugauuaugaacaacugcuguccucacacauauaaaucuaaaacacauauuuuuucuuauuaaguucuguacuccauuaaaagagggugaucggggcuagauaugguucaugucucuaauccccauaccugggaggcugaggcaggagggcugccuugaguuuuaggccagccuacaugacagaaggaggcuuucucaaaaacaaaacaaaagccagccauacuagcguacaccuauaaccccagcucucgggagcacugcuguggauguggggccaguucugggcagccauggcuacucagugagacuugaaugucucagcacaaccaaaaaaccccacgcccuggguguacuggugcaggccugucagcccagccugaggaggcagagacaggaggauuccaagcucaggaagaucaguaugagaugcacacugacuccaagaccgccuagagcaacuuauuaagacccuauaucaaaauuuugucuguuuaaaaaaaaaaaaaagauaaacccuagggcuguauguagcucaauggcauuuagcaggcaaauuuaauaugggugagaaaacagccaacuacagacaaaggaagccacacuuuccuagaaaacccugaccuucauaaagcaguuucugucacugcuaacaacauauugaagaacauaccucaugauugaugacaguccagccacaagaugagucgcugucgcuggaacuuucagacauuuuucaggucuauaauacaaugaaacauguaacacguuuuuuuguuuuguuuuguuuuuuaaaagauuuauuuauuuauuauauguaaguacacuguagcugucuucagacacuccagaagagggagucagaucuuguuacagaugguugugagccaccaugugguugcugggauuugaacuccggaccuucggaagagcagucgggugcucuuacccacugagccaucucaccagcccaugcauguaacacguuuuuaaaugucuguaaaagcucuaccacacugcacaaccuccagguaaaacagacaccaccacaggcuuuccacaccgaccauacgacugcacaccuauaagaauaaaccaagucguuaagcugugggaacccuccugagcuaaggcaaccucccgcugugcugcugcgaccaacagaaguuguaucugaaaggcgaagaauaccuaggauccugcuggcagaugguuaauugggaccagacagcagcaaacuaaguucacuuucaaacagcagugagcugugaaaagcuaacagagaaguuucaauuaaaauaacuauuaucaauaccucaaauggcuuuauaaagggugguuccaaaccuaagacacugagaaggaccucauuuuguccugaagcagcaucuugcucagugcugccuggucgcucuuccaucuggaaagcuuuuacauugccacuccacgaaggcuagccuaggcuagccuugagauuauccaccucuuuaacuagcuucuggccgugcacagacacuaucaaaguguuagaucuaauuugaaggcugugguuccaacacaacuguauccaggggcugggacauagcucagcugguagcaugccuagcugggugagauuuccagcaccauaugacuuaaacaugcuggcacucaucuguaauccuagcaucugagguagagucagaaggaucagaaguucaaggucacucuuggcuacacaguaguaaguuccaggccaaccugguauucaaaacacucuuaagaaguugccccacccuccucugcucuaagaauagcuagucacauagcuuggcaaugaccuucccaaggcuccugcacagcagugcagagcacccuucaauuccagggcucugcacuaagaaagcugaagugggagagcuuccaacuguaagccagccuaagauagacagcaaguacuugaggggugggggaggcagggugggugaaaggcagaagggagggaagcagguaggcucccuuaagcaucagccuccauagauucuguugguuuuagccugugacaccagcacuugagcucuauaguaugaauuugucucaaaauaaccaaaaaaacauguucugcaaggguaacucgagggcuccugggcauagcugugcacgccuuuaaucccagcacucgggaggcagaggcaggcgaauuucugaguuugaggccagcuuggucuacagagugaguuccaggacagccagggcuaugcagagaaacccugucucaaaaaaacaauaaauaaauaaauaaauaaauaaauaaauagaaaaaauaaacaacaacaacauuucucauuaaccaaaacagacaaguuaccuagucugaugaugcccuacauugucccuaauaagcuacauuuuacuaugaagaaggcaagguuuccauuuccuuaucuucuagaauuagacaugagugagaagaauggggcacuauuaucucacaauccugugauucuaagcacagacugagguaggucaaugcugcugggcuguccaugaguccauuuggaugccuguccagaaucugacuguaaucaggccuguaagcccagcuauccaggaggccaaaacagaagaacaaguuuaaggcuagaaguuuggccagaucaagcugaguaaccuuguggaguuuuuuuuuuuucccuuucaaaaauucucuuuaaguauuuuugcauaugcauguguguugugccugcauguaugugcaucacaugcaggcuuggugcccauauaagucaaaagguguuggguuuccuaggacugaguuacaaaugguugagagccacaaugugggugcuggggaccaaacugggguccucuccaugggcagcaagagcucucaaccacugagcaaucucucuagcuccuccucuuuaaaauuuccauacauuacaagcuaauauaaaugagguucaguggcugugauguaauuuaaugguacagcaacuacuucaaauguaucuggcauuagguucaacccaauucaguuugagcauucaaaacaaauuuuggggagaucagaaaguagcugagacaugucucaccgaagccaccaguuagccuaaaucuugcuguauaacuaagcuagccuagaaugugggucuuuccugcaucagcuuucccaguacuaaggcuauguuacuucuaauucuaauuaaguagcuguguuaaugaagguauucuuugugcuuauauguacguucgugggugcacaugccuguacgugucccugcaugcaugcacacacauaaagaugccaaaggacaagaguggcaagcaguccucgugguuuuaagacagcgucucuuaggagagucacgcacgccuuuaaucacagcacucagaagggagaggcaaguggaucucuuugaauuugaggccagccuggucuaccuaagcugaguugcaggacagucagggcuacaaagugaguuucaucucaaaaggaacaugccaaguaggucaagcaggccaggcugacugaccagcuaacuugaucugaccuauaaacaaacaagagccgccacgccacugucuuacaugggagcuggguaccaaacucagguccucacacuugccugacaguacuuuagugacugaguucucuccagccccugugucuguuuuggagacugagccuugcuauguagcccaggcuggccucaaacucauaauccuccuuuucuccuuucccgaguucugggauggcacuggugugucaccugucccagccagacauuucacuuuuucauuuuauuugauauaauuacugcaggguuuuuguuuuuguuuuuuguuuuuuuuuguuuuucuuuuuugagacaggguuucucuguauaacucuggcuguccuggaacucacuuuguagacgaggcuggccuugaacucagaaaucagccugccucugccucccgagugcugggauuaaaggugugugccaccaugccgggcuacuucaggggugugaaagguagcuuauguaaaaugaaaaugacuucuuuuucuuaauugagaaaaaagggaaugcucugaaggcuaacgugauugcauguauacuuuauuuccaucaaguguuugagcccagacucaaggcuaaccuggcggcccagcagaaccuggucuuccuuaccugaaaagcagcuaagcaugguggcugggccuguaacccagcucugcuccccaaccaagugagaagacagauuguggaaccgagcuggggacugagacccuaacucaggaaggaaggaaggaaggaaggaaggaaggaaggaaggaaggaaggaaggaaggaagggagggagagaaaauggagagacucaaagucugugggcgcauuuuucagugcgggggaguuaagcuaaggccuuccuuacagaugcuagguaagcaccucaccaccgagcuacagccccagggguuuuauuuugcuauagggaggaucucacuaucuuacccaggcuggccuggaaaugauucuauagcccaggcaggccuugaacuuucuaucgucuugacugggacucuccaauucagggauuuuaggcaugagccaccaugccugucugcccuuacaacagacuguucuauuaaaaaacaaaacaaaacaaaaacaaacaaacaaaaccucagaccuauaauccuaauuacuuggagucugagacaagagaugaauagcuccaacaacuaggguugcaugcugucauagucuggccuaggauguaacaaaagggagggguguccuggaaagauggcauacucucagcuaucgcuccagaacugugcucaggauccugcuuaaugccaugcuccccaacauaauaugauguucacggucagaucccauggaacuggaguucaaauaauugggagcugucuugugggugcugggaauuaaacuuggguccucuggaagagcaacaaguucugcuaaccacagagccaucaucucuccagcccucaaucucuucuauuguguuggucagggugucucuucacagcaaguaaauaagacacauacacaacacaaaggccuguggugguguaugccuuuaaccccagcaggcagguaagcuaccuaguuuuugagaccagcauagcaaguucuaggcaggaguugcacacugacacccuuucucagaacaacaaaagcagugguuuuuguuuuuguuuuguuucugugagacaggguuucucuguguagcccuggcuguccuggaacucacucuguagaccaggcuacagcuccugugguuuuuacuuugauacaggaggucucacuaccuuacccaggccugacuggaaauucuucuguugcccaggcaggccuugaacuaucuuccugacucagacucuccuguucaggaaucagaaguggcugccucugccuaggcgugugccaaccgccccgacagaaccaauuuuaagcacagugaaaggcacaaauucaagaagcauuuucuccugaaaaguuaacgaaauuaacauguuaccuuaaaguuuuacccaccggauuuuuagugaguugagucaacauaguacaggauauaaggcucuuuuucucuggucauaguaauccuaucagugagugcaaagacucaucuccguaaaaagcagguuuuccugguugaaaugcgguaggaagacacugucacuaaaaauaauguaagccaggcaauccuggcacacuauaaucccaguacugaggaaagcagagguaggagacugcccacaagcuccaggccaaccuggcacagaguuauaacccugucuuuaauaacaaaaaaacggaguguagucacacacaaaucuuagcagaggaaaggcuaggacaggaggaucugaaguucaaggcuaaccuagucuuuguagugagacuggaugcuaaucugagcuacaugaaacuccaccuuuaaaaacaacaacaacaacaaaaaaaaaaaacgggcagugggcacacgccuuuaaucccagcacuugggaggcagaggcagguggauuucugaguuugaggcuagccuggucuacaaagugaguuccaggacagccagggcuacagagagaaacccugucucaaaaaaaaaaacaaacaaacagacaaaaacaacaaaaaagggggcuggagagauggaucagagguuaagaacacugacugcucuuccagagguccugaguucaauucccagcaacuaccugguggcucacaaccaucuguaauaggauccgauacccuauucuggugucuaaagacagucacagugacucauacauacacauaaaauaaauaaaucuuuuaaaaacuaaaauuaaaaacaaucaauuacaauauuuuuaaaagaauaaauacaguccacccauguacuccugcuauauauacuaaauauaccuuuucauccagaacaucauuucugcaagagaaauguggcaacacaccauuacucuguaaacuuccuucuaugauguaacuuugcaaauuaggaagcaaaaaccacuuuugcucugauaucugaaguaaacagccuaagccacaucuuuuuuaaaagugagaaaacagggcuggugagauggcucaguagguaagagcacccgacugcucuuccgaaggccaggaguucaagaucugacucccucuucuggagugucugagggcagcuacaguguacuuacauaaaauaaauaaauaaauaaauaaauaaauaaauaaauaagaaaacaaugauucaaacagcgaggggagaccaccuagagcagggaggaccgccuuucaucagcuaucugcagucuucugaaauguccuggcuguccaggguuguuacugcucaguuuuggaaaaagccugaaagagcuaauaaaugaggcugaagagacagcgcgcgcaauacuguucucucaaaggacccgaauuacccagcacccacauuagauggcuuacaaaaacugcuuauguuguggcuucugggggaucaaacaccucccauuuccauaggcagggaacucaccuguauaucccagaaacaggaacuuacagaguaaauaaagugccccucccccauuuuaguuaacuaauaccuaagaugggcaggcugcacacugcccuuccugggacacugaguccaggguggcuucaucauuuuacaaaucuaucugguuuuggcuuuguuuccuaucuuaauacuguucucucucguguguucucucucucucucucucucucucucucucucucucucucuccacacacacuauaauuauauuuuuuagauguucucacaaaagauaauuuacucuuauuuucuuauaguuaugaucuaagauaacugaaagaaaagcuaauacaaggaucuauguauuuuuuucugguugcuauuuauuaguuuauaucugguacaagggagaaggguccccacuguccuguagugauccugaguggauacccaaccacaguacauuuuacacaucuguuuuccuucacucucacagaccugugucacuuugguaaagccuuccaaaugaacuuagaaauuucuaaaagacugcuuuacauuaaugcucuguauuaacuaacuuaacuucaggucaaacucagaguuagaugcuaauggauaacugacuuucccaggagaaggcaucucuccacccccacccagggcuuucacaccucccugccaggaggauuucagacucaauagucuugcugcucaugagggcaacauuaaaaagaagccacuucccaugaaaucaaacaaaggaccucaacacaucuaacuaugagacugagacaaacacagaaaggcccaaccacagaggcaccacuuuacaauuccaggucuuuuaaucagaagagcuaagucauagugaggaagggaacuaacuggucuucagacuagaacacauuacgcagcucuaccuagaagacagacaaaacccuggauguuucuucaccaaaauuaugcuccaaaagaaugugcauggcacugccaucacgauguguacucaguuucacaggucacuuacaaaggccugagucccucuucccaaguccaccuugaagguacacaggggcuacuuccagcuuggaaguaacagaaagacuugguaccucagauccuuguucaucacugaacacuguuuuccuuuccacguucucuggagcucaucggcaauaugaacucaagagcugagucugucagcaacacucacuaagaaaaaucagacuuuguucucauauaaugaaagaggaaaccugcaacucaucuuacugacuuccuaaagcuuacagaaaacccuacugacucuucagugguuuuucacauauuaaauacccuucuaaaugcccaauuaaaacaaaacaaaaaaucccuaaauauauuacaugcaauccuuacauaguacaggacuaaccucuuucucugaacucaaacugaaagaugauuugguccuguuuaagggagcaaggcaaacaguaagcccugaaaucaaccucuuucccugccuuaaucuagccaaaucugauuguuccuaagaauaaaguccuggagaggaggcagugauggcccugaaggccacguucuugauguuuuccaaaugacgguguguggcuuuuuacaguuaacauucaaauaauuuaaaaaauucuuaaguugguuaaaaaauacaauuucaccuacaauagcaacacuguggaauuuggcagcucagacauauuauucuagcacaaaugcuuuuuauauccuguggauggacccaaagccuacauuaaaccaacacaagauggacuggugagauggcucagugguuaaaaccacugacuguucuuccagaagaccuggguuugagucccaccauccacauggcagcucacaaauccacacaagacacacagaacacaaguaaaagacagaaaauauugaaaagaaacugacauguggagaaaagcucccaacuaaaacaaccuaaaaaaacaaaaauacuaccaucuaaaaagcaauaaaggcuggcucacgcuggcucacaccuguacucagaaggcuaaggcagaaaacugcagcaagcuccaggccuugggcugaggaagacccugucuuaaaaaagaaaacaaaacaaagaaucccagagcucagaacgcagaggcagguggaggccaaccuggucuacuaguccaggacagccuaggguguuucgccaagaaacccugucucagaaaaacaaaaacaaaacggagguauaacucaaagguuauaccugggcucacagccaccaagcugggcagccagaauuugaccuccaggacacaaucacauggugagucugagauucccauaaauuauccuuuccucuguuuacauacaaaauaaaaauauaaccaaggcaaagugaugagaguuacuccuccuaaggucgcuaaugacgaaacacagucacuauucuuuagaagaacagaagcaaagauguagacuaaugaauuguauaauuuuaucuguucacacugaaucuaacaaaaaaauuaaauauagcucaaauuaucagacauauaaagccuacuacuuaauuaucuucaaacagggucuguuagccaggauaaccguggacuccugauucuucuucugaccucccauguauaaggauuauaggcaaguucuaucacuccaagcuaacucccacuuguaaaugcuuacaaauaaacaagcuguuuucagcugaacaugguggcccgggucagugaaucagagaccagccaaggguacaguaagacugucuccugccccuccacauauuuuuuuuuugcauguguauuaaaauaaccaagauuugucuagucuaaaguaucuuuuauguuucauuuuuguucuaguuaacaacaggucaaaagacacauacaugcuaagaauuauuguuaggaugcuuuuuauucuuuccagacaacuaauuggucucuuucccuucuccucaaaauaauuuccauuuaaauucauauaugguuugugaauucaguauaacugaggauugugcuuugguuuguuuguuucuuucuuucuuuuuuuuuuuuuuuuuuuuuugggggggguuucgagacuagguuucucuguauagcccuggcuguccuggaacucagaaauccaccugccucuaccucccaaggaccgggauuaauaaaggcaugagccaucacugcccagcugugcuuugguuucuuuuguuguugaucaguuugcaugugucuuguuggguuuuuuuuuuuuccuacuuccugauuugcuuuuuugagguaaggccugccuccuuagugaagggauuagugugcaccacccacccggcuacccuguuuggacuguguacugcuuuguccuuuuuuggaaacuggaucuuguuguguagcucagauuggccuuaaauuuccaauuguucugccuaugccuccuaagcuauguuagaccuaggccauuacacuaacuucuuuauuuacuuuuaguuuuuaagcccaacacccagccccacagccccccacccccaucucugugcaucuguguucagaggacagugagcaacuuauggggggucaguucucuccauccuguggguuccagaaaugaaccucugauggcagacuuguucagcgaguccccuuacccauggagacaccuugccagcccauuuacuuuagaaagucauacuuaaagaaucuaaagauaauggaggcaagagcauguagaauucaaggcuacauagccaacugguagcuggccugggcuauaugagaugcugucuuuuaaagauuucagagcugaagaaacagcucaaugguggagaacaaauacuaggaggacaguucccaacucuucuggucuccacaggcacugcauacacaagcugccuuuacagcagacaaaacauacaaaaacacaucuuuuaaaaaaaaaaaaaaaaaaaaaaagguggugcauccccagaaaacacaguaaagcguaaagaggucaguuuaguuucacauccuagacaaucaccuucauaacuaaauauccuuaaaacuccaauggaaacacaacagucuauucuuuggcuuacaguacaaaacugguucuaggaguuguucugaucauccuggggcuuaaacucagggccucacauacauuaagcaaguacuguaccaaagaacuacauucuccggucuuuuuauacagaaauaugcucuccacuauauugcucaaguggucucaaacuugccauuccccugcuucaguuucuaaauaucugggguaccaccuuuaacuggaauuucaacuuugguguaacaggguuaaaacagcauuuacagcaggcuccaugguacccaacuacgaucacagugccuaggacgcuuaggcaagagaacucccaggucuagccugggauauauuaguaucaggacagccagagauacacagcaagaaaaaaaagccaaaagcauuaacucacccuuaacaaccuucucaguuccccugugacuugagcuugucagaauagcaaacuacucacaccaguuauacaugauaaauauccccugagaaaucuaagaccuauuaagauugggaucuuaaaguuagucgguggacucagaaggcagaggcaaacggauuucugaguuggaggucagcuuggacuacagugcaaguuuuaggauagguggagauacacagagaaacccuaccucaaaaaacaaaaacaaacaaaccaaaaaaacccaauccacccacuccaaaaaaaaaaaaaaaaggcgaaagaaaaaauauugggucuuuaagauaguuagugcugacauuucaaacauuaugugaccuugcuggaaaggucucauagcaccccuaacugagaauaaccaacugguugcccuuucuagggacaagcagccccauacagccaauaaagcaaaagugggagagggcagugcaugaugguucacccuuaaggaaaacaccccagcugguugcggucuagaacucgggcgcugccccuggcagaguugggauaaaugagagguaaacacaaacgacacacgcgcagcugcuacuuaggacaagccgucagccuaacaaacgcugguaaggacccggaggggaagcgugaagaacgggcggagaacaggcuucggggcugaauaggaguauacuucuggggugcacacuuuucuauuccugacaccugggaccuccgagccggcucagagugacgcacgcggcaucucagcauacggaugcagcugcaccugaaucccggggcgcccagcuccgagcucgcggggcugcagccugcgagcccgcgccuaacaccugccaggucgcgcccuccgcccgaggucgcccgaggaccaaggcauccaccaggagaaagccucccggcgcugcgcccgaagguacgaguugcagcccgcggccgccccaucagcccgaccugcgccccagggucuuacccgaagacagcgccucuuccgcccgaccgcgccagcugucaccguggcggcguccgcgcuccagacgccagugacgccucauaaaaacaacaaccugcucgcaggcguccgcagcggggaagcgguggcaggcgcggcgcagcaaggcaugcugggacuugaaguuccuccuacgucuccugccagcucgcggcgagcaaaaagaacuacgacucccgaagaugcguacggcccgcaccccugagg

SEQ ID NO: 5191 - RNA, 32304 nt, Mus musculus
aggucuaaaaucuuuuuuucuuacuaaaagccaagaguugguuauuaacgugaauauuaauacagacugcacuaaaaucucacaauuugcaugacuuuggaauuuuuuuuaagaaaauacaguuuagaacaguucuucuaaaacuaaauuaacaaaauuaacacacuaccuuccuuucuguaacuuuuagucuuagccuuaucacagugugggaacacuggaugaugcaguauaugaagugaguuccauaucuaagcccugacucagugaccucucaguauuuucacgggcagugagcuccaugcugacauaucuucucugagaucuguaucuauaagcagccaugucuuauaaacagucuacuagaacacagccagccuuggcuuuguauaacugugggguuuccugucuguaguagaagagaaagcaaaagauagugacauugacaugauucagauucuaaaagugcaucugaacuuuuggaaaaagauaaaaauuagcagagaagauaaauaaucuauaagaaagcuaacaccaaauucauguuugaagugcuucuccguccuugcucaucucuccacacuuagguagaagguggugacagguuguccagccauucugaggacguaacuguaacuagaugagaaguuacacagcacaaagaggcauugaaauccauggcuauaucaacuuacucagucauccuugaauggguuuuucguaagcuuacgacaggcaggagggaaagcagaccauuccaggaauggcaacucuauaaacccuuuuggaaacaaaauuuaccuagauuaaugauaaaagaugucuuuaagggggcuggagagauggcucagugguuaagagcacugacugcucuuccagagguccugaguuaguuccuagcaaccacauaguggcucaucugaugcccucuucuagugucugaauacaguuuaggaugcugagugagaaaguuugauuuauggagcaacugaaaacaaccauuuaaaaaaaaaacugaaaaggaaaagauaaaaauaaaagaagcuagcggccagcuggaacugcuguggguuuuguaaucuguauacuagugcugaagucaggccuugaggauuagggugaaggaucaaggaagaggugagaauggggagggcacucgugguuuccagcuuagaguuucaguuugguagucuaucaacaauucaggaagugugcuagcugcuucacauuggaaguaaacgguuccuuaguggaagaguccugcuagacagugaaguagcuagaugaugugguaguccuucugcaacucagcugaauuuccacuccuagauuguuaagugauguucaaagugaguuucaagaccuguagaaggaauuaaaagggaugguuacauccuauguuuaaacuucugcaugcacugguauacccaagugucagauacacuuuuugguuuaguggugguuuuuuuuuucuuuccuguaugauacauguagcaggagcaugcaaacagcaugucuuggcaaaagaacauuuugaauuuaaggucaaauacgaaggaauuguccuaguacuggaugaccaccugggggcuuugcggaugguaguuagaggcucuuccacugcccugcucuauugcagacuuccuaauacauuugcuuugagggucuauaagacagcccaguggggaagggugcuacuuucaagccuguuggccugaguuugaucgccaaggucuacaugggaaaggggagauccagcuccucucaguuucccugaccuccacauuugugucauggcaugcauguucccuccuccaaaauaguauauguauauauuuuuuaaaaguaaucucaguauuuaaagaguagaagggauguagcucuguugguagaguguuugccuagcaugcacauacuccuggguucaagccuugcucaacauaaaaacuaggaauuggugcagugcuagcucccuagaggcagggacucuaguacagaagagguuguucauggucauucuccaggucauaguucauagaguccagccuggucugccagagacucagucucaaaaacaguuaaacaaacgaaaagccucuuugccaggugguggugguacaugccuuuaaucccagcauucaggaggcaaaagcaggugcucuguaaguucaaguccagcugaucuacaaaagguuuccaggguagccagaacaguuacacagaaacacccugucucauaaacacaaaaacaguagaagcaggagaaucgagguccagaucaucuucagguaaauagggaguaggacucuacccgagauaacuuaagacccugucuuuaaaagauaaguaaaauagaaaauugacuuugagaauaauggguguucuuaauuaggcauucccuguguuauauuucagugugugaguuguagccuguaggcaaauuauuaagaaacauuuucauuuuuuuuuugacucaaccuguaggaaaagaacuccaccaaugccuuauuuuucuguuuaaggagguugaaacacuuuacuucagcgaucucaaagcugaguacuguugguauagcaagaugagaagugguuuuuugggggaaggguggguuauuagaguggcccguguuuuucuuuggaaggguagugaacuacuuaagcgauccugugugcaugcugaaugaacgaagcugcaucguuaaccugcuugcccuaugcauuagcauccacuguuguuugaggagugacaccgugaauguguugggguaaagaauguccugcccuaguuaaggagcugguguaggccgagugugcuguguauuuauuuuccaguagcggcaguuauguuauguuaucccuauaaugguuuuuccuuucaggcacaauccagauucagaagcaguuagucagaaagacccacgaagaugagcuggauggugugaaggguuaucucucacagcgcaagcaggaacaagagucuuuucuagauuucaagguauguauuaauuaaacaucgaaaaauaacuaauaggugugagggcacauacacacuguaauccuaaccuggcacuugagaaccuaggcaauaugaaucaggccaaguucaagacuagccugugcuucuuagugacccccugccucagaaagccaaggagaagaagaaaaguagaaaccagcagugaaguaguuaggugucguuacaaugaagaguaguggacgagagaggugggccagcccccagccacaagcuguccacugaccuccacaugcacacauacacacaaacaaagguagucaugcauggcauaaauguggaaaucagaaaaucacuuucaggagucaguucucugaucuaccaugcugguccuauggaauccagcucaggucaucaggccuggcggcaggcaccucugccagcagagccggcuugcaaaauacaguuuuaaaccuuuucuuucuuuucuuucuuuuuuuuuuuuuucccuaaagauugauuuaggaaaacaacuauuucaguuguuucucauguguaaaacucuuauuacuuauuuuguuuguuuguuucugaauucaaguuuacuuggauuugggaaaguacuuaacuaugcuaaggauucaggcuguccucuguguacagagaugcuuccaugagauucuguacugacacacagcagccuuuucugccacccuagugcugggauuaaagguggguacugccacgccaugcugcucucugaauauuuuuuuauccucaucaguacugagucuggggacaugaggauacagauauacaaauagcugauuguggguuacuuacagaaggcaaugcaacuuacuuuaaaaucucuuaguugcuggguguggugggauagaggcaagcagaucugaguuugaggccaaccuggucuacagaauaagugauaggucagcuagcgugauguagagaggcccuuucugaaaauaaaaaauaaauagaauaaaauguucucuaaaccguguaggcaccuuuucaggacagcuauugugguaacaagaugggagggcuucccucacuuuucuagcuuagaaauggguguauuccgaugaugugucuguuugcagcacugugcauggacucuggggacuugggucugcuagucaguccuuggcuuuuaggcuguuagacacacauggaauucuaccuacuuguucuuguuugaauucuccuuccucaacaguguccuugauuugacaugccugccugcuucucguuuucuuccaugugacacuuucccuuucccuuucucuuuuuagaaugagaagccucuugaauauauggcaagugucauuaagcauuuauuuuccaauuuuuaacaccauuuaaccauacccaaaguauuugcgcacauggucauacacacacacagaggcacuaaagggcauggugguuacaugauuaaagauuuagauugaacuuuccaagcacuuaauauuucucuucucuuucauuaaaacaaaauuucuuuccuuuagucgcugaaagaaaaccuugagagguguuggaccguuacugaaucagagaagauuaccuuugaaacucagaagaagaaccuugcugcagaaaaccaguauuuacgaauaucucuggagaaggaagaacaagcccugucuucauuacaggaagagcuacggcaacuaagggagcagauuagauuguuggaggauaaaggcacaagcacgcaguuaguuagggagaaccagguccuuaagcaguacuuagaaguggaaaagcagaaaacagauagcuuccuuagggaaagggagaugcucuuggaggaggcaaggaugcugaaaagggaccuggagagggaacagcucacagccauggcucugcgggcagaacuugagcaguucaucccuggccaggcacagagccgugcggagucuccuagugugcagacugaagagaaggaaguggggcuguuacagcagaggcuggcugagcuggagcagaagcucaucuuugagcagcagcgcucggauuugugggagagacuguacguugaggcaaaggaucaacauggaaagcaggagacagacgggaggaagagaggaagcagaggaagccacagggcgaagagcaagucgaaggagacauuucuggggacaguuaaggaaacauuugaugcuaugaagaauucuaccaaggaguuugugagacaucauaaagaaaaaaucaagcaggcgaaagaagcugugaaggagaaucugaaaaaauucucagauucagucaaauccacuuuucgccauuucaaagauacuaccaagaauaucuuugaugaaaagggcagcaagagauucagggcuccaaaagaagcggcaacugaaaagacaagaacagcuuauaguuauuccucauacucacagcaggaggcaccaaaccaaaaccagaauugcaggcgcccuucugcacagagggauggagggagagaaaagcccagucacucugaagaaauuagaaagaaugcaaauucauauacauacaaggccaagucugacugcagaggcacccauuccaccagaaggguuuguucagguauguuugaaugugcuggacaggaagccauuagcccuguuaauaaggcgaguccuguuaggaugaaugacuucaaacagcugauucacugguacuuacucaaugaacuggagacuuuucaccacuggaaagaacuggaucaguuuaucaguccguuuuuuccgaauggugucuuuagacaugaccagcagcucuucgccgacuuuguugaugaugugaaagguuaccuuaagagcauaaaggaguaucgaguagaggauggcaaucuggagaaguuggacggauguauauauagacacuuugggcauguuuuugcccugccauucggacccaggucgguuuacauaaaaccauguuacuauaauagcuucuaaacagugcauaccauuuuauuuuaucuuuuaacacuuugagcuuuuggaaauuauauuauaaauuauaauuauugcaaacugaaaaaaaguccaugucaaacacuuagacuugaacaaaugauugaauuucuacuuuaaaaauuuaaaggauguguauguguauguauguauguauguguguauguauacacauacacauacacacauacauacauacaaucacaauuuaauugagccaaucuagcuuuuuucaguauaguuuauauaauuaagugaaauuauuucccuuuaaucuuuaacuuaggaagcuagaaacaaagacuuuagugugaagcccgggucauguggagcugcccagcuauaaucacugucagguuuauugaguuuaggaguacugguuacaggguuaaaacugagaagggugcuggacgcucaggagccacaaaaucccauaauguucuucaagacugucuguuguccuucagcuuuuuauucuguaacuguaaaugucuguuuacuuuugagagucaaguuccaucuuuaugaauaaaugcagugugccuauaaaauaaugagacugcuuucugaugucuuuaguuccugaagcggaugcuuuaaugagcaauguuggaggcugcuuuaaggaagcguggauaacuucuugcuguucaagaguuaggugugcagagagaggcaugaagguguagugaccucagguugucuagagaugguuagaaaaucuucaugauugaagugaccuugcaucuaaacuugcuaugaaacuagcuucugggagagaagugaggguuggugcguggauagagcagggccucccuggaacggaagguccuuugcagagguuggagagauggagaccuacuuuacagaaaccaggugagcuggcgugaucaggaaggucucccuuuugcccucaagugccugucuugugagauggagaauuucugaaggaucuugucacggggugggauggugccuaguccucuagaugacuggcagcagccaagaggguugauuggcaaggugugaagccagcugugguggucugcacaugagaaacugaugggaguuugaaugaggucaucagagguggugaggagcagacaagauacauugucaacaagucacauagccagacacuucuaccuuguguaagggaaguagaaaguaagugguguagguucaccuggaaugacuucacuguuggaugcugagauuacucagaacuccagaaggaagcucuaagcaagaggaaccagaagcaacuugauuuuggagguaucuguugacauuuauuuggagaggacggguugguagguacauggccauuucuacucacuucgaagccaguccccauuggucuagugcaggggacaaugcuaucugugcugguuagagagaaggcuaagcgagaagagugcagagugaugcacgugaacccagagaugucaagucaggugcuuagagcugagcgcugcagagcgcuugugugcagguccuggcguaaggcaguggaggagccagcaggcagagugggaagacagcagugccugcucacugcacuugccuggaacgggggaagguuggagacugcucugcgagcugugucucuucucucauugagggauaaagccgauggagacgaggcugguuguucuuaugcuuccuggagugauaacggaaacgccucauuauuuuaugguuacauuccugcuccucgucaccugucaggccuccccuuccggccagugcgggaguauugaugucugcccuuuuuccuucaguguugaaauaauaccccuuuuuccuggaauuagaguaggauguuauuuucuguuuuaucuuuuugcaguguucagguagauaaguggggaaaaacauuguucuuuuuacuuuuagaaaacugaacucuaacauagauuaaaaaaauguguuuacuacuuucagucgaccugauaaaaagcaacguaugguaacuauugaaaacgccaggcaccgaaaacaagagcagaagcaccuucauccacagccuuaugaaagggaagguaaauggcaaaaauacggucgcgcuaacggaagacacacggcaaaucuugagcuagaacuggggcaguuaccuuucgauccuaaguacugauuugugauuaaguuaggaaguuaagagcuguggaugcuaucuacuugguuugauguugagaugaacuccccaugacugucuuuauauuaugcaaaagcaaagcuuacuaacuugcauuuuccuguagcuuagguuuguuaaaaacaaaaacuuuuuuuccugcugggggggggugggggaaaugguaguuuuauuaaggaagccaggcaugaaauagucugugcaugaaacagggcuugguuugaggagcugagcucagcucacacaggcauuucgugccguguggaggugugcagcagggccugaggacugugcugaggcgggacuccgcgcuaacaucucuacucucacgcuuuugucucucuguggguucaagagcccguugguuugugaagagcuggcuggcuugucuugugaacucucuugcacaccugaaugcuauggaagaaacaauaaacugcaccgugaggaaaacuaaaggucucucucaagucuggcgccguauuuguguucucugagaaugccucaggacaguguaugggacagcuguccccaguggcuuccucucauuucacggucaccuacaguuucucucaguuaugccaacgucucugcagaaguccuuacaguucaguucccuccuguguugacccugccggguaaccuucgcucguagacguguaugugacuuccaguucggcgcucuggccagugaguguggaagaauguagcggcccucucguaguucccugaggugaggaagguauugaucuccugcaagcaaauaaagacauguuugccgagugcgacuucaaggaauucuagaguugccaauuacgauuuuucuuuugugacuuuuuccuuuucgaagcaauucugaaaggcgugacucugguagcuaaacauaucuaguaaguuacagaacagcugauuuuacuggggaaaggaucaauuaugggaaucauuauauuuugucaacuuuacuggauuaagaaacuauuagacacaggcaguggugucacacgccuuaaaucccagcacucaggaggcagaggcaggcggaucucaggguuugaggccagccauuagggugggcaggggacauggcucauuuggucaacugguugcugaccaagcgugaggaucugaguucagaccccuagaacccacaugaagaguuggacgugggaguugggugggauggcacgugucuuuaguccuauauagcgguugggaggcagauggaguucugugaguuccagggcuacauugugagacccugucucaaaaauagcucagacaugguggcacauaacuguagcccuaacagugggucauuggaguggggcagagagaggguuugggaggcuguggcaggccacaguuguuaugcuccagguuuagugagaaaaugagguggaaagggacaggagacggcgucgauagacuugaaccucuggcccuuccacguguguacacagaaacaugguuacacguacacaacgaggaaacaauacaaggcaguagugaagcacacuuccuaaguuuguaaguuuuuaaagccuugagggaagaccugcccugaaugugggugacacguuccugugggcugugguccaggcugaauaaagggaagagcagaccaacccaguaugauccaccuguuccacgcuguuccacccagcaccaugcugccucggccacgcugggcugcuguccugaaucugagccggggugaagccugucuccuuaagucagguuugucagguguuuggccgcagccauuagagaaccaauucauacagagggcgagaggggucggugaggcagaugguuguuaaucgaaugaaaaccuuugaguugacauaccuucuccagaacauugaaggugaccaagugaguggggagugacgcauugcugugaaauucuuguuguaaccaucuuaagggguuuaaguagaacauaucugcuucaucaagauacugaguuuuuccagucaagucugggggacacuggagaaaccgcauggacagugggcagugaacauggcuguggaagaaagggccaaagaguuagacacccugggcuggugagauggcucagcacuuaagagcacugaccauuuguucuuccagagguccugaguucaaauccagaaaccacaugguggcucacaaccaucuguaaugggauccgauguccucuucuggugugucuaaagacagcuacaguguacucacauaaaauaaauaagagagagagagagcgagugcaagcaagcacaagcguccaaguuuccauguccuuucaggcugaccuugagcccaggcagaacugccuuccucaccuguaguaaggcguggaguggcagggcaucauuaugaauacugaggccgaagcugggucaggaccucgggggcagacuuucugaaugugauucaugacauccagggugccucucugaugaacuaggccaguguagaaugccaguggcacauuugacaagagcaggaagcucagggcugccuuccuccaugucuucaggugggcuagugaguaaccugcauggagauagguggguaaguggaacacgggcagcuuccuguuccuguuaucagcaaauacacuuguaugauuuuccaugcagacauaagcagugguacugugaggcaaacucaaacaggcagcgagucaucucugaccacucgccaccacugcacucucaggcaaagucuagccgccuagucagucaaggcacgguguggguaauggcuguccagucuuaacguguagacuuaagucucugagggcaucugacauccuaagauuuccaaggggauucugacguuugauuccaggacaauuggaagggcauaguuaaacagcaauccuggacuaagauucaugauuuucuuaacaggagcaauacugcuuguucagacauacccaguuagaucccacacccaguagguguuuuuauuugcauguaguauggacguguaguucucagaagcaucacuccaagugccuacuuugcuccuguugucugguccuaagaaguguugugcugagauguagcuaagugccagguugcuugccuggcuuccaucucaacacaaauacaaaccgcucccgcucuaugugaacuagcucuuuguaugcuuguggguuuugugguuuuuggaaugggguuuuacuauguagcccaggcuggccucagacucucaaauccugggauuccagguaugugcuaucaugcugauaaauguacuagcuaccuaugagccacaucuuaacccugcucacucacacugacuggacggagcacuggaagggcucuagcugugugggccagacuagcuguaccucagcucuggagccuucucacugcccagcuuuaccuuuugccacacagucuucuccaacggugacuuaccagggugguucacaucguggagagagugggaagcccugagcuuucauuuagucauuccauuuccugugcugcaguggcaagaaaugcuaaacaaccacaacaacaaaccaaaacaaaccaaaaaaccucacggucacugggcagugguggcacagcagaggcagggcagauuucugaguucaagggcagccuggucuacagagugaguuccaggacagccagggcuacacagagaaacccugacuccgggggcuggggggaagccaaggaaaaguccccauugccuucucuaguauguucugucacuuagaaauacauguuaauuuuuacauuuuuaaacacugccggggaggaaggcuguuaagucaguugugguguuuacaugagaaaagcaaagggguaguuuagcuggagaaccaguggggaagggcaagcugcgcuguaucuuaaccucugcacaggcagaggcaccaggaaguuuagguugcagcucucguaaggaaacaaagccguauuuuucacugaccacaaccuaaauacuaaaucccccaagaaagaccuuauaguggaauugugaacaucagacaucaaaauuaacuggagacuauguagugugugaucucagugaccccaguuaguagggaguuggaggcaagaggggcgcaaguuuaaggcuagccugggcaacuuacagcaagaucuucugguugagcagcugcuuccagggcagaggacugggagggguggcagggguaaaggucuugccacacaggccugaguuggagccuagaguucaugccucccaggucucacuagacugcucuagaacuuugguuucuucagucucuaccucccaagugcaaggauuacaaggauuacaccacaccugcuguuuuggaguuuucaauuuuuuuucccccuugagacaggcucuugccaugcauguaacccaggcuguccuuaaccagcaguucucuggccucggcuguuagagugcuggcgugcagacagguaccacuuucccuggcccguuggcuuuagaacacagaauccgucuugaggcggugcauaaguaauguugauagacacguuggaacucagaacaaaugcucuucagugggaagcaaagggcucuacuggcugggagcaagccaaugccaccugauucuuguuggcaguacaucagcgcaccucagcguuucugcucgggcuauuagauaagacaccaagaugcagcauucacugugaggaacccggaugcuguuauccagacuuagccuuagaggacugagggguucuggcuggaaucuuagagacugacuacaaaaccuugcuuuuuaaccaccucuugaaucugaccuggcuuuugauuugcugugacccaaagacugguggaaggaacugcagauuugaggcccaggccuccuaccuucccacucuugccuuggaacccugaaagcaccguguaagaagcuccaccuaacccacugggcagugagaaggcuccggagcugagguacagcuagucuggcccacacagcuagagcccuuccagugcucuguccagucagugugagugagcaggguuaagauguggcuggcagugacacuuacaugaaacagguuaaaauaggucacaagaacagaauaaggcuuagaggugaguuuuggaaagccucaacaguucuauggaaagcugcacggugcagcaagccugcuguccuaucacugcuggggaugggcuuagaggauaaucuggaguucaaggccagccugaugacaugguaagaauccugcauggguguuucagccagccagccagucuuaccuccuaccccuggcaaaagaguggacugucuggugaucauucuuguaucuuacguaauacagaaaaaggccacuuaggagcuaggcagaguggcucacaucuguaaugccagcacuuggaagguugaggcaagacgauggcccuugaguucaggucugaccgcauagauugcucuaggucagcucugccucuauaaccagacaacagacacccacagagcauuagauuacaaaaaaggaaacacuaugguaauaguuuguaauuaggaaaguuuucauugagccuaguuggaaauaaauagcuccgugggcauugacagucucuuaaucuuuuauugcuguuuugagacaggaucuagcuaucaaagcccaggcugcccuugacuugugguugauccuccugccuuuuccucuccggggcagggauuacagcagugcugucaagucuggcuucuuuuagcuacucuuucuaaaacguauucuguauuaaaaauacuuaccacagaacaccaugcagaaugguaaaacuggauagauaaaccugaauucuuuguggcccaacaugcuguaauaaaagauauuaagacaaaacauuaauuuuauauuagucugagaaauuaaugcauuuaaacuauaugaucuguuuauuugucaagcauuugacacugaauuccuuuuauuuuccugauaacuuuuuuaccagccaacucuagacacuuguguuuaagcccauguugcuggcauuacagguguuauaccaugaguccgacuugggaauuguacuccuuuuuaaauagaguguggugaugugcuaauaaugucagagugaagccgggugugguggcgcacgccuuuaaucccagcacucgggagacagaggcagguggauuucugaguucgaggucagccuggucuacaaagugaguuccaggacagccagggcuauacagagaaacccugucucgaaaaaccaauaaauaaauaaauaaauaaauaaauaaauaaugucagagugaaauuauaaaguacaauuacacuuagaaaaaaauuuauguauucaacuaaguaauauuacucaaauuuagaauaagaauauauuccuuuaaaauguuuuaaaauguuuguguguguguguguguguguguguggcaggugaggugcucacaccacagugcacacguggaggucagaggaccagaacuuguggccaucaguagucgucuccuccuguguggaucguggugacacugcucagggccacagacauggugguggguggugguaggugccucuaccugcugagccaucccaccaguuccacauuuuaaucucacaacuagacagauguagcaguaggucuaaguccccugaguagcacauuuguucaccugacauaaucucuacugcuguauucuaagaaacaacuucccaauaguuucagaaucucuuaguaacauuuaaacauucaccugccugaacaaagucuuaccuguauaccagcaguguccacagcacggucagcagcaguauguggagccuccuuggggcuaggaagcaaccgugaaugaagaaagguaaguggguccccaggacaacugggaacccuugacugagguaccagugccauggaugggagccauaaaacgucccuagguucugcagcacguuaaauuucaagaaauuuaauuggaccagcguccacuggcacaagugaaagagaaagaaaaauggguuagugucaaaaacugaucuaggacuuuauaguauuugacagaaucauaacauuaaguaagaauuuaaucuaaaaacucaggcagcagucuaagucugcguaaugacaugaguucugguuaauaacugucuuuuuuucucucacccccucuuucuuuuuucuuggagacaggguguuggucuguccuguacaugagguuggccuugaacucagagauccacaugccucugccucccaagugcugggauuaaaggcgugggccaccacugccccaguuaauaacuuguuuuuguaaguacuugauaguguuaauuuguaaaaugcuaaguuuuuuaagguuuaaaucucaaauuaugaauaaucauucacacauacuuuuguuuuauauccaauuagaaaagaauuuuuuaaaauugauuuuucuuuuaauuguaugugugugcacuugaacacgugcccucaugccuaauugcucuucgagaagggaucagauucccuggaauugcccgcaguuaugagcagcuccuacgugaugcugagacucuagcaguuagggagccucgguguggauuccaggugugagccacuacaccaagcacucgccaccacagcuggaucagauacaaagugcugaaagcccagcuugaggguucagagcaguaagugguuagaacagauagccuaauugagcuuacucuaauuuuuacuuacuuggccaaaaaagauacggucaauuaucagagacaaacugaagguuauaaaucugaaaaacaaaguagaguggugacucacaugggagccugcugaagucuaggccacugucuuugucccagcacgacucuaaaacgcuuuacaagcuugccagcuguggggucguacauggugaaagaugagaagaugcacuuaagcaaacauuuaaaaaacccacuauuguaucuauccucagauaauuaacccaucaacauaaaaauauagauacguauuauuuugaaauccucaggguuuaaaaagucguaacuguagugggugaggugccaguggcuccaagugaucauuaccagagcucagcuuugcagcucucagggcugcugggagcuucauuggcaucacgauucuaggacuagacuggcuuuccugugugugugcgcugcagucauucacgucuacugucguggcuggaacugucacgcugcuucuauuccguuuuaugagacuccauuuuuaguuuuuuagaacacuggcugcugacaguaucauagaucccaugaguugucaacuuuucacaccggagagaaccucaguagaggaacugucuccauguaauugucuguggcauaucuguguggcaucuucuuaacuauuaauugauguaguagugcccagcccacugugggugcagccaucauuggacccauaggccaggcuggguaagaauggcagcugagcaggccagaggaagccagccaggaagcggcauuccuuagaggcuuccuuccuucagugucucccuacagguuccugccuuggcuucccuggguaauggauacaauuuguaagguguagucaacccuuuccuccccacauugguuuggguuaguguuuuaucacaacaacagaaagcuaacaaggagacacugcuauauaauuucguuuuguuuuuugucuuugagacaaggucucucucuguauguggcccugucuguaccaggacucacuauguagaacagcugcccucagacucagauccaccuggcucuagcuccugagugcugggauuaaaagugugugccacuaugccuauccuugauuggucugaaauguacugaacccaagguuuauauauguguauuaguguuuuguguguuauguauguguaacauguacaugguuggugcccucagagguaaaaaaaaaaaaaaaaaaggauguuaaucaauaugaacuaaucaguacccccagagcuuccugggacuaaaccaccaaucaaagaaaacacauggugggacucgugucucuagcugcauauguagcagaggaugauggucuaguuggucauuaaugggaggagaggcccuuaguucugugaagguucuaugacccaguauaggggaaugccagggccaggaagcaggagugggggaggggggaagggaggggauuuucggagaggaaacuaggaaaggggauaacauuugaaaugugaauaaagaaaauaucuaauuuuaaaaaaaguguugauucgacgacagccagggcuguugucucaaaaaaccagccaaacaaacaaaagaggauguuggauccccuggcccugaaguuaugggcgguugggaaucugugucggugcugggaacuaacccuggauccucugcaggaggaacaacugcccuuuuuuuuaaaaaauuuuuuccacugugacuccagcucucaaacuggauauuuuugaaguaccuaguagggucuuucaugguuuguuuccaguuacccuguucuuacaguuuucuguuuuguguccucucuggacaugagguuugauugaucaucuauguugucgauuuggucuuccacucucuucacagugaacuucugguuuugguuugugcugugcuggggucagcauggaaguaagucaguccucuguugcugagucauuuuuccagcacaaagguccuuaacuacucaaauguaucuuuucaaaagcuuuccuguuggccuggggaugcucuggucaugggguagucugucugccuggcagaggcacugcuguuugaccuuuacagugagauccaugcuuuucuuggggauuuucuaauaacuuauggugggauguagguucaacauuuuuuuuuucuuuuucaaagauuuauuauuuauuguaugugacuacacuguugcugucuucagacacaccagaagagggcaucagaucccuuuauagaugguugugagccaccauguagucauguagcugcuacgaauugaacucaggaccucuggaagaacaguaagugcuuuuaacugcugagccaucuuuccugcccucucaacauuuuuuuuuuaaagauaguucgguaugcucuuucaaggccuuuauucuagaacuugagauaggaguucaaggccagccuggcuaacauagcaaguuccaggccagcugaggcuuuggacacauaggggcagcgccccccaccccccaauguagaugaggcaccuguaacaucucagaccaagccaguaggaagcacccgcuuuuagacuccaacccacuccaaaacuauagaagauccuaucuagaaagaauaaaggugugugaaaaauccaucaccaugcaccgcacuugcuagccaacccucugccagcucagcguagacagggcagcaucugggaacaacagagguggcagggccagcaccaaagcagcugcagcgguugcacuucccccucccugcuugcacucuuucuccuucccuugaaugcucccucccuggauaucgucugguccacagaccagcaacuggcgcccauguggaccauggccagcugaagguaccccagcuggcgacuacucagacccacaucggaacuccugauuaaacaagacugugaauaaaccucugacacuugcuccauagucccagacuuuucugugugugucucugugacucuccucucuccggauccccacucucccugcucuugccaucuuaauccuucaaccccugcuccuggcucccugucccuuugacucuccaaaucuaaucuuggacuuaacucucccugcuacuguagcaacuagccuacccucuccacuuuucacaccuucccagccccacaaugagggcugccauacagcuaacagggccccgguccagaugguggcgcaugcccagagcucucuacccgccccccccccccuuacagccccagcccagccggcaguuccagcaacaccccguugcccagcgcuccuccacagugcagacagaaaaacagauaugcuugcccucccaugcccacguugcugcuagugcagcuagacagagcacagcuaucgcucugucucacccccucugacuuugccuauaccugauagggugcuaccaaaucgucucucuccucucuguucuacuuuuaggguagaccagcgggguggggggugggggguagaggggugggacgggaaccugccuacuagagcacacagcuggggagugacagcaggcccuuaaccuccaaauuuucagucuuuauugguuguuguucucucccugacaggaacaccuaaaacaauguuugagcaucuuaaccccaaauuuucauacuucuuuauuuaaacguuuauuuuucucccuagcauuuugugucuucuaaccuaaaauuguucuaaaaauuuucaauuuguuuaaaauuucuuuuaagauucaaaaaucagggcuggagagauggcucagccauuaagacauugauugcucuuccagagguccugaguucaauucccagcaaccacaugguggcucacaaccaucuguaaugggaucugaugcccucuucuggugugucugaaaacagcuacagugcacucacauacauaacuaagucuucauuuuuuauuuauuuauuuuuuucuuauuuucuugguuuuucgagacaggguuucucuguguagcccuggcuguccuggaacucacucuguagaccaggcuggccuugaacucagaaaucucccugccucugccucccaagugcuaggauuacacaugugccaccacugccuggcaacaaaaucuuuuuuaaaaaaaaaucauauuuaaucuacucccagaggucaaacuacucugauaacuacuauuuauuccuuaauuaacaaccacuuuccucuuauagacaagcuguuacuaccuaugccagauaggcaacuaacaugguguuuuccuccucagccauccaaagcagauaaaucuuuaacucuucccccugcucuccuuaaugcaacacagguaauaacucccaacuuaaaggaugccuuccgggacuaaauuccucaaacagccuggcuuuuucuaggaccacaagagcagaugacagugaacucacaagcaaacuauuacaccacuuaacaccacugcccacuggugcagacaccccugagggugggcagacacccccugcuggggcucugcucccuuguuaggaugacuccucgguuucucucucuaaaacaagaggcagugcugccacaaccuccuuggaacugccuggggcagugaagcugccuucauccagacaccuuaauuggcucaauaaucccuugucucccuaguccccaccccucuuuaccccucuggcuuauacuguguuuuauuuugaugcuuccauaccaugcaaaauuucacuacaaauaacacuagacagucacuccaaugacuccuuucauuaaagacaagguggagcugagggaccgugaacccugccagagagcugagugaggaagaacaggucugaggucccagagacucggggacaugccugagacggggacaugccugagacggggacaugccugagacgguaggagccucccugcucccugccaaauuccuggccugggcugugccacaauucccacauaaggaaaugugaccuguggucauguaggcccagaacagaguucuccaugcuaaugagauacugaggguuuaaccaauaagcuucccuucccagacauuccuccccgaaaaagguauuuaaucucagguccucccugagaaguagguaggcauccauuuuccaugaugaacaaccaauaaacaguuuggaaccaaggacugucucauggggagcauggagaaggccuucuaccaccaagcccccccccccauccucccacccccacccccgggcccugggcucauccucagcucaucacagguccgggacagccccccacccccaccgacugacccauacuucguucaccagcagugacuggaggcucaaagucaggggauaccagcuucagguuuucccacaucucggucugcauuccccucagccccccaauggugucucagugcuuccccaaagcccagcacccacccagcagcugcuugggauaagugcagucaaacucccuggccuccagggaggaacucagacccacaagacccugucucaaaaacaaacacguaaguaagaaagagcaaaccugacucuuccacuggucuguuugccuuugacuauuucuaagucaccuuagucauuguauguccuaacacuuuucuccucugaagaucuuuacauuccuuuaagggucagaguauggggagcuggcucaauagcuggcacucccccagaggccaggccucaugcaggggucugccauccuaguuacucagaaagcugaggcagaugucaaacccaugcucugcugggcaagguacaccacacccacacccccaggcucaggagauaguugggauuuucuuugagaugcugugccaggcgucauaccugggcgcucucguccuauuuaacaguuccuguuucaucgcuuaccagcucgcuggcuuugcuaacuuuaaacuucuccauguuuccauuuacuauaaaauaagaacaguagcaucacuuaaaucuaaaaagaucacaaggucauauaugagcaaaacuguuuuaggucccauacaaauaggaaauuuuaggaaaugaaguguggaaacucuaagcaauagacacguuuguuucacugaaguacgauacaauuaaucagucucauaaauuuagacaucuaaaauagaauacugggucagugacauggcucaguggguagagguguuugccacaaagccggauagccugaguucaauuccuggaacgaaugcagagggaaccacucugaccuccacauuagccuuccagcaugcacacacuagagugggaaaaacuuuccugagacaucugauauaguaauuuuaguugaaagauuaaaaaaaaaaucuuccuuauagucuuaguaagauguuauagauggcaccacagccagacuuacccuacagguaaaaaaugaugcagagucagauggagcuuucucuguucuugguagaaaugucugaagagcagcggcacccaugggauaagagcuguggggcggaccacacaagcaagugccaccaggagcgaguacuugacgcuaggagcaaggagagcuuguuacagggacagugggaaacugagcuugaaggcaggcgacuaauuucacugugagacaagaacaaagugcagacgcuuaaggaaauagcaugauuaugcagugauagccuuuugugcacauaugaccuugugaagcagaggucuagccuaguggaagagcaucuaaggcccugggucugacuccaccaccacucacaagaaggaagguauuauauuuuuuuuucaaaauugaaguaaauuauacucauccgagagaugcacaugcauacacauguacacacguaagguuguguguaaacacuuguaagacucagugagccucagcuccugggagacccaacugagacucgagaacggaguuuguucuaugcaaaagcaagagguuuaucuuuccagcacacuggggucauccugcacccacaggagaggcgaacccuucucucucuuucauaagcuuuuuauacaauuuuugagggcagauuauagcaacagcaacuaggcacaaaaugcuuggugguucuggugaccuuuaauuggcuggacaggggagggggaaucagggaccuucccgaaggcccagugggaaguuccaagucagggcuuucucagugugagggugugugaucccaacccuccagagacugaagcagguggaucaugaguucgaggugagguucagcaauuuagugaguguuccaaguguugggaugauagucaugaaccuccaugcccagacaaauuuuuugucuguuauauagcccaggcugacuucaaacuugcuguauaaaagaggcugacuuucaacuucugauccuccugucucugcuuccauguuggcguuucaaaagugugcaaccacugugcccaaauagggucaugauguuuuaacagaucuacccagaguuucucaaacagaauguuacauacagagaaaguugagcaauggguagugagaccacaguggacaggaccuggauaggucucucauggugauaaaggaccaaaauagggaguuagagaccucaggcuauaaagcacaaaacagcugguucccuaaacacccuuggagucuccaucuccuaacuaucuuacaugacugaaauauucuaggcucaggagaccaaacugagaagcuauuuucucugucuuuucuuuuccccuuaugguacccuccauccuauuuacaguaaccugaaccuaacgcagaaauaaucuuagugggcaugguggcgcacaccuuuaaucccagcacuugggaggcagaggcaggcugcuucucuguaaguuugcagccaucuugguuuacauagugagccccagaagcagaaguagaccaggagcagccagugaggcccuuucccaagacaaaacaaaacaaaagccaggaaagcuauuuuaucuagaagaucuuuaugcaggaagagagagugcacucuagcuguugugugcuuugaaagccugucucccuuccauccgacacaaucuuuuuuuucuguuuuuugacucgggcucucuaugugccccuggcugucccggaacuuucuccuuagauaaagcuggucucaaacucagaguuaugucugcuuuuugccucccugagugcugggacuagaggugugugccagcaucuccagcuuucaguacauuguuuugaaaucagauuugacugugaugaucuguggguguggcgaagggccuggucccaucccagccucacccuugcccacuccucccuccccucacuuacuccccacacagccuggcaucugcagcucucuccagcugcgugcuucugcucagcccuuccucccugauuggucuggguuuuucucuuuugccauucugaucugcccaaccuguucucccaugcuggucagcagacugcaggagcgcucuaagccuaccuugcuucugauugcuuuagggaaccagaaggcagucacagcaugggugagguuuauuuauccuucuggcugacuccuggcuauugcuaaaggcuagccaggcaggucucccucggggaccuucaaguacagcuuuacacggauccugguacuuucuccuagucuuuggagcccacugauaauagacugcuacuucaguaagcucugggugcuacaggauuuccugaguguugucuacacuuuguaaucaucccuuuuauuagcuucgcuguacagggugacuguuuccugugauacucauugaaaaaaaaccuuuguuucuucuaagccccaggaaugcuugggagucuacuggauaugccacgcugauacuuggguuuuagacuucugucugcauuuauuaacaguaacagccaucuuaccuguucacggaccucgagccuuccagaggauaguagaaaagggcgagggcagugagggaggucuccaugguguucgugaggguccgugugcagcaguaccaugugaaccaggagcacagcuggcagaggaacuaacgagucaggagugaguauggcugcagugggaagugggaagcuagguggucgcgucuguagaaagcaccagcccagaggcuguagccguggccacacacuguucucagcccaugccccccacgcuccaacaacagguuuguauuuguuaugccauagugcuuuuugaauuuagaauuuuuuuucaggucuuuuugaagguuugcacuugacuaauucuuacuucuugcuaaugaaauacccacaacaaagacacuaagaguggaguuuauagaauacugaaacuucucacuagaucauccggcuacugcgccaccuccuaccucacaguggccaggagucagcuauccugagcaucuauggaccuuguuuuggaaaugcugcccuauuucuuuuugcuccuccuccuccucuucuucauauauguauguaaagucgguagugcuuucucuuagggguacacacacacacacacacacacacacacauaaauaauuuugauuuuuuuuuuuuuuuuuuuuuuugguuuuucaagacaggguuucucuguauagcccuggcuguccuggaacucacuuuguagaccaggcuggccuugaacucagaaauccaccugccucugccuccccagugcugggauuaaaggcgugcgccaccacgcccggcuugaauuuuauuuuuaaggguuagaauuuugcuauagcugaugcugaccuggaagcuagucuuaauugagucaguaucuggccccuguuaucucuuuuuccuuuuuuuuuuuuuuugguggggggggcaaggcuucacacaugcgaagccagguauccugcaacuaagcuauagccuuugcccuagcucccauauuuuuuugguaaaaaauuaagagaagcgagaagagaagacucaucagggagcauuugguuucagguugaaaacuaacuaaaaaucaguuuuccugaagaacauggaaacaaaaguaucagaagucuacaaaaccacaucuuagaaggaaggaacuaacuccuuguuaaagcaacgguggcuucuuguucuccuacaagaagagauuuuuccuuaaggagaacucggaaggaaggucucaaaagugggcuggcauauuugcuaucauuucauguacaccuuuggcaauguauauaaaacauaaaaacaaaacagaguugccauggagcugacugugugucugaaucaacuagcaagaaccuaaccacuaaacucaucacuaaucaacuagcaagaaccuaagcacuaaacuaacuuucuuuuuacaauguaaaaaaacaaaacaaagaagcuaagaacacuuauugcucuaugagaggauggggguuuaggggggucccagcaccccaggagguggcucauggacaccuguaacuucagcuguaggggaucccaugcccucuucuggccucuaugggcacugcauacagacacaagauaaagaagauaaaacauucuuuaaaauguaaaagaauacaugucugcacaaauaggccuuuucuccagguuagugauacaucauauucuagaaauguguuggugagugggaagucuggaauucagaauguauuuccugauagaaacgauaaaaccaguacaucuguaaaugguucguguggacagagucaagugaggaagcagugguuguguguaauccagucacccacugggguguagcuugacuuggagaugcaaguauugaaaacccaucuugagauaaaccaguggggcacaccuuuaaccccaguacccaggaggcaaauguauuuccugugaguuugaggccugccugccugguccacacagugagcuccaggacagucagagcuauguagagagacacuguuucaaaaaaacaaaaacaagaacaaaaauaaacaacaaaaauccaaacaaacaaacacccagaacuuuaaaaaaaacaacaaacaacaagaacuaagcugacaggcuuuuccaggugaugcccuccccucacacccggaauuucucaggagagccucaggguggugggggugaggggcuaggcuguaaaagcagcuuccagugcccagagucuaaggaugaggauccugucaguuuagaggcccaagggccuccauagcuggcuccugggacucagccugucccacuuggggcucagucaggagauggcauacaccaucugauuauggaaggaagacauuccaggaaguucuguggaucagcugucuuaggaaguguuuaucccacacaugcgauacaccacaccauaucacaccccgucuaaagugcuucgacuuaccacccauugugccacuuccugguuuuccagcugcuucaggagggaguagagccuuauauccgcuacagcagacagaagagcuuggccaagucugggaauccagaucuucauuagugaaaaagaaagccaguuguuaagcacaucuuccugcuucauacugaauugccauaaaaaugagaaaaaccuaaccauuaacagaaaaacaccuguccaucuccaagcauaucuguucauaugcuugcuaugugugcuuggcuugcaagcuugcccucccucccucccucccuccuuccuucccucccuccaucccagccguccuuuaggaaggcuuugucauguggccuagcuggcuuuguccuuguuuuuccugccucagcaccaaguacuggggauucacggguuucacaccauaccccauuuacccauuuuuauauuuauguauaucuuacaacacuaaucguucaccuuuuguaaucguagggacugaaccuacauuuuuagaagcaaauuuauuuuucugagcaugcaauagcuuuuguuuuuaagcgaggcaucuacagaacuguaugcugggugucagagcaaguacuuuaucuguaucagcucauuccacaguaauccuccgaggcaggaauuguucaguacagagaccaaggcacaaagagggaaggugaugcucccaaggcuacagagcuuguuagcauuaaugccuggauuccgaccaagguagucuugacaccacagccugugcucuuaacaauacaaauuuagggcuggagagauggcucagugguuaagagcaccgacugcucuuccgaaggccuugaguucaaaucccggcagccacaugguggcucacaaccaucuguaaugauaacugaaucucuucuggggugucugaagacagcuacgguguacuugcauauaauaaauaaauaaaucuuaaaaaaaaaaacaauaaaaauuuaaaaauccagggcuggagcgaggacuagugguuaugagugccugcugcucccucagaggugccaaguuuauaacguuccuagcacccaggucaggcagcucccgggugcugaccagcuccagggcaucugacccuuccucuggccuacagcagcaacauaucugugugugccaugcacacacacugaaaaacuuguuguuguuguuguuguuguuguuuuucaagauggccuuagaccaagaagagaaagcacaacccuguauagaaauagucugauccugagccucguuuuucuagacuccacacagcgagcgccucauggacucccuuggaauaccagguugcagcuuucccugacugaaaagaaaaaguccagacucccagguccaaccugaugacagccuagcacaccucgagggcugaguguaccucagugaaaccagcuagcacaacagggaacuuggguuugguucccuccugccucucucccagaggauccuaaaacaagagagugagacuagacauuccucggguccugugcacagccuccucugaauugccagugguaguccguaauccagaaacgaagucuuauugcgcagcgaugauacacaccguucaguguuugucacauuuucuugacaaguucaaggaacaaaaacuauguaaaauaguuacucugcugucuuuaaaccgaguucugauagacuuucucauccacuuuuacuucugcaugcuuaugucugugugcacaugagggccccagagguugcuucugucuuucccuauuacuaguucccuuugaggcagggggcugacugggcacugagaccgaccugccuuggggaccgaguuuuugcaggguagagcacaaccggagauaauauugucucuaccuccucagagcuauggucacagguguuugccgggacacaccuaucuuguuucauggguguugggaccuaaaucuucaauuguggagcaaagggucuuaaccuugagcuaucucuccagccccuucuuuuuacuucaaaauuuauuuuacuucuuuuuaaauauauugaggaguucuguaucacagugucuuuggaacagcgggcuucccagauaaggcuggacuuuaacaacaauagacguuuaaaaacaguuuugugguacuaagaaagucauucaguuauuaccaguuaauuucugaaaaaggaauaaaucuggauuuaaggacaacuuuggucauuuuaauuucaacuuaccaggaauugaacacugucuuuccccagaagaugcagaaccuuguaaauacuggcgaagaugaggggguaaguguagccucucaaucgcuccguccauucccaggucaaauaaccauaauuauuaauauuaaggauuaaaugucaaauaguauugaagcaaauuuauuuuuauuuugauauauaaaacuauucuuuuuuuuuuuuuuuaaagauuuauuuauuuauuauauauaaguacacuguagcugucuucagacacuccagaagagggcaucagaucucauuacgggugguugugagccaccaugugguugcugggauuugaacuucggaccuucggaagagcagucgggugcucuuacccacugagccaucucaccagcccauaaaacuauucuuugacaaugaaguuuguuuugguuuugguuuugguuuuuuuuuuuuuuuugagacuggguucauccauguagccaugacuauccuggaagucacucuguagaccaggcuggccucgaacucagaaauccaccugccucagccucucaagugcuaggacuaaaggcaugugcuaacaccacuuagcuuuuuuuuuuuuuagaauuuauuuuuauuuugugugcauugguguuuuaucugcauguaugucugugugaaguuggcaguuggaguuacagacaguugugagcugucauguggguacugagaauugaacuccaguccuugggauaaagcagucagugcucuuaaccacugagccaucucuccagccccaagacagagcuuuuuauugccuguucagcuaacuaaagucuuaauuucuucaaguuaguagaaauauauuucucacauaauuauauaauaugguuacauauauauauguguguguguguguauauaucuauguauguguauauauuauauauacauuauaguguauauaauauaauauauuauauauauauuauaguguguguguguguguguguguguggcugugcaugauauguauguugauauaaggguaaaaguuagaagacaacucuauagaguugguucucuuuuuaaaauauuuauguguaugugugugcacauguauguucugugcaccagcacaugccuggugcacauggaagucagaagagggcaucaauucuccuagaacagggauuguuaaaagccuccaugugggugcugggaauugucugguccucuggaagagccugguccucagcaguuaagaguaguucuaaccacugagcaaugccagccucucuauccacccuugugugagucucagggacaggauuaugguggccguguucgcaggcuguuacuagcggagccaucccaaugaccgggcuuuguuuugaaacagagcuaguccaggcuauccuugaacuuccgauccugcugcuucagccucccaaacgcugggacggauugugcuuuuuacuuucucuauauccgggggcuacaaaucauuuagguguauauacuaauucaaaggcagcgucaagucauuuguugguguucuuuuguuguugguguuuuguuuguuuguugauuuuuguuuguuuuccgagacaggguuucucuguauagcccuggcuguccuagaacuagcucuguagaucaggcuggccucaaacucagaaauccaccugcuucugccuccuaaauacugggugggauuaaaaagucaugugauaccaugccuauauuuucuuuguguguguguguguguuuuucuucucugucaagucugugucaaagggagacauacgguaacuaucagcacacaacaacagcauacuugguugagcugaaauuauucaaagaauuacugaaaagauauaaucaugaacugagcuccuaagaugaagacacacucagaguggaaaagaaaccauaaaggauaucugaaaaccaugcggugugcaacuucgagggacugccaguauucaucaggaacaaagcuugucugcacuaagaagcaguuaaguauucgcagagcgaugguaaacaagaccagguaaguguuuucuccaagaagaccuggaaagcaaaucaaagcaguaaguguggcauaaaagugagcgaguuccccccaccccccaaugccacaugcccggugcacuggcucccucucuguuaacaccuuccacagcacuccacugagcuagcugaggcacuagcucagggguggaacucuugucuagcuugcugaggccauggaguguuuucuauucccuagcaaucuguagggaauagaaaacaacccacgaacaccuccccccaccgcaaaaaauagauacaaaccccacuaaagaacacacaacgcacacacacacacaauuuguuaaccacuggugagucugaaccuguuuuacuugugaggaugcuaagguucagaaacugcuuugcccaacacaaaaauacuguuacugacuagguagucggucggcuguuuccaaaguuugcuuuucccagugugcaggcagccuguauuuucgcuuuaguuaccaacagugguggugcuuggagguagggaaagauuuuaugugaaaaucuguaugccaggugugaugaugugacaucaccacacagcacuggggagacugaugcaggaggauugagacacgucuaagcacagucagcacaacacagcgaagagacuguguucagcgagccugagcucauugccaccacgcuguguagucccaggugccccgagcucugccgugagcccggcacucaccacggcgcggagagcguuucuccugcgcgcucacguacugccuggacuuccuccuccgcagcuucauuucucccgagcugccguggagauugcgggaggccggguuauagucggcggccugggacuccauccuccccggcuaccugcagcccacggugcccgccccucacuuucuuguaggcggacacaugccacuaagauugggccccgcgagccgccgucccuucgcugcuccggcacuaccgcggcaggaagugcug

SEQ ID NO: 5192 - RNA, 1858 nt, Mus musculus
auuaaaagugugugccacuaugccuauccuugauuggucugaaauguacugaacccaagguuuauauauguguauuaguguuuuguguguuauguauguguaacauguacaugguuggugcccucagagguaaaaaaaaaaaaaaaaaaggauguuaaucaauaugaacuaaucaguacccccagagcuuccugggacuaaaccaccaaucaaagaaaacacauggugggacucgugucucuagcugcauauguagcagaggaugauggucuaguuggucauuaaugggaggagaggcccuuaguucugugaagguucuaugacccaguauaggggaaugccagggccaggaagcaggagugggggaggggggaagggaggggauuuucggagaggaaacuaggaaaggggauaacauuugaaaugugaauaaagaaaauaucuaauuuuaaaaaaaguguugauucgacgacagccagggcuguugucucaaaaaaccagccaaacaaacaaaagaggauguuggauccccuggcccugaaguuaugggcgguugggaaucugugucggugcugggaacuaacccuggauccucugcaggaggaacaacugcccuuuuuuuuaaaaaauuuuuuccacugugacuccagcucucaaacuggauauuuuugaaguaccuaguagggucuuucaugguuuguuuccaguuacccuguucuuacaguuuucuguuuuguguccucucuggacaugagguuugauugaucaucuauguugucgauuuggucuuccacucucuucacagugaacuucugguuuugguuugugcugugcuggggucagcauggaaguaagucaguccucuguugcugagucauuuuuccagcacaaagguccuuaacuacucaaauguaucuuuucaaaagcuuuccuguuggccuggggaugcucuggucaugggguagucugucugccuggcagaggcacugcuguuugaccuuuacagugagauccaugcuuuucuuggggauuuucuaauaacuuauggugggauguagguucaacauuuuuuuuuucuuuuucaaagauuuauuauuuauuguaugugacuacacuguugcugucuucagacacaccagaagagggcaucagaucccuuuauagaugguugugagccaccauguagucauguagcugcuacgaauugaacucaggaccucuggaagaacaguaagugcuuuuaacugcugagccaucuuuccugcccucucaacauuuuuuuuuuaaagauaguucgguaugcucuuucaaggccuuuauucuagaacuugagauaggaguucaaggccagccuggcuaacauagcaaguuccaggccagcugaggcuuuggacacauaggggcagcgccccccaccccccaauguagaugaggcaccuguaacaucucagaccaagccaguaggaagcacccgcuuuuagacuccaacccacuccaaaacuauagaagauccuaucuagaaagaauaaaggugugugaaaaauccaucaccaugcaccgcacuugcuagccaacccucugccagcucagcguagacagggcagcaucugggaacaacagagguggcagggccagcaccaaagcagcugcagcgguugcacuucccccucccugcuugcacucuuucuccuucccuugaaugcucccucccuggauaucgucugguccacagaccagcaacuggcgcccauguggaccauggccagcugaagguaccccagcuggcgacuacucagacccacaucggaacuccugauuaaacaagacugugaauaaaccucugacacuugcuccauag

SEQ ID NO: 5193 - RNA, 1858 nt, Mus musculus
cuauggagcaagugucagagguuuauucacagucuuguuuaaucaggaguuccgaugugggucugaguagucgccagcugggguaccuucagcuggccaugguccacaugggcgccaguugcuggucuguggaccagacgauauccagggagggagcauucaagggaaggagaaagagugcaagcagggagggggaagugcaaccgcugcagcugcuuuggugcuggcccugccaccucuguuguucccagaugcugcccugucuacgcugagcuggcagaggguuggcuagcaagugcggugcauggugauggauuuuucacacaccuuuauucuuucuagauaggaucuucuauaguuuuggaguggguuggagucuaaaagcgggugcuuccuacuggcuuggucugagauguuacaggugccucaucuacauugggggguggggggcgcugccccuauguguccaaagccucagcuggccuggaacuugcuauguuagccaggcuggccuugaacuccuaucucaaguucuagaauaaaggccuugaaagagcauaccgaacuaucuuuaaaaaaaaaauguugagagggcaggaaagauggcucagcaguuaaaagcacuuacuguucuuccagagguccugaguucaauucguagcagcuacaugacuacaugguggcucacaaccaucuauaaagggaucugaugcccucuucuggugugucugaagacagcaacaguguagucacauacaauaaauaauaaaucuuugaaaaagaaaaaaaaaauguugaaccuacaucccaccauaaguuauuagaaaauccccaagaaaagcauggaucucacuguaaaggucaaacagcagugccucugccaggcagacagacuaccccaugaccagagcauccccaggccaacaggaaagcuuuugaaaagauacauuugaguaguuaaggaccuuugugcuggaaaaaugacucagcaacagaggacugacuuacuuccaugcugaccccagcacagcacaaaccaaaaccagaaguucacugugaagagaguggaagaccaaaucgacaacauagaugaucaaucaaaccucauguccagagaggacacaaaacagaaaacuguaagaacaggguaacuggaaacaaaccaugaaagacccuacuagguacuucaaaaauauccaguuugagagcuggagucacaguggaaaaaauuuuuuaaaaaaaagggcaguuguuccuccugcagaggauccaggguuaguucccagcaccgacacagauucccaaccgcccauaacuucagggccaggggauccaacauccucuuuuguuuguuuggcugguuuuuugagacaacagcccuggcugucgucgaaucaacacuuuuuuuaaaauuagauauuuucuuuauucacauuucaaauguuauccccuuuccuaguuuccucuccgaaaauccccucccuuccccccucccccacuccugcuuccuggcccuggcauuccccuauacugggucauagaaccuucacagaacuaagggccucuccucccauuaaugaccaacuagaccaucauccucugcuacauaugcagcuagagacacgagucccaccauguguuuucuuugauuggugguuuagucccaggaagcucuggggguacugauuaguucauauugauuaacauccuuuuuuuuuuuuuuuuuuaccucugagggcaccaaccauguacauguuacacauacauaacacacaaaacacuaauacacauauauaaaccuuggguucaguacauuucagaccaaucaaggauaggcauaguggcacacacuuuuaau

SEQ ID NO: 5194 - RNA, 3314 nt, Mus musculus
ggagagcguuucuccugcgcgcucacguacugccuggacuuccuccuccgcagcuucauuucucccgagcugccguggagauugcgggaggccggguuauagucggcggccugggacuccauccuccccggcuaccugcagcccacggugcccgccccucacuuucuuguaggcggacacaugccacuaagauugggccccgcgagccgccgucccuucgcugcuccggcacuaccgcggcaggaagugcugccggaagcggaugagucuccgggugggucaggagcaaaccucccugaccaguguucaaugcuggaaaagacaaaaauaaagauucuggauucuuuacuccgccugacacaccucgcacagcgcccgccgaggaggcgcucggagguaacagagcagagggaggcagugcaucgcugaggaccagcucccgggugaccgcggugcucaucccucacgccacguccucgcgugggaaguuucaucacgguucuuacaauaauaggaaaaaguuauaacucaaugaauuuuuauuaucaauuuuuuaccaccccaauggauuucucuaucccuaauuaucuauuuucuaaucaacuuuuuauuuucuggagucgaucucacuauguagaucagacuggccuugaacucgggagaauuaccgucucugccucaugagugcugggauuuaaugccuaagccaccacacucugucuccucuuaucuuugugacagggccacagucuuauauaaccguggcuggccuggaacuugcuguguagaccagacuggccucaaacuccugccucugucuuauggauguugggaucaaaagcaugggccaucaugaccagcaaucaaggcauuuaaaaaauuaguuggugggggcuggagaacugguucagggcuuaaaaacacugacugcacuugcagaauacccauauacuagccuggugucuccgaggguaccaggcaugcgugcuauugcagauacauacaugaagacgaacacccauacacauaaauugucuuuuguguggucaacuguauaauccaggagaagacaugcuuuucuuuccucggcgagcuuaaauuaugccugagaacuauuuagggcaagcuccuuacaguacaggaaggaguugcugauuauuuuugugaccugaggcuuggauuaaggauccauaucggaguccagaaaguguguggcuccuucccugugcucucuucauucacagccucugacccagaugcugaggggguugacacggaaagugcuguguuguucauuugucacuuucuacuguuuucaguuguuggaucgagaagcaaaaucuucuacacccccaccccauuuuucucaaagaaggcaugcaaaugauuugcguuugauuucuccuaaaauaucaaaagaacucaacauaauuugcuuuugcuuuuuuugagauaggcucuuacuauguagccuuggcuggcuuggaacucagcucuuuagaccagacaggccucagacucacauagucucugcccacaccuggugcuggaauuaaaauccugcaccaccacaccuggcucagugaaguuuuacagccucuuaaaaaucgcuuuugucauacagcuugcuuaaaagaguuacagcuacugcagaaggcauagugaggucacuuguccccucucucuaucauccuuuagaggaagcuuaaacagagacacucacuucugaguccuuucgggcaccucuuggagaaaaaguauuaaacgacuugaaagccgucagccaucccuuccccuccuuuugccauuuugaaaauuaccaguuuaaacgcucugagaagacuuccagcagccauguuaguggcgcacaccugucauccuaacacugggguggugaaggcagaauuguaaucuagagcagccugccuaucauaaagaaccagaacaaacacucaaaugcaaaauaacucacaggcaaauacacacaaaauaacucacaggcaaauacacacaaaauaacucccugggaacauccccugauagaagaggaugcaucucugucucacaccacccucaaacuugcauucccuauagguuccuuuuuaagguuuuuauugacuuguucuccgagaaccuguuauggaauccagacuggccgccaacuggcagugcagccagaggguaaccuugaguuccugauccucuugccuggacccaacuguugggaauaugagcaugugcuacgaugccuggaagaaauaacaauuuuaauauaaaauaugauuuuuaacuacugacaaccuaauugagauuuuagaaaauaucccauaguaagccuaugugcugucaugcuacccuuauguauuuauuaguuagugauucuugguuuuuuuaaagauuuauuuuauguacauggguacacuguagcuguacagaugguugugagccuucaugugguuguugggaauugaauuuuuuuaggaccucugcuugcucagucccaaagauuuauuuauuauacauaaguacaccguaguugacuucagacucaccagaagugggcgucagaucccaugacggaugguugugagccaccaugugguugcugggaauugaacucaggaccucuggaagagcagucagugcucuuaaccgcugagccaucucuccagcccuaguuagugauuuuuaaauauuacaaaacauucaugccagaggaaaguaguaacaagucuucuaaagagcagauggggcuggagugaagagugagcugcuguuccggaggaccugaguucaguucccagcaccuguguuagaugacagcugccuguaacuuucuggcuuccagacuccugcacucagucgcacacauagcacaaaauaaaauuguuucuaaaagucugcuguacuaagugguccuuuuuuuuuuuuuuuuuuuuuuuuuuuugucccuuuuccuuagaaacagcucugaagcgguuugcugcccggggagcauagccacccucagcuugugcgcuaccugccgcugcaaugcucgggagauugccacuuccacaacugcuuuuugcugccauccuuggaauugcuggaggaauguauauuuaucagccaauauuugaacaauauuccagagaucagaaggaauuaaaagaaaaggugaaguuguuggaagaaucagaagaaaagggagcuaauucugcauaaacugaaauuguaaaccuugcuuaacguucuauugaaaucacaccgacuauuagucuaguaagacuuuagguaugcuuuaaauaaauaaaucauggguaaugaaucua

SEQ ID NO: 5195 - RNA, 53694 nt, Mus musculus
cgcucuccucuacgggaagugauguggggccagacggaaaauagcgccaagcacccaaaaaaggccagucgcacggggucccgagcuccauuuggaagggaguaccuaagggauagagcacagcgaggacgcggcacguugggaaucuagcacugcagggacgcaacaccgcagggacagcaccggacagagcaccaaaccgggugagcacucagcguucugggcgcgcugcagauugcaggcgagcaagucagcccuagggcaaccaggggacagaucuucggaauggaugcugguuuucuggaguuccaggggcugaagguuaucccggguggcaucuaggugccaaaaucccuuuaaugaggggaagagaaauaggucugcccaucccucuguccuucccucacuucgguuuuagaagucuuugacuuuaaagucuuuagaguccugcugcuuucaggugagaaagggcucugccuuuuccugucauucagagaacccagcuggucagccuggucuuagagucacccuaucggagguagaauugauggaugacauauuuuggucacuuugccaagaccgggucucuggcccaguagcuggguaccgauuuggaaagccagcucuguaauguaggagaucuugaggcgucucagcagccccccuggccuuugcaucuugcuguugucuggaguauuccccuaggcuucucuuucaagcccaagggcuaacagcuguucugccuuagcuguucagcccagccgggugaggaaggcaggagacauuucguauucuuuaaagcucccuguagaguggaaccgguaugggaaaaguaaucccugcauuuggaagguggacagagaaggauccaggguucaaggucagccuuugcuacauagugugugcuugaaaccagccuggguuacaggagacucuuucucaaaaaacaaacaccaaaaagaaaggaaggggggguauucagaaaugcuaagcgcgccugaaugggagcugccuucuuauuuuaccuuggucuucccccccaccccaacaccuuuccguuuccucuccacagugugucuuauuugucguuguuguuguuguuguuuguuuauuucugacgucaccccgccccacccccucccuugccaccuuuuacgaguuuuuuuggcugugcagaagagucccuuguaucucuguguggaauuuacggucagcuucucaauucuguggccuuggcuuuagagcacgcacaggcauuuugaagagggaagccgccuuugggaaccagacuuuuaacuuccuuuccugauaccuguuuccccaucuuaguaaagaaauuccacucuuagagaaucucaggccaaacaauucucuucauucuuccaugucucuuguccacccugaacacauuuuauugagucuaacuugaguagaacuaaauauuuuuugguuuaaaaacuugguaaguggcuggagaaauggcucugucauuuagagcacagacugcuugcucuuccugaggauccaaguucgguucccagcacccacaacaggcaacucacagcugccuguaacuccaacuucagagaacccagugcugucuucuggacucugccaguauugcacucauugcacaaaaccaaacacacacacacacacacacacuuaaaaauaaacaaacugguaucaaaagauugccuagucggccaucacuggaaagagaugcccauuggacaggcaaacuuuauaugccccaguacaggggaaugccagggccaaaaaaugggaauggguggguaggggagugggggggggggcgggggagagugugggggacuuuugggauagcauuggaaauguaauugaggaaaauacguaauaaaaaaaacaaacuguaaaauugacguucacugaaugcucuggugacuaggaauuauuugcugccuuugcagaggaccuggguuuaguucccagcacccacauggcagcucacuaacacugaguaauuucaguuccaggggacuggauucccuucucuggccacugaaagcacugcacacaugugcugcauguacguacguguaggcaaaauacucauaaacauguauugaucauuuguguauggugucauauguauggaaggucagaggacugucuauaggagucagcucuuuccuuccaccuuguggauccagggauuuaacucagguuguguggcuuggugguaacuacugagcuaucuugucuacuuaguuuuuuggggugugugugugugugugugugugugugguaguugaaacauggcuccguuauguaucccaggauagcuuggaacccagaguguagccuaggccucagccuccugaaugggauuacaggugugcccuauaccuggccacggucacaucugcucuaauaaccauuucucuacuguuggcacccaucccgacuaccuucucuagcuguguuccugcugaggccucuuaaagcacuuuuaaucuuguucuuuuuuugaaauagagaucccacuuuguccugccuguccccucucuaccuguccucuuccccuucgugcugcgaucagcacagcccacugugagggccaggggucaggcucauucacuauuguguccgcugcaaucaggguuauuaaguuguuauuauuaaggggcuggagagauggcucagcacuuaggagcauucagaggacaaggcucgauucccaggacccacagggcagcucacaaccacccauaacuccagucccaguggcccugauacccucuuugggcacggaggcaggaggaucagaaguuauucucugcuaccuuggaaguccaggccagcaugcagaacaaacuuauggccggcugaguaguaauggcuccuuccacacuccugcaccugucuugugaugguggcagcaggcagcccucugcccuggcccugagaaaauuaggcagggcuguuuaguagcugaccuaucuucuggccucuuacauuagucuagagcaagaguggaguucuuggaaaucgaaggaaauggacauuaauuucuucaugaauauuuugcacuauaaugaaugaaccuuucuguggcuucuaacagaaauggccaacuguuggcacuuaauuguguaacuacuuucaguugucagcuguuuuucugugacuuggcccauuuccaugacuacacccuuucauucuuggggcuugaacucagggccuggcagaugcuaggcaagugcucucucauucacugagccaccccugccuccagcccauccuugauuagacccugucugccuggagacagagugucacucugacucauuuugaaucuuauuuuguaaggagucagaggcaaaaccaaguguaagacuguggcugaaugugcacucgaguuacuggauaaaacuccaggaccaucuaucuaguccagcaguucucaaccuccuaaugcuuccagccuucgauaccauuccucauguuguggagaccccaaccauaaaauuauuuucauugcuacauuauaaguaaucuugauacuguguuuuccaguugucuuaggcaaccccugugaaagaucauuugaucuguugagacagaaagguugagaagcaacaguuaagucuggacuuucuuagcaggcgucuuuauagaccacuuuacacuacugaauggggcuucccacccaaugaggaguugggaggcuucccagugagaacugaacuaauuuggccuauaaaguaugauaacuaauuuuaugguuacucucuuuaucucucucuuuuccuuccucccucccuuccuuccuccuccuuuguacacacacacacacacacacacacacacacacacacacaccccugagugcugggaacugaacuuggguucccuuuaggaagaaucuuucuuaaccauuuagccauuucuccagccuauauaugggauuuuuuuuuucaauugaguuuaccuucuucuuuuguuauuaagacuuuuccuggcaugugucuuaucuauagauucacuaugaaauaggaaagaauuauuuuaacauauauaugcaguaguuauacacacacauaaaacauauuucccaaauaaaauagaguaaguuugaugcuucugaaggacagaacaacgcuugcagcuuaaagccugagccccccuaagaagaaagcucucuugccccuguuaagaaaaugauuggcuccugaggaaguagcgcuucccuucaaaagcgcucccuuucugugcccccugagauuugcuuggacuguguuuguuucuccacuuggggaugaggaaauuugaguugaugaucuggcuuccccuaagcugauuagccugagagcagacucuggcgauaaaagcuuuuagugaaccugauguccuggggugagggacuggaauagugaacauuuagcuagcuagggccuuccagugugggggcucagcucaucauuucucuuguaugauuugggguccauuaacacauuuuauuuauugucaauuaaaauugagugccuugucuaaaagggaugggaauuuucuccccccccccuuuucuucucucucuccuuuucccucuccccuccccuucucucuucuuucuuucuuucuuucucucucucuuucucuuucucucuuucuuucuuuuucuuuuuucuuucuuucucuuuuuucuccuccuccuccucuuccuccuccuccuccuccuucuucuuuucucucucucuccuuccuuccuuccuuccuuccuucuuuccucccucccucccucccucccucccucccucccucccucccucccucccucccucccucccuuccuucuuuauuucuugucuaauuggaucucaugcaugucaggcuaggcuggaacucugcguagcugaggaugcccuugaacuucugagugucuguuuuaugcuaggacuacagguguguguuaccaugucuguaugaaauucuaauuugaggauaggguuucaaauuuaccaaauaaaagugauucaauuuuuaaaucugucuucaauuuuuuucuuuuaaaucagggucuugagauguagcccaagcuagcucuugaucucccugacuccaccuccuaaugugcaccauccccccuuauuccaaaauacacauguacacagcucuaguuagaggucauguuuauauacaggaaaugugcgauaucguccaaagaaugguugagccguggguuuccauggugaugggaaucuguuaauggcucuagcgcuagaaacaagagagagcauuaguuuuacuuuaguccuucauaguuaaggagauccuuaccuacagaggcuaaaucuguccaugucacauagacuaggaggaggggccagggccagcgccaggaccaguggcacaaugccucccuuaagaaguuaugcauaggguggggugggguggcccuuuuugcucuuccagaggaccuggguuuggcgcccaucacccacauuauggcuuacaaccuuccauaauuccagucacagaggauccagugcccucuuaugaccugcucauacauacaugcagacaaaagacucauacacauaaaauaaguacgcuuaagaacauuuuuuuuaaaaaguuuauauaaccccaguuccaggggaugggaucacuaccaucuucucacuucugugggcgugaaugugguacaagacauacagacaagaaaaauggacacauaggggggaaaaucuaagucucuuuuuaaaggaaggaaggaaggaaggaaggaaggaaggaaggaaggcaggcaggcaauccugaaaacgaacgagguuuugucugccacuagggaaaccguauuucagagccccuggucuuuuuucacaaccuggauggugguuaauucauauuaagccuuuccagcugccaggucaaagcauaauaaaauugguugccaagagacagaaaagucuguucucucuuguuugcugagguugguccaaccgcguggguggauggcagauccucuggguguuccugugcacuaaucuccuauguauuuguaucauuagcggcaaagacaaggcgucaaucaaucaccuggcuaaacauaauagagugagcacuuuaauuccugcaguacuagccuggcuuggggaagugagacauaaagcuuuagucuguucggaugcauagauagagaucucuugcugguggcugggaacaccacucgauacgugcuugcuuggcaugcaggagccuccuucugcucccucagguuaccuaagaauugugcauguguuugagacagagucuccuauagcucagacuggccugaacuugcuauguagccaacaaugaccuuuaauuucagaucccccugccucccacucccaagugcuaggauuacaggccugagacaccguucuugguuuaugugguaccagggauggaacccaggguuucaugugugccaggcgagcaccuuaucaacugaacugguuccuggguccuaugauguaaaacuuaaauaauauugcaauaaaaggaauauggaaaaauaauuuaaaaauauuaacccagagccgggugugguggcgcaugccuuuaaucucagcacuugggaggcagaggcagguggauuucugaguucgaggccagccuggucuacagagugaguuccaggacagccagggcuacacagagaaacccugucucaaaaaaccaaaaaauaaaaaauaaaaaaauaauccauaguugugggcaggguuucuuuacuucuuguguuaguuucugucccacaucuuacuugaacaguaaggaaugccagggagaacucagcagucuguugguuguucugggcuucgcuucucuuauuagagacuaggcuaacccuucauuaucccucucugcucugcaugagaacauaaaguagacuaugggcuuucuuguuuguuugcuugguauuucugguggggguggggaaagucacucaucuaugugccccgugacugaaaacaaaagacccaccacugucaggagucacugggagucuucucuuuuccaagucacugauaaucggucguaagguaucacauuagcagcuugcaacaggggucaucaccccacccucaccagggaguuucagugucuaccugucugucugagacagggucuuuuauagucccaggcugguuucauacuuacuuggagucaguguggccuuacuggaggaaguaugucacuggaggugggcuuggagguuucaaaaauccaccugaugcucacacucccugccuccccaaaccaccuguggaucucacagcuacugcuccaguaaggugugaggccauacucccacccuggugauaauagaccgauccucugaaacuguaagccagccuccaauuaaaaugauuuucuuccuaagaguugccauggugacgguaccucuucacaaccgucggacaucgagaaagacaaugccuauacauguuuuuuguuuguugugaucuuucgagacaggguuucucuguguaauagcccugggugaccuggacucccuuuguagaccaggcuggccuagaacucacagagauccaccugccucugccucccaagugcugggauuaaaggcgugggccagcacuccagguugccucuacauguuuuuaacucuuauaagggccgcugcugugcaguggggaccggugaggcccuugaugagcacagguugcuuucaggagaagaguaagcccagccaggcaugguggcacacgccuuuaaucccagcacucaggaggcaggcagauuucugaguuugagaccagccuggucuacagagugaguuccaggacagccagggcuagacagagaaacccugucucgaaaaaaacccaaaaaaacaaaaacaaaaaaaaaacccaaaaaacaaaaaaagaguaagcccuguggcuggcaagcaaacggcuggacugcaaugucucuuugugugaccccaaaggggggcagaaccaaacagugacagggaucugggcagacaaagccuguggccaccucacgucuucagccuaccggcgucuguacuuccugaguucccagcagccuccuauagcuuugugccacggagccaagaaacuaucgagacgguaucgauugguucugcuuggcugggagguuuucugcauuugagagucagucuuggaagccuccuccuaacucuccagccccuuuugcugcccagauaaggaaaccuuacugguuacacugacacaguuguguaacuuuagaucugguuggaaggggccuugaaaaucauguggcucagccagguuuucccuuagucuccuuggcccgaagcuagguaccacaccacugagggauugacagcaggcaggauuccuaggaagaaccuuuuaaugugucuaggcugauauuucuucacugccaccagcugugagguaggcaguccaaacagcuguguuguuugaguguucaaaggaaguggcguucauucauucauucauucauucauucauucguguauuuauuuauagauagacuuuccgguugaaacccuugaacuuccaguucuccugccuuuacuucuggguaugcuagaaacuuucuuuacuucuggguaugcuagaaacugccuuuacuucuggguaugcuagaaacugaacucagggcugcaugcgaacuaggccaguacucuacccacugagccgccauccaaccccgagggggacuuucgauggaauuuuacuaaccacugaggcaauuuccuugaaacugucugaaaugacugaguaucuauggucuugacuuacauuaaagcugcccagaagugucugccacaaugauuguauuuguccuccagggugaauuuucugucagcccccagagagcugcugcuagagucgucucugcccacuuugugccgucagugaguuccugucucuacaguaucuauugcuguuugagaugagucuauuauauuuaucuugcuuguggccggccggucucuuccaucuaaugugcucucucggugagccacuguggcugacuaccuagaaaugaccuggaguagcgguucuccaccuuccaaugcugugacccuuucauacaguuccucuguggugacccccucucccccccccaaccauacaauuaucuuguugccacuccguaaguguaauauugaugcuguuaugaaccguaauguagaugucugauaugcaacccucuccaaagggguuguuauccauguugagagccauugaccuagaugagaagguggugagugcuaaguuaauaguuaacaggugaauaggggaacaggcaguuugagaaggcugcuugcuuuuucuucuuaaacgucuuaccuuauuugaugcuuauguaugucugccugcacguaugucuguguacuauguaugugccuggugcuuucagaggccagaagagggugucaaagcucuuggauuuggcauuaaaggucauuguaagcuuacaugugggugcugagaaucaaaccuagguccucuguaagaacaccaagcacuccuaacuacagagagaucucucuagccccugaacuuuauuuuaaauaacuaaauccagaauaccaguuuauuaguacauagaaaaauuuuuuucagauucauguuauuuuuuuuuuuuauguguaugaauauuuacgggaguguguaugaauauccacgggagucagagagggcauuugguccugaaacugaaguuacagaugguugggagccaccaugugggugcugggaauugaacucagguccuuuguaagagcagucaguauucuuaaucauugagccaucacuacacucacccccucagauugcucaggcauucucuuaaacaacaacaacaacaacacaacucaucccuaccuccccagagggcaaacacagaaagagagguuccugugaacccugacuguaaggacaaagaaacagaacuacucagggcuuuaugcugcaaggagccagagagacagugagucacaagacaacuucauuaugucucuuuaaagcucccuuuaaaagcagcaugcaaugugucuccuucagcgacuguaaucuguuagguuugagauuaggccuugggaaucaguuuauuuguguuuguuuguuguguauuaguguuugaccugcauguauguauauaugccauauauauauguacagugccaagaaggccagaagagaacauuggauccccuaggacuggaauuacagagggugugagugagcccaaucucuccuuaccgcugcugaccuuggcuucugcugaccuuggcuucugcuguagguggcucuuuaacaugaaagccuuggcuuguuaagcaagccaucauguuuagaugcugggacucaagggcagguucucugaaaaacagcaacuguucuuagucccugaacugccucuucagcccaaaggaaucagcuuuuauuuaaaaagacuucccagccaagacugggacacaucgaugcucucuacccugagguacuuaacuaaggcucagauaaacgugagccggggacacagaaccccaccucucugcagcauucggaaaccaguaagaaagaaccgauuuucagggcaguggcagcacacagagccucagaauuuguuggcucauuacauucagcguuguuuacuuguaacuagccaggcuggugucaaacaggaagcccucaggcacagcuuuccuuuccgguacaugguguccugugaauuagguguuagauguggggcuguagaggaaaacccucccuccauaacuucaucugagcccagcaaugugaacaccaccugagaagaugcuacggaggcaaauucacagccccaccccagagccgcugguucugaagcuggggagcucggggccuguguuuuaauacuuccagggucauccuagugcccacagagcugaaggacgccgucugugggucacagcccaaucuuuccuuaacacugcugaccuuggcuucuguagucggugacucagugagguggaagccguaacuuauuaagcacaccaucuggcuugcuuaggaacaccuauucaaaacccgagcuguccuuaggaucuuaggaauaucacacaagguggagaacaaaguccugcccagcaccugcugugggugaggcacugggcuuagagcguuuacuugguauuuuguuuucacagggauccugcugaggagaugcuaugaucugguuuacagaucuggggccugggacugguagaggcugaacacagcuuucaccuccagacuucucaccuagucauggcucugcauauugucuuccuaauauaguggcucucaaaccuuaugccacaccagguagccgcugguaaacuagugauaaaugcagauuuucuaggucucucuggaauccugauucagaggcccagguggggcucagggcuugaggguuucaucaaaggcccagaagggucuucccaugggcaucugaccauaccugggaaaaccccaucuggggcugucuccugcccuagcuggcuggcacaggccauccucaaggguucauaagguuuuguggugcuguuuugugcucacaggucuuaggggcugcugagugagaaaauagcaggagaauaugagaacacacagaagagggcuuuuguagccgagagaagucuccaaugccuggccucuccugcauccugacugccuuuugugggaggccaggccauguguugguuuugaguaacuugugauuuuuuuuucugauauuuaccccaccccaccccccugccacacuuuuguaauuuuuccuauggcggcuuuguacuuguguuuguggggagcucagaugggagcaacucccuccgagcugcaguuaacaucuguggaauagugaauugcuucagcuuugaggucagaaaugggguuucaugugcucagagagaagagucuuuauuuuucagaugggagugacaucgagagucauuuggcagcccaguaggacacuaaaugacuuggugcugcugugaaggaagaaaggaagacacacauugaaaaccaacuucaggugugaugccggguguccuuugccaguucaugcuaaaggcuagaaacuguuagaauaacaaauaccucaagggagugcuaggaaugagccugauccacaaaacgcauacugcccaagcauaaaggccugaguucaagucccagagccauggaaaaaagccgacugugagcuggguguguguuaauucuuuaauucuagcacucagaaggcagaagcaggcggcucuccaugaguucuagaccagccuggucuacagagugaggccuggucuacagagugaguacaggacaggcagggcauagagaaaccaugucucaaacaaacaaacaaacaaacauacaaacaaacaaacaaacaaacaaacaaaaaacaaaaaaaagacaaaagacaaaaaacaaaaacaaaaccgaaaccaaaccaaaccaaaaauggugugcuuauaaucucagcacuggggaaacagagacagggauuugcuggccaaaacuggcuaagugagaccuucagguggcaugucagugagauauugucucaucuaaaaacaaagaagaaacaaggggcuggugagauggcucagugggucaaguugccugcugccaagccugaccacccgaguucgaucccuggguccuacuugggggagaagagaggcaacucucuagagcugucccuuuccuccacagggaggcccagugugggccgccacacagacaaccugcauacgaaauagaugaaugaaaauguaguaaauuguaaaacaaaaccaagguggagaacuccugaagaacacacaugcaugcgaguacacacacacacacacacacacacacacacaccccuaaaacucucacaguggagaaaagggaaacuugcaugagaacacaguaaacgccagccuuuguagaggagagugguaaauguuacugaacuauuaaacaucuuugaaagacuuauuuuuauuuuauguguaugagugugagccugaaugucuguuugucugucuguaugccaugugugugcagagccuuugaggcuggaaaagggcguuggaucaccuggaauuagaguuacaggugguugugagucaccaugucagucuuggaaacccagguucucuguaagggcagccagugcucuuaaccacugagcuaucucucuagucccaaccaucaaaauuuuaaguaugucuuaaucccaacacaaauuguguaggacagagauggagaaaauuuaauaagaaaccagcuuuggcaaggugugguguugcaggccuuuaauuggguguuguacuacuugggaggcugaggcaggcagaucucugugaaauugggguuagccuggucuacauaaugaguuccaggccagccagggcuguauagugagauccuagcucaaaaaauacaaagccauaaagaaagaaagaggaagaaacucagcaucugacuuccaggaaggcacugcgcacagagcacauugccuguuuccuacuaaaaaccuuuccucacccuacguuagagcuacgugcccugggugcagcuggagccaccgcuaccaauugugugaggaauuaugggagcacugucucaccuaugcuuuagcagccuuucaaaguaguagccacauuuggaugggcuggagagauggcucagcaguuaagagcauugacugcucuucuagagguccugaguucaauucccagcaaccacaugguggcucacaaccaucuaauagcauccaaugcccuugucugaagacagcuauagaauacuuauauauguaaaauaaaaaaaucuuuaaggaaaaaaaaaaaaaaccaguagccaccuuugguauuccuguuaagaucuaggucagggacaagguugguuuuuccgggucaugggccucuuucaucgacuuaaaucugaucaucucugcaaaaugggagagucggucgccaugucagcacuucaccucacaggugacaguaagggguucuguucaucacacagaugacugcuauaaggaaacuuccagucagaugcagaccucugagacaugccucagugcccuuuucccucugggccacaugucgcucaguaagccuggcugucuagugacccagugcccaaucacugagcaacggaugcuggaagauggcagagcuuguucuagaagggcacauugacuguguugagggacagcuggcugacaugcauggguggggaaggaaaaaugaaauacaaaccaauaaugccaggagugguggcgcacgccuuuauucccagcacucaggaggcagaggcaggcggauuucugaguucgaggccagccuggucuacagagugaguuccaggacagccagggcuauacagagaaacccugucucgaaaaacaaaacaaaacaaaaauaaaaagaaaguuuugauuuucuuuuuccuccaugggauucccaggguucaaacucaggccuuuagcuaugucucauguacucagcaagccaugucacuguccccgcaaacccgcuuucaguacuucauaggccuugcauaauucaguccguauaacacaauccuaucagcuuuccuguuucacaguaugggacagugagacagaaaguuggguaauuuucucaaagugguaaguuugugcaucaaagccagucagucuuccccuagaggcuaggccuucugucaggauagguacucaauccuggagaugcaguguggccaguuugggaugucagucagucuuccccuagaggcuaggccuucugucaggauagguacucaauccuggagaugcaguguggccaguuuggggugucagucagucuuccccuagagccuaggccuucugucaggauagguacucaauccuggagaugcaguguggccaguuuggggugucagucagucuuccccuagagccuaggccuucugucaggauagguacucaauccuggagaugcaguguggccaguuugggaugucagucagucuuccucuagagccuaggccuucugucaggauagguacucaauccuggauauguaguguggccaguuugugaugucagucagucuuccucuagagccuaggccuucugucaggauagguacucaauccuagagauacaguguggccaguuugggaugucuaguaugauguccuaaaucauucgaggaaaacaaacacauuuuauuuugcauuaauucauuuuaaaaucaagccgggcagugguggcgcaugccuuuaaucccagcacuugggaggcagaggcagguggauuucugaguuggaggccagccuggucuacagaguuaguuccaggacagccagggcuacacagagaaacccugucucaaaaaaccaaaccaaccaaacaaacaaaacaaaacaaaaacaaacuacaaauguuguucaacaaggcuuauauuuuaaaaagaaaccagcaggcucuccaccuccagccauuucuagcuccccuugcugguccuugcauacacacacacacacacacacacacacacacacacacacacacacacacguaggcgcuaaaugacacacuuacauugccauggucaccuccccucaggguuagguguucuaucuugccacucuauuggggaauaagagugguugguucauuuucccagccaccucucccacacauaccacuucugacccuuuccucuccguggacaagucauauuagaaguuuugguuuaguuuuauauugaggcaggguuucucacuguguagucugaacuggucuaggauuugcuauguaguccaggcugaucuagcaguccuccugcaacuaaagacuuaugcuaccagucuuuuuaauuuuuuuuucuggugucuucuaggauuuuuacaauuuuaggcuucuccucuauuccagagucagccaaaguuggggugacagacuuuccaugcuagaccauggcccaguucauccauaacuuugagaagcccccucccccaccucucccccaccuccaccccaccccaccccaccccaccccacccuaccccacccuacuccuguacuggugaacccugcugugacuugcccacguuuugauucuauacccagauugaguuuaucucaucaacccuggcugagcucccuacagcuauuuagagccugaaaagaaaaaaaguccaaagugcuaagcuaaaacugagagcuucaaacagcuuccagcuaaggacgcuacacugcacacuuccguggccauugagguaugaaugugguuuuauguuggagggcucacuggcaggcaugggaucuuugugacgguauuugaaggucagucuuuaacaucugauuugaguucuuauuugaauauugaggaccacauaaaucaggcuguuauaaaguaagagcuguuggaagggaaaaaaagacuauucuauguuaaguugaugcuuguguaguuuaacucuugggccugcauauagcccauuuucuccacacuguuggagagucugugcuaauccguuuccucugugugccuggcucucucauuggaaauuaaguaaccauagugugaauuuauuucugaguucucucuucuguaccucugcucugcuugucauggcagugccuucuguuuuaauuacugugguuuguaauaguuuuauauuuucuuucuuucuuauuuuuccuagacaugguuucucuauguagcccugguuguccuggaacucaauuuguagaccaggcuggccuugaacucacagagauccugccucugcuuccuggugcugggauuaaaggcaugcguccccgugccuagccuuaguuuuuuaauagcuugaaaucaggaagugcaaugacaccuucucuuuuguuuguuggguuuuguuguauuguguuguguuuuugucuuuuuguugguuugagacagggucucaggccaggcugagacucgugacaguccucuuacucaggcuccugaguaugugauuauaaauacgcauggccgugcccagguuccaucuuccuagucaauugcuuccauaggagagaguguguguaugugugugcaugagcauguguguguauauauguaugugugugaugagcacauguguauaaucuuuuggguucucuguccauaggcucauauugccaacaaagacagauucuuuaguuguuacuguucgcagugcuggggcuugaacucagggcaagguugaacucugcugggagcuccgaccucaguccuccguucuucccgggaugcuuuaguuucuuucccuugccuggcugauccagcugugaccuucaggaccaugcugaagggcaguggugagugugggcaucugccuuggccuuggucuugaagaagguuuucgggagcuuggcacugagaaugcuguaggccgugacuuuguguuucacguguccaugacuguggugaggggaaugcccccuauaacuaauuucuugagagcuuuugucaugaaaagauuggucuuugacaaacaucuuguugaucauauugucuuuguucugcauuuuuuuaaaagauuuauuuauuuauuauauguaaguacacuguagcugucuucagacacuccagaagagggagucagaucuuguuacagaugguugugagccaccauaugguugcugagauuugaacuccggaccuucggaagagcagucgggugcucuuacccacugagccaucucaccagccccuguucugcauuuuuaaaaaagauuuauuuauuuauuauauguaaguacacuguagcugacuucagauguaccagaauagggugucagaucucauuaugggugguugugagccaccaugugguugcugggauuugaacuccggaccuucggaagagcagucggcgcucuuaaccacugagccaucucgccagcccuguucugcauuuuucuuuuuuuucuuuuuuuuuuuuucuuugguuuuucgagacaggguuucucuguguagcccuggcuguccuggaacucacuuuguagaccaggcuggccucgaacucagaaauccaccugccucugccucccaagugcugggauuaaaggugugcgccaccacgcccggccuguucugcauuuuuaauugugugugucucacauuuauuuauuuugggggucuacagagauggcucaguaauuaagagcucuugcugcucagguagagaaccuggguucacuucguauugagacauucaaaaucaccuguaauucuaggagaucugaaacccucugaccucccuaagcaccugcgcgcucgcgcgcgcgcgcgcgcgcacacacacacacacacacacacacacacacacacacacacacauacacacacacauacacacacacacacacacacacacauacacacacacacacacacacacacauacacacacauacacacacacacacacacacacacacgacuaaauaaaaauuuuaaauaacugguuuuuauuuuuuuguguacgagcccaugcucucgcagaggaccuggcuucaauucccagaagccacacagcaacucacaaccuccgcaagagccguguaugcucuuaacugucuuaacugcagucuucucuuccugaccccagguuuucuggaggaagugcuuggggaaagaacaauuugaguaccacgagggggccaggaucagagguguggacauauuugcagccagaauaccaaauaagcguuuaaucauggccauccagaccagaaauaaaauuuucaaacagaugaguacgaaagcaggaaagauguggccaauugggaaucagagaggaggagagggcggggccgcugaggacccuuaguuacugaagacccaggagcagaggcagcaggaaggggagcgaggaggugugugcucugagggcaggcagaacgugcuggcuuggaggugcuaguggguaucaggguagccuccccuggagacugucauuggcuuugaaggccuggagcaggcggcggcacugauuuaucucuggcuggccgcuacuugcacgugcuccuccgucugucugaaccaaguguugcauugguaaagaaacugcaguucagaaaacaaaugugcuuucuugauggugagggagacuaacacugcucccccacccccacccccaagucccaggcacaguuaauaacucugcucuaugugagaaccugcuggauuggaucuaagaagccugacccggggaagucacuugacugcucggcccagccauaugacgagcagcugagacucauuagccagacuguggguuucuguggagaaguccgauuuggaaagccuguaagauagacagcuuuucaaaagagucuuuggaaaaacuuuccuaagcaggccguuuggccuuuaccauuuucuuuuuguuguaacaucagacucaaagugaccuuggagaccaagagaugugauuagaguugucaguuggugugcuggcaacuucaaguuagagguuuagagaacaacgggcucucuccuaacucagguaugguuugcaucuguucuuuuuuuuuuuuuuuuuuuuuuuuuuuucuccugauguuuucaagaucugccaugccaacuuccaggcacugaagugguuaauuguguuagguuugaaaggccaggcucuuauuucagagcuuggggguagggguggggagucugagccuaauauaaauuuuggcacuuuggggcaguuugauguagguggcacuccaccuuguaaauguauugucacccaaaaccgggguguuggcagggauggguccucgugagagugucaagggagaccccauuccugaccucugcucuugagucugcaugcccgucuucccucuaggcaugucggggacccaguuuccucuguguguuccaaugcuuguguuccugaaggccagaggucaaccuccgauaucuuccucuguggguuucacuuuauguuuuaagacaaggucucucauggagccuggagcucauaagccaggugaggcuggcugaucaacacaccuaagaucaucuucucucugcuuccacagugcugggauuacagccaucugcucccgugccuacuuauuacaugaggucuggggcuagcacucaggucuccaagucugaggaaucaaguugucuuaccaauuuagauuuucuuuucuuucuuuuugguuugucgagacagggucucucuauguaacccuggcuguccuggaacuggcuuuguagaccaaacuggucucacacucgcccugcccuacugaucucucauaacaccugacuaccucuauuagaaguccuagcuaugaaagagguuauagccugagauacugaaaguuaguacuuuccagcgacaauuuuggagaaagauaauucaacuugaaacagauguguuugagacguuucaguaauaucacaaguuaaagaucugccuuucccaggcugcauagcuggagaggugggucagugguuaagaacauuggcugauucuacagaggauccuuacaccugauccacaaguugcagagagagagagagagagagagagggagagagagagagagagagagagagagagagucagagacuagacuuagaguaggcauuugaaaccucacuccugugacaaaccuccuccaacaaggccacaccuccuaauccuuccuaaacuguccaccgacuggaaaccagacuuucaaauaugagccugugggagccauucucauucgaaggacuaauucugauccgggauauaccacaaucaaaacauaauacaaagaucaucugaaaauccuccaaaguuggcaucaugcaggcgauauuugcggauuacugugcaguaggauuagaagcuaacaguaacaagaaagcauacugcagucuaacaggcugauggaaaugagcgggugguggugcguugcucugcauaaaugaacaccaggcacgcccagucuauaaacagaugcugauagacaggcaaacauccaguucuaagaacccacaucuaccuaggaaaaguagacagaggagagucugcguagauacuguaaggaguguaugugaucaggccccauccucuugguaaguuuauuuucauucuuuuagauucaucaauuaaagacuaugauguuuggggguaauuaaauauguauuguagagaguaaagcaguagagagaaagccuagaacacagacuuggugauggcuaaugacagaggcuuaggauucuaaggucucacccaugccacuaauggaagaaaguucuaucuggguuguuuguuuguuuguuuguuugagacaggguuucucucugcauagcccuggaacuugcucuauagacaaccaguuuggcucggaaucuccugagugcugggauuaaagauguguucuaccacgcccuccauaucaaagcuguucuguuuuguuguuguuguuuuuuuaauauuaauguguaugaauguuuugucuggugcccuuagaagccagaagagggugucagauccccugaaucuggaauuauagaugguugugagccaccaugugaacacugacaaucaacccuggguccucugcaagcucgacaaguacuguaagccacugagccaccucuucaggcccagagcuguuuucaauaauguuacucuagaauguuuucuuuucagauaaggauugagaaccuaauaaucauuguuaaaagaauucuauuuuagaaguuuuuaacauuagacaauagauugauuuucugagucuauuacacuggguuuuauuccucaucuuuuagaagaaccgaguuggugaaugguggaaauuuuuagagcuacuacgggguaagcuugugagaggcacauccaaugccuucucuguuaugccauggugaauuccuaaccaggacaguguugagacgcuugggucugugaggcauuucccuucguauaccgugaggaaaaacucucuuaauggaaaaguagaauuuccuagagaaccagccuugugggaacugagaaggguugaauaccagcagcucacuguguuuccaggagagcacuugcugguugauugcugguguaacucuaaggucagcuuuugggaaggaaaucuggagauguaggaccagagagccaaaagaugaggaagacagaggaugaccucauggggagagagagagagagagagagagagagagagagagagagagagagagagagagagagagagagcgagagcacgcgcucagguuugcuguuagagagcuacgugcuuguguggccggcagaugcagcagaugcgugacaaaugaaagcaagcuggaaauguugauugcuuggggggggggugcggggggcaucuuggaccugaagagcuuguuuccauggcugcagagcagcucuguuuaaugaaguugguuaggaugugagggaggggaagcuguauauaguccaccagaguagccuuugggaguaucugccccaagccaauggugcagcuuuuccuuaggggcggaguguuaggggcggaguguuaggggcggagugcaggauucaguacagagaacuuaaagccuacuuuggaccucauguugaagaauucagauuugauuacaacauacuggaaacaccacuccuuuaaaagcgaugaaaguaucacccugguguguuaaugaacgggcgcagaaagagcagggugcuaaauacccaggacccaauuccucuauggaugagaaaauguacaacacucauucucuuaaaaaguuaacucuaaaugaggcccuuuucucaguucuacugacaacucgggguucuuuguauaacugcuuucauuacucaauuagacauguaauuugcaggguuuuuuuuuuuuuuuuuuagaacaagagaagcagaguugccccuucacagaguagaggggcuugcuuuuugaucugguacauuucccuagccgauggccaccauugaugcucaacagcugcguagugcagcccuucgucaaccaggcccguguuccacauggaaucugcgcagaaucccuaccuggguuucagaaaggcguuuguguuguagaguguugagagauucucguuccaacuucauguccuuccuuggugcugucucuaacaguucugccuugagcagcaggccuaggggggcggggagggguugguaguggucuccagcuuaacuaauaacccccacauucaguaacuucagagccugagaguagcagauggacugcaagggaguccgcauuccaggcggcuuagguugcuccuguacuuccgugcucggagaaucuuuucuguccuaucuuugaggaauguccuuuaagugucguucuuuagccugcguggaaagcaccaggcuuacagccguagugugggauucaagcccugaccugccuggagugaugagcagagcucuaacuugauccaccacacccagacucugcugcucauuuuacccaggaggguguguugucugucgcccuguagaggauccuggcucugggcccuguucugcacugucucucuuguccccacagaaagcagccacccagugggaguagacuuugcacuucuucguuuauuuuuuaucacauucuuggagacagcccagcuucaggguucacugggaggcacacucagcugugggcugguguuucaugacagugacauauggcugugugcauugugugacugccucuguguuauuuacgguauuacucaggaagccaaucagccacaccucuacucuacacauggaacguuguagucuccucccacgagacaguauauaaaacaagagguacuugucacagauguaaguacuacacucccagaucuugguaaauuucccaaauuccaauaugucaauaugcaaauauccucaaagaggcuuuagcaauaaaugauauagaugcugccccuugaguaagcgaaaggaugguucacccugggauaaaaagcuagugucuccuuugagucacagacgccagucuuccggaucuacucaggaaaggucuaauggccucuccuucccuaucuugcugcagcccauguuaccacuuccuggucagcugcuaagggauggcaaccuuucacaaauccucgguggacuuuggaacugacagcguuuaaguuuucuucaagcugguuuuuccucacacugacgcuaugugucuuucugaaccuguauuaaggguaagaauagguuuuaggacugaggcuguaacuccgugguagaagacuugccuaacccaaacaaggcccuaauuugauucccaacaccacuaaggaagagaaaggggagggguguuuaaaaugaauaguguccuguaggcugggcaugcugccacucaccuuuaagucuagcgcucagaauucagagcaggcaggccucugaguuugagaccagaguuguguaaguagugguguauccaugccagccagggcuacacagugagauucucccuaaacagcaacaacaaaaaacgcaccuuauugcuacgacaggcaagccggcuuccuggguaaagauacuugcugccaaauguggugacuugaguugauuucuggaacccacaccguggaaggagagaaccaauguuugcauaguuuuucuauggccuccacacgugcucugcuccccaccccacccccaaauaaauagaaaaaaaaaaaaaacccucugcacugcuaauaagucgaggcgacugaccauuuggaucaaucacuggcuggaaucuuucugugaguuaccucagugcauaaaucucaucccugcacuuaguaggguccuuaugacggcuggcuuuacuugucaaguugauacagccuagaaucaccugggaagagagucucagugagggauuauguagaucaaggauuauguaugagcaagucuuaacugauguggugaagcgguccccuggguuugaacccugagcuguccaagggcaggggaaaaguugaccaccaagcaugcaugcaugaguucauccucuuuguucuugaccauggauauggcguggccggcugcuuccaguuccugccguugucacuuccugaaaugauggacugccuucugaaguuccgaccuaacguguauguacauacacauauagacauguaguaacacuuggaggagagcaaggaggacagggaaaggagaaacuauaggauuauaaucccaaaagcuuuuuuaaaaaguaaaaaacaggggcuggagagauggcucagcgguuaagagcacugacugcucuuccuaagguccugaguucaaaucccagcaaccacaugguggcucauaaccauccauaaugagaucugaugcccucuucuggugugucugaagacagcuacaguguguuacauauaacaauaaauaaaucuuuuuuaaaaaaaaaguaaaaaaggaaacaaaacaaaaaaccaaaaaacucaagauuccccuuaguugcuuaucgccaggguguuuaucgggagguugguggcuguugccuccguuuuauaauugaagggaugaggucacuuuuaagcacugggacugaaccguguaaggcagaagaggaagagucagaauugggaccuaugcaaacccucuuugggaaggcucucucucucucucucucucucucucucucucucucucucucucucucucucucucucuguuggaaaucuauagaccuaaggaugauaaauaaguaaaagucccuaugucuagugcuguuuguggcauaugacaguguccggcaaugugucccucucuccuuauuuuuugagacagucuugcugugcggcccaguaaccuuuccugcgucagccuuuugagucucaggguuaagggcaugauccgcuaaagcucaucuccuuuuguccgaacugaaaccacuucccucauuuacucccuggaaagcaauuuaccuaugucuucaguuuuuguuugucuuuuuguuaguuuugguacuaggaauuaagccuaaggccuugaacugcuagacaagugcucgcccccccccccccgccccccuugcaucuucagguccuuuuacuguuugaguagacccuaucaacaaguugcccaggcugccuuuucuauccucccgccuuagccucuggaguagcugggauuccuggcuuucaccaucaggccccgcccuccucuugcacuuuuuuuuuuucucuuuuaaauaaggaagcucucugccuaucuggcacuuaucuaacaugcgguucuuguugaggaaauggguguucugugcuuucuauuguuagucugaugagaaugaggguggggagcacuuugagaaaauauuuguguaaggagggagaggcagaagccaacugagugcgaguguguccacucagaaggugccuggagcuuuugacccugauggaggcuuugaaacaguacuuccuccaggagagagggacucagaugugugaugcacgguuccagugcccucagcacaucuuagcuugacgaauuuaguaaucuucuuaauguagaugaguuucugggcauuuccuagcaguucugugagucacaggcuguuagaugacacugaaugcuggguauuccacacacagcaugucuuuccaucuucagggccguugugugaggggguguauuaucacgguucuuuuuucuucgaagaucuuacaauucuuuauuuuuguguguauggguuuguaccugcaugcagugucugaggaagccaguagagggcgucagauccuagagcuggguuuacaggugaucaugaggaguugaugugggugcugggaaccaaacccggguccucuguaagagccacagguguucuuaacuaccaagccaucuagcccccaggguuuguuuguuuguuuguuuguuuguuuauuuuaaaccaaaccaaacaaacaaaacacaggcagugugguggcacacacauuaauuugaaacuaaccuggucuacacagcaaguuccaggauaguaagggcuacacagagaaacccugucuugaaaaaaacaaaacaaaacaaggcaacaucauuaauaaaaauaauaugggcagacaguggugacacagauuuuuaaucccagcacucaggaggcaggugggucugugaguuugagaucagcccacucuauagagugaguucugugacagccaggggugcacagagaaagccugucucugaaaaaaaaagauuguaaaauaaaaaauaaacuaaaggguuggagagauggcucagcguuaagaguacugacugcucuuccaaagguccugaguucaauucccagcaaccacgugguggcucacaaccaucuguaauaggaucugaugcccucuucuggugugucugaagacagcuacaguguacuuauauauaauaaauaaauaaauaaauaaauaaauaaauaaacuaaagcauagguacccgacugaccagcguuucccaaauuaacauaaagcacaaauaaagcagguacagggucuuuguugcuucuauugcagaaccagagccccuuugcuuccauuugaagcccccaccuuccagcugacuggagccugucugggucugcuuucaagucuuagcuccguuucuguacaacacgaagccaggcucuagcuucaugugcuccucguuuggagagcucaguaauuccgaguucagugucugcaaggagaaacuaugaacacagccaccccucaguaaagugucacccuuuauauccuacaaacagaacugugaagguugguaaggcucugcccuuauccacugggccaguccuaucugcaauaugaggucacgggucuacgcuaaggcugucugaggaaguucuccacggcagcucuaggggcugagaaguuugaauuuuuaauagucaccaaguugaggcuucaggcagggguagaagaggugagugugaggagaagacccucgccuguacuuuuauucuaaugaagcaccuaguguugagccuaggaccugaguagacaguaugagggaauggagaggcauggcgggcaccugaugugcgcauagaugggcagacccaccuuucaugagcaggaugaggugucucugugagggggacggacagaagaucauuguucugauugucagagaguuuguuagcguuugacaugugaaaugagagugcccaggacuuuccuggagagggguaugugugugugugugugaauauguagcccugacuggccuggaaugccacauagaccgcuacauuggcugacuuaaacucacagaaaucugcugggcucugccucccuggcacugguaucagaaguguguccccccugccccuacagcuccccccauaccuggugagagacuuguuucucuuuggauuggaauugugugcugcaucuguugagaagguaaaggcagauggcgagagccucacggaggagaaaagcaaccgcggauggguacugcuggggacgaugacauuuuucuccuuugugguggaguuuguuucaguugaucuugaagaauuuugagcaacuuccuguuagaaaacccagguggagguggauuuagcuguggguuaugguuucuacuccacuauggaacccacuuccugaaagagcaugacagcuaggcagucugaccaauaaguaggaaauaauaauaguguauacagaagccaucagaacaauuugaccugugaauuaaaagugacuuauuuccuccuccuccuccucuucuucuucucccucuucuuccucuucuuccucucccuccuccuccuccuccucuuucuuuucuguuuuuucaagacaggguuucucuguguagcccuggcuccuugaacuaacucugaagaccagacuggcuuugaacccagagaucuggcugucucugccuuccaagugcugaguuuauaagugugugugugugugugugugugugugugugugugugugugugugugugcaugugcauacggaggucagagguuggcguccgaugucuuucuccagcccucucucuguaccuuaccuuuugagacacgguaucucacugaaucuggagcucaccaguggacuagaccggcuggccacagcugccuauccccacacugugauugggguagggauggaccugccuuugcgugugcgugcuagggaaucagaacucaggcccucacacuugcacaguaagugcuuuauggaccgagccacuucccaugagcauaaaaacgaauaagacaaacaaaauuauuuaaaguccaaguggaaagagagagagaccgggaucuagugcugaaaagaugaccagcagccacugaguacugggagucaccacucaugcccugucccaccuaccugccccacuugucccacccaucccauacgucucuuucuguacauuuucucauugaggcaacaucucaacucagguuggccuugaacucaggcuccugcaucccuuccagguacuggggucggggacauguaccacugugugguauucucgccccgucuuaugcuucucuuuucucacuuacuuuucccuuuucuuauuggagacagucucacuaugcagccuugguuggaugagaacucacuguauugaccagguuagcccccaaagucaugggcaauucuccugccucuauuucuggauugcucagauugcagguguguaccaccacacccaccugccccuucuuugguucaccagcuuuuguuuuauguggucugccaugacugugguuaacuguccuacagacauucccacuuggagucuccuucuuuauauaaauucuacgguugaguucaggaaagccagagcuacacagagaaaccccaucucaaaaaaccacucccaccaaaacaaaacaaaacaaaaacccuaacccccaaaacuuaaaaaaccaaaccccaagcccuaaacuguuauuuauguuucuaugagcaucucagucaccaguuauuagguucuuggggacagugaacaucucauuaccuccccucauggaccccuagaucaggcuguuacacagaagcaccuguggaaagccaggcacgguggugcauccugucuguaacccaagcacuugggagcuggaggcaggaagaucaggaguucuagaccaaccugaaguaccugagaccuuccucaaaaauaaacagaaucaccaacagacagacagacagauggacaaaacccccaacaaaguaugcaaacaaauacuuauugaacagaauauuguuacuuuaauauagaaaauuuuaauauuuuuuugauuaaaaauguaugugugugugucagagagagagagagagagagagagagagcgcacagacaugcauguaugcucacaugcuauggcaugcaugugucagcagaccaccuuguggauuugcuuacgugggcuccagggauaacccaggucgucagcguugcauggcgagugcuuugaccagugaggcaucucaccagcucuaauucucguauuccugguggacuuuccuaacuccguuucuucgugucuuacaggugaggcacagaguucuccaucaugucggauggagauuacgauuaccucaucaaguucuuggccuugggagacucugggguagggaagaccaguguacucuaccaguacacugauggcaaguucaacuccaaauucaucaccacagugggcauugauuucagggaaaagagagugguaaguucugcacccuucauaagaaucuaaucugagucaacaaauuaacgggacuugagaagccaaagguugggaccuaaaguuacaguacacaagaaaguggcuagguacaacauccaugccuuuaaucccagcauggaggcagugguagggauauugaguuugagagcagccaggucuguauagcaagcaagcaagcaagcaagcaaacaaacaaggguucugugcucgggacacuugauauaaaacccuuuggacacaguuaaaguccauauuacuuuuuuuucuaaaacaacaacagccgggcguggugacgcacgccuuuaaucccagcacuugggaggcagaggcaggcggauuucugaguucaaggccagcccggucuacagagugaguuccaggguuauacagagaaacccugucucgaaaaacuaaaaauaaaaaaaauaaaaaaaaaaaagaaaagaaaagaaaagaaaaagaaaaaaaaacaacaacaauaacaauuacuuauuuugggggcuggagagugacucagagguuaagagcacugacugcucuucaagagguccugaguucaauucccagcaaccauauaguagcacacaaccaucuguaaugggaucugauugaugcccucuucuggugugucugaagagagcuacaguguaugcauauacauaaaauaaauaaaucguuuaaaaaaagaaagaaagaaaaaaacaauuaaaaaaaacccuuauuuuuaaucagguauaugugugugucccugugaguguaugguuacacucucccugcccccgcucuccguguguguguguguguguguguguguguguguguguguguguacccauggaggcuagagguguuggauccucuagagcuggaguuauagguguuugugagccacuuaauguaggugcugggaaucaaaccuggguccccugcaagagcagcacgugcucuuaaccacugaaccaugucucagccccugcagagaacauuucuacuagcauuuccccuugcuccccuucuggcuuauaucuuucuuccugaauaccauugucuaccugucuaccggugucaugaagucugucagccaucuugccucuucuggucugguuggcugggcugggccuuacaaugucucuuacaccggcaucgucuccucuuuaaccgcagcucccuuaccuggagccuagagcuccacaggaaacaccaugugccaggagggccagggugggauggcagugugggauguuaccagugaugcagugugcugcagaaugguggugaggaaguauguguguacaggcguuguguauaauaggagugcagggucuucuuauaggggaaggggaaaguaggaggucauaaugcaaggagcgacuaugaccuuccaugaaugguguuguuugaaaaacccaguuauggugcuacugguaaguccccuaaggcugaagccaaagagucuucagcauguguauucugucagggaagcugcacgguccccagcuucucagacagaacaagucagucccuuuaacccaggauaggcccuuucuacuaccagccguauuuuaucacuuuagggucuuucuauguggcccaggcuaaccuugaacucuugaacaccucagacucagaguuacaagcaugugccaucacacccagcaaccagaguaucugacagacauucagacucacugcaagagaugcgugcccuaagagaugcucauggucacauagccgauggagaugucacgucgucaguuuucugucucagggcucaaccacauggagucucccaguguucuacugugugcuguguaguuaagucuaggaugauagaugugagucacugaacccguguagacuuucaaguuucucucugucugucugacagagucuuugucuuuccauccuucccucucucuuuccugcuccccuggccaaugugcagacuuuccucuuggcauuauucugaccaacacaguugcaauaacuucaacccacagagauuuuggaagcguuuguagcaauaaccucaaccugcagugaucuuuggaaguguuuagaggcuuugguaucacaugcuagggcugauggugugcacacgauuguuuuugcuaguuaccucucgccuugugacccagcuuguuucaugcauggaguucugaggguugaagucagggccuugugcaugcuggguguucugccacggagaggcaacuccagcucuuccuuuuggucuaaagcagauuuguugauguauaauucucaacaaguaaaaucaggggcuggugagauggcucagcagguaagagcacugacugcucuucugaagguccugaguucaaaucccagcaaccacaugguggcucacaaccaccuauagugagaucugacucccucuucuggugcaucugaagucagcuacaguguacuuauguauaauaauaaauaaaucuuugggccagagcaagcagagacgaccagggugagugggguugacuggagcgagcagagguccuaaauacaauucccaacaaccacaugaaggcucacaaccauuuguacagcuacaguguacucauauacauuaaauaaagucuuaaaaaauaacaaguaaaauuaguccauuuaaaguguagaauucagcagauuuuuuucuagcauauccauggcagcagauucacacgaugucuccaucacaauuaauugcuugcauauuucuuuguugauuuacuuagguuuucggauugauuuauucuuguuuuaugugaaugauugucugugugcauguaugauauauauguguaccaccuaugugccugggacccacaaaggccagaagaagguaucacauuccccggaccuggaguuauaaauggucgugagccaacacauggguauugggaaccgaacuuagguccucuacaggagcagccagugcucuccagcucaacucguuuaguuuuugaagacagggucucacgcagccuaggcuacuuugaauuaauccccugccucaccuuugggguuauaaguaugugccaccagcaacuguuuuuucuuuugagacaaggucuuaccauguaguucuggcuggccuggaacuugcuguauaggauggucuugaacucacagagauccagguauuggaacuaaaagucuucaccaccaugcccagcaugaacauuuuuaucaucacagaaauaaaccccgauaaugccauugccuaucgcucuuccuuccagaguugccuaauucuggaugugcuguauacaaggccuuugugucugucuucuuagacguagcaugucucgagguucauccguauuguagcaagcaucagacagaaucaauuuuaaaauguuuauuuuuauuauguuuaugagagagugggguggguugggguaccugcagaggccagaagaagacauuggauccgcuggagcuggagcuacgguuacauuaugaacugccuguugugggcaucgggaacugaauucagguccuuuccaaaaagcgcccgagugcucucaagcaccgagccgucucccucacccuuguaugcaucgauuacggcggcagaguaagauuccacugugcuaacaugccagaugcaucugcccagugcugaugaggauuuucacuguuuucuguucuagcuaugaaaaugauccuucuguaaauauucuguuuuccuguggcauagauuccacucucauuguuuuauuuuuacgaaaugaagccggaguuuauuaggaaaagguuuggacauagauuuaagcacaggcauggggagggagaaaagauuagugcugaggaaaaggacaggacggagacacggguagagggagccacucuuuagacucuuuagggucuuaacaauaaguggccaugccucacugguagcuucugaagucauacuuguuguaagcuggcccgcagccuacaugagccggguguuucuggaaggcaggcuggugcugaaagagacuuagacuucgagaaaagauaaugagccgggcgugguggcgcacgccuuuaaucccagcacuugggaggcagaggcaggcggauuucugaguucgaggccagccuggucuacaaagugaguuccaggacagccagagcuauacagagaaacccugucucgaaaaaccaaaaaaaaaaaaaaacaaaaaagaaaaaaaaaaaaaaagaaaagaaaagauaaugaagccaagacagauguucugaucaaggcccgagauuuuacucagagacugugcuuaaaaaggggaaagcccaucccccgccaauccauucuuggugccuggagccagccugcaggcgaggaugugcaggauaggaugugccucuggaauaucucaggggccucucagcagguagcagugucuuggaggagagcagcggcaagugacagaacaauggagccaucuaggucggaaggcuccaccccagguggucucauucucaguagcagcaagguuugcaacagccagcuucaggcugggggaggcuacacguacuguuucaagggcuucugaaaaacaaaacaacccaaaauccccuauuuuucuucuuaguaagaaaccacuggguaguucccaagguauacuggucaggauuacaggcugauagacaaaaccacaggccacaaggguugaaggaaucuuuacuccaugaggucacaaggaacuuaagaccuaaguuuuuuuuuaagauuuauuuauuuauuauacguaaguguagcugucuucagacacuccagaagauggagucagaucucauuacagaugguugugagccaccaugugguugcuggaauuugaacucuggaccuucagaagagcagucgggugcucuuaccuacugagccaucucaccagcccaagaccuaaguuuugaucauuagaaaaguucauaaucuuguuugugaagcucucuggaagcuacggguuuauaguaggaaggagugauacuaacuguagggguuauagaugcugaagucuuaagccugguuccuugcucuuuuaauuuuauuauuaggaauguuugcauaugaaagaaaaaguuucucuauacaacaaaucuuauuaacaacuggauuuuuuuuuuccguuuguuuuucaagacaggguuucucuguauagcccuaguuguccuggagcucacucuguagaccaggcuggccccaaacucauaggaaucugccugccucugccgcccaagugcuggaauuaaaggcaugagccacuauugcccaccuguuuuuguuuuguuuuugagacaaggccucuauagucacggcuguccuggaacucugucuguagaccaggcuggccugcaacucacaaauucaccugccucugccuccaagugcugggguuaaaagaggacaccaccuuugccaggcuuuuuuuuuuuuuuuuuuuuuuuuuuuaaguuuauucugaggggacaaugcuagagauuagacauuuauuagccaaaauuggugucgcugucccuggaagccagcggugucuguuaaauaacuauagggacgguuguugaugaauucgccaagucugggacuuuucucaugaacaagcucugggugaggacaagccugggaauggagcugcucuuuagggaagcuuucugacaagucuccaaaccugcucugcaguggcugccuggccagcugagguucucuaggcugucaugcugguccauuugcuguuguuuguuuuguccugugguaugugguaccugggaucagaccuggagucucauguauaguaaggcggugggugcuaccccacugaacuacugagccauaccuccagcuucaaucucucucucucucucucucucucucucucucucucucucucucucucucagagcuuucuuuucuuuucuuuuuuaaagauuuauuuauuuauuuauuauauguaaguacacuauagccgucuucagccacaccagaagagggcaucagaucucauuauggauggccaucucuccagcccuccccccucucaaauggggucucacuguguagcccuagcuggccuggagccugcguuuuuagcccuggcuugucccgcccccugagagcugggacaggagugcccauguauaaagccauuagguuuuguauuuauuuaauuauuuguuguguaugugugugcaccugugcugugguucauguauagaagucagaagacaaucugugggaguuggcucucuuuaccauguagguccuagggauugaacucagccugcccuugaacucaaggcaagcacgguuaccuacugaaucaucucccuggucucuauaaaaucauuuccagggcacuuccuaaagauaagauaaggaaaagccacagaaagucaguguuuuuuggaauaaaauaaauuauuuuuauuaaguuugguguuuuagagacagggacuuauacauucuuggcuggccucaaauucaauuugauauauagcugcgagugaccuuucuaucuucugucucaccucccaagugcugggauugcaggcaugcaccaccaugccugcuuuuacgguacaggggguggaaucuggagcuuuguggaugcuaagcaagacuaucaacugaacuacacccccagcuaggucuuaguaggaggugccauugcucaagugugguuauugcaccaaagucuaaaccuggcucuguucgggacucaauucucuugagaagucuaaaugcuuugagauuuugugcugaaucgaaagucaagaagagcccgcuggucucagaauuucccuuggcuuaucuuugcuuugcuguuuuagguguacagagccaaugggccagauggagcugugggccgaggccagagaauccaccugcaguuaugggacacggcggggcaggagagguaugucuccccagucuguccacacugaccugggcaggagaggugugucucccccagucuauucacacugaccuggccaggcaaaggcagccaacuggcucaucugcaccugguaagaugagcugccagaucuguguuggcagccugaguugaugguaacaggcacauuuucuccaaggucaaaggagauguaaaucucaaaauuaacccuucauacuugggacucauucuuucucccguuucaggcucuaggcuucuccccacugccuucugcgcucugcucaccaguaagggagucccaagggugcuugcuuuguucuucucuguugcugaggccugguggaacaucuggucgggaugaauuaaucugauuauagguuacuugacugaaaaaaaaacacaugacacuuuggugcaaggcugcuuucaguuagcuacagccucugauuuaucucagucuucuggaaggguguguguguguguguguguguguguguguguguuguguguguguguguguuuugugugcuccugugguuaugcaugcacacgugugaugugggggcccaagguugacauuaggucucuucuguaguugcucuccaccuuauucauugaagcagcgugucucaccccagcucagugcucacacacacagcugguccagcuauguagcuuauucugagaaucccccaucucaggcgccucugugcugaauuuauagguggucugcugugccuaccuaauaguuguguggguuccggggauccacucuggcucucaagcuuguaugggaaacacuuuaaccacugagcgaucucccacuuuucuuucucucuuucucucuuuccuuccuuccuuccuuccuuccuuccuuccuuccuuccuuccuuccuuccuuccuuccuuccuucucucucucucucucucucucucucucucucucucucucuuucuuucuuucuuucuuucuuucuuguuuuuugagacaggauuucucuguguagcccuggcuguccuggaacuugcuuuguagaccaagcuggucucaaacucagaaaucugccugccucugccucccgagugcuaggacuaaaggcgugcgccaccacgcccggcucccauucuucuuuuaaugauaaaagaaccaaaccaaagcaaaccacccauagaaaucuccaaguguauguauaauggugaagagauguaacugaaccugugucccuuacucagaucugaucauuuccauguuguggccauucucauuucaucucuccccuuaaaacuccuccucccucccucccauauuaccuggagggaaaaaauuuaaauaccacauccugccauccacagcuauuuugguauguaucuauaaacaguaaagacguuuuaugagaccauugaauacaguaauugaagaaaaccuacuauuucugacuagcugguuacuauuuggcauuuccuucuguggagccugccugucaguuacagacuagacauuuaggcaaagcgagaaggaacugagagaggagagggacagcaggcaaagccugcgggaggaagcauaccaugacagguccacccagcaccauucccaccucagagguagggaaaugguugccagagagacgucuacagagcuggaagugaguucuauugacuuguagugaccugaaaccuccccagaaggaggagacacauggcugacacuguugguuuuggcuuggugaacucgaguuguccaaugauuuccuggcugggaucucucgugcagccgguucagucuuccauaacacauucuguucacaugugaacuugggggagugguaagccccugcuugagagaacuuuguuggaauagcugaugucgcuuuguagaaugcugagggugucagugacagcuuuacaguucaggagugggaccaugcauggcuugguuguuaaguuucaggacccgggacaagcagcagaggugccuauuuaacauaucagagcagaccgggccuccagguucucccagggucccuuagucccugccuguuacaggaucuggcugguauacuccacccucuacccugaacucuccugccccagagcugggccacccuucuuccagaaguucuucccuguauaauccagaccugggucagccacuccuccuuagcuccuccuuuugugccuuuggcuaccuggcugcuguuucuugcucgcucucucucucucuccccuccccucuccccacaacauucaagguccugcucacucuagcccccccagaugugucugcugcuggcuaugcucucccacaaauccauaacaaacuuucucuuccaccauacuuggagccaucauguccuguccuuuucuuuuuauugacuuauguuucauucguuagugaccaacuguuuaacugcuuuuuuuuuuuuuuuuuuuugugcccuagguuucguagcuuaaccacugcauucuucagggacgcuauggguuuccugcuucuguucgaccugacaaaugagcaaaguuuccucaauguccgaaacuggauaaguacgugugguuuccccagcccugcccugcuccuggaccugcucugcacugccauguuacgacauguccacucuauggcugccauguuauauauucugcuggaaacagcucagugucgaggcuacuaagaauaagcccuucagcuuagggccucagauggcagacauccuuuguucccuggagcugccuuccccagggagcugcuggggacccuuccucauccucucaggaaggggugagaagagccuaagggugagccagcccacugaaggagccugaucagagagcugcugcccuggaacucgcuuuguagaccaagcuggccucgaacucagaaauccgccugccucugccuccccagugcugggauuaaaggcgugcgccaccacgcccggcucagaauuugcauuuucaauaaguucucagggguugcugaggcugcuagcccauaccacuuacacagagagccaauaaaucaguuaaucuugguucuggaaaguaaguacugucauguucauuuguagaucaggaugcuaagguagucacauaacuucccccucaagaugagggcgugcaggggguuggguaguggaugaggagaacagccagccagcaacagagccaagcuuccaacaguaggagauguucguaaccaugguaguagacguuggagguucugggagagcgcagaagggaccaguagagaagaggauggaacagaucuugaaggaaguugugucugggcauuaaagagugugggaacugcacauuaacaaccuaggguagaagaggccugccuuguacaggaaacagggcacaguuaguuagaucuugccugggcaggucuugugacccaaguugucucuugaaagcgaagaacaauguccugaaauucaggcuuguguuauuuaaggcuuggggagacuuccuccuucuucaccuuccccugauaagauauguuugaccugcguuugugaggaggaacugaaguggcaacgcuccuggcugauagggacaaagcacacaugaugucacgugcucugagaccacugguugcaaaauuucagaugcuuccauuucuggcguguugaggagaaagaaguuggguuuuauguuccuccuucggaagauggaacuauuuagcaccauggagcuccuuucuuuccuuuuaaaagagaauucauuuuuaugauauuuuaauaaaaaucuugugucuguguggguaugcacaugugaguacaggggucugggaggccagcgcagcugguggugaugagccacuuaguugaauggugggaacagaauccggcuccucuggaagcgcaguaccugcucuugaccaccgagccaucucuccagccccuuuuuugcuuuucauaguuaagacuuuggguucuuuccaaaaguuacagaaucugaauugugguguccuguguccccuggucuuggugacacucauuuacuauuuauucucucugucuucuuucaucaucaaaccgcaguuuuucuuugcuuguauaagacaagaucucacuggguaguccaggcuagcucugaacucagaguuucuugccucagcuucugggauuacaggcaugcaccaucacaccugguggugacggcaguggcugcggcugcugcuucuccuccuccuccuccuccuccuccuucuucaaauggcaguuuauaaagggaaagggggaaccccaguuaggaugaguugguuccuuuugauuguacauguuaacuaggugagccaaaaggggccuuuugaauccuggacuucaauacuuugauagcuggaccucaguggggaggaggaaguagcccaauaagggacuagaccuugguggccaguuuuaggaauguaaucugugguucaccaaggcagagggaaaguauucuaccagcucuuuacuucuguauacucauuugagguuuguauacucauuugagguuuucagaagcaccuuugcacggauuuucuguugaucgccuguuuacauuaugacuuacguauaaccaacuuucccgugccuuaggccagcuacagaugcacgcguacugugaaaacccagauauagugcuguguggaaauaagagugaccuggaagaccagagggcagugaaagaggaggaggcccgggaacuugccgagaaguacgggugaguauuccuguggugggguccagagggaacagaaacauuagccagcgagugacugaaaagagaaaagagccaacucagugucaaacccucagauuucacgucacaguggggaguuugagagcacacacgggguggggguggccucugcugucuccgccccucuuggcaaguucuuagauuuugcaggaggagaguuuugaaugcagccauacugacuuuagugccuucuguccaacacgaaaagagaagauuuuuuuuuuuuuuuuuugagacaggguuucacuguguagcccuggcuguccugggacuuguuccuuagaccaggcuggccuggaacucacagaucugccugccucugccucccaagugcugggauuaaaaggugugcucggccaucaccuggcuaacaaaagacucuuggaguaaggaaauccucuguguuuggcaaggaaauuucaaaaccacuuugcauaccguugcagaguucuggcaguagagguggccuuugggguaucuaucacagagcaggugaugacuuugaugggaggaaguauagccgcccuuggcuuuaaacugguuuugagugaagggccaggaaaugcugacucucuccucaagcucuuggagcggguucauggaggcaccacagggcuugcacaugaaaggagaaggugacaguugcuucacuugacuccugucccuccaggugggcaggugcgggauuucugggaaaggaaaagagaaauacaagagagaaagcauuacagagugggcagggcacgacuuugugccucuagcagcuccugcuucaccugagauguuguguuuauaaaaagauaaauggagaggggaauauguuuuauggauguguggugagguaugagggaaaggggcaucucagcaggcccaugcugaggcaacccuucccccugagggacuagccacacaaugguauaguauagaauaaaguuuauucagggcauguggaggggaguuaagaggguaggagagacagagagaggcagagaagaguagagaaauagaggcuggccaugagcacguggauagagaagggggaggggaauggggagagagggggaauggggugaggggacagaggagagcaagaaagcaagagcaagagagagcagagggggcaagcagccccuuuuauagucaggcauaccuggcuguugccagguaacuguggggcagagcuuagacaaaaugcuaauauggggggcuccuacccauccugcuggcuuacucuuaugaggagaugcaguuucaugccaggauagacggugucaagcccuuagaaacaccugggagcuuuguacaguuuggucucaccucugucacucagucauguggaguguuagcaguuaaguuucuguugaugcuuguauaugaagagauccuggccugggggaugugaugacacgguuggcagagugcuuaccacacaagcuugaagaccugaguucaauggcccccacuccagagcccccguuuaaagccugguguggugguacaugccuuuaauccuaguacucaagagaccaaggcaggcagaucucuuugaguuugagcccagccuggucuauauaagugacacccuaucuuacaaaacaaaacaaaacaacaaaaauaaaacaaguuggguguguuagcucucauuuaaucucagagcuagacagcagaaacaggugcaucccuggggcuugccugccagccaagcuagcauaguugguaaauuccaggccagugagaaaucuaucaaaauaaaaacaagguggauguugccacucaggguuaaucucugccuucaccuacaccuacauaagugcacaugugcgcauaggaacaugcaagccugugugagugcauguaucuguugccgagaucugccuuuaugucauuguaguuacagagucgcuggaacucucucuuugugucugaugcugauucuugggcuucacaggaugggcugucaggaaaagaagcugauugcaaacuguggauuggguauaggaaaugaagagcgacuagaauuuauaugugucccaaaaacugccggcagcugucgccucugaccucgguggcgugggcauccugcacaagccagucgcuuuaucuuagcuaaucacacaccugguuuagcagucucagugcuauggagaggugaggcgagggggugggacaggugcaagucugguugcuaggcugcaccaagaugagucagcagguaagugccuacgugugcgaaaucuuuaaaggguaaugcuucacuucccccaugccucuccuguggcccacccgagaccacagagcaauuucugggaaaugcucagccaggcuacagugguguacuauguggggaccugggcacuggugccuuuaacggcuugaggcuggcagagccaggugccaggcaguucugguacggcuccucccucuugagaggcucucaaaaguguggaaaggaaacugaggggccaaacaccacaagucugacugaagugcugaaagggaugcuguuuugcaagggcauaggaggaagucggccaugaggcaauagaggccacaguucuugcccgugcuuuugagaagugaauguaaaaguagggcagggcggucagaagagucuuucaacaggaugucucaagcacccggagaguggaagggccaaccuggcccacucuaggccuucaucagaucuuuccuuguuacagcaugcugggucucgggauccuguagucugcccagcaucagagagccugguguugcuuucuguuguacgaggaucugagccaugcagggacugucuuucccuguguccagcacacacgugccacggaagaggucacaaagaugggcucuaaugagaaacgguuuuaacugaugaggauaaaggaaaugccaggaagagagaggggagagauagaggcuguccaugcuccuuuagucacggaagauaacuggcgcugggaauaaaccccuuugccauuuuuauuccgaauggagagagccauggaaacugugaaagggguuaaaggacaacugaauggauauacuugugugcugugcacauaauuggccacagauuugagaacucuguccccccugcuggucgcugaugagggaaggcacuccaaguuucugcaacagaagcucaguugaaaaccuuuauucagugucagugauagaugcaucgccacagaccaggcuauggauuuccggggucugaacucggcggugcuccgugauaacucagaacuagggaauguggucugaauuuggucucugaucguuugaucccuuguaaagaaauuaaugggggccggagcgauggcuccaugaugaagagcgcuugucaacucuuguagagagccaggguucgauucucagcaccuauucaguagcuuacaacuccauaacuccagauccaggggacccaaugcucuuuugacuuccucagacacaaggcacgcacacggugcacacauagacacacacgcaggcaaaacacucauacacauaaaaauaauacaauuuuaaaagaaauaaauuaauguauuauugugcauacauugaaacaacauaaguaagcuacaaccaaacacacaagacugacuccuggaagccacuucaaggacgcagcguccagcaagacucgccaucaauucuggauccacauguaagccaaaugccuagacacauuugacaaaacucucuagagaucaucauugucauucugacgacuucuacagugcugggggcugaacucuaggccuugcacaugccagacaagugcuuucuuagugaauauaugaauauauguauauauguguguguguauguauauauauauauacacacacacacaguugggaggcagaggcagguggauuucugaguacgaggccagccuggucuacagaaugaguuccaggacagccagggcuauacagagaaacccugucucaaaaaaccaaaaaaaaaaaaaaaaaaauuuuguuuaaacuauguuuguauagaugcaacuacccagaagguccaccauagauaucagaggcauuaugucucucuggagcuggaguuacaguugugagugcccgauaccggugcugagaacugaacauggauccucugcaaggacaguaaggcacacucaaccucugagccaucgcuuaaucccuggcaacuugguguuaagguuccaguuuugucaauaaguaaauaauagaaguaauuuuuaaaauuaauuuauuuuuuauuuauaugaguacacugcagcuaucuucagacacaccagaaaagugcauuggaucccauuacagaugguuguaagcuaccaugugguugcugggaauuaaauucaggaugucuggaagagcagucagugcucuuaacugcugagccaucucaccagcccgugaugaauuuguuguuguuguuguuguuguuuuucgagacagguuuucucuuuuuagcccuugacuauuuggaacucacucuguugaccagccugauacaaacucagagaucugccugccccugccuccugaaugaugagauuaaaggcaugugccaucaccacccacccuuuuaaaaacacaucaaaauauuuguugucuccaggaacucccaaguaacuauuaaguggccauuuguuagguggcuauaucaaccaaccauuuuucauaccucuagcaagagcucucccuggcaaugcugcuuuagcgccaucuuguguacauaagggauaguaccagcuuucuauggugaaaguaaugguccuuuugaauuuauguucagguaccuggacuuguucucagauaagaauuuggaaaagaaaacauaagcaucagacacaccuuuaaucccagcacuccugaggcagaagcaggagggucucugaguucaaggccagccuggucuacagaaugaguucaggacagucaggagggcuacacagagaaguucugucuugaaaaccaagccaaaccaaaagaccaagcugcucuggaaugugcagaacuggugccucuggcaugcugggacugcaggcaugcaccaccacauccagaaagaaugcuguuacuaagaaaagccucuccaugucugacugugccuauuuuguuuguuuguuuguuuguuuguuuuguuuuguuuuuuaaagauguaugagcugggcgugguggcacacaccuuuaaucccagcacuagggagacagaggcaggcagauuucugaguuugaggccagccuggucuacaaagugaguuccaggacagccagggcuauacagagaaacccugucuccaaaaaaccaaccaaccaaccaaacaaaaaaagauguauguauuuauuuuauuuaugaguacacuguagcugucuucagacauaccagaagagagggcauuggaucccauuacagaugguugugaaccacuaugugguugcugggaauugaacucagaaccucuggaagagcagucaguguucuuaaccacugagccaucucuccagcccugacugucuguguuaaguguuguaccugugucugucucaggcccuuagcaccaugaccuccaguuacugcuccuuuucacggauaagaaggcuccagagcuauguggggagcacagugcuugcucuacagcuuagaauacuugcuguuuccugacuguucaguacugacucuccuagaauucacgaacauagaccaggcuggccuggaauucacagagaucggccugcggcugauaucguguggggcucugugaccaauccagagucuguuguugcuuuugguuuugaagcaggcuccugucagaugguucugcgguccaggccagccuggcacuuugcauacgcaagucucggcuucccaagugcguuuaacacaaacuaacaagcaaacaaacaaaagcauaacacgguaagcugagagggguggugcacaucugcagucggaauacuggacaggcugaagcaggaggacugugaauuugaggcuaccuugacuacauagaaaaucccaaacccauuugaguuaccuaguuaaauccugucucaaaaaccaaaagguuguggguguugcucacucauggauccaagaggguguuucgguugaacaggggcuauagggugugugagaaccuauguaggaaugcagggccaggcauagugauguacacccgaaagccuagcuugggagguagaggcaggaggauccuaaguuuaaggacagccucacaacacaacaaauuugaggaaagccugggcuacauuagacccugucuccaaaaaaaaaaaaaaaaaaaaaggagaggaagggagaaugggagggggcuuuaauuucucugguguugggaguguuaaguuucaacacugcccccuccccaccccaccccuacacaaaagcagaccuggcuuccagauucuuccagaaucucucagucccuuccugugugguggcauacaccacccucuacccugaacucuccagcccagggacucuucccuacauaauccagacauuuuggauaccugcuccacuuuuguaccuuuguccuccucucucccuccccccccaccacacacagcucagggucaugaccacucuggacucucccagaugccccaaccuuuggcuauacucucuccugaguguauaauaaacuuucuccuccaccacacccaugagcagucuuguccuuuccuuccuuuuuuuuuuuuuuuuaauuuuuuuuuauucagggagcacagagguucuugcaucaacagaucauuagggaaaccagggauguuaagcauacaaaagauuucuuuucaaagaaaaagauguaccaccaguuuuucacccagauagcuagcuguggauguugcuaacguccugauggccuuagcuaccuguagagccagaacacacccaaauaccacagaauguuuaucccagacacucccuccaaagaccuuuuauuuuucgguuucucaaucaacgggauacauauacuuuauagacccaaggacgucuacaguuugauggagacauaucagauccuccccuaggcaccuaagcuacuacauggagccuaucucuggagcccgucuucuuggaagaaguaacauauacuuugaguuugagguuuuuuuuuuguuguuguuguuuuguuuuuucugagacaggguuucucuguguagcccuagcuguccuggaacucacucuguagaccaggcuggccuugaacucagaaauccaccugccucugccucccaagugcugggauuaaaggcgggugccuccccgcccggcacuuugaguuuugauauaauuaugcuucccugugcacuggcuauuguauuacaccaagaacccccccccccccccccauuguacugcacuuaaauaaaccuccuggcgucagacugcagaaggaaacauuuccuuuccggcugugaugcuugcgcacacgccccuccacacacacaccugaaggucauucugcuauuacuuggcgcuccuguaaucggucuccaggaaacgccccgcucaauucucuguggcagcuacuggugguugccuagacgacacuccuagcccaccccuccccuccucguagaaguccaguuuucuuuacacauacagucugccucaggaugaggcuguuugagagagucggguacaaacgccagcccacgcagaccgauugccuucuggcaauugcgaugacgccauuccuuuaagccuaaacgggcauuuguuuuaggugcuggcaaaagauauccuuuugaaaaaugaaauaugaggguacgguuuugagagguacacacaguggaauagaauucauuuuuuuucauguaauuuggcacacugaauuaaacugaaacacugucgccuccucucugggcacuacugaagucacacuguugucauguauauuuauccucaauuucuccaaauccugaauggccaaaaaaauuacgaagggcaaaagucacugucuuucuucccacauuguuaccccagugauuucugucuuccagaauccccuauuuugaaaccagugcugccaacgggacaaacauaagccacgcgauugagaugcuccuggaccugaucaugaagcggauggagcgguguguggacaaguccuggauuccggagggagugguacgguccaacggccauaccucugcggaucagcuaagugaggagaaggagaagggguuguguggcuguugagacgccaagcgagccccguggcagcagcgcaugaccccugguugccgccagcuccgcuguagagaccaagccggcagcucgaugagaugagcaaacagccccuccuaugccaggugccucuccucgccuccaggagggucaccucgggcauccaucuguaacgcgcugcagcuuuguaugauuuaguccaugaaucggaagaaauacuucacagagccaaaagugucuuauaaaagcccacgguggcgggucauuuagggauccaagauuucagccaugaaagauuucaucuguuauguagaacgcugaugguccugucgccugccuuaacacagucgccugccucaacacaggacagcccuagagucucauugaagacauuaagaucuuugagcaaggaaaagcuagcacggucuugagaauccagauuucaaaauccauacuguagacuaucacucucaaacacgugaaugucaauaaguguguacacacagaucaaugucuuucagcauugcuuuuuaacauagccuuuccuuugacaugagcauaaacagauggcggccauaccuauagacucugaauagaucggauugacucacugugaguuuggggguggggggaaggguuuauggagcaggggugggugaaguagggaucagucagauugucugcuguuagccgaggggucaugaagacucuugugucuauccauggucuguuggguucagugcaccucugaacaucgcucaugcuucuacaguauguauguuugcauguauguauguauggucucuucauauguacguauguuuggucuggcaccucaggaucugcuuucacuugucuggagacugccaaucugacuuuucccaucaaguuuuggugguggugguguuucccaguuuguuuucucccccccccccuucccccauuaauguaacugaaggaaucucuuuuuaauuaaacggcguguuuauuugcuaucuggagggagggaguucacugucuguauuuaagcagucacauuugugggccaguuuaagagaaguguuuuguagccuguagcuuucacugggaauguggggcacugauguuuuuugauaguggaaaacauacuuugcaugguaguuucaaguggcuuuuuuuuuuuuuuuuugagacagggucuuuucauauaguuucuagcuggcccaaaacucccuuuguagacuaggcuggccucaaacucacagagauccaccugucucagcacccuaagcacuggggauuaaagguguaguugucacaccuggcucucagaagacuuuuaaaaaauugcacaucuaucauuuauugccauuguccuuugaccccuccucagaaaaaaauagccauggccacuaagcuuuuacuguuuuugaaauaagggacucuuugaaacaccaaacucaucauugaggccuauacaucugaauccuauauacccaggacaugaggcccaucauagccgugccuuccagcguuguucuaagacuucaguggagcauacugcuuguuuggcacauuucuuaaugucucucuuguaaauacaucaagucaauaugccagacagguauuggugguucguucuuuucaucucccauacuugagaagcagaggcaggcgaugaguuugaagcuaggcuucacuauagagugaguuucaggacagccaaagauacauagugaaguccuguuucaaaaaacaaacacacacuaggcaguggaggcccaugccuuucaucccagcacucaggaggcagaggcagguggauuucugaguucgaggccagccuggucuacagagugaguuccaggacagccaagacuacacauaaaaaagugaauguuugcacaguggcauagugcggguuuugagaagugagaugccgcuccuguuggcuccacaccaggcacggggcuuaaugugugugauaguugcccaacacaagagcugccuugaauuguugaaacaaaacaaaacugaguucucugaaaaugguuuaaauuugauaaaaaaaaaaaaauaaccguacuuuuugucacuguauuuuucuauuuacaaaucuguauaaaaaaugcucuuuagugaacuuugugccaauuaaaccauaauaauaauaaaaaaaaauaauaaaagagguccaguauaucaaguucuggugaauauuucaaacuaggaauugugaugccaaaggaacccgaauucaggaaugcagaguccacgagaugcuugcugaggacccuggccaaaacagcauccagggaagauagcucgagauagauuuuuuuuuuuuggucaauuuuauuucauguauaugaauguuugccugugugucuguguccuuugugugcauguccuuggagaccagaaaaggccauuggauuuuuugggacuagaaucacagacaguugucagcugccauguaguugcugggaauuggacauagguccucuagaagagcagccagugcuuuuaacaucucuucacccccaauucaaaauguuuuauccaauauuuauugaguaccuuugagaguuggugaacuagguagucugauggagcaaaacaaaaaugguuagguccugcacucaaagcagagcugggaguggugccagggcacuggagaaggcuuggcuacugacggaaagagacucagccuccucucagaugcacaucccugaguuggcucugaucuagcacucaugggucugucugugaugcuagcuuuccagaggucuacuuggugcucucgccaagacuguucaaauaccaccuuguccaaucauguccuauaaaagagcagccacuuucaugguccacuaggaugccccaugcugaaaaccuggugccugguuugcuaacccuauugaagaggauuugucaaagucugcaagccauagcuaaaaaguggagguuccaacaggggaggggucuuuaaguguucaugcucaccacccaucugucggugcuuaaucugcaacagcccuggugcucugcacaucugcagaugggaacucaucaaaga

SEQ ID NO: 5196 - RNA, 2235 nt, Mus musculus
aggaugaaacgcugcuuggguugauggcucgagggcaggaacgaguaauucuuggaacagaagauggcuucuugguguuucgcccucagcucucugggcugugagccucugacugccuggaagucuuuucaggcugugagcuuugagcaaagacuguguggacgugugguacuugucacagcuuauccugauacguuguaaaauauuugcucuuuucuuguaaacugggaagaccagagaaaguuuuucucacagaugucuccagaaacccaaucccaaggacaagaagggcuggggauggagaagcugaccuggccugggcucaucugugagcauggaagagcaguguggugauacgugcuaaggauuguccugagacuuuaaugaggaggaagucaccauggcaaacaauuacucaagaaacaggcuguucuuuugagaguuaguaacucaagaguaaagugguauaugucugcccgcaagcaggucguugcuccguaucuccaguuacgaaucugcuuggcuggaguuuuugcucacaaggaaacaacguggugaucuucuccaaaugucggacuuggccaagaaaagguuauccuagaguucuuaucuaggacucuuaacccuugaucuacaagcuuacggcagagagugcaaugagacaggaagggcuggucaacugcucagagaacauguugaguaauuuugcuuuugaaaauaagacacagcuggugauguucaggcuagccacuacaaccgaagucacuuugaaguuugacuuugaggaucaggaaguuugggcaugaugagaccuuccucaggcuggaacgaaggagaugaauuguguauuuauuuuauuuuauuaguacacuguagcuguacagauggucaugagccaucaugugguugcugggaauugaacucaggaccucugcuugcucuggcccugcuugcuccagccccacuugcuccggucccaagauuuauuuauuguuacauguaaggacacuguagcugucuucagacacaccagaagagggcgucagaucucauuauggaugguugugagccaccaugugguugcugggauuugaacucaggaucuucagaagagcagucagugcuccuaaccacugagccaucucuccagccugaauuguguucuaauaugacgauuuaucuuuucucuagcaauaaacuuacugcuggagaaaaaaacacuagguaggguuuauaugugcugggaagaaagugaggugugccuguggacccagacuaggaaacaaugggauuugaaguggggccucugcagagugggcaguagaaagcccgugcgugucuugggcugaccuugccguggcaacuuggauagaugggagacauucaggcagguggaggagccuggaaaggucucugaaucacagagccauccgucugcugcauuggcaugauguaacccaggugcugacaaagggagauagggaaauauuuucucccaggagagaagcguggggcaguuagaucgugggcauauucucuagugccccuguguucucuacuuuuagugcugccgacagaaagcagcaggcuuguaucugcggauugaauuauucagcuguugaucugaaugaaagaacagggcccaugacauguaucgaucuguaaaagcacuugccucaaaagccugauaaauaccugaguucagucuccagaacccauauaaaaggccggaugccccauagccuagaaccaacucccaagccuuguccucucaccugcacauaacugaacucuguucucuguuuacuugaccagcagaugaugucucucaggcgaguuuauaggccauuccaaaguuucaaagagagggcuagggcaucccgugggcaaugccagccuuuccuagggcuugagggagcacugggcauucacagugggaggagggucaugcugcugcuuaugagaacaaaguggcucgaacagcuuuacgagggagaacauuuucccuucacaaucuguauuuuaugaaaauagagagcacuuguuaguagccaagaguagagacaauuugaaucaauugagcuuccugcagagaguuuuauuucuccaaaauuaugcucggagaauuuaaaugaccaaaguuucucaaacuauuaauaaguagaaaacgaacaaaucacauucuaucuacuuucauggaucaaauauaucaauauuaaaaaaaauuaaaaugua

SEQ ID NO: 5197 - RNA, 403 nt, Mus musculus
aaaaccgccuucuugcugucccugcagucaucgagucaucggagagcagcagacauggcccugcgcuaccccauggccgugggccucaacaagggccacaaggugacgaagaaugucagcaagccgagacacagccggcgccgcgggugccucaccaagcacaccaaguucgugcgggacaugauccgggaggugugcggcuucgcgcccuacgagcggcgcgccauggaguugcucaaaguguccaaggacaagcgggcacuuaaguucaucaagaagagggugggcacgcacauccgugccaagagaaagcgggaggagcugagcaacgugcuggcagccaugaggaaggcggccaagaaggauugaugaacccacccccaauaaaagaucguucguuuuu

SEQ ID NO: 5198 - RNA, 584 nt, Mus musculus
gaugcuucgcuacucucuugacccagaaaaccccacaaaaucaugcaaaucaagagggucaaaccuucguguuuacuuuaagaacacccaggaaacugcccaggccaucaaggguaugcaaagccaccaaguaucugaaggaugucacuuuaaagaagcaaugugugccauucuggcgguauaaugguagaguccguaggugcgcccaggccaaacaguggggcuggacacaggguggguggccaaaaaagaguguugaauuuuugcugcacaugcuuaaaaaugccgagaguaacgcugaacuuacggguuuagacguagauucucuggucauugaacacauccaggugaacaaggcaccuaagaugcgccgacgaacccacagagcucauggugggauuaacccauacaugagcuccccugccacagugagaugauccucacugagaaggaacagaucguuccaaagccagaagaggaggcugcacagaagaaaaagauaucccagaagaaacugaagaaacaaaaacucauggccugggaauaaauucagcauaaaauaaaugcagauaaaguuaaagguu

SEQ ID NO: 5199 - RNA, 4085 nt, Mus musculus
uauuuaaaccucaacaauaauccgagggucucccgcugcuccugcuugccccaccccaugacgcucuccuuguaccaggugcaagugauauucccaaauguccaggugggucagagugggaaguagcugagccuagaaagccuacugagguuggaccgggugcaggagccaaaggauggccgacucgcaggacccacugcaugaacgcacuagacggcugcugucugacuacauauucuucugcgcacgggagccggacaccccagagccaccgcccacgucugucgaggcggccuugcuucgcucugugacuaggcagauccagcaggagcaccaagaauuuuuuuccuccuucugcgaaagccggggcaaucgccuggagcuggugaaacagauggcagauaaguugcucuccaaagaccaagacuucagcuggagccaacuggugaugcuccuggccuucgcggggacgcuuaugaaucaaggcccuuacauggcugucaagcagaagagggaucuggggaaucgugucauagugacccgagacugcugucucauagugaacuuucuguauaaucugcucauggggcgucggcaccgcgccaggcuggaggcucucggcggcugggugagaccacuggaggagggugacggagauggcuugggagacggggcacaggaggauguguugagugccuuuaccgcagggucuuauguagccagccuaggcuggccucaaaccucaccagauacuacccugccacuaugguccuccugcuucuaucccaugagcaccaggauuacaggcuaugucauuaugguggguuuuuguggugcuagaaggggaagccagggcuuugagcauacugggcaagaacuaagugagccacaucuccagcccagggauuucuuuuuuuuuuuuuuuuuuuuuuuuuuuuuuucagggauuucuuuauaggcugcucuuacucaauagcuuuuauaaaacuucauucaggggcagucaggcacacuuggcuuacccuaacucuuagcccaggacugucagggaggguugauuaagucuaauaggcccaagugguauaaagggagcaguaaccaugcccagacuuacccuuauuagaguaaggccuuagggauugugaaauguguggggccaccaagugaggagccugacugggaucuuuuaggccacuguacuuuucccugcugggcaaccuccaggcucauggcuuucgguugguccuuaaucucggugguguaggcuaacgaggcaguccuuagccucccuccagcugcauggagcuauugaucaaggaaaacacacaggaugaggauaaaaagcuugaugguagacuguuagcaucugugaagcccuggguucgauccccagcaucaccagaaaagaggagagaaaaagaaaggaaaggggaggaaaggggaggaaaggggaggaaaggggaggaaagggaagggaacccuucuaucuuagguuaguccacaacaggccccuuggaggcugagcuuagccuccucagguuucuuuaccucccucuucauugugguugaaucaaaauggauacauuaugggguaaauauaacuuaaccauuaaaaccugcuauacaaaacccaaauggauuacacuccugucaggagucugcauuuaagcuaccugggaaaggcaaggcagcaggacauguuaguaccugcccugcuccugauggacgggucuccacugggcccacagacugccuucagccgaguuuccaaggacccucucugagcccucugaagaggucauuaagaccgaguguugauuucucccucugccuccuggcuccucccucuaccuccucucucucauaagcucucaucucagccuuggucagauuuuccuuuuugggggagagagauucacuaucagacuuacuagcacccugagaagacaacauggcgacagcucugcauagaguuuagguccauaaggccaagcgaggucucuuuaggucucaaaggcuccagaggaagggguaggucgugugccacauagugaugaauccguccguguggaugcauggguguguguagcagucaccgaugcuagagcaggaggggaagugggaaagauugggcccuuuaguuagugucuguucacgauacaggauuugcuacccauagcccuugauuacuuagggugucaggcacccagcuguucccuuuggggaauagaggcuuacgaguucccaggcugacuuucaacaggguuaucugcuauuucuuuuacacaagcugugaagguagagaaagcagcugcugcgagucagcauggccuggauacccucuaguucacauauaacauucccagccuuuuuuggucuggagauaacaggcguuaagugucugaucgcugucauacugacuuggguggugcggucagcaggucucccaucuccggguaucugagucagagauuggcacaauaguaggauauuguccacaugagugugugugaugcaccacacagcagucuggaugaauugagagggaaaguguauucaagagggggccugugaccauaagaaccaagauacuuauuaaaggaguaaccagagcugugauccaggggggucccccaugaguuuugaaaccauuuugaauuugauuuacagagagagggucaagagugacuagaagggcugaagauagacugugcugucaaaggagagaaugcuuuuuacuggagguuguggggaagggaucagagaguaauaagagguuuuaagagaguucuccaaggugucuuaaguaagcguugagguguacugaggauaucugugccauaugaggcaguuagaugguugcugaugcagcaaguuggauugcuuauuacaaaaccuaacugggagguguccgguagccaggugccuuuauuuguauggcaugaucuaaaaccucccauguauccuagaguguucuucauacuggagacugguccagggccuugugcaugcucaucacauguuugaccucuaagcucugagcuagcccuuuauguggaaaugcucgggaaggccagagaggaugucagaucuccuagaacuggaauuaugggcaguugugagacacuaugugggugcugggcacggaacccaaaucuucugcaagagcagacagugcucuuaacuucggagccaucccuccagcugugccuacugugaaucuggggcccagguuuguucaugaggagacaggcuaauucuugucuuuccccccacccugcaggauggcuuuugccgcuucuucaagaauccuuuaccgcucggcuucuggagaagauugcugauucaggcuuuucugucaggcuucuuugcaacagccaucuuuuuuaucuggaaacguuuauaaguuuaaaauuuuuaaagcgaucuuaccuaccuaccugugaacccucuaaggaacaauucuggguaauuggauaagaacugaggaaguccuccagccuagagacauuucuaccugcaugcuacauggaguucuggguuugugauggggccagcauuugaaaggggcccauguagcuuuucgcugcuaagugaggaaaugguccccaucacuccagagaacuucagaaaacgcuacacacacugacuggauguccagcugucugaauuuggcugcaggugcagcagagccucccccaucuguucuggguucuugagcugccaggguuccagggcaggggauccuaaagcucagagcaaugaggaaugcaauaggaaacuggaaggaaucccuugaaaccuaaauucuucugugccuaguucuaaggacuucugaauuuauaauacuccccuuaauacauuuuuaauaacuucaaauucuuaauaaauguaugcgcuuuuuuaaaaagggagaaaaaaagaaaaugucuuucuauaacuuggcaagacucuuguucuuaggaguaacucaaauugaugacaauuuacuuuuauugucuccaauauaaaccaggauuugguuuauauugcugugcggggaguaauuuuuauuuuuauaauguguauguguguuaugcuuguac

SEQ ID NO: 5200 - RNA, 7600 nt, Mus musculus
cgugacugcgcgcgccgcgggggcggucggagcugcacgcggccugcuggcggguacaccccggccucagcugaaccaccgcccagagugucguaccaagugacccgacagggcgagcgucugaacggcugcugggucccgugcugucgggaggaagugggcgaaggcgaauaugcuaggccagauuguugagcagauaagcucagggugguguugggaaggccccugggaucgguccccgggguccguuggcugcuucuagaagcauccgcgguaaccagggaggugaaugagugagggguccugggaaaacugagcaaaagcucagucagcaggguggcuggcuuguugagaucgcugagaccagccagaguuugacauaggcgugcugagaaagguagauagcugcccuuccagugcuuagaugaaauuuaaguauuuaggaacuuagauauaaaaagcacaggguuugccugggaguaguggcacaugaguuaacuagucuauguagugccaggacagccuaugcuauauaauagacccugucucaaaaggcugggagagcuuguuguuguaccccugugaucccugucuuggagaccagaaggauuagaagauacaguuaauccuuggcugcauagugaguucaaagccagcccagacuacugagaccccgccucacaaaaaagaaaaaugagagguucgguuagcccuuucuaucagugguaauugaccauccuaaagaaaauauggccacugcaguccaugauccacuguaagcagcaaaccccuuucagagaugacacagucacuugaaguuaagagcuugagaggagcuucaauguuuccuaauacagagauacauuaaaauauaugcuuugugagacagcaucucucuauaacucagccugcccuagcacaccuaaucucccugccuuagcuuccccagagcuuggauuauaggcuuaggcagcugagcccagcucuauuauauuuaaagcaauaccaucugaauaccaggagaagagcaguaaugccuacagaaagcgagauuuacagcuguugagugcagccggcacugugaaguucugcuccaccgacccacucuguccucccucuaguuccuccugauggacucugggaccuccaucuuccucuaauggcuggaccccccggggugguggugguggugagcauaaauagcaagccguaugcuuucucucagaaaguuuauaaugcaucucugcugacuuccauuaaagccagccauauugcuuuauaggagucaaaggaguccacgauguuaaguguuuguggaaucuuaaaagagaggucagggugagcuagguacaaaauuuuggagauuugguuuaugauaggccuuucaucaaggggucuugacugggacugaguggugugacaguuuaggaugggaaagggaagaguuuugaaagaagucuaggagaauuuaauguuggauaagcccagaaucuugcugggggcgggggguggggggaggggggguggaaggcgaguuuacccugaugaguuuagucacuuauguguucuuuccaaaaauaggcuuugaggaagucccugccugaaagcgcgauaagguauuugcaaauucaucuuccuggaugagaauuucuugaagucggucaugcguauaaaccaagugugguagugaacgcuugucaucccagcauucugcaggcugagacaggagaaucuugaggugaggucagcccuugggguuccaaagcaggcaagcaaucaagcaaaaaaugagagacagcagcagggagugcgaaugaccacauuucauuauauacguguaugaaauugccaaggaauuuuuaggaagaaaaaggucauguuuguaugcacagcugaauuuuguucaugguaauacagcuaggcuagauuuuuaauccuauuguaugagcauaaacaugaguggaggccacuuccccuaacauuugguuuauuuggaaggggguuguuuugaaagacgucugucugugcagccccaacuggccucaaguucacgcucauccugccucagucuccccaaugcuccacacccagcuucuccaagucguuuuugaagcuguauaugacaauuauuuaaugaguaggccaaucauuugugugggucaugaccaacaaauuucauuacccagaaaaacaaccugaauaagagaccauccccuauaaacaggaagggcaacagggaagcuugcagcuuuguccuacauuauagcaaaucaaaaugccaccagauacaaaccaggccauuauucuauguaguacuaagaaugauaaaaccagggcuugggaaaagagagaugacucaguagcaaaaagcagagucaauucccagcauccacguggcagcccacagccauccauagcucuaguuccaagauauccaacacccuccucagguacauggugcugugcagacauccgugcagacagaauacccauguacauuuuuuaaaaaucucaccaggugguagugguacacuccuuaauucccagcacuugggacgcagaggugagcagaucucuuuucggguuuaagcagucuagucuacagagugaguuccagacagccagugcuacacagugagacccugccucaaagaagcaauaaaucuuaucauaaugucucauugcuauguucugauuucagagcugucgaaaugaacacagcauugaaguauaggacauuggaucacagugugaaaugaauuugguuuuugcuuguuauugcuaggagaguuugaagguuguggaagugugcaggagaggcugaacauggcugaagguggcagacucugagcacuuucugagcugugauggaccaguuacuaagagcuugggacaucagagaaagcucaacugaaagagagggcuuugccuggccucaccuuggucagguaguggcaggacaaaagacauucccaaaugagagaacagacguaagaaggccugagccugcagaccacugcaaagccugaggaggcuuugcgggaggccugagggaguugguggcagauagcuuuggugguccugccaacaguuuuaggcauuagucuuacuaaugacaucaggcaaggaauuucgguggugcagcuaauuauggaugguggcaaugauggugauaaugaugauaacagugugugaugcaggccauagaacccaaggcuucugaaugcuuagcagacugcugcugggcucccugccccacccccaaccuggaccuaguucuuugaacugaaagagcugaaagccugacaucaaugacaucagugggaaggcagguugauaagcagaacacggaagacgcaggagaaucaauugcuucugccuaacuuuccuuauucugcuaacgacacaugcucaggaaggucguacauggaacucugagguaaggcugugccuugugacuuuccuaaaaauugcugagacaaaggagccuggggugaacagacgagacagaagccaucuguccacuguaucucaccucucauuagagcacacuucacccacaagcacagguuucuaauggagcugcaggcaucccaguucauggcugaucaguccaagggaagugagugaggagggagcuugcaccucccagaggccaugcuuuccaguaaaaccagaacuugaaacacaaagaagcaaccaacgugcuccgagacucacaaggcugaagugcaccgucauggccacucuugcuuuguuuccaguguuugccaaauaccuguccuguuuacaccuuuaaccagucccuccucuagcuccggagacucuugguagaguguauguaucaagaggcaagacaguaagggguaaauacguguugugcagcuuuucugcugcccugaucaaaacaaaacgucaaaaauguuugaacucuugaggcagagauuguguccuguugguacauggaaaggaagcgugcuuagguuugcauguagaguuucuuuccuacagcauaaaaauaauuaaagcuucuuucucuagaaucacauuaacaaauugaaaagagcuuuauguuuaauacauaaaacagcuuagcagcuuuaaaaaaaauguaaacacugaccaccauauccaagcuuagcuuuucauuuuuuaugcuguuugaacaaagggcuucagaaauucaccagcauugcuaagaaaucgucuccccagcccccagccuggcaucuccccgaccucugaagaaggugagucaaagaaagacgccccgcccacccgcuagcacucccucacuuccucugcacugagauccacugcugccuccaagccagcugccccucuugaggcacacuuccuguaguaaacacucacugggcuucauuauuuuaagaguuagguaguauauuagucaggguucucuagagucacaaaacuuauggguagucucuauauaguaaaagaauuuguugaugacuuagagucugcaguccaacuccacaacaagggucagcagcagcuguggauggaagucuaagaucuagcaguugcucagacucacaaggcaagcaggagaggaagagucugucuuccuucuuccaauguccuuauguaggucuccugcagaagaugugacucagauuaaagguguguagcaccacgcccuuaaucccagaugaccuugaauuuggagauucccgugucuuaaucuucuggaauucauagccacuaugccucaagaucuccaagguuaaggucagaaacuuguaucucccagccuccagauuaggaucacuggcgagucuuccaaccuggauuguaguucauuccagauauagucaaguugacagccaggaacagccacuacagguggggaggggaaacccaguugguauuuauaacaugguggccauaggagacacaaauuagaaaucacauccuaggaacugaucucagucacaaguaaagacugugugucuuccaagcucaggaaagccagcgccaucuauaaggguguuaaggcuggagcaaauacaugcuaacccaaaguuucuaacagugauaacuuucuccccagggaagaguucagcccucuagaguuacagccuaaagagcuugauuccuccaaggcugaugagcucuggugaccagugcuggccagacuauaauaauuaagaacucagagauagcggacaaugguggcacacaccuuuaaucccagcagagacagaugcaucucuaaguucaagaccagccuggucuucgaagugaguuccaggacagccagggcuacacagagaaauccugucucugggaggaugggggaaccccuaaagaugacuuugcugagcuggauucagcccaucugguauuuucuugcugugugaauaaaacuucuggguuugacuuguugagacucuggugaaggcuuucaguaaguguugaaaauuguuuaugaauauuacaguugucagcugugacccaaacuuagggacuuagcagcggugauucuaccagagccauucaccagccagucaguguuucaugguuguaacacagcgcauaagucaugguuuuauuuuggcucaugguuucuaagguuccauggucaucugacuauugcuauggggcuuugaaagacagaaugaagcagcaagggauaagauagauccuuguagugacacuucuaucccaguggccuacucauccuaauuaggcuccauuuguaaggucucuaacacagcacacacugcuagcaccaucuaauuuugcucccucuauggguagccuuguguugacaucagaauccucauagccuaggcaccuuccaaaagcccaaagcaccagagccucgggaccaaucuccauuugugaugguuuauauaugcuuggcaacagggaguggcacgauuagaaggugcggcuuuguugaaguaggugugucacuguggauguuggcuuaagacccucauccuagcugccuggaagucuuccacuagcagccuucagaugaagauauagaauucucagcucugccugcaccaugccugucaagaugcugccauacucccaccuugaugauaauugauugaaccucugaaccuguaggccagccccaauuaaauguccuuuauaagacuugccuugauuuugaugucuguucacagcaguaaaagccuaacuaagauacccaucugaacugguggaaauuugccuuguuauuuuauagccuuggugaaucuguuaagacccucucuuaagguuucccagaaagaacucaaugcaugcuuuugaaugaugcuucuucacucuauugaacaagauaaugcuuucagcuguuauauuagucaggguucucuagagucacagaacuugugaguagucucuuuuuaguaagggaaguuauuaugaugacuugcaaucuguaguccaacuccccaacaauggucagcagcagcugugaaugggaguccaaggaucuagcaguuguucagacucacaaggcaagcaggagaggaagggucuucccucuucuaauguccuuagguaggucuccagcagaagguguggcccagauuaaaggugugaucaccaugccuggaccugggacuuguauugucccaaaugaccuugaacucagagcucuucuugcuuuagucuccugggacuuauagccacuaugccucaagaucuggaucacaggugagagcuuccaauucuggauuguaguucauuccagauauagucaaguugacgaccaggaauagccauaauagcuguguagucugcuuucuuaguauggaggccguuguauucagcaaauaguauuaacucaggcucucuucuuggaaccaaguacagcuuccagcucgucuugagcacacuucauacuaacugccguccuccuguccacucacacagcuuugugcaguuucccuuuucuucagcuuagauacauggguuuggaguuuaccacccugccggagagcuucaggacauuuucagcccagugacugugcuacaugagcucaucugccuucucagagucucgcgcucuccugcagccgggauucaugagagcucuacucugacagccccaaggagcugcugcuacccaucugguguccugaugccaccagcaucauccacgaaaucuguggauuggcccacugcugccacugauugccuucaggcaaguggucucaccccaucuuaggacagcucucuccugcagagccguucugagguuuuucaggagcuacuguguggaaagcaccuggcaacauagaaggcaucuggggcguucaggucuccagccagaccuucuucccaccauggcuuccugaaguuggccaggucuccuuccacucccuguagucauucaacaguuacucuuuaauuaccuacuuuaucuaagguagagcauuuucccggagcugggagccagcaucuguaacauacauguggccugaguuugaugcucagccaugggagagggcagguaaaaaaacauucuccaaacuuucuggguaauguaguugggaagugguuguuuucgguguuuaaugcaucaguugacuuuuaaagugguguguguauu

SEQ ID NO: 5201 - RNA, 7600 nt, Mus musculus
aauacacacaccacuuuaaaagucaacugaugcauuaaacaccgaaaacaaccacuucccaacuacauuacccagaaaguuuggagaauguuuuuuuaccugcccucucccauggcugagcaucaaacucaggccacauguauguuacagaugcuggcucccagcuccgggaaaaugcucuaccuuagauaaaguagguaauuaaagaguaacuguugaaugacuacagggaguggaaggagaccuggccaacuucaggaagccauggugggaagaaggucuggcuggagaccugaacgccccagaugccuucuauguugccaggugcuuuccacacaguagcuccugaaaaaccucagaacggcucugcaggagagagcuguccuaagauggggugagaccacuugccugaaggcaaucaguggcagcagugggccaauccacagauuucguggaugaugcugguggcaucaggacaccagauggguagcagcagcuccuuggggcugucagaguagagcucucaugaaucccggcugcaggagagcgcgagacucugagaaggcagaugagcucauguagcacagucacugggcugaaaauguccugaagcucuccggcagggugguaaacuccaaacccauguaucuaagcugaagaaaagggaaacugcacaaagcugugugaguggacaggaggacggcaguuaguaugaagugugcucaagacgagcuggaagcuguacuugguuccaagaagagagccugaguuaauacuauuugcugaauacaacggccuccauacuaagaaagcagacuacacagcuauuauggcuauuccuggucgucaacuugacuauaucuggaaugaacuacaauccagaauuggaagcucucaccugugauccagaucuugaggcauaguggcuauaagucccaggagacuaaagcaagaagagcucugaguucaaggucauuugggacaauacaagucccagguccaggcauggugaucacaccuuuaaucugggccacaccuucugcuggagaccuaccuaaggacauuagaagagggaagacccuuccucuccugcuugccuugugagucugaacaacugcuagauccuuggacucccauucacagcugcugcugaccauuguuggggaguuggacuacagauugcaagucaucauaauaacuucccuuacuaaaaagagacuacucacaaguucugugacucuagagaacccugacuaauauaacagcugaaagcauuaucuuguucaauagagugaagaagcaucauucaaaagcaugcauugaguucuuucugggaaaccuuaagagagggucuuaacagauucaccaaggcuauaaaauaacaaggcaaauuuccaccaguucagauggguaucuuaguuaggcuuuuacugcugugaacagacaucaaaaucaaggcaagucuuauaaaggacauuuaauuggggcuggccuacagguucagagguucaaucaauuaucaucaaggugggaguauggcagcaucuugacaggcauggugcaggcagagcugagaauucuauaucuucaucugaaggcugcuaguggaagacuuccaggcagcuaggaugagggucuuaagccaacauccacagugacacaccuacuucaacaaagccgcaccuucuaaucgugccacucccuguugccaagcauauauaaaccaucacaaauggagauuggucccgaggcucuggugcuuugggcuuuuggaaggugccuaggcuaugaggauucugaugucaacacaaggcuacccauagagggagcaaaauuagauggugcuagcagugugugcuguguuagagaccuuacaaauggagccuaauuaggaugaguaggccacugggauagaagugucacuacaaggaucuaucuuaucccuugcugcuucauucugucuuucaaagccccauagcaauagucagaugaccauggaaccuuagaaaccaugagccaaaauaaaaccaugacuuaugcgcuguguuacaaccaugaaacacugacuggcuggugaauggcucugguagaaucaccgcugcuaagucccuaaguuugggucacagcugacaacuguaauauucauaaacaauuuucaacacuuacugaaagccuucaccagagucucaacaagucaaacccagaaguuuuauucacacagcaagaaaauaccagaugggcugaauccagcucagcaaagucaucuuuagggguucccccauccucccagagacaggauuucucuguguagcccuggcuguccuggaacucacuucgaagaccaggcuggucuugaacuuagagaugcaucugucucugcugggauuaaaggugugugccaccauuguccgcuaucucugaguucuuaauuauuauagucuggccagcacuggucaccagagcucaucagccuuggaggaaucaagcucuuuaggcuguaacucuagagggcugaacucuucccuggggagaaaguuaucacuguuagaaacuuuggguuagcauguauuugcuccagccuuaacacccuuauagauggcgcuggcuuuccugagcuuggaagacacacagucuuuacuugugacugagaucaguuccuaggaugugauuucuaauuugugucuccuauggccaccauguuauaaauaccaacuggguuuccccuccccaccuguaguggcuguuccuggcugucaacuugacuauaucuggaaugaacuacaauccagguuggaagacucgccagugauccuaaucuggaggcugggagauacaaguuucugaccuuaaccuuggagaucuugaggcauaguggcuaugaauuccagaagauuaagacacgggaaucuccaaauucaaggucaucugggauuaagggcguggugcuacacaccuuuaaucugagucacaucuucugcaggagaccuacauaaggacauuggaagaaggaagacagacucuuccucuccugcuugccuugugagucugagcaacugcuagaucuuagacuuccauccacagcugcugcugacccuuguuguggaguuggacugcagacucuaagucaucaacaaauucuuuuacuauauagagacuacccauaaguuuugugacucuagagaacccugacuaauauacuaccuaacucuuaaaauaaugaagcccagugaguguuuacuacaggaagugugccucaagaggggcagcuggcuuggaggcagcaguggaucucagugcagaggaagugagggagugcuagcgggugggcggggcgucuuucuuugacucaccuucuucagaggucggggagaugccaggcugggggcuggggagacgauuucuuagcaaugcuggugaauuucugaagcccuuuguucaaacagcauaaaaaaugaaaagcuaagcuuggauaugguggucaguguuuacauuuuuuuuaaagcugcuaagcuguuuuauguauuaaacauaaagcucuuuucaauuuguuaaugugauucuagagaaagaagcuuuaauuauuuuuaugcuguaggaaagaaacucuacaugcaaaccuaagcacgcuuccuuuccauguaccaacaggacacaaucucugccucaagaguucaaacauuuuugacguuuuguuuugaucagggcagcagaaaagcugcacaacacguauuuaccccuuacugucuugccucuugauacauacacucuaccaagagucuccggagcuagaggagggacugguuaaagguguaaacaggacagguauuuggcaaacacuggaaacaaagcaagaguggccaugacggugcacuucagccuugugagucucggagcacguugguugcuucuuuguguuucaaguucugguuuuacuggaaagcauggccucugggaggugcaagcucccuccucacucacuucccuuggacugaucagccaugaacugggaugccugcagcuccauuagaaaccugugcuugugggugaagugugcucuaaugagaggugagauacaguggacagauggcuucugucucgucuguucaccccaggcuccuuugucucagcaauuuuuaggaaagucacaaggcacagccuuaccucagaguuccauguacgaccuuccugagcaugugucguuagcagaauaaggaaaguuaggcagaagcaauugauucuccugcgucuuccguguucugcuuaucaaccugccuucccacugaugucauugaugucaggcuuucagcucuuucaguucaaagaacuagguccagguuggggguggggcagggagcccagcagcagucugcuaagcauucagaagccuuggguucuauggccugcaucacacacuguuaucaucauuaucaccaucauugccaccauccauaauuagcugcaccaccgaaauuccuugccugaugucauuaguaagacuaaugccuaaaacuguuggcaggaccaccaaagcuaucugccaccaacucccucaggccucccgcaaagccuccucaggcuuugcaguggucugcaggcucaggccuucuuacgucuguucucucauuugggaaugucuuuuguccugccacuaccugaccaaggugaggccaggcaaagcccucucuuucaguugagcuuucucugaugucccaagcucuuaguaacugguccaucacagcucagaaagugcucagagucugccaccuucagccauguucagccucuccugcacacuuccacaaccuucaaacucuccuagcaauaacaagcaaaaaccaaauucauuucacacugugauccaauguccuauacuucaaugcuguguucauuucgacagcucugaaaucagaacauagcaaugagacauuaugauaagauuuauugcuucuuugaggcagggucucacuguguagcacuggcugucuggaacucacucuguagacuagacugcuuaaacccgaaaagagaucugcucaccucugcgucccaagugcugggaauuaaggaguguaccacuaccaccuggugagauuuuuaaaaaauguacauggguauucugucugcacggaugucugcacagcaccauguaccugaggaggguguuggauaucuuggaacuagagcuauggauggcugugggcugccacguggaugcugggaauugacucugcuuuuugcuacugagucaucucucuuuucccaagcccugguuuuaucauucuuaguacuacauagaauaauggccugguuuguaucugguggcauuuugauuugcuauaauguaggacaaagcugcaagcuucccuguugcccuuccuguuuauaggggauggucucuuauucagguuguuuuucuggguaaugaaauuuguuggucaugacccacacaaaugauuggccuacucauuaaauaauugucauauacagcuucaaaaacgacuuggagaagcuggguguggagcauuggggagacugaggcaggaugagcgugaacuugaggccaguuggggcugcacagacagacgucuuucaaaacaacccccuuccaaauaaaccaaauguuaggggaaguggccuccacucauguuuaugcucauacaauaggauuaaaaaucuagccuagcuguauuaccaugaacaaaauucagcugugcauacaaacaugaccuuuuucuuccuaaaaauuccuuggcaauuucauacacguauauaaugaaauguggucauucgcacucccugcugcugucucucauuuuuugcuugauugcuugccugcuuuggaaccccaagggcugaccucaccucaagauucuccugucucagccugcagaaugcugggaugacaagcguucacuaccacacuugguuuauacgcaugaccgacuucaagaaauucucauccaggaagaugaauuugcaaauaccuuaucgcgcuuucaggcagggacuuccucaaagccuauuuuuggaaagaacacauaagugacuaaacucaucaggguaaacucgccuuccacccccccuccccccaccccccgcccccagcaagauucugggcuuauccaacauuaaauucuccuagacuucuuucaaaacucuucccuuucccauccuaaacugucacaccacucagucccagucaagaccccuugaugaaaggccuaucauaaaccaaaucuccaaaauuuuguaccuagcucacccugaccucucuuuuaagauuccacaaacacuuaacaucguggacuccuuugacuccuauaaagcaauauggcuggcuuuaauggaagucagcagagaugcauuauaaacuuucugagagaaagcauacggcuugcuauuuaugcucaccaccaccaccaccccgggggguccagccauuagaggaagauggaggucccagaguccaucaggaggaacuagagggaggacagagugggucgguggagcagaacuucacagugccggcugcacucaacagcuguaaaucucgcuuucuguaggcauuacugcucuucuccugguauucagaugguauugcuuuaaauauaauagagcugggcucagcugccuaagccuauaauccaagcucuggggaagcuaaggcagggagauuaggugugcuagggcaggcugaguuauagagagaugcugucucacaaagcauauauuuuaauguaucucuguauuaggaaacauugaagcuccucucaagcucuuaacuucaagugacugugucaucucugaaagggguuugcugcuuacaguggaucauggacugcaguggccauauuuucuuuaggauggucaauuaccacugauagaaagggcuaaccgaaccucucauuuuucuuuuuugugaggcggggucucaguagucugggcuggcuuugaacucacuaugcagccaaggauuaacuguaucuucuaauccuucuggucuccaagacagggaucacagggguacaacaacaagcucucccagccuuuugagacagggucuauuauauagcauaggcuguccuggcacuacauagacuaguuaacucaugugccacuacucccaggcaaacccugugcuuuuuauaucuaaguuccuaaauacuuaaauuucaucuaagcacuggaagggcagcuaucuaccuuucucagcacgccuaugucaaacucuggcuggucucagcgaucucaacaagccagccacccugcugacugagcuuuugcucaguuuucccaggaccccucacucauucaccucccugguuaccgcggaugcuucuagaagcagccaacggaccccggggaccgaucccaggggccuucccaacaccacccugagcuuaucugcucaacaaucuggccuagcauauucgccuucgcccacuuccucccgacagcacgggacccagcagccguucagacgcucgcccugucgggucacuugguacgacacucugggcggugguucagcugaggccgggguguacccgccagcaggccgcgugcagcuccgaccgcccccgcggcgcgcgcagucacg

SEQ ID NO: 5202 - RNA, 24947 nt, Mus musculus
acuugccuuaaauguuuuauuacaaucaaaauuucacaaacagaucaauuaaucucaaucaaaauaacucauguuuacauuguauuuauagacaagcuguacaauaaauauauaaaacgcauucacaguuuguagcucagucaucuucuucuucuucuucaucacugaucacauacuucuuaugcuuuuuauucgcuuugucaucgucuuccgcuuuccucuuuccagaagauucaccuuccugaacagauaaaaacauuuacagucugaaaguuagaacauuucuagggaaguuuaucaaaauagcugaguugaaugacucauuacuaaaguaacuuuaaauaucuugcaguugcucguuucagcagcaacagcacguguacuaaaauuggaaugcugcagacaagauuagcuuggucccugggcaaagaugacacauaaguagugaaguguuccauauuucuaaaaaagaaaaagagugcgaggcauggcggugcggggcauggcggggcaugccuuugauuccagcacuuggaaauacaggaggcugggacagaggcaggaggauaucugugagguacaaacaagccuggucuacagagugaguuccagcccagccaacucuacaagugguaaaaauaaauaaauaaauggugauaaaauaaaaagauaacuuugcagaguucaagcccagcauauuaucuuguacagggaaaccacuguagacacaaaaaaccacaacaaccugggcuauggggucugcccuagaaaagguuaggacccccucaaagaagcacgagcacgcacgcacgcacucgcacacacacacaguuucuuaaaugaagauucacuuguccugauggaacauuuucuccaugaucagguacuuaaucaacaaucucucuuuucucaguauuccacuucuguucccuaucuaaaauuuauuuuuuuuaguaaguaucaauuuuuaaaauaauuuuuguuuggauacauuaaaaucauaaagguuuuugagaaaauauuuauagacaucaaaggccuaucuacacagagaaucuauuaaauucuauuaaaucuauuaaauucauuugcacaauccucuaacagcaacaucauguaggagguuuucuagagaagcaguuucgacaggcagaauucagcuucacauuuaagucaacacccccucaacaacuuugacacuggcugacacuucagaacugucacacacacacacacacacacacacacacacacacacacacacacacacacacaccccugaguuaaagacaugagaagcuggauuacauagaccagaggcuggcugcuggcaggaugagcgcgaccuuggacugggucccuagcagaacaagaccaacuuccauggacacacagucagggauggcugcagaaugcuucaagaugcaacgcggcaugcacacucauuuccugaucuccuuggcugagccucugaagacaggcaacacccugcacuuacuucuugccuuucuaucccaaauguauuccuauagacugggcgugccacagcagggcucaacaaaguuuggaggccucacaagagcuggcggcaguaaagcaaacucuguaagaauacuggaagauggaucaugccuccaggaugugacaagucgccuccuuuccacuccucagccuagaguagacccagcuccuucucuugggcccccaucgagagaggcaacacugacuucucuucccacuggagaaucuugcacauuacagccugcacauaaacagguuguuuggugucuagcucuaaaacucuuuaaugguagacauuagaucugagcggcugaaagaacuggcaugguacuucuaaaaauguguaagguuuuuccaaaagcucuuagacaagguacagcaucagcccaaggucagggccuccuaaggaagugccagguccagcucauugucaggguugagcagcuguggaaagccugccaagaccgacugauucccuagaaacuacaugcaacaugggggccccagaacuacaacggagccgucaggaugaccuuacuucgagcaugcagaaagcugucuuacugaacacagcugaaacaugccccugugccauacauacugaaacaauaaaaacaaaacugaacuagagcuugauaaugcagccaugaacacggguuccuacagacacaggcagcugugacacaaggcagagcaacgaaguggguuucagaaaggagagcagaagagggaagaggggagccaggcccuuccgacaaaccuuucccaucuucacuuuccagccuccaucugaucaguucaacucaguguccccuuuucuuagcccaacccccuccgggaacagagaacaaggcaaucccacucucugaauuucacugccuuugaagggagaagcaggguuucuacaggguucccugugagcaaaggggaaggcgcaccccccuuuuacacugcucuccauuuaggcuggggaaagaaaggcagugucccugucagucucaaggucaccauguccccacauccuacaguacugacuacaauacaguuagaaggcacucagcaaaaggacagacucagggaagacagcugccuugccccguggcaugcaaaugagaacuggaaggauggguagcccucacauucaaugaugcagcugaugauaaccuuuuucccccccacauuuguuuuuugagacagaauuucucucauucauagcaaagcuguccuggaacucacuauguguagccucuagagagcuaaccuaacuugcccuuacccuccaaggccuguucuggcaaagcaguaguuccugauauggguggguaccaugacgccugaacucuccccuacaucuuagaagcgcagcccgguuccuggucuuugaggggauuuguuaugcaaacagcaggaagguugcucucaguccucacugucacccaccacugagcugccucauaggaggaggcagaggugugugucugucaggaaagguacaagagugcagagauucugagagugugcugggggaccugggggaggggcugcuguaagagagcuugaaggucacccaggcguguuuaagccacaggucuucguguucucagcccagccagccacaggggaagcugucaggcauauugcuuacuagacauaaacaguuccguggcacuugucaauucucacagcucugcuugccaaggaucaagcagcugcuuagaagagagccccuguuugccaacuguucaucacacuguaaacacgcuauugagaugcugcuucaucuaacucacacaaauauggugcagaauaacacuaagaaacucugucgguagcaagcuagucccaagaacaucacaaaauauagaugcgguacucaacaauaaacuaagaacauacuuuugcuucacaugagaaaagaguucauaaaaucccaaaaugaguaaaucagcucuaaagcaaaacaggaaacuauccacugcuacauacaauauggcagaccaguacucagaacagcccucucacugaaaacagcgagcgaggauggcaaggcaaagcaaagcacaccagaggccaaaacauaagcggaagcaagaaggcagagcaaagcaggcuccuccucggagacacugagcuaugugaucucuccggguggccagacaagggccacaagccuucccuguaaaagcagacugggguagaagccuagcgcugguucucugagagagggguuuacaaacuuaaaguauuuguguaguacacuggggcagggggcagguccacuuguacugcagugugcauggagaggucagagaacaagcuguggcagucagccguuuccuuccacucuguggauuucacagaccaaacuggguugucaggcuucacagccaaaucaagcacuuucauugaguuaucuagagagacuucauucugggaacaguuucaggggccuuagccagcugacgugcagcgcaccuugcagagacacauacaaauaagccaggcccggcagugcaaacuuguagugugaaucucagcacuagcaggggucaaaguaaauucaaggccugccugaacuacacgggaauccaaaaaccaaaccccaaaccaaaucaaaccgaggaaaucaucuucagagaaaugaaucuaggcaucaaaaacuccuguggaggggcuggaggagaagggucagaggguaacagcacuugcuggucuagcaaagaaccuaaauucgguuccuaacacccaugucaggaggcuuacaaaccugugacuccagcucaaggggaccagaugucuucuucuggcccuuguggcccccacauacaugugcucacucacauacacagagacucacacauacagacacaaauaauaauaagucuaaaaaaauucucaugacuaucaacucaguaaaccaauccaaauuaaucauuagaucagagaauauaaaaagaaauaugguaccguauuucuuugaaggaagaaauaaauauagccagaaaaaugcccuggucugucuugggcuucgagacccauaggcugaaaugcuagccucugagaugaggagggaucuuggaaggugaggguuguauuaacugucucucccuaggauugaaauauucuauucugcgggacgcuucuuaagcaagaacaacuccaaacaacuucaggaagucccugaaacugaccagauucacaauacccauuccuaaaaaguaagcaauaaaagcugagucccucucagaggaagugacucugagaugagcagagcugccaagacugugacaagcucuaagaccacaccagccaccuggaagaagcaaaacccaagcaagcugcuggaaguuuagaccgauggaggucucuggaaaggacacuccaaccuguugagcugccugcagaccaagcagugugcuaccccagaucccagcaucugugggugggccuuggcaguggaguugucguggaguugucuuugagucacaucugguccugguaguuaaccccaguagagcucacuaguucaccaaauugagcuuugguggugucuggacauuggucugucaugaguuuccuaucuggggugagaagaguuauguuucuccagggaaaguuuugucacacaagaguaaccaugaaaggaguggguacuuacacaaacgugagcccagagccuggccuaucccaggcaguuuguggacuaggaccuuucugaagaagucuuuuugucuauccuggaacucuugucaccccaggaaccaaguccuaaguacaagguaagccucaaauucagaacauguggcuuaccucaucacuguugagcuucuuugcuuugaguaaccuuugagcuuugucuucuucggagcccucaucacuguccgaggaguagauucuggcucguuccucugaaaacaagggauugcacagagucauuuuuaaagaaucuauucauuuuugaauuuucccuccaauaacaccuucaguucucucuguacauuucccacagaggaagaaaauaguauguauuugucccauucuucugugcugugcucaugugcuaugaacaugugugcacauacauguggaggugucaggacucagccuccgccacucuucuagcuuauuuagugaggcagggucuuccugcaaacccuagagcucaccaauacagcucgucuugccagccagcuugcucugggaauuuccugucucugccuuccaaagcugaguuauagguggccccagguggcaccacccaguauuuacacggguucuggggaucugaaccccaguccucaugcuugcauagcaaguguaacugagcauccucuguuccaguuuuaacuuuccuuuuguuuuaaauauguuaaaaugaaccaggccgggcagugguaucgcacgccuuuaaucccagcacuugggaggcagaggcaggcagauuucugaauucgaggccagccuggucuacauacagagugaguuccaggacagccaggguuacacagagaaacccugucuugaaaaauaaaaaaauaaaaauaaaaauaaaaauaaccaagacuauucuuuccuaauagaaugccuucccagcucccuauauuauugcuaggugaguacuguacuaugcuaagaaccaacgaccaugccuaccugguuuaaaucucugaugaacugcauauuaaauacccuaauccuugaaugcaucucuaauauucugcaugaaaaauguuacaguuaagauuuuugugauaggucuggagagauggcucagugguuaagagcauugacugcucuucugagggucccgaguucaaaucccagcaaccacaugguagcucacgaccauccauaaugagaucugacugcccucuucuggugugucugaagacagcuacaguguacuuacauuuaauaauaaauaaauagcagggccggagaaagcagagauccugaguucaauucccagcaaccacaugauggcucacaaauaucuguaaagcuacaguguagucauauacauaaaauaaauaaaauuuuuuaaaaagauuuuugugauaaauuagcauuggcaauguaaagaaagccacuguacuagguucucaaaauaaguagggaagguauaacagggcagcagaacaaauauagcccugcaagauaaagggaaacuuagguguugguaaaccuaucacucauuugggaccaaacauuaggcccugaguuuuauacccagugacacacauaacgaaaagcaucggcaacccucauuucucauuuuacagacaaggcaaaugauauucagaaaugagaagucgcuuucuugaaacugacgagguaagagaagcagcuuuaagaaggcucaugcacaauacaccagugucaugcacgacacaccagagucaugcgccgagcauacuccuucacuccucagcccgugcuccaggcaccauuaguagacugacuuaguccagacaacguaugagaaguucacagggguauggagcccuucugaagucacuguuaaaaugugucggaaugagcugggcauggugaugcaugccuguaaucucacucagggaccugaggcagagcaaguucaggaauccaggcaucuucugagucugcuuuucuuucuuucuuccuuccuuccuuccuuccuuccuuccuuccuuccugcucccccccccucgucuuccuuccuucuuuucuuuuguuuguuuuguuuugguuuuuuugaaacaagguuucucuguauagccuucgcuguccuggaacucacucuguagaccaggcuggccucgaacucagaaaucugccugccucugccucccgagugcugggauuaaaggcgugugccaucacugccggccuuuccuuucuuuuuuaaauacauuauugccuuuauuuaauguguggguguuuuuugugcaugcaugucucuguaccauuuaugugccuagugccugcagaggccacaagaggacaucauaucuucugggacuacaauuacaaccaugagccucaucaauaagagggaaaacaucagagcacugcucagagaucaagcaggcugucucaggugugccuggguucaaugugugcuacauaaacaccaagcacgaugaaaugaacacugcuaggagggcccugcaaagcugacgggcagaagcaaguaccaugugcucucaauagcuggauuucuuuauaacugucaacuuagcugaguaaggaaguuuaugccuagaauacagcagcauuugagaagcugaggcaggaggauugcugaaaguuugaggacagcuggacuagaaugagacccuuccucaaaacaaaaacugucaaccuuucaaacugaaaaccggaaggucuagggguaaauuuggauaaggccugauauauacacgugccugcaaccccagcacccaggacacaggcagcagggggccgugcaaggagggacuccaaagacaaaacagcuggaagggagccacgggagguccugcccuuccaggauggccucaaacaacuaacaaugauggucuuacugagaccuagccggagacaguaacacagacucuuuaagcuguccaauggucaguggucagcgcaugcgcaagugaacacgcaugaugcggcuuuacaccacacucaccgcggaugcccccuuuguagcgguuuuuaauggcagccaggcugacggacuccucgccuuccuccuccucgucguagcgaucaggcuccagguagcuggcgcucagcccccgcuggugcuguuucucucgcauccggcgcugcugagacucccuccugauggaggcccucaggcguucuucuucuuucuauaagaaagcaauaagcccuucugcuauggcuugaaagugaccccaauuccacuggaagcuaaaucccaagcuagcuaauucauggguuaacugguaaauuaaugaagugaugagcuguugugggacugaccacuacagaagccagccugcugucuuucacucugcaccgccauggacaguuucuaccaugauggaacacaggaaaaaggccuuucaucgccacugcucccuugcucuuggauguucuuagucaugaaaccuuuuuuuuuucauuaauuguaucuuacuuauuuugauuguugggaguaggucagcuuaugagcgcuggguucauccuuccaucguguaggugcuggagauuaaacuuggguuguuaggcuuaagguggaauaaacuucauaccgugcuucuuugucaaggucugagcagacaucaggcuggccgagaacucacaauccaagaaugacugaggcucuagguuuaauccucagcaccacagaacaaaacucacacagcuacucugugggacucugcucuagauccgcuacauccccucuuuagccugcccacugagcucugacgggacaagcugcuguagaugauuuagugguauugauaugugaaaacucugcuauuucagugaccaguuuuguggaaguuuccagcccugcugggagacaacccaagagcuugcaucuacuuuaucagcauccacacaucuuuccacuugauaagagcuuaggaaaguaaccuagcucgugucauuggaggagggaagagaaguccaacaagagacggcgaacagaaaacaacaggcgguuggggcaaucuguucuuaaugugcaaagcugcuccaggguaaagccuaggcaacuuaccuuaaucaucucugugcgcuggcacucagggucacggccagccauugguaagauucgaaucuucugugucuuugagcaucuaucugcaagugacagggucaucuuccuguguguggcacugucuguagagugaggccuguggaaaaugaacagaaacuucccacuguuucucauggauauuugugagccaucagacccacaucacaaaaacacaaagucagcagccgcuuccuauccaccaaagaagaguuuagaggccagaccucuaaccugaauauucuccuuggaggacagaacacuuuccuuccucuaauucacugucaauccucucaaccugucaguugugaccuuuaggggccuaaugacacuuucacagaaguugcacgacccuuauacagggccaugcauaaaauauccugcauaucagacauuuacauuacgauucauaacaguagcaaaguuacaguuaugaauaguuuuaugguuggggucaccacaccgugaggaacugggaagguugaaaggcaccuuucgagcucaaugagacaggaaaagugaaaaggaaaagugggggccagcuugucaggcagggguggcaaugagacgggaaaagugaaaaggaaaagcgggggccagcucgucaggcaggguggcgccccuuugagcccagcaccugggaggcagagccccgcaaaugucugaguucaaagccaaccuggucuacaacgugaguuccaggacagccagggcuacacggagaaacugucugggaaagaaaaaggugugggguguggggugaagaccguuguacagcaugaccccaaggcagcaaacaggcaggcccgaguaguguugugcacaccacaccacacagcuacccacaaucucacaaaaucaaagcuguccaaggucacgagcagaaacaguugaagcaguacaauucugaaggucagagcucccuacagagcagugucacccaggaagggggucugccuauccccaagggaggaugacuacaugugcccgcccaggggacacauucccacagaggccugccccaacagccccaguauucacaucccccagcucagcgcccuuccucuggcacuggcacacacaagcccuaauuaucaguuugucucuaagucaguuuuccugaaaacaaaaggauacauuuggccagcacagacaagcccuuuaggauucucggcaggcaacuaaaauaccaacuuucuguuuuacaucacagccuccaagaacgcagccucagcuguccuugacuaaagccucugagccuccagaacugagaaccucugagccaccgagcuacagagcuccacugggggcgggguggggcgggguggggccggggaggggccaggcuucacaaaccaagcagcaggaccaagagcgcuuaccugaaggugagcuucguuuuaaagacggccugccccugcagcccaguaccuugucuuaugaaaagaugguuguggucgcccugcaguggggcuuuguacacaucaaacacuucauucccuaaaugcagggacaugcugaggaaaaaaaagaccucacauauuaaauccaaggcuuucacugcacagcuuuaauuacugaaaaugugauucaaucaguuucucucuuuacacagaaugaagaaacccuccaugcuggggaaaaugaccugacagaagucacaccugcugggacucgggcccagccccacuguguucaggaaaggauacuuucccucguguugcgaguaguauucaaugggguuaagauucuaaaccuacauuauguuuaguuuauugucucccaucugccccccagcagagcuguagccauuuuguuccaugcccaccagcuauuucauauuauuacuguagugugccugccagucacugaugcagaaaaauaaccugacacagaacagggucaugcugaccacauacccuguuagguucuguauguuaugaaguuuguugaccuuaagaaauuccacaacuauaagcuucauguaggauccaucaaguuaaaggucaacaugaacuguugugucuaaaauggcuugagucagggcagaccgccaggcagaccucccagcaccugcgugugagcucacugugguuuugcaguuuuagcuuucauaucugacauuaaaaaguauguucaggguuguagccucagugcgcaaauucugagcuacggcccuaacuugucagucuuagagcaagcaugccuucaauaaaccaucccugucugagacugcuguucaugugcuuugugggguggcuccuggaccccgaccccaacaagcucaaaugaccaucucucucagguuuucugugcagucacagggaguaacuauuggggagucucuaacaagagccagccuccugaguaagguccaagcccagaaccuucucuccuccuccugcucuggguacucaaugccaggcauuucuuacucaccuuccaucugaccacuugacgauccgcgcauugcuuucuuuaauuucauuuccuucuucaucucugcguauccuccaucuuauaguguuuucuaccuguuuuaaaauacggaaccuuagaaagcaagccugugggauuccccuggagagacgcagccagcgaauaaguguguguggugacagagcagacaacagugaggcccucuggggucaacgacaggagagacaggguugaaaugaacuuuggugcugugagucuuacgaucguaccuuacagccagagcauuugaacagacacaaagccugcacugcacacgccugggaaaucacaaacacaaaaaaagcucugaggcacaggggacaaagccugagcccugaagagguugaaauaagacacaucuggagaggacuccaucucacagaucuaaaaaccauugaaagugagaccaagacccucugccuucuggcccccucgccacacaugcaggggcucaucaccugcaggauggggaagugccagauuuagaaaaugagucaccaguacagaaauuaaagacuuaaugggccuuccaggagaacacagcacaucaaaugcguggguuuugucacacuacauccuggaaacacuaaaacagcagcagaagggggaaauacacuggcucacuacaaggauuaaaagaaugagaacaccccaggugugguggugcaggcuuugcuuccagggcaugggacgcugaggaaggaggacagcaggucagaguccagccugccagccugggcuaaaagggcaggguuggaaugaagauggggauggcaagaaggagaagcaaccacgcugguccacgcaauccccccugccccucccaucugccucagcuccacagcuuucuguacagccacucucgaaaacucccgcuuucccauguaccaauuccucacuaaacaagugacuacugagccagcuaagcaaagacuugauagcauuagacgggagagcauuucugagauaacgccauaacuaucuacugaaggcugggugagaaauauugaaacaagaguagucaagcugauaggcacauaauuaaaacauuccuccuguguuuauguggacuuggaauuuuaguaagaauuaaaaugaagcuggugagaugguuuaccagguaaaggugcacaccaugccacuaagccuaacaaaccgaguucaaucucaaagccuugcuggaaagcaccaacuccuaaaaguuguccucugaccucccaucuacacaguggacugugaacgcucacaccacacaaacauaaauauauguaauuuuuuuuuaauuuaaggaauugggucugugggaacacccuaggccuggaaugccacauugagaggccacugcagaggguauaggcucacucccaagucccaagaucacccacuaucuccuugguucacccaucaggguuguaagaaaaugucagacaaaccagacaugggggaaauugccagcuucaaugagaccaagcuuuaaaaaaaaagaaaaaagaaaagaaaagaaaagaaaagaaaagaaaagaaaaaagaauccugagacacaggaaaacagccugcagcaaaaccaaacaaaaauaaauaaagaaauuagaaugaaaaaugugucacuagcucuguuuccccucuaugaacaauacauuagaguaacaguugguuuugucagcuuggcucagagacaaaucugggaggagggaaucuuagcugagaaaaugccuccacaagccuggccugugguaaggacugugguguauuaucucgauuaaugaucaaugugggagagcccagaucaaccugggcaauaccaucccuggggcaggugauugauccucaguuguguaagaaagcaugcugaacaagccacgaggagaaagccuguaagcaccacuccucuauggcuucggcuucaguuccuacuuccagguuccugcccucauuuccuuucagugauggauugugauaugaaagacuaagaugaaauaaacccuuucuuucccaacuugcuuuugggcaugguguuuuauuauagcaauagaaacccuaacuaagacaguuagcuacauauaauauacaaacacauauauaggcauugucuuaguugcuuuuguauugcugugauaaaacaccaugaccaagacaaauuaugaaagaauuuauuuggggcucacagauucaaagaacuaagugcccaugcccaucauggcaggcaacaggcaggcaguaauggcauuggagcaauagcugagagcucguauccuggacaaacaagcacaaggcagaguguuuaucgcgaauagugugggauuuugaaaucucaaagcccacuuccagcaacauagcuccuccaacaagaccacaccuccuaauccuuuccaaacaguuccaccaacuacggacaaaauauuuaacuagaagagcuuuuggggaccauucucuuucaaaccagcacagguaucagugacugagaagacauuuugaaaguugccuuugagaacacacuaugaggucucauucuacagaaaugaagcacauggaaauacuucuaaagacacaaaaucucacagagccacacagcucagcccugguucaucaaugaacuaacuaugccaccaguuaacuaagacuguucaccuugucucaaccaucacucgagaaacacagcauccagggauacucugaauuacagcccgagagucugaaggagagcucgcuauauuaaacucugacacuuugcacuuggaagcacuugagguuuugcagcaaaacagugaugucuaaacugugauucuacacuggaacauaugguggcuauacugcuauuuacugcugcaccauaagagaaaacagaaaaaugccaaaaugauuaaguuaaaaggagcaaagaacuaccacauuaauuuauauaaaugauggaaagaaugaaaaacagaacaauuacgucagaggcauugaaaugaccacgaaaaauuaauagcgcuaacucuaaaucaauacacacacguucuaagcaaauaauauugauagaugauugauagcagugcagagacaguccaaaccauccaucauucuaaaccuacucacuggaugaucuugaacaaauuacuggcauuuuccauccccguucucaccugcuccacaucuccacaguggucauguaacagcucuagacaccugugcccuuagacaggaaccaucuuuaccacuaccaauguuaaccaccaauguuaccuaggcacuuaugaagcuguugugugaagaauacaguacuacagaaaaugaagaagcucaaccucaggcagauaacucaugccuguaaucccagcacucaggaggugcaggagggaagaucaugugauuaaggccauagugagucccugccuuaaguuaaaaaacaaaaaacaaaacaaaaacaaaaacaaaaccaaguauaagggccuagguucaaucccagccggcauguaaguaaccaaagauacaccuccauacacacaaaggcucagaguucaguccccagcuccaaaaggauucugagaagacagcucacucaguugaagaacaagaaacacaaaagagggcuggugagauggcucagugaguaagagcacccgacugcucuuccgaagguccgaaguucaaaucccagcaaccacaugguggcucacaaccacccguaaugagaucugaugcccucuucuggugcaucugaagacagcuacaguguacuuacauauaauaaauaaauaaauaaauaaauaaauaaauaaauaaauaaauaaaucuuuaaaaaaaaaaaaaaaaaaaaaaaagaaacacaaaagaacaucuucaaagcucaagucucggguaccuggugucuaccagauugacucuauaaaaagcaaagcaaggggcuggugagauggcucagcgguuaagagcaccgacugcucuuccaaagguccugaguucaaaucccagcaaccacaugguggcucccaaccauccauaaugaaaucugaugcccucuucuggagugucuuaagacagcuauaguguaguuacauauaauaaaaaaauaaauaaauaaauauuaaaaaaaaaaaaaaaagcaaagcaaagucugcaugguaccuucaauuuuaaccugguucuccccucuucauccagcaucuccucaucuucaaauucaucuucauaauacugaggaucaaaaggccuacaaaguguauuuuuaaaaagcuauuaacauuucauaaacgauacugccauaauauaguuauaaaccacauaucaaauauauuuugaagcucaacuugaaagaaguauucaaaauauacuaaaauuuaaaauucugaugcuguuauauauuacuugaaauaaaguacaaacagggcuaaacauuccaaauagcuggguaugguggcauaugcuuuuaaugccaguacuugggugaguuucaaguuagucuggucucugacugaguucuaguccagccaggguuauauaaugagacaaugucuaaaagaaaaaaaacaauuuuuucucaauuuuucauauuacauaagucuuccaaagaaaaaagcaucuauggugcagcuuccuacaucauuuucccugugggggaacuguguaaaugaccucagugaggauuaacuugggaaucuccaucagcauggcuucacuacagugugacaagagcugcacccguggccagcagaccucaaggcuucccacagcagugcuguugggcuggaggaguuacuaugugucuacucauccccaagagaguaucaaaccccuaaccacaggcaggagaucucccugaugcuuuccuguugugggaugccugacugacuuuuucagacacauuucucuacuagucgacugaaugaaaguaagcaaaacauguucauguauacucauauuucuuuucuuuuuuuuuuuuuuacuuuuguuuuguuuuuuuuaagacaggauuucucuguguuacauacagucuuggcuguccuggaacucacucuguagaucaggcuggccucaaacucagagaucuacaugcuucuaccucucaagcgcuaggaucaaagccaugcaccaucaugaccagcgaacacccacguacuucuagccaugcaccaccaugaccagcuaacacccucguacuucuagccaacacccagaagacauccuaauguccuuaccugggcucuacacugaggaaguugggcaguuuaacaaaauauaagucauugcccaaguccguguuuacuuuggggaucuccacuucuauucuggucucagguaugggcucuuccuccugcugauccuggggcaagccauuuucauccuaagugcaagaaaauggaaaguuagagcugcggggaccaggugacguccaguucaaguuccacauuucauuacguaagggaacaagaaacacugucugguuuuuauuuuguucuguuucauuugaaacaggggcucacucugucguccaggguggccuagaacucacuaccuaguccacgcuggcuucaaauucacagaaacucuccugccuccacuuucccaguacugggcuuaugaguccagcaagaaucauauuuagauacuauucaucaaucuccaagcaucucaggagaagcaagcagagucucgcugccuuggggcagagcuucuaugaucaguugucuccccagccugucccugacaaauguucaaucagcuggcuccuauguagccacucuaauggcaucagagaagguuacucacacauggugaaucugaggccagccugggauacauagcaagacccugcuuccaaaacuaaacuuaaaaaauaaaaaggaaugaagaaaaaauuacuaacaaagcacacauuuacuugcaugaguaagaaaaacaauuaggugaaaggcucucaaauccuggguguucauggucuugccccgugaggcugggcaccucaugguagcugcacucacuuuuccuccuuggaaccaaaugcuuccuacagaauuaagaaagucaucuacugccgggcaugguggcuuuaaucccagcacucaggaggcagaggcaggcggauuucugaguucgaggccagccuggucuacaaagugaguuccaggacagccagggcuacacagagaaacccugucucaaaaaaacaaaaaaacaaaaaaagaaagucaucuacucauuauaguuccauacuauaauuuagauaacgacuuccucuucuuaagagagaaagagguccuuccccucacuugaauaugggcuaacucaugcuacuuucacuuaccacaggcuguccuggaguugggggcuuaucuucuccaucacucccugaagauaugucaucugcaccuccgaacagauccaugguuccauuauuaucuucagugcagagggaaaaacacagaguguuaacaucuggucuucauuugaacaucccuaagauuucugggccagcuccaagaaauggcauaaauccagaucuugagcuuggguagggaggcaaagggcacuguggcaugugcguggacagacaggcacuguggcaugugcguggagagagaaagucacuguggcacacacauggaaagauguguguggagagguuugcacacugcacaggaagcucuuuuucccccuccaucucugcauccuucuuccaguuuccccuucuagcgaggucucauucucacaagcagagucacugaggcacccaucaagacaauaaugugcguaagccagcaaagcaaggugaggcacgacagcaaggaaacaggagacagaagaguuuuuucagagccagcugucuaaacaagccagaauuauugguagucacauggucuagaauaaaccuaugagacugaguuagagagacguggcaaaagacaugccacuggacagcaaagcaaaggugaccagaguacuggacgcucauuaugcgacuuccuguuuaggaggugagcacagccauguccuucccauaguccccuuagcucaugucaccagccagccacuguacacguaugugguucacuugucucagaguaggcacacccucaccaccagauggcaagguauaggacaugacuuagaacggcagccauguacagcagagccucaggaaacaucagucaacaacggacacagccuaccuaauucucaccgcucuguaagagggucugcaucaccccauuuuacaccuuagaaaacucuggggagcuggagcacuggguuauaagaggguuaucuuuaaucaggcugcagcacugucacuuacaaaccguucagaggcucagauaaauucacugcaacaaacuguaacaacgaagcggguuccuaacagcaugagcugcagaguacacugagcacacacacacagucuucugugaguccugcagucucaaggucugccagggcacgacaguuacaagcacagagagcuaugaagcagaccugcauacaagguaaacgggcuaccuuugggcaccucggugucgcugucugcuucggaauccgauggaaucgcguucuugcgcuucagucguaaaacuucaucuucacugucacugccucuugcagauucuaaaagagcagaguuagaagguguacacaaucgcauccgagcuuccuagggaaacugugcagccacggauagaaaaggacaaugagggcuggugagauggcucaguggguaagagcacccgacugcucuuacgaagguccgaaguucaaaucccagcaaccacaugguggcucacaaccauccguaacgagaucugacgcccucuuguggagugucugaagacagcuacaguguacuuacauauaauaaauaaguaaaucuuuaaaaaaaaaaaaaaaaaaaaaaaaaaaaaagaaaaggacaaugauacaucgaacaggcuggauccggcuaccacacauuaugcuacuccaagaaaaccuaaccuggcaaagucagugccugucauccuagaccuaaugaggccgaggcccaaggaggcaagagcauagugguagaacaggucaguaugcgaugagguuaggccagggucauggcuguaaaauaggucucauaacacgcuguccugugucaaguuagugguagccgcguaagucuauaaacgugucaacacaaauuaaacugcacacaaacaagaguagagguaaauaugaaggaagagaagagaaaacaaaaaugaaaaacaggguaauaaagaugggaauaaaaaggaauagagagauggcucagugguuaaaagcacuggcugcuuuuccagaggaccuggguucaauucccagcaaugagaugguggcucacaacuggcugcaacuccuguuccaggggacccaacacucgguucuggccuacgugggcacugcaugcacagacauacaugaagggaaaauacccaucugcacaugaaaagcaaaacccuuuaaaaagacacaaaaugggcuggugagauggcucaguggguaagagcacccgacugcucuuccgaagguccagaguucaaaucccagcaaccacaugguggcucacaaccauccgcaacaagaucugacucccucuucuggagugucugaagacagcuacaguguauuuacauauaauaauaaauaaaucuuaaaaaaaaaaaaagacacaagaugcacccagccaacuguccgcccaugaacguuuuaccugacuucuggucuugcuccuccucaccgucugaacgccuuccaucuucaucugagacuuguggccuuucaucgucugaguucugcauuuucuccucaucggacaccugcggcugguccucaucguccgaauucugcuucuccucgucauuaucagaagcuacuggaugcucaucgucagaauuccccuucuccuccucagacagcugcugucugucaucaucagaaaucugggcccgguccucgucaucuguguucugcauuuucuccucgucgucgucagaguucugcagcuuauccucaucggacccuugcucccgauccucgucgucagaguucugcagcuucucgucaucugacuggucacuuuuauccucuccaucccauuucucaucaucugacugggcuuuuucagacccuucugccucugagugacggcucccuucguccgaccuguggcccucaucgucgucaucguugugggcuucagagccacugugcugguccucgucagagggcucauuauccucguggucagagcgcucggaagccuccgaccuauugucugaccguucagagugauugucacugccacugugaugagaggcccccuccuccucacugucguccccgaacaguuccuuguuacugggcuguccggagucaccucugucauccugaucacuuucgcugccagaggcguugcugccagaagcgccguuguccuggucagaguccgagucggacucagacucggaaucugugggaucguguaaacacaaaggaauaucagcagagcgaggagcucuagaaguccgucucaauuugcuaaaagacaaacagaaacuggcaaggcugcugaagccaacgcucucacuguuccagagacaaagaagguucaaggaccagaagguucaguuaggacaacuuagcagacuugcaguaagcaggcacacuagcucaaccucagcaacccagguagcggaagcaaaaggaucaguucauucaaauaggaggccacccugggcuacacaguaacucccaggccaucuuaggcuacagagugagacccuguuucaaaaagcugaacuaacuaaauaaacaaaguagaacucuucauguuuuaccucagaccccaccacugccuaguucuuagacaugaaauaaaacaguaagcagcccuacauucugguacagggagcacugcuugguucagagugacauccccgccacugugaugagagcccccccaucuccuccucacugcugucaacaguucuuuguuacugggcgguccugaaucaccucuuucaucuugaucacuuucuugaccagcagguaguggucccuguacccgaaaugcagcaggaagagaaaagcaaacagagcagaaguauagaaaaacaauuguacacagucccaucagagcaccacauaugcauuauggagugaagaauguaguguuuugguuuguuuacaaaccccaguuaugucauaugaguauguuuuuguuuaaucccagguguggacuauggggcugcuucaguuugccugcagccauuaaccaugauugucuccugcucuaggaggggugugauuuuugccagauaguuuaacucuggggacucuggggaggguauagacacagagccccgagagagcagagggcacucugggaaagcugcugcuccugauugcugcugcgguuuguaaaguaaucaugaacaaagugagcaaagagaugaaaagaagaaguuguagauauccugaugacagagaccggauggauccaaggaccaguaugaccuuaaucaguacaaagucgccuacagaggucugcacccccuuuucccucuuucucaccuucuuucucuccuaccuaaugcuggggggggggggaagggcguggaaagggaccaaaguggagaaggguuggaagggagguagagguauaagaacacaaucaaauaguaauacaaauaugccaacagaagaagguaauagcuaaagaaauaaugacccaaauagaacgaaucuaacauccgagaaguuuaauuaaugccacauugaaaaaccuuaaggaauccacagcuaaacauaucaaguugucaaaaaaacaaaaacaaacccuugagccgggugugguggugcacaccuuuaaucccagagggagacagaggcagacagucugaguucaaagcaaguuccaggacagcuagggcuacauagagaaacccuguuuugaaaaaacaaaaacaaaaagaaaguaagaaagcccaaaguagauaaucaauaaaaccaguaguuuaaaaccaguaguuggauuuuuuuuuccuccauuaaauaaguucuuguagucucaguuggccugccugcaacugguuauguagaccaagccucaaacuugugccaauccuucugccuauugucuuuugaguuuuaggauuacagagauguaccaucaugccuggcuaacaguucauucuuuaaaaacauuaacaaaauuaaaccauuaggcagacuguacaagaaaaaaaaaagcaagacucaaauuacuaaagucaagaaugcaaguggggaugacauuauagaccuuacagagucgaugauuauaaaccauaaacaaugcuagaaaccuagacauacuccuucugaggucaagaacaauaucuacuucugcaagucccauucgacaucauaaagagaguaccagccauagcaagguaaauaaauaggcaagagaaagaaacaguacaacuaucucuaaucaccauggcaugguuucacauguagaaaacccuaaaggagccacaaaaacaaugacagaaaacauaucagcaucaggauagcaucaagucacaagaucaacguauagcagaaauagaaaauaggacguaguaguacuagcuggaaguggagguacacaucuaacuaagaccagcacucacugaggaaguggaaucgggaguauaaagccaacaaaggcaacauacacagcagauccaguagaagaaagagggggaaagaaagggaaggaggcacgcaggcagguaagcagacaaucaggcagaccuaccaaguucuacccugucacauccguagcaacuucaagacuaagagcaguugucaaagacaggacaccagacccugaaagucagucuuggagaguccacuaacucaaugguaaaauggaagaaaacugccaugaccuuaaaagaaguuuuuaaaagggaagaaaggggaggggaagaaagcguagaacugcaaucaucuguacacuccacuucccuaagcuauggguggcuaugagaaagcacuacagguacaucuuacuaaacgacgcuuucaccaguggaugcaaaaaagcacuaagcguuaagcacuaagcuggggagcgggaaccugucuucucaugauuacauucccaaccccuagcaagguggccaggagaugauagggauccuuguuuacugaaugaaugaaacgcuucauggaaaacaugggaagguguacacagaauugugccucgaagacacagagaauaaacuaugagcaaagccgggcacaggaagaguuuaguucucuguacuuuuacuuagugcucccuccacaacuggaguaauuacauacaaacuggaguuggugacgaauggggggaggggcaaggaaaaugacauguauagaaguuaauuugggccugggggggcugcaagaauucugaaguucaucucggaucuuuccucauucuucuauucacaucucaaauucagauauucguagaccugugccagaaaugccccccaugaaccaucauucauucauucaucaccaaauccugucacuccucuccaaacacuccacaaguuuccccauucuuacaucacagacaaggaaacuggcuuuccgcacaggcucuccaagggcacccaucgccagugcguaguccuucuguagaacuccaaccugaucccucccagacccuucaggggcaucuacacucucccaucaacucgcccuuucacacggggcguuaccgcgcccgaugggcaguugaacaugucuccacucauucacugccagccacccuuucaauuggccauguaugcacggaggggcgcaggccacacguccucccuucugcucccccaggaguccaggccggucccugauccuccaggcacugacuccgcggcggucuccccgggagaggcgggcaccgccgggcaugcagggggcgcugggcaagagcuuggggacuucgcguugcccggcgccgcgccuccggccgaaaagcaacccgacgccccaugugcccauccgcggagcucgcccgcccgcccgcccgcccguccgccgcaccuuugcgcucggccucgcucucagcuucgcucccgaagagguccuccauguccgccauagcagcuugguccgcggccuuggcuugcucggcucgagccugcuuuacggccagacccguccaaacacgacgugucguaaagagccgcac

SEQ ID NO: 5203 - RNA, 14106 nt, Mus musculus
agccagacaagcagaggcaaccgcagugucccccgagucuccaggccaguggacggcugcucuccucagguacgagggguuuuucugggaaugucuguucuuuucugagacauugucacuuuguaguccucacaggcugguuacccuagagggucuccugccucagccccccaggcuuugggguugcagaccuguccuggcucgcggggccacuuucuugaggaauuuuaaguuuguuuguuuaggguggggaagguuuuuuuuguuuuuguuuuaaaauuuugcuuuauuuuuuuauuuguuuuuuuuuuuuuuuuuuuuuuuuuuuugagacaggguuucucuggguagccuuggcugucuuagaacuugcacuguagaccaggccagccuuaaacucacaagagaucugccugcuuccaggcuguuaguuaaaaaaaaaaauuuuuuuuuuuugagaccacgucuuauucuguagccucggauagcuucuaacucacaguacugcuguuucugucucccaaauacugggauuacaggugugagccaccaugucuggcuaaguguuuaaguucuaagaauuuuaccucuucccuguauuuucucaggccugcauuugaauguuguucucuguauuuagcuaucuuucuaauuaaaauucuuuauuuuuauaguaaccuagcaaacaacuuuaagcuuaauguaauuuuaaauguauuagauuuuguuuuuaaaguuuuacuuauuuuauuuaggcaguguuuugcuguauagcccagguugugcuugaacuuagguuuuuuuaggcuccuaauucuaggauuacugacaugagugguagcccauucucucucucucucccucccucccucccucccucccucccucccuuccccccucccucccuccccccucccucccuccccccuccucccuccccccucccucccuccccccuccucccucccccccucccucuccuccccucucuuuacauuaaaaaaaaggaauuauuuauuuuauguauaugaguacacuguagcugucuucagacaccaaaagagggcaucagguucuauuacagaugguugugagccaccauguaguugcuggaaauugaacucaggaccucuggaagaauagccagugcucuuaacugcugggccauuucuccaccccccuuuuuucucuucuuuaagacaguucuuaaagaacuguauguagccuagauucagguaugcuacuaugucugguuugccaaaacauuuuaaggaaaaaaccaauuuaggaaauguuuauaauauuuuuacuuuuuuuuucuguaaggauaagauacuagaaaaguacuuuaaaaagucuaucaccgaucugcuaugauaacugguuagggcuuauauuaaguauacccagcuaucaaaauccaguggagccuuuagauaaaaagguuuguuuggcugggcagugguggcgcacgccuuuaaucccagcacucgggaggcagaggcagguggauuucugaggcuagccuggucuacagagugaguuccaggacagccagggcuacacagagaaacccugucucgaaaaaccaauaaauaaauaaauaaagguagguuuguuuguuauuauuuucucuuguuuugagauaguuuuucuguuuagcccugacuguccuggaauucccucuguagaccacauuggccucaaacucagagaucugccuacuucugccuaccaguucugggauuaaagguauguacuaccaugcccaauuuuugaauuuuuauuuuauuuuauuuuauuauuuauuuaggcuuuuuaacuaccaguuugguuuccuuaauagagacagggcuguuuuggugacuucuucuguaguaaauuucgguguuuuauaaucaucagguaacuggauuauuugcguaagcuguugaauuuauuuguauuaucccccuguuauuuugaauagcuacauuuugcgguauagcccucuuuuagucaagguauuugucacugugucuucuuggucuuucaguagggccacugagauggcucauggccuaggaugcuugcugccaugucugaugaccucaguuugauucccggaagccacacaguaggagagaacugccuccugcaaguuguccucugacuuccacaacauauacaugcaaaugaaugcuaaaaacacuuguauuuaaaaucuaggcaauguuuccgggcuagaguuuggucuugcuauauuggcgagcuguuccguuagacuguuuacuauuucagguugcuggucuucgugcacacagguaacuaguauaaguauaaaguggcuuuguucagucaugggcuauagcauugcuccccagaauugaugggggccuauagaagaacuuuuggaauggugggaacuuugagaacaucauuaucuggucugugguuauaauggcagaguuuaaagucagagggccccauagcuccagcgucuccuuuacuagacacguuaauaaucuuuuuaaagcuggcuguuguggugcguccucuugaguguggagggcucaagcguccauguuacguauccuaagacuggaugaggccauuagggauccuggagaauaaagggaauggggagagauacaggggaugagaggagaaagugucuuuguuccagggucaggcaucccggugcacaacagcuuagaacagcauaggaauucucacucagauccuugcgcucaggaacauggaaaugucuuagcugugaggcucugguucagguacucacagggcugcgcucucugaaggccugucuguagcggaaggaucuguuuguacauaucuguuauacaggagcuagcuuguacagcuguuuuucacuaugcggguaggaguccccauaggcaggcuguguguuuucacaauaaagcacccgcuucccuccuagugaugagugacccuaggaaaacaagcaaggcagagaacccauggcauuauucauagugaggugauaguucgcugaucccacagauaagcaugacacgacaaacaggccaugagaaagugucacagccaguggagucccuagaaccagggucucauguaguccaggcuaguccuaacccccuuucuguuuccuaaaugcugggcucaccaccaugcauggugugcaucaccaugcccaguuccgggaacccuccucaagauggcucuccuggugacacucaagggagccuugcuaaaggccaggcucgaggagccagcucgagaugguuugguacagauuugguuuguaaauauugggaauguguugaggauuuacauuaagaacaucagugagggggcuggagacagggagggggggcacuuggucuugcaggagacucaaauucaguucccagccccuguggugggcagcucacaaccacuuguaauuccaccuccaggggaccugauccccaucugaccugcccucagguaacacauaccacucuccccuguauacauaauuaaaaaucaaaaaugacuuuaguuagaccaauuaauaauguauauuccuucaacacugaagaugacagugggaacauggaucuguuuggagauauagaugacauuuccucagagagcgaugaggaccagcaagcaccuacuccaagacagccuguugugaguacaacucccagucacaacuguucacaggacugaaggcuaagagaaaagauucuagggguauugagucucucauguugagaagggggugugcucagagaggacgaaugugacauucucagcugaguuagucauuuagggaaacaauuagaaggcacagggggaaccauuagaaugagagcagugccacacuugaggggugggacuaugggacuguuaccauggacaccuuugauuuaaaaggucuucuuacccaugcuuaugaugugccaugugggcaacauugcuguucuuuucugauuuggggcaguuacuuaguaaugauggguugaauuauuuauacuccuccugcaaaauagaauaauggcuaugccaagaaaauauauucagguuaacauaucuuaauuucccccauggaauuuauuguugcuuuuuuuccuugugggugugguuggggugauguuuuagggagagacuuggaggaaggaguggcugucccuaaagugugugugacaucacuuccuuucagaccugugucugccacucgcagagcacagcugggaccuuuggagugucuuggaaacagcagguggaacgcagcgucuuugaaaccagagugaaaauagcaguucccagcaucaacucggacuugggaaaugaacuguauuuuguuaaauuacccagguuucucaggaucgauccuaaguaagagaacugaauaaaagguucaagagauugaaaaguguaguuuaucugucaugagcccauaagaugacugagaacaagagagugugaggcaauugugagcugucguaugggugccgggaauggaacccagguuuuccaugcucuuagccacugagccaucucuccagcuccccccccccccccgaaguuuguuuuaaaaagaaauuucaaggcaguagucauuggcauacuuccugaggguucucauggagucacuuuucagcagugauauauuguucuagagacgaucgguuuauagucauucaaucacuaauuaugacuaauauggcaaaaauuuagaccguuugauccucaguauuaugaagaugaauuugaagaugagaaggugcucugugaggaagacaaagcuagguuaaaauugaagguacugugccaucuucugcuccauuuccuuguaguccccccucuccucaaccuccgaguagcuguggccacaggcaugcucuaccaugccggcugaguucuuccucacauuguuucuuauguuuaguucaggagugugagugcuuugacugcauguguguguaugugcgccacaucugugucuaguaccugcagagguuggaagaggucaucaaauccucugaaacuggaauuuguggaugggugugagucacccuguggaugcugggaaccaaaucuggagccucugaaagagcaucaagugcucuuaaucuuaagucaucucuccauccccugacuacuuuuuccuuuagacaguaaacagggugauaaugugagacuagagcuuaagaacguuccuaacguuuuccacuuacucaacagacaccgcuaggacacggaggugaaccggcuuuccagauaucuuuaggggaguaagcauacaccuguucucccuccuuuagaauugacacuuuccuaauguuuucagggguuuuguuuguuuguuuuguuuuuguuuuuuuguuuuuuugagacaggguuucucuguguagcccuggcuguccuggaccucacucuguagaccaggcuggccucgaacucagaaauccaccugccucugcccaucucaguuuaaguuuuaacuuaaauuaaaccuauauuauaauaucgguauaguaaguaaagguaaaaacuguugagacucauuagcgucccucaggauaaacaguggaagguuggccccgccuccacacucccucccauguauguuccagcaaccucccaccacaugacugucucuucauggagacugugcacagcagcggaccuugccaguaggggauuucucuugagaauguugggaugacaaaggaccaccauuguucacacauggaggguaacgcuggcaugggcuguuuuuaguggucucuuuugacuugcaguucuccacuucaugagauaaauuuggacucagauuuuaauuugcugguaauuguuuuaccauucuugaacaucaucaucauccucgugugugucugucugccugugucaguagaucgugugugugugugugucugugugugucugugugugugugucugugugugugugugugucugugugugugucugucugccugugucaguagaucgugugugugugugucugugugugugugugugugucugugugugugucugugugugucugugugugugugugugugucugugugugugugugucuguguguguguguguaugugugugugucuguguaucugugugugucugugugugugugugucuguguguguguguguguguaugugugugugucugugugugugugugugugugugugugugugugugugucugcaaaguccagaagagaguaucaguuucucuggagcuggaauuauagaugguugugagcugucuaauaugggugcugggaacugcaccuggguccucugaaaaagcaacaaguuuucuuaacugcuaagcuaucucucuagcuccuaguuaguuagucuuccuuucuuuaaaaaaaaaaaacaaaacaaaacuuaaaacugucauagagcuuuugccauuagacuaagaaauccuuuuuacuuaaaacaaaaaccauuuaucuguguguguaagaacaugcacauguaugugcacauggaucaaaaaccaaugugcagaaguucucacauccuauuacauggauccuggggacucaacucagguagucaggcuuggcagcaagccccuuuauccagugagccauggcacuggcccugacacacacacacacacacacacacacacacacacacacuuuuuuuuuuuggaaaaggaggaauuuuauuuauuuauuuucucauacauuacauccccacccacaguuuccccuccuuccacucuuccuaguccuuccucccaaauuugccucuucccaagauccacucuuccucccggggauaccaacugaacagggcauaacaaguuacaauaagaccaggcaccaacccucauaucaaggcuggacaaggcaacccaguagggggaaaagagucccaagcaugaaagaguccgcaacacccccacucccacuguucggagucccccgagaacacugagcuagcuauacagccagaaugcauaugcagaggccuuagcucagaccguacggauccaugauuaucugaucaguuucugugagccccagugaguuccaccuaguucauucuaagggcuguauucccuaagagacacuuuuaaagccccccuccccccccauugggcccacaguccuuccaagaaauugugugugugugugugugugugugugcgugcgugcacugaaaauagaacugggaaccucauauacgcugggcaagugcucuaccacuauguuacacccucaguugguguggauuuuggcagcuuaccuuguguggacuagccucucuguuccuauggagcucuuagcugugguuucaggcagcguccgucuuagccuccucccacugcucagaccuaggccucuggaagcgugcacagagugccugguuagcuaccacucguccagacgucugucgucaaugaguggcagagcugcgcagucagccacuuauuacuuacuuucucucucucucucucucucucucucucucucucucucucucucucucucucucuuucuuucuuuuuuuugguuuuucgagacaggguuucucuguguaguccuggcuguccuggaacucacuuuguagaccagguuggccucgaacucagaaauccaccugcucugucuccugagugcuaggauuaaaggugugugccaucaugcccagcuaaucagccacuuucuuaucacccaucaauuuuuaguguaugauuaugcauuauuagaggaacaaagaacauauagcuagguaaauugguugucuaauaccuuucuauuuuaaaccagguggaaaauacuauacgcuggaggaucugccgggaucaagaagguuuuaaaacuaaagaaagcaaugcucggauagucaaguggucagacggaaggcgaguguuagaacacuugagggaggcuugguuaccuugaaguuuucuguguaggacuuaagaauugggggaaucuaggcuacugccuuuaccuaggaagccugagagagagaagcaguuagggccuuacagccagguagugagagcuuaagucuggcacgauuccaucagcuacaaggcucgccuuugagaaaucagggcaacuugaaauaaccugugcuggaaaucaaacccagugcugcauguuugcaaggcaagcguucuaccaacugagcuacagauagccugagccccuaagcugagccguagauagucugagccccuaaacugagcuguaaauagucugagccccuacacugagcuauagauagccugagccccuaaacagaauuuuuuguuuuuguuuuuguuuuuuuuguuuguuuguuuuuacuuuuguuucuuucaagacaggguuucucuguauaguccuggcuguccuggaacucacucuguagaccaggcuggccucgaacucagaaauccaccugccucugccucccaagugcugggauuaaaggccugccuccaccacugcccggcugaaauauuuuaaaauucauuucaguuuacuaauuuaaagauauagaugggaagauuuuuauaagaugauucuauuauaagcuaaaaaguagauuuuaccacuuuuuacccugaacuacauauuaaguuacuuuucuauugcucugauaaaaauaccaugucagagacaacuuauagaagagguuuauuuggacuuaaaguuccagagggauaggaagccaucauggcaauggcagcaggcauaguggcccucaccucucuccagccaugcaggaggcagagagugugcuaacuggcguuggcaguggcuuugaaaccucagaagccacguccaaugacauacuuccucuuaaaggaaaggccucucaaaggccgcaccucuuaccccuacccaaacagcagcaguuggggaccaaguacugaaaccucugaccauuuagggcaacauucucauuuagaccaccacaaagagaagagauuucauuuuuuuuuuuuaaagacagggucucaucuccugugguagagcacaccuuugauccuagcacugggggagagagagagaggcaggcugagcucuauaaaauagugccccccccuuacacacucauuuccaggccacccaaggcuacacagucucaaacagacaaacaaaagacagggguucacagcccauccuggcccagagcucacuuuguagcugauucugagccugugcuaugaucuuuaagcuccugauccucuugcuccgccucccaagugcgaggauuacaggcaaacuuuccccguuuggaaacaggcuguguuuguuuuccuaugacuucucugaggacaggauccugggcuguucacuaagcauccuaauaccugaauuguuaccccuuuccagcaugucccugcauuuaggcaaggaaguguaugauaucugcaaaaccccacugcaggacaaucgaaaccaccuguuuauccgggaagauacuggucuccguggucaggccaucuuucaguccagacuuaccuuuagguaacguuguuguuguugcugcuguuguuuuccagacaggguuucucuguguagcccuagcuguccugcaacucuguagaccagccuggccucaaacucagagaucuuccugccucugugggaauaaaggcgugugcuaccacugcucggcccuuuagguaccuuuuggcaugcacauacaugcugcuccuugcaguuaaagagccaagcagagcugugcugggaaagcccaccccuucccugacaucauccccuagugcaguucaucaacaggcacggcuggguccaggaugacaaguuuuuaaagauaacuacagguuucucagggaaauauagcucauguugugaacaugagggacuggugcauggccugucgcuggucagugcuccugggaaaggcuugccgccauuguagcuugcugucugcuggguucucacucuuuagugaaacugacccaagaaagcuaaacuugucaacggaguguagugcuggggugugcuuacaacaggugugaccagagugcuuguagccuaugcccacuuaagacaugggcccggcucugaggcggcaguugggugggugcuucggccccuucuggacaccuuucccuuuagcuagcuucccgagagagagaggggggggggguacagcacuuucuguuacaguggcacauacuuccuuugaagaugcuuugguguuuuaaaaucagauugugggcgcgguuaugcaacuuuguaaauuaaaaaauuaaaaaaaacccaauuacauaggcuauauggucuugaggaugucaagcucacagcuuugcaggcucguuagauagcuaaugugugugucacagggguauuguguuaacucggcgcauaaaccugcauaggaagugaaggccaaccuuuccauccugaaacgugucugcuucugguuugguuuuuuaccacuugcucugaguugcacuggguccuuucuucacuucaggacccaguuaggcgcugccuucccaugcucaagaagcauuuacuguuugucuugccacguaacccaggcuggcuuuggacucacgacccaucuucaccucaaguuugcaauccuccugcuuuugccugaguggugggauuacaggguguuuccccgcugagacucacgacuuggccugagcuguugagccccccccaucccccgccacuguggcucaauuugguuuugaaacaggaucacgcacuuggcugccuacauuuuauuuaugcuuuuuuugaguagagggagcaacucaguucucaaaauguuccuguuugcgcaugcuccacucuuguggaauggagauuucauguuucuugucugugguuguaguuggggguauucuuuguaaaaagcacuccaucuggccaccugccucucccccugcagccugagucacccaccccauuuuccugagcagugaacagauggaccagaacuguaauccugccuguuuccucugccuagugugaggucaucacuccccaugggcagguuugguguuuuugauaaaugcgagacagauauuucauuucccagcagaccuuacuguagagacagugccacauauaagaagaugacccuuucauuugggaacagaaguucaaagacgcagauuagaauccucccgauggcugaucaugauccugaguggcuaugcccagaucugaucaagguauauuaacucagcuuuacguugggaccuuuuguacauuuagagcuguuuuccugaaguuugaaaaacaaauauuacccucucuguguguguguaagugugugugugagagagagagagagagagagagagagagagagagagagagagauguguagaagugugcaucagaggacaauuuuucaggaauuuguuauuuccuucauugaggacuuuggggguugaauucagguagucagauuagugcagcaagcuuugacccauugagacuucuugacgguccauuauuauuauuauuauccauuacuauaugguccauuauuauugcugcuauuuuauuuguuguaaucaguggggaaccauucuacucuccugccuauaguuacccuuaccacuaccaaugacugcagugggauuacagauaacgucacucucaucucugugugacuccacagaaaaccuuccaauauuagaaaaaaguacagccaaguucaguagcagaaugcuuucucucaaguagguacagccuuggauuugaucccugguaucacaagaaguaaaaagaaaauaaauaacuaggggggcuggcgagauggcucagcaguuaagagcacugacugcucuucugaagguccugaguucaaaucccagcagccacaugguggcucacaacuauccguaaugagaucugaugcccucuucuagggugucugaagacagcuacaguggacuuacauauaauaaauaaauauuuaaaaagaaaaagaaaagaaaauaggaaggaaauaaagacuguagaacccucugccauguagacacuggcucagcuagcucuuuuagcuccuaacuggcaugcugagcaggccuacucuccucagccuguucuggaagcugggauauagcauuugcauugaaggcuacacuaggaaugucugggaagcgugggagcuuggugcagccucagcugacucaggucaggugucugcagcuuagggaagaacacagggagcuucuacugccccagaggggccaugucugaagggguuucucaggcugcugcuucugagcugugauguacauagcgcccaggcgcacacacacacacagaucaggugccagcacuccucccccauucccacuuguguguugccuuuaccccaccaagccaugugcugugugggcuuauagccacucgggugggagacacauggcgucacccagcuuuaaaaguggguuugaaugggcacagaauagcuggcucccuuuucccuuucucuccuuccccuuuucuguuggaaagacuuucaccacguugcaugcgcuguucuuggucuuggacuccugguuuaagauauccuccugccuuauucuccacuacuggugcaugcuaccacauccugcugaaaguaggucauuuuuuuuuuaaguugaaaauuagccuuuuaaaaaaaaaagaauuauuuuauguaugaguagauuguagcugucuucagacacaccagaagagggcaucagauuccauuacagaugguugugagccaccaugugguugcugggaauugaacucaggacuucuggaagagcagccacugagccaucucuccagccccagccuuuuuauuuauuuauuuauuuuuacguagaugcagagaaaagaacugaggguaucuacuccccggaaaguccgucugcggaggaagagcaggaggcagaagcggcagcagcguccaggucggaguuccaccuuccagaagccuaaccuuguuguugaggaagaggaggagguggagggagaagaugaggaaggcaaggccuccaucgagguugccacuaaaagccguuaccagggcgcagccaaaaguaagucagcgcagcugccacaccucauuguaggcagggccuaguuucacucuggugagaucuucaucuugcuaguauuauuuccuuaugaccguagaaugcacccccucuuucauuuugcuuuaguuagggacacucaccauagaaaagguuaauugaaagcaagacuucuccaaagaauacaaaaccuguucauaggaaacacaaaacccaggcacccugcucccuaccagauuccuggccuggaaugcacgccacgccgcacuucccacauaggaaacaugaccugugguuauguagcccagacaguucuccaugcuaaugagguaucgagaggcccugaagguuuagccaauaagcuucccuucccagauauuccuuccugcaaaagguauuuaaucucugguucacccuaaaaaggugguaugcauccauuuuccaugaugaacaaucaauaaacaguuugggauacaaaaaaaaaaaaaaaaaaaaaaaaaagaaagaaagaaagaaagaaagaaagaaagaaggaaaacaaaacaacgugguguguacugugaagggaaauguauguauuagcacaauuaagaacucuguauuuaaaccuuauuauuuuuaaagcuauuauaaauaacuggacaggguggugcaagcuugccaucaacacuacggaggcugaggcaggagauuuugaguuugaggcuagccugggcugcuacuuaauaaguucuaggcaagccaggguagacugucucaaaaacaaaauaaagcagaagaaauaaaacaaaacccuaaaaccaacaauugaaacccacacugcuauguguuucucaggcuucuggcacuuaaagcucaaccugagaaugucucaagcugucauucaguucauguggaagacuaaauaaaaaaggagaggccuggagagauggcucaacaguuaagaacacugacuugugguuuuuuuccuguauaaacccccuucacuuagaccuggggguucacucucuuuccuguucauuccaucaggaagguugguggcccaagcucuagcuugaa

SEQ ID NO: 5204 - RNA, 14106 nt, Mus musculus
uucaagcuagagcuugggccaccaaccuuccugauggaaugaacaggaaagagagugaacccccaggucuaagugaaggggguuuauacaggaaaaaaaccacaagucaguguucuuaacuguugagccaucucuccaggccucuccuuuuuuauuuagucuuccacaugaacugaaugacagcuugagacauucucagguugagcuuuaagugccagaagccugagaaacacauagcaguguggguuucaauuguugguuuuaggguuuuguuuuauuucuucugcuuuauuuuguuuuugagacagucuacccuggcuugccuagaacuuauuaaguagcagcccaggcuagccucaaacucaaaaucuccugccucagccuccguaguguugauggcaagcuugcaccacccuguccaguuauuuauaauagcuuuaaaaauaauaagguuuaaauacagaguucuuaauugugcuaauacauacauuucccuucacaguacacaccacguuguuuuguuuuccuucuuucuuucuuucuuucuuucuuucuuucuuuuuuuuuuuuuuuuuuuuuuuuuuguaucccaaacuguuuauugauuguucaucauggaaaauggaugcauaccaccuuuuuagggugaaccagagauuaaauaccuuuugcaggaaggaauaucugggaagggaagcuuauuggcuaaaccuucagggccucucgauaccucauuagcauggagaacugucugggcuacauaaccacaggucauguuuccuaugugggaagugcggcguggcgugcauuccaggccaggaaucugguagggagcagggugccuggguuuuguguuuccuaugaacagguuuuguauucuuuggagaagucuugcuuucaauuaaccuuuucuauggugagugucccuaacuaaagcaaaaugaaagagggggugcauucuacggucauaaggaaauaauacuagcaagaugaagaucucaccagagugaaacuaggcccugccuacaaugagguguggcagcugcgcugacuuacuuuuggcugcgcccugguaacggcuuuuaguggcaaccucgauggaggccuugccuuccucaucuucucccuccaccuccuccucuuccucaacaacaagguuaggcuucuggaagguggaacuccgaccuggacgcugcugccgcuucugccuccugcucuuccuccgcagacggacuuuccggggaguagauacccucaguucuuuucucugcaucuacguaaaaauaaauaaauaaauaaaaaggcuggggcuggagagauggcucaguggcugcucuuccagaaguccugaguucaauucccagcaaccacaugguggcucacaaccaucuguaauggaaucugaugcccucuucuggugugucugaagacagcuacaaucuacucauacauaaaauaauucuuuuuuuuuuaaaaggcuaauuuucaacuuaaaaaaaaaaugaccuacuuucagcaggaugugguagcaugcaccaguaguggagaauaaggcaggaggauaucuuaaaccaggaguccaagaccaagaacagcgcaugcaacguggugaaagucuuuccaacagaaaaggggaaggagagaaagggaaaagggagccagcuauucugugcccauucaaacccacuuuuaaagcugggugacgccaugugucucccacccgaguggcuauaagcccacacagcacauggcuuggugggguaaaggcaacacacaagugggaaugggggaggagugcuggcaccugaucugugugugugugugcgccugggcgcuauguacaucacagcucagaagcagcagccugagaaaccccuucagacauggccccucuggggcaguagaagcucccuguguucuucccuaagcugcagacaccugaccugagucagcugaggcugcaccaagcucccacgcuucccagacauuccuaguguagccuucaaugcaaaugcuauaucccagcuuccagaacaggcugaggagaguaggccugcucagcaugccaguuaggagcuaaaagagcuagcugagccagugucuacauggcagaggguucuacagucuuuauuuccuuccuauuuucuuuucuuuuucuuuuuaaauauuuauuuauuauauguaaguccacuguagcugucuucagacacccuagaagagggcaucagaucucauuacggauaguugugagccaccauguggcugcugggauuugaacucaggaccuucagaagagcagucagugcucuuaacugcugagccaucucgccagccccccuaguuauuuauuuucuuuuuacuucuugugauaccagggaucaaauccaaggcuguaccuacuugagagaaagcauucugcuacugaacuuggcuguacuuuuuucuaauauuggaagguuuucuguggagucacacagagaugagagugacguuaucuguaaucccacugcagucauugguagugguaaggguaacuauaggcaggagaguagaaugguuccccacugauuacaacaaauaaaauagcagcaauaauaauggaccauauaguaauggauaauaauaauaauaauggaccgucaagaagucucaaugggucaaagcuugcugcacuaaucugacuaccugaauucaacccccaaaguccucaaugaaggaaauaacaaauuccugaaaaauuguccucugaugcacacuucuacacaucucucucucucucucucucucucucucucucucucucucucucacacacacacuuacacacacacagagaggguaauauuuguuuuucaaacuucaggaaaacagcucuaaauguacaaaaggucccaacguaaagcugaguuaauauaccuugaucagaucugggcauagccacucaggaucaugaucagccaucgggaggauucuaaucugcgucuuugaacuucuguucccaaaugaaagggucaucuucuuauauguggcacugucucuacaguaaggucugcugggaaaugaaauaucugucucgcauuuaucaaaaacaccaaaccugcccauggggagugaugaccucacacuaggcagaggaaacaggcaggauuacaguucugguccaucuguucacugcucaggaaaauggggugggugacucaggcugcagggggagaggcagguggccagauggagugcuuuuuacaaagaauacccccaacuacaaccacagacaagaaacaugaaaucuccauuccacaagaguggagcaugcgcaaacaggaacauuuugagaacugaguugcucccucuacucaaaaaaagcauaaauaaaauguaggcagccaagugcgugauccuguuucaaaaccaaauugagccacaguggcgggggauggggggggcucaacagcucaggccaagucgugagucucagcggggaaacacccuguaaucccaccacucaggcaaaagcaggaggauugcaaacuugaggugaagaugggucgugaguccaaagccagccuggguuacguggcaagacaaacaguaaaugcuucuugagcaugggaaggcagcgccuaacuggguccugaagugaagaaaggacccagugcaacucagagcaagugguaaaaaaccaaaccagaagcagacacguuucaggauggaaagguuggccuucacuuccuaugcagguuuaugcgccgaguuaacacaauaccccugugacacacacauuagcuaucuaacgagccugcaaagcugugagcuugacauccucaagaccauauagccuauguaauuggguuuuuuuuaauuuuuuaauuuacaaaguugcauaaccgcgcccacaaucugauuuuaaaacaccaaagcaucuucaaaggaaguaugugccacuguaacagaaagugcuguacccccccccccucucucucucgggaagcuagcuaaagggaaagguguccagaaggggccgaagcacccacccaacugccgccucagagccgggcccaugucuuaagugggcauaggcuacaagcacucuggucacaccuguuguaagcacaccccagcacuacacuccguugacaaguuuagcuuucuugggucaguuucacuaaagagugagaacccagcagacagcaagcuacaauggcggcaagccuuucccaggagcacugaccagcgacaggccaugcaccagucccucauguucacaacaugagcuauauuucccugagaaaccuguaguuaucuuuaaaaacuugucauccuggacccagccgugccuguugaugaacugcacuaggggaugaugucagggaaggggugggcuuucccagcacagcucugcuuggcucuuuaacugcaaggagcagcauguaugugcaugccaaaagguaccuaaagggccgagcagugguagcacacgccuuuauucccacagaggcaggaagaucucugaguuugaggccaggcuggucuacagaguugcaggacagcuagggcuacacagagaaacccugucuggaaaacaacagcagcaacaacaacaacguuaccuaaagguaagucuggacugaaagauggccugaccacggagaccaguaucuucccggauaaacaggugguuucgauuguccugcagugggguuuugcagauaucauacacuuccuugccuaaaugcagggacaugcuggaaagggguaacaauucagguauuaggaugcuuagugaacagcccaggauccuguccucagagaagucauaggaaaacaaacacagccuguuuccaaacggggaaaguuugccuguaauccucgcacuugggaggcggagcaagaggaucaggagcuuaaagaucauagcacaggcucagaaucagcuacaaagugagcucugggccaggaugggcugugaaccccugucuuuuguuugucuguuugagacuguguagccuuggguggccuggaaaugaguguguaaggggggggcacuauuuuauagagcucagccugccucucucucucucccccagugcuaggaucaaaggugugcucuaccacaggagaugagacccugucuuuaaaaaaaaaaaaugaaaucucuucucuuugugguggucuaaaugagaauguugcccuaaauggucagagguuucaguacuugguccccaacugcugcuguuuggguagggguaagaggugcggccuuugagaggccuuuccuuuaagaggaaguaugucauuggacguggcuucugagguuucaaagccacugccaacgccaguuagcacacucucugccuccugcauggcuggagagaggugagggccacuaugccugcugccauugccaugauggcuuccuaucccucuggaacuuuaaguccaaauaaaccucuucuauaaguugucucugacaugguauuuuuaucagagcaauagaaaaguaacuuaauauguaguucaggguaaaaagugguaaaaucuacuuuuuagcuuauaauagaaucaucuuauaaaaaucuucccaucuauaucuuuaaauuaguaaacugaaaugaauuuuaaaauauuucagccgggcagugguggaggcaggccuuuaaucccagcacuugggaggcagaggcagguggauuucugaguucgaggccagccuggucuacagagugaguuccaggacagccaggacuauacagagaaacccugucuugaaagaaacaaaaguaaaaacaaacaaacaaaaaaaacaaaaacaaaaacaaaaaauucuguuuaggggcucaggcuaucuauagcucaguguaggggcucagacuauuuacagcucaguuuaggggcucagacuaucuacggcucagcuuaggggcucaggcuaucuguagcucaguugguagaacgcuugccuugcaaacaugcagcacuggguuugauuuccagcacagguuauuucaaguugcccugauuucucaaaggcgagccuuguagcugauggaaucgugccagacuuaagcucucacuaccuggcuguaaggcccuaacugcuucucucucucaggcuuccuagguaaaggcaguagccuagauucccccaauucuuaaguccuacacagaaaacuucaagguaaccaagccucccucaaguguucuaacacucgccuuccgucugaccacuugacuauccgagcauugcuuucuuuaguuuuaaaaccuucuugaucccggcagauccuccagcguauaguauuuuccaccugguuuaaaauagaaagguauuagacaaccaauuuaccuagcuauauguucuuuguuccucuaauaaugcauaaucauacacuaaaaauugaugggugauaagaaaguggcugauuagcugggcaugauggcacacaccuuuaauccuagcacucaggagacagagcagguggauuucugaguucgaggccaaccuggucuacaaagugaguuccaggacagccaggacuacacagagaaacccugucucgaaaaaccaaaaaaaagaaagaaagagagagagagagagagagagagagagagagagagagagagagagagagagagaaaguaaguaauaaguggcugacugcgcagcucugccacucauugacgacagacgucuggacgagugguagcuaaccaggcacucugugcacgcuuccagaggccuaggucugagcagugggaggaggcuaagacggacgcugccugaaaccacagcuaagagcuccauaggaacagagaggcuaguccacacaagguaagcugccaaaauccacaccaacugaggguguaacauagugguagagcacuugcccagcguauaugagguucccaguucuauuuucagugcacgcacgcacacacacacacacacacacacacaauuucuuggaaggacugugggcccaauggggggggaggggggcuuuaaaagugucucuuagggaauacagcccuuagaaugaacuagguggaacucacuggggcucacagaaacugaucagauaaucauggauccguacggucugagcuaaggccucugcauaugcauucuggcuguauagcuagcucaguguucucgggggacuccgaacagugggaguggggguguugcggacucuuucaugcuugggacucuuuucccccuacuggguugccuuguccagccuugauaugaggguuggugccuggucuuauuguaacuuguuaugcccuguucaguugguauccccgggaggaagaguggaucuugggaagaggcaaauuugggaggaaggacuaggaagaguggaaggaggggaaacuguggguggggauguaauguaugagaaaauaaauaaauaaaauuccuccuuuuccaaaaaaaaaaagugugugugugugugugugugugugugugugugugugucagggccagugccauggcucacuggauaaaggggcuugcugccaagccugacuaccugaguugaguccccaggauccauguaauaggaugugagaacuucugcacauugguuuuugauccaugugcacauacaugugcauguucuuacacacacagauaaaugguuuuuguuuuaaguaaaaaggauuucuuagucuaauggcaaaagcucuaugacaguuuuaaguuuuguuuuguuuuuuuuuuuuaaagaaaggaagacuaacuaacuaggagcuagagagauagcuuagcaguuaagaaaacuuguugcuuuuucagaggacccaggugcaguucccagcacccauauuagacagcucacaaccaucuauaauuccagcuccagagaaacugauacucucuucuggacuuugcagacacacacacacacacacacacacacacacacacacagacacacacacauacacacacacacacacacagacacacacacacacagacacacacagauacacagacacacacacauacacacacacacacagacacacacacacacagacacacacacacacacacagacacacacagacacacacacagacacacacacacacacacagacacacacacacacgaucuacugacacaggcagacagacacacacacagacacacacacacacacagacacacacacacagacacacacagacacacacacacacacgaucuacugacacaggcagacagacacacacgaggaugaugaugauguucaagaaugguaaaacaauuaccagcaaauuaaaaucugaguccaaauuuaucucaugaaguggagaacugcaagucaaaagagaccacuaaaaacagcccaugccagcguuacccuccaugugugaacaauggugguccuuugucaucccaacauucucaagagaaauccccuacuggcaagguccgcugcugugcacagucuccaugaagagacagucauguggugggagguugcuggaacauacaugggagggaguguggaggcggggccaaccuuccacuguuuauccugagggacgcuaaugagucucaacaguuuuuaccuuuacuuacuauaccgauauuauaauauagguuuaauuuaaguuaaaacuuaaacugagaugggcagaggcagguggauuucugaguucgaggccagccuggucuacagagugagguccaggacagccagggcuacacagagaaacccugucucaaaaaaacaaaaaaacaaaaacaaaacaaacaaacaaaaccccugaaaacauuaggaaagugucaauucuaaaggagggagaacagguguaugcuuacuccccuaaagauaucuggaaagccgguucaccuccguguccuagcggugucuguugaguaaguggaaaacguuaggaacguucuuaagcucuagucucacauuaucacccuguuuacugucuaaaggaaaaaguagucaggggauggagagaugacuuaagauuaagagcacuugaugcucuuucagaggcuccagauuugguucccagcauccacagggugacucacacccauccacaaauuccaguuucagaggauuugaugaccucuuccaaccucugcagguacuagacacagauguggcgcacauacacacacaugcagucaaagcacucacacuccugaacuaaacauaagaaacaaugugaggaagaacucagccggcaugguagagcaugccuguggccacagcuacucggagguugaggagaggggggacuacaaggaaauggagcagaagauggcacaguaccuucaauuuuaaccuagcuuugucuuccucacagagcaccuucucaucuucaaauucaucuucauaauacugaggaucaaacggucuaaauuuuugccauauuagucauaauuagugauugaaugacuauaaaccgaucgucucuagaacaauauaucacugcugaaaagugacuccaugagaacccucaggaaguaugccaaugacuacugccuugaaauuucuuuuuaaaacaaacuucggggggggggggggagcuggagagauggcucaguggcuaagagcauggaaaaccuggguuccauucccggcacccauacgacagcucacaauugccucacacucucuuguucucagucaucuuaugggcucaugacagauaaacuacacuuuucaaucucuugaaccuuuuauucaguucucuuacuuaggaucgauccugagaaaccuggguaauuuaacaaaauacaguucauuucccaaguccgaguugaugcugggaacugcuauuuucacucugguuucaaagacgcugcguuccaccugcuguuuccaagacacuccaaaggucccagcugugcucugcgaguggcagacacaggucugaaaggaagugaugucacacacacuuuagggacagccacuccuuccuccaagucucucccuaaaacaucaccccaaccacacccacaaggaaaaaaagcaacaauaaauuccaugggggaaauuaagauauguuaaccugaauauauuuucuuggcauagccauuauucuauuuugcaggaggaguauaaauaauucaacccaucauuacuaaguaacugccccaaaucagaaaagaacagcaauguugcccacauggcacaucauaagcauggguaagaagaccuuuuaaaucaaagguguccaugguaacagucccauagucccaccccucaaguguggcacugcucucauucuaaugguucccccugugccuucuaauuguuucccuaaaugacuaacucagcugagaaugucacauucguccucucugagcacacccccuucucaacaugagagacucaauaccccuagaaucuuuucucuuagccuucaguccugugaacaguugugacugggaguuguacucacaacaggcugucuuggaguaggugcuugcugguccucaucgcucucugaggaaaugucaucuauaucuccaaacagauccauguucccacugucaucuucaguguugaaggaauauacauuauuaauuggucuaacuaaagucauuuuugauuuuuaauuauguauacaggggagagugguauguguuaccugagggcaggucagauggggaucagguccccuggagguggaauuacaagugguugugagcugcccaccacaggggcugggaacugaauuugagucuccugcaagaccaagugcccccccucccugucuccagcccccucacugauguucuuaauguaaauccucaacacauucccaauauuuacaaaccaaaucuguaccaaaccaucucgagcuggcuccucgagccuggccuuuagcaaggcucccuugagugucaccaggagagccaucuugaggaggguucccggaacugggcauggugaugcacaccaugcaugguggugagcccagcauuuaggaaacagaaaggggguuaggacuagccuggacuacaugagacccugguucuagggacuccacuggcugugacacuuucucauggccuguuugucgugucaugcuuaucugugggaucagcgaacuaucaccucacuaugaauaaugccauggguucucugccuugcuuguuuuccuagggucacucaucacuaggagggaagcgggugcuuuauugugaaaacacacagccugccuauggggacuccuacccgcauagugaaaaacagcuguacaagcuagcuccuguauaacagauauguacaaacagauccuuccgcuacagacaggccuucagagagcgcagcccugugaguaccugaaccagagccucacagcuaagacauuuccauguuccugagcgcaaggaucugagugagaauuccuaugcuguucuaagcuguugugcaccgggaugccugacccuggaacaaagacacuuucuccucucauccccuguaucucuccccauucccuuuauucuccaggaucccuaauggccucauccagucuuaggauacguaacauggacgcuugagcccuccacacucaagaggacgcaccacaacagccagcuuuaaaaagauuauuaacgugucuaguaaaggagacgcuggagcuauggggcccucugacuuuaaacucugccauuauaaccacagaccagauaaugauguucucaaaguucccaccauuccaaaaguucuucuauaggcccccaucaauucuggggagcaaugcuauagcccaugacugaacaaagccacuuuauacuuauacuaguuaccugugugcacgaagaccagcaaccugaaauaguaaacagucuaacggaacagcucgccaauauagcaagaccaaacucuagcccggaaacauugccuagauuuuaaauacaaguguuuuuagcauucauuugcauguauauguuguggaagucagaggacaacuugcaggaggcaguucucuccuacuguguggcuuccgggaaucaaacugaggucaucagacauggcagcaagcauccuaggccaugagccaucucaguggcccuacugaaagaccaagaagacacagugacaaauaccuugacuaaaagagggcuauaccgcaaaauguagcuauucaaaauaacagggggauaauacaaauaaauucaacagcuuacgcaaauaauccaguuaccugaugauuauaaaacaccgaaauuuacuacagaagaagucaccaaaacagcccugucucuauuaaggaaaccaaacugguaguuaaaaagccuaaauaaauaauaaaauaaaauaaaauaaaaauucaaaaauugggcaugguaguacauaccuuuaaucccagaacugguaggcagaaguaggcagaucucugaguuugaggccaauguggucuacagagggaauuccaggacagucagggcuaaacagaaaaacuaucucaaaacaagagaaaauaauaacaaacaaaccuaccuuuauuuauuuauuuauugguuuuucgagacaggguuucucuguguagcccuggcuguccuggaacucacucuguagaccaggcuagccucagaaauccaccugccucugccucccgagugcugggauuaaaggcgugcgccaccacugcccagccaaacaaaccuuuuuaucuaaaggcuccacuggauuuugauagcuggguauacuuaauauaagcccuaaccaguuaucauagcagaucggugauagacuuuuuaaaguacuuuucuaguaucuuauccuuacagaaaaaaaaaguaaaaauauuauaaacauuuccuaaauugguuuuuuccuuaaaauguuuuggcaaaccagacauaguagcauaccugaaucuaggcuacauacaguucuuuaagaacugucuuaaagaagagaaaaaagggggguggagaaauggcccagcaguuaagagcacuggcuauucuuccagagguccugaguucaauuuccagcaacuacaugguggcucacaaccaucuguaauagaaccugaugcccucuuuuggugucugaagacagcuacaguguacucauauacauaaaauaaauaauuccuuuuuuuuaauguaaagagaggggaggagagggagggggggagggaggaggggggagggagggaggggggagggaggaggggggagggagggaggggggagggagggaggggggaagggagggagggagggagggagggagggagggagagagagagagaaugggcuaccacucaugucaguaauccuagaauuaggagccuaaaaaaaccuaaguucaagcacaaccugggcuauacagcaaaacacugccuaaauaaaauaaguaaaacuuuaaaaacaaaaucuaauacauuuaaaauuacauuaagcuuaaaguuguuugcuagguuacuauaaaaauaaagaauuuuaauuagaaagauagcuaaauacagagaacaacauucaaaugcaggccugagaaaauacagggaagagguaaaauucuuagaacuuaaacacuuagccagacaugguggcucacaccuguaaucccaguauuugggagacagaaacagcaguacugugaguuagaagcuauccgaggcuacagaauaagacguggucucaaaaaaaaaaaauuuuuuuuuuuaacuaacagccuggaagcaggcagaucucuugugaguuuaaggcuggccuggucuacagugcaaguucuaagacagccaaggcuacccagagaaacccugucucaaaaaaaaaaaaaaaaaaaaaaaaaaaacaaauaaaaaaauaaagcaaaauuuuaaaacaaaaacaaaaaaaaccuuccccacccuaaacaaacaaacuuaaaauuccucaagaaaguggccccgcgagccaggacaggucugcaaccccaaagccuggggggcugaggcaggagacccucuaggguaaccagccugugaggacuacaaagugacaaugucucagaaaagaacagacauucccagaaaaaccccucguaccugaggagagcagccguccacuggccuggagacucgggggacacugcgguugccucugcuugucuggcu

SEQ ID NO: 5205 - RNA, 7319 nt, Mus musculus
aaaggacuuggucuccaauguugacagacaguggacaggugacuguguggcugugguagaugguggucagcaaaguuccaucggagagaacggagguggcaaagaaauggggugaguagauggucugggaggggagagcauuuaggugaaguccaggaguuaggacuggaugugcauacaugaguucaaagggcgagaugaggagaggucacuuggggagagcucauagccugagaagagccagagguaggaguuuuacccaaucaaggugaaauuccugugacagcuuaacaagagugguuuuaaagagcgguuaguucuuucuaccuuaccugaacauugagggugguagggaauguaaaaauaccaggggaugucuagggccuuagauagaauuugagaaaucugggaaguaaauuuggaaccauugucugacuggagggaggcugggacaccaaacugggggaugaucucucacaggaggagaucagagauugucagcccuuuuguuagugugggaaaugccuccacccaccccgagaagguguccaccaagaccaggaggcacuuggcacaugacagugggcauguggguaaagucaaguugccagucaguuccaggaagggaaccucuaggcugauggguaggaaaggggugcuacgauaccuugaguuggagucugacaucugacagauuuugcaagaagcagugguagauuuuaagaaacuuaagucuucaggaguagcuguaggugggucuuaacacaauaggacaaugcuuggcuguuaggaugaaagacuuggugaagauaggacagaguuuuccagugucagggggugaaggcagggaugugaguugcaguguaaggauguccugaggagggugagaugagucuaggucccuaagggccgcagcucuggcugccucaucggcucaguuguuucccuuggagacaauagagucauagcuguggagaguugggaggccuuuagcauggccauaaugugguuugaaguaguuacugacccuccuuuugugguaaguaacccacgcuccuuccagauaguggugugggacaggaggauguggaaagcagauuuggaagcuguaaauguugagggauuguccuugugccaguuggaaggcauggguaagggcucuuaguucagcauguugauuaguggugugagcaggaagggccugugccuccaccaccucggugucugacacugcggcauagccagcuuuucuagccccuucauauagaaaggagcuucuaccugaaugccaaguauaaauagcuugaggcaaugugcccuccuguaugugugaaggucgaggaagaagauuggaaauauuaagaggcgggcaugauuggaaggugaguguggaauauucuauuagugcuaccugaagagaaagaauucuggagggagguagagucuguaagccuuuguaaaauaggagcugugacagauuauaauagagaggacaguuauaggugaccccaagguuaguuuuuugacucucaaauaaggaguucagcggcugcuaagguacaaauacaaggugcccacccauggaugguuaaaucuacucuuuuugacaaguaugcuacaggugcaaaagaaggucccaguuggugacuuaagacuccaagggcaaauccuuccuuuucaguuacuuacagggcaaaagggugagucaggucagggagauguaaggcugggaccuuaaggagagucuguuggagccucugaaagggcuugguaacagguuugagaagugguucgugaguggggccuaacgcugcuuucacauaaggggagagaaagaagggaaaagaaggaacccaggaacauaagaaguuagccauuccuaggaaugauaaaaucucuuccucuguagaaggaacagucugagacugaaucagacuuuuucuuguggauuggggaauuguuagucccaaauaggugaccugaggaguagacagcuggacuuuuagaaggucagacccuguagucucgacuggaaaggaaauuuagaagaacagagaugucagcuuggcuaaucucuagaguggggcuacagaagacaucaucuacauaaaguacaaucuuagcuuuagggagagagaaagaaaauaagucagaagccagggccuggucaaauagguguggacuaucccggaauccccgaggcagaacaguccagguaagcugaguagaaaagugggugucaggaucuguccagguaaagguaaauaugaucugugacugggcguugggagggauagacaaaaaugcauccuugagaucuaagacugagaaaugagaggacccugggaaagaaguguguaaggauuagcuacaacaggauggagaggaaccacugcagaagucuugaauuugucuuagucaggguuucuauuccugcacaaacaucaugaccaagaagcaguagggaaggaaaggguuuauucagcuuacaauuccauacugcuguuuaucaccaaggaagucaguacuggaacucaaacaggucaggaagcaggagcugaugcagaggccauggagggauguucuuuucuggcuugcuuccccuggcuugcucagccugcucucuuauagaaccaagacuaccagcccagagauggucccacccacaaagggccuuucccccuugcucacuaauugagaaaaugucuuacaguuggaucucauggaggcauuuccucaacugaagcuccuuucuuugugauaacuccaacugugucaacacauaaaaccagccaguacaaaccaggugauucuuuuuuuuuuuuuuuuuugagacaagguuccucuguauaguccaggcuguccuggaacucacucuguagaccaggccuugaacucagaaauccgccugccucugccucccaagugcugggauuaaaggcgagcaccaccacugcacggugaaccaggcaauucuuaacugcuaguauaaggguguuaaagggggaagagguggggugaaggaguuuuuuccuuaagaggucagaaaugaugggcuuaaguccccugaggcucuggagagagagagggcauugagcuugggugauguaccugguagaguccaggaacuggaugacaacaggagagugauguuuagcaacagaggaguucuggacgucccagacuuggggguccaccugagaagcugguaaaggaaacauguuaguguuaggcugacuggcuaggaggagcagaggaacugcugacgagcuuggguucaggagaguggguggggggagcaaaggaaauagagguucccaacuuagcuaaaaggucaagguggcagugggaagagagagagagggaggggcauuccucuuauauguauggauagugaugugguuacagguaaaggugggaggugagcccaauggauucugggaauauguugaccauuguuguguauaggucacgcuguugccuaugugaugucacagguuuuggaggaccugguaccaacaauggugucucuucuaguuuucucauuucauccauuuuuucguuucuccaauuccuucauuuccacucacccauccuccucacuuuuuuuuuuuuuuuugagacagaaauaggaagaagaaauagagaauccuuuuugggagcaaagcaggggagaacccuauggcaguagcugcaauaagccucuugcugacauccugaaauagaacauccauuccuucauacccugcuuucuccucugcugcauuagaaaccaaguuuccuauucugcccagcucaucuuggugccacuugcaggcauacuuuuuggcuacuuuauuguuugcuuguuuuguuuguuuguuuguuaccuaccacccuucaccccaaucccuuucaacuccccagcauuagguaggcaagagagaaagcuagaagagaaacacaggguguagauucuuuaaacuacuuccugcugauuaggggcaucaggucccuaggggcaaugcuuaucuuugucaggauauccaauuccuccucguuucuuugcuuacggccaccugacaaaccgcagcagcagcuuccucucuuuaggcucuggaguuuuuauucccuguccagaguccccagaauuccaaauguauacuaucuucagcuggcagaacauucuccugcuagagcauguagacaaaucagagucagcugcuguggacaaucugaagcagucauauaucucacaccugggaguaauacaaaaauauauucaucuaacauagcugggguuuuaaaagaaacaaacgcucucacuacacuugcugcugcuuguucugccacauggcacgcagcagggacaccauuuguaaacuggaucgcaaucugcuggcacccaggccuuggcucuccaaccuucaggauugaaauuucacgugauaucagaauaguauuuacagagaaggcacaagagaaggcaaaggaugacccugcggagauuucgguucccgggguggaaagccuaaagacuugugcucacagaaaccugucagguuuucaguccgccugcaaggcgguaccugggaugcugcacccucaggagcagaaggcugcaguguccuccuguggcuaaaugggaacuucacugucaggccuguggugcuuugaauaugcuuagcccaaggaguagcacuguuaggaggugcagccuuagaggaagugugucacucacuguagagguggacuuugagacccuccucccagcuacuugaggaguccaucuucuguuugccuuuggaacaagauguagaacuuucaguuccuccaacgccaugccugccuagaugcugucaugcucccaccuugaugauaauggacugaaccucugaaccuguuaaauguuguccuuguuaaaaguugcuuuggucagggucucuucacagcagugaaacccuaagacaggcucuuuaaaaaggcacauguugcuggaugacugaggaggaaauggugucaaccgcaauacaugagaggucuuacggagcuaagacugagacaagacauaaagugaugcccaguaguaacacaugguccuguucucggccaccucuaaccauuggagaaaauacuguuuugagggcuacugaguagucuuucccugaacaaauccaaccuggagaaacuaggcucuuggcacauggaggaguagcucugccucauaccagaaucauguggaccaguugcagaggcuguugcuuucccuggaaagcuucuguugccugcugcaaagagggagcaaggggugaaagcaugacgggaggugagacuuagacaaggggcuugguuuuacuucuguguaggggaguuguauucucugaggugggaauggcuguuggaugaugugguuugaacuggaauggcccuccaagaacucagauuugaaugcugggccaccagggaguggcacuauuaggagguguggccuuguuggaggaaguguggcacugggggugggcucagaagcucaagccaguccuagugucacucucuccccggugcauucugaucuggguguagaacucucagcuccuucuccaauaccguguaugccugugugccgccauacuuccugcaaugacaauaauggacuaaaccucuaaaaguaugagcaacagaaacccucacuaauacugcaggaagcaaacccaagcauggaucuuguuuggagagcauaagacacgacacaaugaguaugccggguagacccaggagaugaacaaaacgcacagcaccuucugcaccaccuggagggcaagggccaucagugccacagacggaaaggcuaagagcggacacuggagcacgcaggcuggaagccuucacgggaagccagacuagcccugacuagugcuagcacucgcacguucuaugaagugugcagagugguucaagccugcacauccagcugccuugacccuucauggacucaacuguguuuucuuaguaaccaaaguggaggcauccgaaucauuaggaguuccugucacuuuguuuauucaggugggagucuauagagucuaacuacuggaaugaaaacaagauaggaagaacauucuuugcccucgugaaaacuguaacugggcucucuggauuaaggguuggaaauaaacaaacugagcuuuaaaaagaacuuuuaaaaaagaacuuuaaaaagagcuuuuaaaaaaacugaguuuuaaaaacaccgugugcgugcauauacacauacaaauaauauuuagaaaaguauugguaauuugcuuuuaaacuugucugaauauauaaacuauaauaucuggaagauuuuuaugggaauuauuugcucuguaucuaaacacugacaacguagaaaaaggaaugaagucuuucugggugaggggggucacccuaagggagugaauguguaucgguuagucuauuuucacccagcuuugaaagcugggguccuagguccaauucuuuacaguuauugaaggcuuucuaaaacacaugacaaaagaaaaaccaaagauaauauguggcauccauuaaaacgauuuacuuagaagaagugucuuuuuauaagcuaaccuccaagguugguccuucaaacgauaaacugcaaggugaaguugaaaacuaacgaaauguuauacauguuuacuauaaaaaucugcauaauguucaguuuuuguuauuuguguguguggccgcgucucugcuugugcaccauauacgugcaggugccuacagaggccagaagagggcacuauaucuggaacuggagugagcugccugcuaugggugcugggaaccaaaccugggaccugugaagagcagccagugcuauguuguuuguuuuuuaucaagacagggcuucucuguguagcucuggcuguccuagaacuugcucuguacaccaggcuagccucgaacucaagagaccugucuguuucugccuccugagugcugggacuaaagguggcaccaccacagccuggugcagucaguucucuuagugauggaggcaucucuccaggucccaugcuugacuuuuuacagggaacucauggaaccaaauaacagugcaguaaaggaaacaggacacccacugaagugagcgagcgacccgugagagcugacggacaagacaguucugaacauguucagauccaagaagucacacccgugccuggcagcaacagcaacuguugacucucagauacccacaguucguuucucuuuggugccacgucuccaguugaugcuguucaaagcgaagcugcgcuggaggaguacagccagacacugcaagg

SEQ ID NO: 5206 - RNA, 67159 nt, Mus musculus
cauugugacgucacggucagcccacgccgggguugaagcugccgggcgccuuccucuugcaucgcggcugcagcuugcuucuguucccgcgcccgcuugcacauccuccugcucgcgcgguccugcugccguccggugcuccccguagccgcucaggcagagaggugagccgccugcuucaggaacuuggcgggugccaaggcacuggggugcggccaggcugcuggcgccgugagguccggguugggcggggggcggcaggcaccguggcccggcgagcgcggggcgcgggccgagcggagcuccgccgggauggaugcuuucgcaccuguucguggguggcagccacuuuggcgcacugacaggcgcggagaucgcagggaaggauggcggcgcgcuuggaucuuccuccgagcuuucucugagcgaccguaagggcugccgaggaggaguccgcguggguccgugcaguaccgggcuuuggggccgcgcgcuggccuuucccugcuuuccucuccuuugcugcugccagggacgcccgcuuucccgcgaccacuccagcggguaucugcagcccagccugccccgggaggguggagacgcggacgcauagcugcggguaacggccuggagucugcgaauccauaaagugcgcugcucagaguuuuagggaaaguguccuuuauuguuugcuugccagcaagccuuccccuuccccuauccuugagguggagauaguaagguccagagagaguucuuuuuagacgaucuugaagccuucggcaccuuugaacuuggcgucccugcucuagauuacauuaugcuuaucuccaggcgccuugauugcaaauuugaaggaugcauuggaugaauuuucguaaggggagggggcgauugaaagaaugcaacgcaugacucccuagcuggaggauacccggggagaagucugauaagaaauugugggggagcgagcagcccuccucccaagccucgacugucuuucuguuuuuuuaaugucagggcugguggcaggaaguguuuuguacaguuguacaggagggccaguguugucuguugguuuuguaauucguuccucuaaccgcuuggcaguuauaaccuguugguuuguacuugcaagucuuugugcuuuugcaaagucucaggccacagcauuugggucaaaaaucuacagauacagucagcuuugcauuagaugaaugcgaaugcacaccguagauuuuaucuauggcugggcacaggugcaucguuuaucuagucagucccaguacugccggguuucucugcgaaagcucugaccuugaaaaaaaaaaaggggggggggcuacuuuccuuugagauuuuucuccugauaacgucagugccaggaacauccaccauaggccaucuccuuuucuauucucuuuuugucuuucaguuuggaacugaagacagaaaggaggaauguuauauacuuucacagaauggaggguaaacuuaaccaugaauaggaaacauggguguuggguuuuucaaaauagguaacuaguaaguaguucuuacuugacucgguuuccuugucagccagccgggucccauguaacugauuuauuuauuaggugguuucaagagacuguaaauggaagaacccaacagggggucugcuaaauagugguuugauaaauguuuccuuuuccuucccugggauuaacaguguuucucuuggccagagccuuagccuuuggaugccuguuguucacagaauucuuucccccagcaguuccgcuaauuacugcuugugcugcuguuagaggggaaguacucaccuuugugcuagauuuccaacuugaagucuacauacaaaucgaggcaaaauugccuugucuuccaggaacuauggcagaguagagcauauuuguugccuaacaaaaaaacucugacacacacuaaccuucccaggggugugugugugugagguguguguguguguauucuacuuuugccugccaauucacaauaucauagaccacuuccucucaguugccugucuuuuccugcaugcguucccauucagaggccauucacauggcugcuuuccccaugccuuguuucuguuuuuccugcugcagagagcugaacccagaaguucacacgugcugaguaaacacugccacugagcuccuucaauccugcgucaugaacugaugcuaagaacagauuugcuaaguguuucuuuccacaaaccaggguccucuagggagucccauuacccaucuuuuuguuaaaaaaccuggaacuagcagccaggugauaguagcaccugccuuuagucccagcacucaggaggcagaggcaggcagaucucuaugaguucaaggccagcaugaucuacagagcuaguuccagggcuagggcugcacagagaaaccuugucucaaaucacccaaacaaacaaacaaacaaacaaaccuggagcuaaggcccagagauguugacuuucugaaaaacacacagccuuaucuccaggauuccagcuucucacuacaucugucuguuguuggauuguuugucuagucagcuacaugucauuuauguaauugugcuauuugcuaacuuaaaauacucuaaccaugugcugaaccaucuuaaaccaaacucagcacgugugaacuucuggguucaacucucugaggcaggaaaaacagaaacgaggcaugggggaaagcagccaugugaauggccucugaaugggaaugcaugcaggaaaagacagguaacugagaggaaguggucuaugguauuguaaguuggcaggcaaaaguagaauacacacacacuaaaccauaggauuaacaauuugcugcuucucagucugccugaaguauguuccuguauuuauccuauucuugauucauuuguuuuaagacagggucucauuguagucuaggccgaccucaucuuagggguuucugaaaggucagcccucaacuucugauccuccuacuucuaucucuuaagcacagggauaauaagguauagguuaacauuuggucugggcugugcugggcaugggacccaggucuggcaagcaguguaccaacugagguauguccccaauccacaauucauuuuuauuaacuuucugacuuaguggguauguguuaaauauguccauggcugggguguuuggauccaaagaugagugaagcaguuugugauuccaaaaggcuucuugguuuggcuuacacugggagcccuuuugugcauacuuauuuuauacuuuacaccaaaagagagccagagguagguuucugggacacauggcacaacuguccgucagauagugcagugccuaauaagacugaauuggucagggugcuuuugauucacgaagcaaagcccaguuuaaauaagcuuaccaucgcaccuuuguaauggccuugaaagcaagaccuuugcuccagugcacugcaguccucugacaugcugguuauagauccuuaggcucauuuuacaagaugacuccuaggaacugucuggauucccccugaggugcuuugcuuuaagccucggccccuuuaagcacggccaggcagaaggauccgauaaccugguauucaucccaccgguggguugacucucaaccucaccuaacuggcugcuauacuggcuguuagggagggcuugcauuaacaccagguuguugaaaauaaggggaaguuuggagugugaacaaguauggaaucacugaacaagaaggaagugcaggugacugaagcugguagagacagcagaaguccgacuuuagccugguugugcuguaauaacggcuaaguuauuaagguggugguguccgaguacuagaucacuuccugagaucggaccucacucagacucuauuaauugauaccagaggauucuuacuuuauaagaagaugcucaguuuagauacuugcccaaggucacaacucaugcagccuagacggugcuggugccaaauccugucuucuuuccugagaugucucguaacagaauacuacaaguagagcuccccccccaccccccccccccccccccgccccggaguacacugggugcugugcuuaggaaauagggaaauaggagucuugucggcauauaggauggcuuggcuaggauggaggcucggauuguggagagagccugagauuauggagcgguaacagucuggcuuaccucccacaauaaaugcaugugacagacugaaaaagcacaggcucgggauucgcgguucgaguaaagcacacguguacuagcuaguguugacguuuggaaaggcaugggcauugguggguaaaacuggcugcguugucccuuaucuucaccugcuaucaacaugagaaauuaguuuugagcccuggugucugucugucuguuugucucucucucuaccccuuccucccccauuaaagaugaaagguuaacauuucuuaguuucaguuuugccaagaauaaacccuuuguuucuguuuggcaguggauugagaaugaaaguugagaucucuuaggucucagcaggacaacugguggggggauugaagcaguggaagcaaacugcugcucuucugacuuucggagcuuggaucuaggagauguuucagccuagggaagcaacuuguuaagguaacacaucugacccaauguaaguuucugugauagggccucccucccaugcccugauuucaacccauaaauguuacuguaccaaacucugugaccccgggcuuaaaacaguccgacuuggugcguuuuuagacguuuaaauugcagcauagagaggugacuuggcuuggcaagccugaggacuuguuagguacucagaacccaaagcugaggguggggucugggugggagcugggagcgauggcauccauuuguagucacagcacuaggagacauugguaggcagauuccuggaggucccugaccauccagacuugacaccucagaaaguuacagaccgaugagacacccuguuguguccccaaccccaaaggacagcgccugagguauaauggcaugaggaugcccucuggcuuccccaagcccacagguacacaacuacacagagacuagauuccuacccuuccugucccuucucuccccaccuguuguguaugacauucaguuguaauuguagucagguaguaagggguaccccaggacuccuuauugccagagagacuuuagugcuuuuggcuucacaucuuacauuguuugagguuuacgauuuuucaguguugauucuggcuugcuuuuucuaacucgaauaaccauuuucuugaaaaacacuugugacuuuuaagugcguucuuaguuccuauaugaggcuagaaauguccccucaugcucgggaugcuuucugcuggcugaucuccccccugcucuuuucuucuccugguuaacaguuacuucuugcuacuucuaggaagccgucuugaaugggcuuuauuggaaccagaccuggggaguuggccucucagggauguguuuuguguuuccaaggccaggaguucuguucccccuuugucuugacccaguaaaugcugugacaaagugauuguuaugaauucuccucccuuaaagaauauucucaggauaccaaauucaguaauuacucauuugcuucucugggguuucagcaguauggugaguccccagggguaguguucaaggcacaccugcuucuuuggagaagaaacaaauuaauauuuacagagguuacugaaccccagucagcuguuuuguuaguugauuugcacaauugaaaauuagcauucaauucugacagaacuggcgaaugucuugggaauuuaaaugcacuuuaggaucugagaugcauuuaaaggaacaucaugcaugcaucuaaggaaggcaggcugaagggcacguguuaagagucagugccuuccgaguuagcagccacacacccaaguaggcuuccacacuuacugaagugugggcugucauggguaaguuaugucaccuccccaagaucccagcauguguugacaguuccgauaccaagugcguccacuuugaguggugcuggauccaucaauauuaugugugaaaguuaaguggggggaucgacugguuauugcagguaagaauucccucuguacaggaugccacuugaagcauuguuuaauguuucaagguagguuagaagauguucuaccacagaauaaacugggccauagcuuggcaagggcaggcauacacccacuggugugugcaaaauggagcuggucuuuguuuuguuuuguuuuuaccacgagccacuuugguuaagugcucggcauaaacuauuucauuuccaguagcucacuggaccuuauaagguaagagccugaguuuuacagaugagaaaccggguuuaggaaugguaccucgguguucagaguucugugcagagccaggcgagugccgccucggagucuccuaggcccuugcagugcucuaaccccuaagggcaccugcaugggcagcccuucgucagaaggcacaggaggcaagcgcaguucauguccaucccauucugggagguuggugacagcauaaaugcuuuguugacuguaacuaagcagagcuuuagaggaagugaacagggacuaaugacccuuguggucagggcuuaagaggggaacuuucuauuucuuaccuuuagauagucugaacauaaggcuugucuguuugaacaauggcgcugguggagcaucucaggcagaacgcuugcuuaagguugcccaaggccccaauucuguucucaguacugcgaaaacaaaaagugcagacacaggacucugcuggucuaagaagccaguguugagaagccuccugacuggccuagggaagcccgaguugcuguccugauguggacuuggccccaguggguuuucucuacauggugugaggucugcgagguguaugcugcacuggguaggaaaggcacccagguuccauaaggagcauccucuaugcccugagaauggacgugucagucguuagugguuugaggacacgaggucauucugcucuguuagagcuggugcgcugggcugguguuucagccggaggcaccugcugccccuucuguucucuugggaucccuccggcuucuccgcacugaaucuuccuucuaggugagcauagucacuagguuugucugacacgacugagacgacuugaaaguaccuuuguuccuaaaauaaaaccacuagucauaugacggcuuauauauuagcaaggaaucugauaauaaaaccaucgugaccuugggccacaaucuguagaagagaugaauacauaaauacuauuauuauguuugcuuuuuaaaaacuacaacauugcaaaccggcuuugaaaaauagccugcacguuuugguucugggagcccugcagucaccuccacacacuggaaguaguuauaagauacagauguuuggucgaacuuuaacaaagaaguguguuuucauauugcuugcuuaagguuacacgggcucgaauggaaaccuuuuaagucauuuucugcugagggauuguauaauucuguuaugccucuccucucuuuuaauuuuaacuuggacuauaauacagccuuuguacgcuuuguacaaauuagcuuagagaacauuagaauuuauuuugaauauucaagugcucacaucagccaugagacugcaaucagauaggaauuuuaaguagcuacccaaaaaagaaaauacugcuuaaaaaccuugugaauauuccucucgcagcuauuugcacucgcggccuguugaguuaguuguucacugcaccacugaggcagagcacuguccaucugagcccggccucuaaggcagcugugggaaaggaagcagcuagaguugucuugaugucuuggcugcugucuuuuguacaagugcauuucacacaagaagguaguugcucugaacgggugggagcuucuccauugagacuuuuuuuaaaaaaauuaauuacuuguuuacauuucaaaugucccuaagaucugucaggaccuccaugucccuagacaggcuaugaauacugcaguggcuucauugucaagacaaguagaguuuggaauggaccuagugaccccaaaggagguuggcugugaccagagaacauugagaccaugcaucccuuucuucugccucccucacucccucccuuccauuuugaacccaggacuuaaaccauguauguaaaugcacugucacugagcugcacucccagauaaaguagcuguuguugguguguguguguguguguguguguguguuuguuguuuguuuguuuguuuguuuggugguggugguguuuuugacacagagucucauacagagcccaggcuccccuggaacucauccuguaacuccccaggggcugagguuccaggcacggauguaucgcaccauagcccggacacuugauuuucauugaauuguagaacagaaguugaauuucucauaguuuugagaaacggggaucuggacucuaagauggugguaaacauuugcagacacugucauagcucacagcugaucugcuggugggauugcaaagcucuucacucaccgauggccccucucugcuguuuauuucuagcccaccucugagcuccgggcugcugacuucucauaucuaagucuacgugggcugucaccaagaauccugcuauuguguuugcugcgugauagggcgcauuagucuauacuaguuugccuaagccauuauuaagcuagaacaacccucaucucagccagucacucuugucuaccugucagucaccaggugugguccacccaggccuguccugucccugucugcugcuugaacguucucagcacauuuaguuagugacuacagcuucacucugucuccuuucugucucccuuguagucuguugccaaaguggcuuuccggcaugucgauaggaucauuuugguccagccuaaaggucuccucaggcccgucauccuuugaccccguggccugugugugccucuuaaucuggacauuuaagacuuguuuucccccuguguucccuuacuccugucuccgugucauguuuuauuuagauagcuuccucauuuauaucugugucuauucccacuauuuaaaaagcuaagcggaacggcuaagugaaaggccaaggcuaaccucaccuucuccuugauucugacucuggcugaacucuggguacucugacuccuugacuguuuagcuuggcaugcuaaccaucgugugccucaguuuucucuuuuuaaaaaaaaaaaaaugagaauggccaguaucuuucuucucacaguuucucaggcuccuccugggaagacuuucucuguugcagaacgugagcuuuuccggcuguaguguggguaucugauguguccuugagcuaugugcuuuccuuuacacauggccgugugaagcugaugggaccccugagaacccugagcuacgugaggcuucgcagacgaggagcccaccugaucagggaacugggccaggucuccaggcuaagccgaguaaaccucagcagcucaguccauccgcuagacacucaucccaccccccaccccccaggggugaugagugcuauuuuaaaggugguguuuauuugcauaucacauuguaaguuuuggggguugaaugugcccaagauagaacagucugauggcacuauucccaaaaaagccauaaggucaagccgauguguaaauacugaagguguccauuauuaaaugauaucgacuagccgcccuuuggaaccuuauuuuguugugcaccaugcccagggugaggaugggcaaagcuggguuaaguagccacaaggcuaccugauucauugauuaugcauacucacuugcuguagagcacagugcugcccucugaggaucugaggaacgcgggcccuagcauuccgaaucccagcauugggaggcagaggaaggcggaucuauugaauugaaggccagccugguuuacaaagugaguuguaggccagccagacucugauggaggccauugacagagugaacacauuaacuuaguggugaggccugugguaagaucguauggaguaccaggggacagucauggagacuuugaucagauuggaaagccaggaggaagcaggaagcagucggggagaaagaggaaauagacaugcugccggggauagacagguaugugaggaaugagagucaggaaaccugugagaaaggaagcuaccagugucggcccuggggcuacucagaggagucugaacuuuccucugguuuugagcagugaauaacggugcaagucuuaaagacagaguagcuccauuugagaggggcuguguaaggacaguagaggcaugaugcuagcuucaguuggacgguagcucugguaggagcaaauaggucuuaucaaucaauagacuuuagggauuggggaggaauuuagaaaucaucuggccuguuauacuugcucugggguuugcagagaaauucaaacagagcaauacaagaaacuuucucuaaaccucuuuaugucucugaugugcuguuuucagaggcuagggcauuguggacauugguauuuuaguuuuauuuuucuucuuugaacuuuucauauauguauguuuugaucaucuuccagaacacccucacuacacccgaguccacucaguggccacaggaugcgcacagauguagggccuuccacugaauggguaccuugcgaggggccacaucucugaaaaugggcuuuuccuucccaguuagggguugggccucagggucucuccuucuacuagugcuggaaugcugacuggcugacuggcuugaucuuguauggcagccacagcccugaguucaagaacacgauggccuuaggucaggaaaacaccuuuuuacaguaacccagccucugacucgaagaauuguucuguuuguuucuucaccugcuguguuugccaggccucugagggagaggugguuuagcuguucuguuuagggccguacagcguacagucacuugcucuguucuuugaucaguuguggggcucuguuuaaccuccacucucugcaaaaagagacuucuccagugagggcuaaggacugcacuaacccuagcuggccaaaagugguacuagcugcccgagcagggucucaggcuauucuguuuuaaaauaaguuauuauuuuuauauugguugagaaaggggcacagggaggguuucagggcuuggucucagguugucacguuacacacgaaacucuucuuggucacucacuuggugucuuugcaguuggguuucucucuguaguccaggcuggccugggauuuguaggagugagccaccacauuacagcuucugggagagucggggaucuuagagaaguagacuuguuucuggccuggagaguuagacauaggagguggguggguggcuuuugaguugaaucuuaagagcugagacuagcuacgagaagaguagugagggccugcuguguggggggccuacuguguggagcaccuacuggguagagcggcacgugagcccuaaguuguaugaugugagugaaacugggugcccccaggaaguagcagucauacucagaaauccuggagagcuguaacagcuccagcuguaagcagccucaguguuuuuuucagaguugauugauuugauuauguaauuaucaguauugaggauucugcuuugcauaaauaugugguacaaauuggcagaaguuaauuuaggaccacuuuggaaauccuuccuaaucccaagcuaaacuucauccugauuuuguuuuguuugguugguuuugcuuuauuuuuuagugaaauccaagcuugcagcuucaacggcaguuuuuaaaauugaauauacuuaaaaccauauaguaucaaaauacacuaguuugguccuuacaugccaaggaaugucaguaggaaaauauuaagugucuuuguuuuccauaagugaacuacuaugcuucucucaaggcagagcagaaaugcagagcagaaaugcagucuguaguggacagcagcacuuaggcugagcucugagguguuucagccggcauuggcugggguaaggcagguugccguaggcagugcaguguucauacgugagggggcagggggcaggggcucaggcagacaugccuuggguucauuacguguuugauguggaauuaauuuuuggucauugugcauucaagacucuuuuacuguucccagcuuugcauguugcuuuuuucaugauuuccaguaacgugaccucuaguuuaaaaaguugggucauggaaaaaccuuaaggaaaaccauagaaaaaccuugguaugcgucagucccuugacgugucuugacuacaguagagaugcgguuagcaugaaauguguggggcaguugccauugucuguggcaucgugugaugucgugugacaucgugugacauguaguuucacguaaauguuuauagaauaagugauugcauauugugaucgcugccccucccuuucuuccuaguguuuuuacccuaaauuauuuuuuguuguaauuuacaauauagugcccccucuuccaagucuuugaaccaauguuuuauugauuccucauuaaacccaaaacuuugggccaggcuaaacuaaaagcaaaaaacaguaucaaggccauaaauaccaccaucuuuaugagaucucaaugauucauuugaagacuuuaccaagccuggucgcacacacagcagugccuacugacucagcuagaaaaccgugucuugucugccuccugcagcagcuucagccacggucucucuagggaguagaagcuggagccgcuggguuggguuucgcugaguguucaguagcuugacucguucaguccugagucggcuucaccccuccaccagccugucugauuccccauugcccaugacucuugagggauggaagcauccacugaagaaggucugugcccggaagagcuccagucuuuguuccucuguucugccacacugacuccccacccaucuuuccaguuuggagcucaguuuguuaucuaggagaauguguucacuggcucaucuauguuaagggccuuggcuuuucugccugggguuguguguguguguguguguguguguguguguguguguguguuuugggaggaguuuuccuuccucccuccuugauccguccccuccuacccugcaaggucucacuauguaaccuugguggcuuuccuggaacucuagaccagccuggccuugaacuucacagagauguccuugcccgugucucccagcugcugggguuaauggugugcacaaucaugccugagucucucucacuuuguacaauugcuccccuucuauuuggagucagccuggacauuuacuuccuguagucucuguugguuaugccuucagcccaugccuggaccacugucuuccacguuuuggcuacuguccagccuacccgagcucucaggguagaaugccauucucucggaagccuuccccccucccccaucuccuguacaugacacucacucucaguccaccagacuguauucuugaguuagcucaucacauagacaucaggucccacaggagcagagcugucccuaccacgugacagcagaccucugaccucaaaacacuucccuuucucucugucucauaagccagaugcauccucacuaccaucuagugcagugguuuucaacuuuccaaaugcugugaccauuuuaauauaguuccucauguugugacaaccaaccaaaaaauucauuuuguugcaacuucauaacuguaauucugcuacuauuaugaauugucauguaaauaucugaugugcaggauaucugguauuugacaccucccaccccauaggggucacuacccacagguugagaaucacucacugaucuagcuccugccuucuuacacuaccuccagcuagagacaaaccgccuaguccuuucacagagaccagaaaucacuagaaaaaauaagguuacagcuuagcauguguggugaacagacuguccgugcacagaccaaucacugauguuacgggccuuuuagucaguaguuuugcaggcugcguggcuuugucuguggucugugaaaucuaaugccuccauuugaaggcuggccucacaccccugucagugauggguuuugcucaugcuugugccucucaagugauggaagaaaacguguccuugcuggugaaggagcugacccugcucuguuuccgaugcuaccucuguguguuucugcuuccguccucgccucauccagaggcuccaggucccuugcagguucucaccaccgacuccugcaccugcacaguuuugccuuucucggucacccugccugucuccauucccugaaaggccuagcuaggcuuguauucuguggcagcuucccuaagccuggcagcaggagcugggugccugccuuuguacucagcccugcauaggaagacccugguccugcggcccuucccuccaauguugagccuauaaaugcagcugcugcagugggccugccaaggccacuggggucagaggcaaaagccuguguugcuuagauaccaggccacaucuguggccucacuucugauaacaguaacccugauuuuaauaggagaguaaguaagugcaaucaaauuaguaagguagaguaaagaugguucugcggcucgcugcuuacuuuguucaggucgaugcaggguuuucccagaagccacucuugacacuaguggucccuuuccuucucugaguagcucaaggucacauguucugcccucuggguugggcaucuuaccuuaccagugagucagggagagaaggaaucauagcuugcugauggcauacuagaagggacguggaugcugcuuguuauauuuucacguuuuaaaauuauuaguuucuaaaucaauuuguuuuucauaauuaaauugauguagugauuaaaacuaguguuucccaaggaauaggaguggaaacuguuuuacaacggcuauggaguguuuuggcauuagaacuuauuuccucuggcaccacguugccuuucuaccugucuggagaugguauugauaaaguaguugcaugugccaccaugaaaaucacuuuaauugcaaucgucucugcuugucuuucaucuccagaaagggaaacaggauugaagugagagccagugcacuuaggugaggaggcagauuguccguucugucuuuugccuuuugguuugcuuacauauacguucuguguugcagacagugggcugucauuuacagugaucaguacccccaugagacagaaccccuccugucccaccccaccccaccccccagccaugcugcaagcauagacugagcacagccaggcuggguuaggaugccaagagcgccugcccuucacugccaagaugucagcuguauuguucuguaucaacugucaagauuuuuuuuuucgaucuucaaaucacuguuuucccucaguaagcucguguaccuggcucacaggcaucacucuaugauguucuccaaacugagaaagcaaggagaaaguguuuuguguuggagaaacucacagacaucuguucugaggcugugcacuagugcaaaccuucugaaacucacagacgucuguucugaggcugugcacuagugcaaaccuucugaaacucacagacaucuguucugaggcugugcacuagugcaaaccuucugaaacucacagacgucuguucugaggcugugcacuagugcaaaccuucugaaacucacagacaucuguucugaggcugugcacuagugcaaaccuucugaaacucacagacgucuguucugaggcugugcacuagugcacaccuucugaaacucacagacgucuguucugaggcugugcacuagugcagaccuucugagcucuuacucauagcacaggggaugugugugcccagcacagcagggcgugugugcacguggaugcacaguguuucgcucucaugacacugcaaaggaauacauucccaagccaggagcgcgugcccggggagaugaaaaggucacuugcaaauucuuauuuuggggaaaagaugccacgugcucugccuugccuuucuauucacuccugcuuucucccuucuaccccucccuccucuccccuccucucccuuccuuguccccauuucuaguccuucucuccucuccccuacauccccccucuuuugucucccuauauauguauguguguauaugucuauaucuauauauauguauauguauguguguauauaucuauaucuauacauauguauauguauagauauuuguauauauguauauguauguguguauauaucuauacauauguauauguauguguauauauauauguauauauacauauauauuaauaaagcaucuucuuucuuuuuuguuuuuccaagacaggguuucucuguguagcccuagccauuuguagaccaggcuggucucaaacucagagacccaccugccucugcccccuuagugcugggauuaauggugugcacgaccauaccuggcaauaaagcguguucuuaaguguguguugcuguacugugcucuuccucacuguccuuugaaugugcucuuugugcagcaagagcacauuagcucaugcgacuuagcucagggaaccguccgagaguguccuaacgcaccggagcucccaccagagcuagugguguuuugacgaaaaagaacuuugagauuuugugcccacauagucaugugaaaaccagcuugauauuguuaaguugauccuguuggauuuuccucaguucugucuauguggcucgagccagcagggaagugguaaugugacucucucacaaguaccuuuaauuauaacauauuuaacuucuauuauugcuagcuuuacuuucaaaaugaucaguucaguaaauuuaaaaguauuugaguguucaguuuuuaauguguacuuuuaacuacugaauacagguguuaaagaaauuauucuuggggcuuaaaagauggcugagcaguuaugaucacacgcuguuccugcaggguacuagaguuaguucccaguaccuaugucaggcagcucacaaccacgucaagggcagccuaagagaacccugaucuggaggcuggagagauggauggcucaacuguuaaaagcacuggcuguucuuucagaggaccuggguucaauucccagcacccacauggcagcucacaacagacgaaaauuauaguuccaggggaucuggcauccucacacagacagacauauaugcagacaaaacaccaaugcacauuaaaaaaccaaaacaacaacaaaucccaaacaaccuuguucucuuuuugauuuuccucuuuuggggggaggggugguggugauggauauuuaaguuuaaaaacuaaauuuucaauaucauuuggaaauaaaaccuugggggaagggauaucagcauagcuccuaauacgacgauugucaggcauuuuguuucauuuacauuuucuuuuaaaaauugcgccucaccuuuagcuuaugcagauuauaucuguuauguuuaaccugccaggaguuaauuuuaaaugacguuaaaauuggauuuuuagauauuuuucucaucugacaccaugaauaaugucuuucacggaaaaugugcuuuauaaaacagcagaaaacuaaugcacacagaacgcuuguuuuuuugccagagucuuacacgccuaccucagugaaggacgccuggacccucucaguuugcugcagucaguagacuucgaucuugcauguguagucucugaugagagggagaugggaaaguaucaugaaaacaguuuuuccuugcuggaaagggcccagagcuggggugaugacugcaugcugaggaccccuguaccaaagcuccucuguauugcuuuuuuuuuuuuuuuuuguauacgugcaccuuuauuccguauugcauugucuucaaacaauuugaucauuucuauuuuuaacaucuauuauauuuacaugggucucuaauuuuaucucuuguuuauuucuaucagguuuggacacuaauuuuuuuuuuuuaaugaugcuaauuucuacaauaguuacugcuacuuucuucacaccuuugugugugucuugggguggaucucugucagucugaggccaacuaggguuagagaaacccuguuuaaaaaacagagaaagaaagaaagaaagagagagagagagagagagagagagagagaaaccagagaaagauuaaugucauuguagcaguaaaguuauuuuuaaguacucauuuuuauuuuugaauuuaucccuucucauggaauaucuuugcuuugugguccuuggaccuuaaaguuggcuaaaacucgcuuaaauuacauaaucucauuuuuauucaggcuuauuuacuguugacgaaggagagugccuucguuuuaauacuaaacugcugcugguauccccuugaucuugcuuucuguaaccauuuaacccuuaacucucuggaagacaagucuugccagucugccugguucugcgcugagucugcuccagggcagugagcuacugagaggcucuguugguucucuuugcgccgacuagucuaguguuuaccagcuacguacguguucuccccaagaccugaaagugacucauguaauugaggaacugaaugcauuguuauuuuuacuuugaaugauuuuuuuuuacuuuugacacagagaccugccugccuuuguuguguaacagacuuuuccuggggaagaugucuuuccuccuccuccuucucuuccuccuuccuuucuucccucccuccaucucuccucucccccccccccccaaccccacaaaaucuacuacucagccuaguuagggagaccaggacagaccaaaguacaguuacuucuaaaguccaacuuggugaaccaguaaguuuuacugugauaggggcaguacagcuaacaaacuggagcacacugcgcagccuguagcuuaaccaguagaguguccuuucuagguggcugggcugaucugagcccuuucaggcagcucacuuaucucugccuauucaaagugauugggcuugucuuaaaguccaauugcuucguggacagagaaggauuuaaugaauccugucaguuucagggacuuccugcagaugguuuugaguuauuuucugucuuaagcuuucuuguaggagggaauguuucaauagcaaggaaagugcuauuauuuaacacuccgguccuuaggcauccuccccccccugccccccaauacccgccaagccuguuuuguugugcugguuuuuuucuuuuuaaaugaauuuuagcagcuaaagaguauuugauuauuucuuuucuaaaguuuuaauuaacaauuauuauacauauuuagagaguauacuauagacauuugauacaugcauacauauauauuaugaucaaauagcauugagauccuucagacucuucuaguuacuuuaaaauguggauaaacuauuguaaaucacaggcauucugcuaugcuacagaacccuggaagcuguucaccccaccagugcuuucauaccuaguuucugaucuguuucuguccccucuccauccccuugcugcuaccuggagggcuuggguugaccugaugagcgcacgugugcgcacgcacacacacacacacacacacacacacacacacacacacguacacacacacacagagucugggaucagaugggacaagcauucugauggagacugucggaaguccugaaacuuagcaggucgcuggaggagaguagucacaggcugccgucaucccugaggccugugguucaugcucaugucaauaggguauccuuaggaguucacccccgccccacccucuaucuuucuaccuuucuuuuucuaugaaaucaacauuuaaacucccacgagugaaaacacuaaguaccugucuucuugccgugccugacuugaguauguguccugacuuguuuauaugugccugacuuguuuaugugccccauuucacuugcuucuccaucuuggcucuugcuugugcgcaugccuguguugcugagggugcagccuaagccaucuacacauagagcguaaaugaccagcugaguccuaggucuuuggcaucacuaucucgacacccuuggagaugcacuuaggacgggaccugcuggcuucugaguguggauuuuugaggaacccuuuccuugcaguuuccugucagcgacagcguuaucuacacucauagcugggauguuuuuggcauuuguuuuccugucccaccaguguuugcuuucaucuuuuuuuuaucauagcauuaucauuggcagguggugauuucucggucuccuuggugacaccaaguauuuuucauguacuucuuugccacuuccuuuugagaaauaucugguuggauugcuugcccacuuuuugaaaaaaaggauuaauaaaaauaagggcuguuucacaaaugcguguuguccuugcacaggggccucgccggucuguuucaucccaggguugugugugcugaagugaauguugccaccuuuuaacauugagaaaucuugcuuucacuguugagugacugaguucgggacagucccucgugaaguguuuccuucaguuggcugguugucccuaacgacagcucuuccuugugcugcaucccugccucguuccugaccuccucgguuuccugaaggcuuacccugcccacgcgccugucagugcagguauacuuuacugucuagugugcuucgucacugagaaggaaacuggagagacaggaaugaaaagcaagucuggugauggacauugaaagugagccuuguggacaaacagucuaggggccgauuguuuucagguuguguaggaucgacccagucuuuggagagaggcaguaaagguaacaugggaaaugggauaugaagggauggauucucagaagggggagagugcagaggaaguagagggugaauagggaccuuauggagcagguuagugaucccacacugguucugugcagaggaaggaaagcagacuguuaagaccccauacuuggggguuuauugcuguucuauccguaaaagccagaaaauggaaccaaccagccugucugucaggugaguugaguaaagaaaacaggaugugcacacacagugugauucuguugagcuucuuuguaacauggauagaacuggagagcguggucacgccaggaggaauaagucgugcacagaaagacagucacuacaucuucucauguagacaaggaagcugaaaggcgaaucucauagaagagcuccuggagcgauccagggcugggaagggggagggggaggaccauggugcaguaagggggugggggugggggauaacuugccaugcucuguggcacaaaacagccauggcugacagcagugaaguauguagcguagcuacuagaggcgguuuuggguguucuuagugcgaagcagugcuaugucugagaugaugugugugguuaccaugacaaucaucacguguuguauauacuugcaggcugucacacuguaccuuguaaguguauaguuaaaauaaaaagugugaguuaaaaauaaaaagguuguguuaaaauagacagugagugggaaaaggugaauuucuacugguuuacacaguacacgauugauggcuuuaagguuuuaguacauacaguaggguuuguguguucucagucccguccccccucccccuuucccaucuccauaccacuggugacaaccuugcuugccuccuuggggaccucugcaggcuggccugcugacacuuugauguggcacaugggcaguggcuguggcucgucuacgcuguugugucagggugguguuugcagauagagugcuguucacuuggagucugaguuuggcagaagucugguucugcugguuauuuuuccuggaagucaggcuccgcggguguggugccaggaguguuccuggagugacuugcugggauccagccugaccagaaaagcagagcuucguggguggagccccaguugugggucuuguggagacgguccccaaagcagacuggauucucuggagggcuccgggagcagggcuggcuaggaacuuguguuuaaagagagagggguguccaguuucaggaugcauaguggaauccugagugagagugucuguggaauuauaaguucagcucaauggggucaccccaacuuuuugccaaaguacaccaaugagguuuauaagcagcaagaugggaagauuaaaccuguucuaauuuuagugccaguuaagagcugggcagccagaguuggaucuguuucccgcccgguacaggcucugccuuuucuaacgugugagucucugcuucuguaaauaagaaaaauaacccuuucuagcauuaucgagaagauuaaauugaacagcuugugugguaggugcuugguccugacuguucguguucugagauuguuauugauauguuucuguuauugaugaucccaucucaaagccagcaucauccaagggagaccauccaggcuucauaaugaaaucuuuuaacucguuagcaaagcauuacagcccauaaugaugcagaauguguuugaugcuaggacacauuaggccagaguuaaugccacaccuuguccuauuaaacccagaacagagcagcuacucuccuuacgugcuagauagugcccagacagagggccacuugucaccaugaggccauugugauccauguagaaguuaaguuaguugguuauaaauugaagccauugugucccaaggcacuuaguuauucuaugcguagcagauagagaacacucaggguguguccucugacauggguauaaaguuucucuguggucaagucaaaauauuuuccuguucuucugcacccgcacaaggauuggaaaaagucaagcuguuuucuauugcuguagcuccucugauaacgaaggacauaaacagaauguggcugacucugcuguugaucaccagggccucucuccugcaggaugcuauguacacaguuaggaaaccaaccaggagagugcuguccucuuaaacacagaacacauuugacuucaaaagaucuuagacccugucucucucuucucucuucucucucucagaccagauuuacaguugcuucagagaauuccucuuuuugaagaucuuuaaaaaucaacaguccacauuucaaaagccagaugaccaaagaguauugcaauauaccuuuacauaggagauauuguggauauugaagagaaaaaaaaauauggagguuuagaaaugcucaguuguugagagccuucguugcucuuccagagaagccaggcucaguuugcauagcccaucccaggugcuucacaaucccccccaguuccagcuccaggggaucucgugucucuggccucuguggacaccuauacccaugugucguugccaggcauaagcacacacacagacuuauaauuaaaaauaaaauacgucuuaaaaaaaaaaagcaguagaugugauggagcacaccuuuaaucccaguacuccaaaggcagagacagaucucugaguucaaggccagcuuggucugcauagugaguuccaggccagucagagguacagagugagacucugucucaacaaaccaaaacaacaagaaagaaauacaaaaagcucuggacauucuguccuccaucacuaugcggaagaaauaguuuccugagccauuuugucuugaguguuuguuaacggcagcccaggcuggcugcagcugaucuccagauggagggaaugcuuuagacggcucguguguaugacagaagccucgggaggaaguggcaagcuuucuuagacggcugcugcugugcuuuaacagguucagcucuucugcuuuuugugcacaaggaaauaugugauagcuuuuccagaucagguaagcuauucuggaccauuucauuucugucaccugccagguagucagucuugucuuucagugugugugugugugugucugucugucugucugucuauacuguguuggacuuugugaauuucugcugagcauggaugguuuugauaaaguaauaaggaaucccauuuguacaacuagcucuuugagcugcagggagagaaggucacucuugggcaucuuauucuguacucccuaaaaaagaaccggaugcccaggaaaagcaucuucuaagaccacuuuacagcuucuuuuauucccugacuucucuaggaaaggcuacuuacaacuucuguacacagguaggguccccucuaaaucuccuucauuuucccauggggacccauugguuaugccuugguggacuucauguuaaugucaccacuggcuuuccuucauuguuacagggaaugguuuuucugagagcuuggguugaaucuugcugucuggggagaguuggagggaagggcucgcgugagagcacuguagauauugcuggggccuggagaacggaggcaguuccaugcagaaguggcugcagauacggcccugcggccugaugucaggauucugcccuuuacacuggucgggacuuaagcaccaugagcaccuggcugcagaggaaccgcauuccugaaagaggcuggggcuuccagaggcugacaccgccucagucuguugugggggcugcgccagucuguggcuccugcauacagaagaccccaugcagagucaaguggcaucaggaagggggucacagagugacaggauccccuccacauguaaaacugccucuauuuauuuaugagacagagucucuauguagccugugguuggccuggaacuccccacuugucucuacuuccccugagugcugggguuaagggugaggagccccauguagcauuucagaaauaccucuuccuugucacugucaguggaguugauaagaaauuagccagagaauaggaaaaaaaaaacuuuuuuauuuuuuauaaugcaaccaacuuucauauuuuguugccagaaacaccuaggaugugucaacauaaaaauacugaggauuuuugucacaggggcccgagacuaacuccacugaagaacaauauucucgguugcgaaacccagauugaaucugcaguaggagcugagaugagggaaggugacccacuuacuagggacaaggacacguaccuugcacucacuguuaggaaaaaagcccuggaacgcuuacggguuuaucccuggugucuuugccugccucuuacggcccguaggacgagauuuuuuacauuugucauuauggcugagguaguucagaccaccgugucuuugaaucucaaagacauuuuauucagggugcuuuugugcagugcagggcucccugaagugaagcaggaggaugaaaacccacuccccauccaccccacccccuccccauccgucccacccgcuccccauccaucccacccacuccccauccaccccacccccuccccauccaucccacccacuccccauccaccccaccuggucugcagagcugaggguuaaauaaaugaagcuccaacggacagccggacagccguggacccgagagcagcggagacaccaguguuuggugaugguauaagcucuggggcaaaaggcaaagcaccccccuuuuucagcacacacccuuauucauuuuuaguugcacccccagaaccaccaccauguagauggaggaucuggcugaguguuuguuuuuauuuaauaaauguuuagcccugcuuauugguuagauuuucuuguaacaguuaugaauauuuaagaauugaguguuuugagagaguuguagauucgaauguagcuauaagagaguaaaaauacacacagagagagcuaaggcaggggcugguggguaaggaugaagggaauaggggaacuguggaauuauauuuuaauuuaaaauaaauaaaagagcuagcauagagauccuaaguccccuucaccugguuucccaggggaagugcccuggagacacugaccugguucaaucuggcaugacguggugccaucacgcaaguuugcuuugauugccacaucuuuucuccuucaccucucacccuuggcagccacuaagcuccucuucagcucaggaaguugguuauugcagaaauauuauauaaauggauugacuucuuugacuccauuuaaaucucuggacaaucaaguagauuguugguauaucaauagugauuuuuuuuuuuaagucuuuucuccuuccagguuucaaacaugaauacugaguaucuugauucucuccucucccacuaccccuggcuguccccaacaugucccucuccuaccuuccuuuccucucagauuucucuucuuuauuuccuucuuuccuuccuguauucauuccccccacccuuccuucucuuuuuuuaacccagaaagcgcaguugcugcugccugccaugucuggaagucaucucacaguacccuccuuuggccuuuacauucuuuucuuucccucuuccauagucaugucuccugagcuuuagagaguggugugucuucuuuagggcagagcacucacagucccuuucucagcaccuaacugggugcugcauugacugcagaaagagacuucccuggucaagguugaaagcagcacuuaccuguggcuauaagcaugacuaauucagaaggcaguuuguccaucuagcagaacagcagugccagguucuucuccugucacucccaaggccuuagugaccacugcucaucccugaccacucucccauccucugcccagagccucaagccuuugaccugcucuguucaaccagaaagugguugguugacaucauaaccuucaugggcuguuguuccaguagacauaccuugucaagcugguugguacucuuguucaagauucgcugcuggauaaaaccauugaugacguuucuccuccaaugguccaaagcacucuaugguguuaugaaagcuagccagcagaggagaaauuuugaaucaauuccaucuugauuucucuaauguccaaccaaagugugcugucguuucagcaguagucuuacagucuagcucuugggcaacuaaugacuugacuugcuugcauuguuugggggccucccugacuaacaaaucauggcaaguaucucaugccaggguguguguguguguguuuuguuuuuaauaauuccuggguaauauuccacagaauagucaauauugcuguuaaacugccuguccacccauuaaagaacaucauaguuauuugaguucaaagcuuaccaugauaaaaacuguauguucguguuuaugugaacauacuuuuucacuucuccaaauguucaauaaagucauuuuggugauaaaauaguaugucacuguggggccucuaccacaguuucuguaggucauaguuucuagauagaauuuuaauaggucuucucaguauuucuauaguuuuaaauauuaccuagaugauggucuuuagggaaauuauauuuuuucaguauugauuucuagacauuuacguaaguaccaaauacaguuuaagcauuuccuuuaaauuuuuuuagaguuauuuaucuaaguagauauaauuuugaaguguuucacguccugaaaagaaacuccacacacacaguaggcacuuuccauucuaccuccauuccucucacaucccgccccacccccacccacccccugccccuggcagccacguuuguacuuuguguuucuucagucagguucugggcauugaauggaaugggauagcuuuuuguguguugggcuaaguaacacaugccauguuuuucugucccaucuugucacagcacacuuuguugauuuguuguuugacucuugaguugcuuuaacuuugggcugauagaauaagauaucauagauuuucauccucucaagugaaugucuaaaauugccgggcaacgugaaguucuguguuguuccaaggacuucuuaaacuguuuuccauagcacauacaccauuacacagcggcacuggacuggagggucugaguccggcagcccauaguuucuauagguagaauuuccagauagaauuauuuccagauaaaauguuaauagcucuucucaguauuucugcacuucuaaauauuuccuagaugauggucuuuagagaacuuguaauacgcaucugcuuuuauuucuuuaguauugguuucuaggcguuuacauaaauaccaaaaaaaguugaagcauuuaaccagaggcagguauaucucuggacauuugagccagccuggucuauauagugagcuccaggccagucaggguugcauaguaagacccugucucaaacaacagaacaacaaaccgaacaaccacaaaaccucacaaauaucccagguuccccaacaacaacaaauaucccagugccaauacccguuacuaccugccuucaguauaacuuaccaugguggcucuuacaugggccugagcuguugcagcaacaaugcuuggcuggccuccuuggugcuaacaaccacagugacucugcuuuuguucagaguucccugugaacccaauugacugccucaggcuugcuguguaagaaggggggagaauuguggguguccccccccccaagaagaauugcugcuguugugacauagaauagcauugaaaacuuuuaaaauuuaagauggaaaagucuucuguuuuaaaaauaguucagacccugcuuuuuggcuuaaagaacuaacagccaggggcuucucauagaacuucacaucaacuaggggagucugcaggagagauggcugugcugugcaaugcaugcuggguaugugccauaaauguggggcggggcaguauuaggacaccuaagaauuaaugucuguggugguagaguuugguuucauuuggagagaugguuggaacagaagugguccuccuuccucuuggcugguaaaauuacagcaaacaaggaaaugugccagaaucuguugggauaaaaaccagcguguccuugcgccugcugucuaggcuuugucaguguaauaugauacauggaugggauggguguauaagcaucagcagcuguaacuguaagcuaggacguggacauuuauuuguuagauucagaggcccauuuagagagcuuuuaccagaggaaugauccugaacuucuagggauggcuuccagacaucugugcuugaagguucugggugauugugaguacagccagguuugaaaaguuauugcuaggaaacugugugacuccaggaggacaaguguguccucacuuguccaagcuuaacacgggcagucacauucacauccagguucucucuaaagguacaggugugaacuccagaggugucacucuugaagagcuuagaccuaaucagaauuguggacaaaugaacagauaguuguauuuuaacuaauaauuacauuuuaucaaaaaaaaaaaacaaaaacaacaacaacaacaacaaaaccaaacaaaccauuuuaucccagauugaaguacaguggaaauggcugggcagugguagcacaugacauaaauccuagcacucaggaggcagggccagccuggucuacagagcaaauugcaggacagccagggcugcacagagaaacccugucuuggggcaggguuugggggagguggaaaugaugauggaguugguagguaaggccaagagaggaucauggcuucggucuccucuccgguaaugcauugcagagggcucugaggccuguaguaccauugauuuuaggggagcacagcuguuuggggggcaguguacaugugguuguauuguaauguguuaucauuuaaaauuacguuaauccuguauauucucacagucaguucugguaccugcugucuucauuaucuuaguauaaucaagaaguuggauugaaauucccaaugaggucaugggcugugaaacuugcuugauauuagggcucuguuauucuguguuguagacggacggagucacaggcaaugguaauguuugcaucacagggcccguggaaggcugucuggaauguuuuaagagcagucggguguagaacggaagacccgaguucaguuuuugcgugcaugaccccuggcagcucaucaccaccucucuagguaaaauggaucuuggcuugggacagugauauccagauccauccauuuguagcuuagcaacccaguccgcuagugcucucccaugugaucacauggcuggcugguagcuguggcucacugcuauuacccaguaugucacacugacugucaccaggccaggaaaagauuaaagucaaaaaacaguuucuucugaggauuguucucacaccaccaguaucaaagaacuugaaucuuuuuggccagaaagguuaaaagcacuuacuguucuuuuagaggacccagguucgguucucagcaccuacaucagaaagcuaacagcugcccuguaauucuaguucccacaccaucuggugugagaggacgucugugcauaaacucaugccagguacacaaacaugcaaaagcaaaauugucggugccuccaccauuuucugguugugagugauaagaggcaggucagacaccucugacuuacaucugcucuuuacuaaggaggaaauggacccugaucugcguuuuucacagagaaauuaacaaccagcauccucuuagcauuccagagacauucuucuagaguuuucuugcaggucuaugauucaaauauuacuauugccugugacuccgucuacaauagugaauaacagcccugauaccaaguuucacugccccacuaccucauagagaauuucaguuuuugggcuagcugaguccauaaacaucagguguguguuugaucaguguugaguuuguaaugaugguaauaauauuuuaccuguguugacuuacugggucacgugaagguguaauuauccucauuucacagacuggagaucuaagacugaaagaguaacuuucccaaggucaucuguuggcaagacaggcacuugaacuccugcuggcuugcuucagagugugugccccucacuacuauuguucaauucccauuggccagcagguaucuuuacauaucacuuucaacucuguuuuaagaaggguggaauccugucugccucuguccuguuacuaauaaagcaaucugcagcuuugcacacagaaauucaagaaauauguuagcgugagucagcuccauuucaaaagccugguagcaugagaagcagccauggagcacagaaguaaaaccagucuccguguggccagauccccacaccaaugcaagguuuucacauugcugcacuguagcuucgugggcuacaguuaauggguaauugugagagggaguucugaguccaccugcagcagaccgaugaugcucacuuaucagugaggagucugugcaucagauacugucucguuccaagcaacagagugcguuuugauaaagcaaaaguuaucaccaguucucggauuuaaaguggaaaugaaauugguacuguuaaugauaaauuucuaugacaauguacccaucucugauaacuaaguuguuauguggagucuguguuagagauuguuaagaauuccccuagaauugaauucuaggaccauuuuaauugcccuuucaaacugauuuuucuuagaaucuauauauauauauauuauauauauacauauauauauauguauauauauauauuuuuuuuuuuuuuuuugcuugucuguuuguuuuuucgagauaggguuucucuguguagcccuggcuguccuggaacucacauagaucaggcuggccucgaacucagaaaucugccugccucugccucccgagugcugggauuaaaggcgugugccaccaugccuggcuauauauuguuuuuaaggaccagaaaagcccgugucuuuguucugaguagaaaggaaguuccuuucaguguugaaaggugugcacauaugugcauguguguuuguauuuuuaaaguugugucguaccucacagaauguuuuugcugagcacguugcuaagaggggagcagagcauugaggaaggggcucccugggaaaaaacgccucuguaacuaggauuuuaggaagcuacuguuguggggugugggucuuccucccacuuuccuuuggagugcgugucugaccgucuguaguaucgugguuguguacucccacuuuaaggugguacaguguguguuuaauaccuaacuugaaauagccagguucuguugcuuagagguugcuguaugcugagggagcccagauagcagagcagauagaaacuacagggaggccccugcuguggggcuggggggaaggagcaagggcugggaaugaagagagagaguagggagggggcuugcagacaaccccuuuuagaacagaacaacugggcauguggguaaacaauccugguucccuggaggcugaugagguuugaggccaguauggguuacauacagaccuugccucaaacgaacaaaccacacugcaacgcuaguaccacauaucacaacaaaaagccagcugccgguuuagaaaguguucuccagccgugugcagucuccuaccagguccccucuguaggccaguaugugccugagucccgaggacccacucguucagggcuccccgcuugccaagugcaugcuaaccagugcaaaaugcccuccagcccuaaaauacugccuccccuccucccuccacuaaccagcagccucaggaguugagauggaggcuucacauuugaaacaucuaaucuuauuuagugcaaaggaauucuggugguggcaacauuuuaaacauguuuguccccaaacacuccuguuauauccaaacaguaggacggcuuuaccuucucagcggccugaucugugacuuggaaggacagcacauccaugcuuugcucuuaguuacugaucugagugccggaaugggcuggcugggcugcuuuucuucaaguuucucggggggggggggggggugcggucaggguagugaugggaguuauguucuuugugugagguuagcuauauaugugggaauggaggcacuaagcuaaugugaauuauuuuuguuaacccaacuuuauuauuuauuuaaaugccagaaguuuugagagauuuauuucauuauugggugaccuucguauccugaagcuuauuagacuguuuuccuccuuguguccuuguguauuuuucacauuucugcuuuuguuuuugagaugggggucuuacuauguacagugugcuggcugggaauucacagagcagcccagugcccuaaagcuguauuuuaacauugcugaaaagaauuguugcuuauucucucuuugggagccaauguucucagcauagaacacuaaaauucagggggcgcguguaguagcuaugguuaugugugcaugugucugucugucuguguguguguuggcagccaacauagagugucccccgccugcucacccuauguugaccaucaaaagucauggaugagcccgagugcaggcuuugagugccagccuggcaucccaggucauagguuuguuagcccagcuaguuggcuguuuuagaugaacuuugacaguucaaaaacaguggauggggugagaugguagacagcuaaacuuccaugauauauuuuuaagccaaaagaaauuugacuggacugauuucacagaaaaggagacugccagccugcuccugucaccuuugcagccagaaacaggauuuccagaaugccccuggcacagaugggucaccaggcggccuggcuguggguuuagggcaucagcucuccuagcugugauguaguuuuacacagucuggccuguccagacagauggcuguauggcccgagccccuuucccugcauggccgcuuucuugcuuccuucagcagguagacugugccugggagagcucugguuccauagccuaaggaaccuuagcaguucuugccugucacugucauaccaggcccauugucaagcuucucucgcccuucuuggcaccccagggguggggggggggggaagcagcaggggggaaccgacuugcugggaaaccuguccugcauaaucuuucuuuuuuuuuuuuccauuuuuuauuagguauuuaacucauuuacauuuccaaugcuauaccaaaagucccccauauccacccacccacucccccuuuuuggcccugguguuccccuguacuggggcauauaaaguuugcaaguccaaugggccucucuuuccagugauggccgacuaggccaucuuuugauauauaugcagcuagagucaagagcuccgggguacugguuaguucauaauguuguuccaccuauaggguugcagaucccuuuagcuccuuggcuacuuucucuagcuccuccauugggagcccuaugauccauccauuagcugacugugagcauccacuucuguguuugcuaggccccggcauagucucacaagagacagcuacaucuggguccuuucaauauaaucuuucauucuuugaagaugcuucguguaacugugauuuaauucaccugggcuugcacuacauucgaagggagcuagugagauaaauuggggguagguuuucugcaggagcagggcugggccgucuuugggcgugggauuuguuugcccuuuuggguucaaaguucacaguauuucacgcugcggugguucugaucuuucuuuggacucaggcauaaggauucuaaauucuaaguaguuucuggaagugauguagagggugugcugcuggacucucuccuccccucaugcucuccucagcugucuucauaaauauaagggaguuuguuucguucauucacucauucauucauuuugguguuuugccugcauguaugucugugagggugccagcuccccuggaauuggagcuacagacaauugugagcuguuagguggggguugggggugaggggcugagaauugaacuggagguaaauacaggggaguuucuaaacagaaugccagcaccagucaguuuuccauggugugauguuuaaaaugugacacaauaauauaguagcagaguugccaaaaguggucuagaauuuuauagugggaagagacacaacugagacugucugcuggcacaccucgaaguauuaaaguggaauucuuacauugccucgugguacacaccgguuaucccagcacuuggaaggcugaggcagggaggugaccaguuugaggccaaccuaggcuuuuuugucuguuaaaaaggagauugucugaaaucuguucuaauuuaccagccccugcucaguuguuuaaucuuuguucguguguuuuaugugugaucuugaacuccuggauagcuuuaggguacucugaugguuggaauuucaaaaaauggauucugauacgccuggcuguggccugcaguuuccgugaggcccuccagguugagugaaggucagagaccccaaguuaaaaggcuguuacuuagguguagugucugcagggucuagcuucuggggagagaaauccauucucgucauguauuucuugucuauguuuugggagcugggcagaucaaagagaggccuguugcuugcuccagaggaucaaagccucccccagagaggaggccuggccugguccccacuagcaccaugguucagaguggcuguguucccacuuggcccagcacgcuugagaaucgugucuguggccuucacagcuuggaggcuggaaacugcgguaggcaggcagggguaggcaggcaggcgggccggcugcagaccugacagcaugauugaacauucuuguaaauugggucauggcguucccauaauuccagaugacuaggcaaagugucaaggguucuccgggguucuguaccuaugugagaguauaucccaaaggcuacuucagcagugggucaguccagcguggcugggaagacaccccuuauacugcugcuguggcagggcagaugaggcugugagggagaugagacuggaaagggcguagugcugcaggccguccacggccagcgucggggauagagggggugugagcagcuaaggaugggcaccccucgucuuucccaaggcauuagccacaugcucccugcaaggugugccauuugauugcccucuguggagcccggccagaugcacccaagccugggagucauugugcuucucugaaaggggugcagugcccuuucucgugauggacacaggcuggcucgugcauguacaccugcugucuuugggucagaacuccauuucugaaaacaagguccauauggagguucauuccaucccuucacccggcuuucuucuuguguaacagugucucagguuucauauauguaccugucauuaauacaguuguuucucuuagccacguggauguacucaggacccaccucaaacugaaugccugaagccagagguuauauaaaagcuuguacacacuaaggucugucugucugucugucugucugucugucucucuaucacugucucuuucauacacacacacacaaauuuucaccuucucacauaaagcacacuuuaagaggcuuacugugacaucuccaaaucaccagcaucaguguuuuuuaagaucauuaguaaaggcugugugaacagccaggcugauaaguagaugucacuaacuguucgucccauugguagcauguagcauaauggggauacgcuggacaaagcaguuugugcuccaggcaggguuguguggguugcaccucuuuccucggagugcuguacagucuaacaccagccuaaaacguuucugcuguuuucagucuaauauucucgagcugcagucaacugcaggucauugaaaccguuuagauccuguuuguguguagaauguuuuuucucccggaccuuaaauucugucuucugagcuguuguaucucuuuggguuuuaaguccuccgugccuggcaccugaugcagacagcaaguguccagguguaaaugaaaaagaaaaaugaaugguguggaugggugauagcugggcagaagcguggcauugugguugugagugauacaagccuuuggugacagccugucuuuguaccuuagaggagcagcagccguagcuguaaagaguguauagacacacucaguugugggugugggcgugggggaagauaccugccuugucagaaucagccuggugagucauggcucaacccccacuucaucacuggggcagcgagcccauccguggcauagaucccucuugacucucgccaugucugcucuccaaagacuguuggcuuuuuccacuguuccuaaguuugauugagaaaaguucugcaaacccaggaggagaguggugcagcugagaaggaaggcaccgaaagaacaaauguggcccucuggcaaagucuccuccugggugugcguuugaagagggacccccaugugaggcagcuccugcaggccuccacggcagagcaguuuagacagguuauccaggccagacacugucuucaguugucuccagauacuaaacccacaagucuuuccugaagcccacugcuggauucaguacucuugacugaaauuugaccuuagguuuuucugcuuuucucuggccauguuagccuagauucucaaacuggauucuguccuaggcugcuguccuuggaaucuuaggucauucagagcaguuccaggaacuuacuuuuuuucccaauccacuaauggcucuccuccgcuguccacccccacccagucgguuagccuuguauauuuuaaagccuuucuaugcucuuguuuccagcuuuccuguggcuucugcuuagaaaacugaaaagccuuaguuaacaaggagauugaacgauucuuguauuguucccucuccgggaacuguuccugauguuagaauccagaacgcugugacuugaauuuucuuccuacuguguagcauuaaauggguguguacagcuacuaggaaguguguuccaacaucugcugugcuucagaccuggguccuugugcccuuugggcacaucauuuguucuaggugaugcugcugaacaucugucccuguuugcacucuccuggacaugggaggcaauagauccuugauauuuaguuaauguuuucauuuagcuguugauguuuuagauagucucuuaaaucuuccaagcuucucucuugaaguauuacccaucccccaugccccgcccuuucccuagagguuuggcaauacuuagaaaugguuuugaagguuuucagaagaacuggaggcucagugacugauucuguguaaaacagugcaacuauauuugcagcauaacuaaacacacgauugugaauuugauaaccauaaauuaaaguuacauuaaauuuaacugaauuguuuguguguguguguguuuguuuugagacaagguuuuauuuuguagcccccgcugaccuggaacuauggcuagcccaggcuagccucaagucaguuugucuugccucagauguaugcauuucccacacccggcgcaguaucagaguccuaagguuggacaccuugacucacgacugugaucagugcuaaauugacucggucauuugcuauuggauuacgauccaaauuuacaaaaauguguuuaucguggccuuugugugugugcuccaaaggagagaccuuucuggaacaguuuauucaagcacuuccacuggcuuccuuccguuuagagcugacuugauugguuggaggacaugauguuuaauauuuuaauuuuuuacugugggcaugaaguauuuaaaguaaaaaacgaaggugacaaguaauuuuaagcagggagcagagucagacaggguauuggggaguacaggugacugggggaggguaagaggacuagcaagacgagaggcagcggggaaggguguaugugcaugcguguguguguguguguguguguguguguguguguguguguguaaauaccuuaauaauggcaucaggggguggcuuaggcuaacaagauggcucugcaggaaaaggcacuugccgucaagugugacaaucugaguuugagcccuguggacccacgugauaggaggaaagaaccaauucccaaacucauccucagacuuccacauacauaccccccacacacacacacagaauauuuuaaauuauauuguauauaauauauacuauguauagccuaaguguauuuaauauagacaauauaucuggugacaagcaaggacaguuccucuccugcuguuuucaguguccuuccccugugggauggaugucugccaccuuucaauccaguucuucuuucacaccgaggucuagcaccacagggaaggcugcucuggaacugagaagagaaguuuaggaaacugggacuugguuggguuuuuuggguuuuguuuguuuguuuuuuguuguuuugguuuuuaugugacuucauaggcugcaccgcugugguuuucagugcgcacaguugcaugcguggagggguggggagcagcuuugguuucgcaugaggaauucagccuuugccuuugcaccguugaaaauggcuuguucuuguucuuucaggaaaaugcguguaagaaguauuuugaguagacaguaaucaaugucuccuuucucuuuaauagguuuuaaaauggaacauuucgaugcgucacucaguaccuauuucaaggccuuccugggcccccgagguaagcuggcuucugguuuagcucucaucugcggcuccccucccaucucuuuauagccucucguaaauauugcaugaggucuuggaaauuguuuucuaagaugagaucaaaacuuuaucuccaguccuaaggaccuugugaaguucucuguuaguugaaugcuguccccuggcucucgagguggagaccuuauggcugugccauccuucugccggcucagcuuccauagugcagcccgugaacgccagugauuucacagugguugauggugguacgauuuccugagaucuugacucucuagaggagaccaagccggugcauucugaacacgcccagugugaggacaaaaugcucucucccuugcaaaguucugagggcugcuguucucuacaaacugggucuugaccuauugcccaggccagccccgaaccccuuagauccucaugccucagcucucccaagugcuagacucuaagugucugugaggcaccacagccagacagaaguauaugcauacagugcuggccaugaaacccacagcgucaugugugaggggacgugcgcuguuguugugcuguaaugcaauaagcccacaggacuuuacucuuauuuuuaaauuuaaguuucaaagaauuaucguuuauuuugacaugugugaauuguacacacaguugagcuucguuuuggcauuuccacgucuacagaauguaugaaguucuuuucccuccauuacccucuccuuugccccucccaucacccgucaguuuccauaucucuaauagugcuuuaaggauuuuuuuuguuuuuuuaagaccaggcugaccugccugccucugccucccaagugcuaggauuaaagcuguguaccaccacugccuuuuuuuuuuuuaauuaacaaaucauuucacaucaugccauauauucuucaaaucccuugcuauacugcugcuuuucauuauuuguucuuuuaauuuuuuuuuuugaaguagcuaugcauggccuuuuaguauucucuauaauacuuucuuuacaaaagaacuuuucaagggguucacagaaauguauaagguuuccaucaccaacaaaauaaccuggaaaaccaacuuaaaggaggaaagcuuuauuuuggcuucuggguucagagggguccauccuuaccuuucugggccggagacaaggcuggccauuguuggaagagcauggcagaguagaaccgugcuucuggaugcaggcagaguguauaaggacagagacaggauaagauauucccuucaaagggaagccguguugaucuguccucucccgccaggccccgccuucuacgguuuucaaugucucaguaguccagucaaggaugaacaagugacagauucacccauuagugcugucagggaucucauggucccuucccccaaagcccuaacuaggcagcugcuuguaaacugcuucuuaucagaacagaggacucucagguucacucauuuuuaagauacaggaaaaaaaaaacgaaaaaaaaacaacaccaaaagagcuucaucagugggugaaagaugaaagguguuugauaccaucugccguaagaauaaggguguggggcgucuaaccugguacagccucucugccucuguggcagguaaaaugcgcggucuuuaaacugucauccuacagugucauccuacagugauacuugaucauuuugcaaagauacaugaagaaugcccuucugagaauuguuaagaucaggcaucagguaguugcccauggagaaggagcagguuagacuagaggguacucuguugaaagaacagguuacauuggcagugcuggcucagaccugucauccuagcacccaggaagcggaagcaggaaaaccauggguuugagaguagcacaaaucauguaacaaguuccaggccauuccgagcuauacugugagagacagaaaaagaacaaugaaaugccuuugcaucugccuguguugaaacggugccuucauacuugguuauaaagagucagaaaauucagccuuuaguugucugaaguaauaaaagugauaagugcucuacuuugcaagguagaggagcccauugcaagggcacuguggccguaaccaagaacccuguucuuuguauuuuuccacuuugccauucucauccguccucaagaugaccaccuucaugauuccaguagcucaggcuguucacccaccacaggaagaagaugguuguucauugcauaagcuggagaaaaaagaaagcuuaguggucacaauuaccccaacauuccauuucugcacgagaaaccacacagagcagugauccgccaugguuaccuggauccuuaggaacgcuugcccuggggcuaggguugugaccagcugcuaugggugcucuuggaaauacacaauacaaaagaauaaggugcugagcugaaccuuuaaguaaaggauauggaaauuuuauagguaaauacuuagcuucgcuagcugguaagugaaaacguuacuuucucagcauauacugcuaaggcccagagcugagaucaaaagguguuaggggccccuuccuuguggucucuggggccagccacuucccugaaggaccaacauugccauccgccacuacuguaucauaacugguggcguggggaguagaggcagcagcucugacugaaacaagugaaagcaaggugcggcggacuggcuggacggggucaagugucugcauagaaggaagacuggcauguaguuccccaaagggagcguguuccucuucccugcgaggccaggggaggagaugagggcgagagcgaggccguccaguagagcaguggcuggaggcugcuucuagcaugcgcuuggguuucuucccuuucuuuguccugccuaggagacgggguaagagugggguguccucugagucagggugggucucuacccuaaaaacaugagcucagggguucucagccugugggucaggacccuuugggaccaaaugacuuuuucacaggggucauauauuagauauccugcauuaucagauacuuacaauucauaacaauagcaaaauuacagauaugaaguagcaaugaaaauuauuuuaugguagggggucaccacaacaugaggaauuguauuaaaaggucgaagcacugggaagguugaggaccacugccuugcauagucccgagucugaucauggccgagccaauagugguccauucuuuuuacucacuggccucuauugcuggcuccccagucagacccagugucccucaccuggcugaagggcacacugcuugugccugcacgugccgggcacucacugagcuggaaggcuuuugaaugcaaacuaccaucucuuaaguuuuccaauuccacauuaauucaguaagcauaauaaacuuaguggguaguuugacuuucuauuuucuuucagauucuuugaaagcauguuuauauuauuuuacuuagcguaaacacaaguaauaaauuauucuaaaccuguaucaaaagagcuuugcuuuauuugauguauauuuguaugugguuugcuuuuauuguauugcccagacuaaaggcaacaugagugucagguggcuuuggaaguggucucccuuauguguugacgacuaaauguuuuccuucuguugguuuucagauacaagagucaaaggaugguuccuccuggacaauuacaucccuacguuugucuguucuguuauuuacuuacucauuguauggcugggaccaaaauacaugaagaaccggcagccguucucuugccgaggcauccugcaguuguauaaccuuggacucacccugcugucucucuacauguucuaugagguaggucaguggcucuagggcuuccuuccacggagcugugcugcuguggccgccugaggugugucccuacgugaagaaaggcaucuguuucacucgggagaaagagggacagcgaguccguuaaugcauuuuaaguagguuuugaaguggaucuuuauaaaccagaugucuguacagauguccccuggaauaccucaaaggagaagcuuugguugcugaguuuuugucgcucguguuuuguguggcacacugagaacuaagcuaaauagcuucaaaaacauucuuauucgcguaacagauaggcuggaaaacaaaggaagguugaagagcggaucuggguacauuuuauuauuaauaaaugcuugcuucucguguggaggaggaagugggugggacagugggaaauucuguggcaauucagcuuuuguuuugaucugguaacuugucagaucucacaaguucuguuuuuaaagugucgcuguccauauucauugcgcauggcacucuugugugggacacuguguuguguauaagcugauuuuagaagcuaggucacgugagugguaagauccucauuuggaaucuuagaugggugugugugaguuugggcccagucauucuuucacguggcuagaauguuuuggcuaaaaggcaaauaaucagagucaacacuucaguucuccucccuauuuugcaagggauaaugauacaguccguaaagccaggaagacagggaauguugucccucauuggucagcaugguucaucugugucucuuggaaggacucuauuuuccaggcucacauuagccuuuugcuaaauccccuccauacagagaauuccgaucuacccacaaaauggacguauuccgauauucuuagguguuccggcagcuucaguucuccggggaggugguagagaaaagaauaggggaggggaggaggggccugucgugguggcuuccaggcucauacugcucagggaugggagcuaguagaaauugccaugaccacuggaggauccccuccagcagaaggaugugcucguccgguccugcccguacccucucccuggguagagaugcucgccugugagaacagcucugccaucgcuuuuauguuuaacucuuagagaagugcuuacaaccaguuugguuuccuauuuuuuuauuuuucuuuuuuguuuucuguuuuguuguuguuuuguuuuguuuuucuuuucuuuucuuucuuuuuuuuuuuuuuuuuuuucuguuccucucuagaaugaaggcccucucugcucuaagauggagagugcaggccuggaggcaggagccgagugugugcaugacaccuggcccagugcugggagcugcucuccugcuccagggacagacugcagcagccgucggguuccagagcgaacuuuucucucacuaauggaacagugauaauaccauuucuuuaacgaagcuuauguagagcuuauagacuuuaauauuguacauaguauauucuagaaacaguucauuuaaguugauugacuuuuggagagccucagugugugccuucaguguugcauguuucacaagcccagaugagauaguuauagugucauuuaacuuuguauauagauaucuccgaagucacgagaagaaaauugcuguauaaacuggcaguuugugcaucugauuuagggacuuccaggcagccuguauugaaagcauagauuucuuucuagcaguauggcccagaugaguacuuucagguauacagaggaaaucccacccaugacccuuaagcuugcaggacauaaagggcaacacaccagcauucggaucgcuccugcugcgggagcagccccaagcccuucagcacggucaccauacacaacauugguucuguccuuccauggacuaaaaggguccaccacacuauaguagugacuguaguguguccuugucaagucugggacuucauuucaguuccuuuuucuagaacuagcauuuguauucugugaacuaagaagacacaguagggcagccaugaagccuuaccggcuacgcugaggagguugugaggcccuuggggugcagugucacgcacgccagucucuaguuaccuuccugcuuccgaggcuguaaggaauuguuucuuuuaagcaaauauauagucauugguauuuugguuuauuaacuacagauaugccuugacauguucugaaucaauacaaggaaaaguaauggccacaaaaaggaaacacagaagucuucuuaaacgagggggaccaggaaaggaggggagccgcagaggcaggaagggagcgggguaaaaacaacugaagcaauucugaaaaugacacaaggccaaaauguaacgggaguacagguauauuuauaguuggugccuuagguagggaaaggaggcuguguguguagauaccucauugaccuuagguuuaucucccggcaaaggccaggcaauccuggguuuucaguguauuugagaugugagaugcauuaguuugacaguaucgggugugugaggcuucccuuguugauguagguacugugacuuaguuagguguuagcccuuagugacuccggcugcucugacagaagcucaggaagcuacacccucagagagcgugucaccugacuacugacgcugucuguccaaauaucugucugucuuggugaggagcccgcgaugaugaauucugaucaucaguuugcuugauugaauuaggaagcaccgaggcccuggguucuggggcauugaugaggcauacuuuaggguuuguucacagagagguccuucuggguggcagcauccaucccugaccugaaauagaaauagggcaggagaaggucggaggagucauggccuuccuuucucugacuccagagugaagcaagcccuucugaccaccacaggggaacaaaaauucucugaacugagccagaauaaacccuuccgccccucaaguugcauuuuacaagguaaaaggaaccaauacaaacccgggccuucaaguucuggagugacuugcccuuauucuccauuucugcaccagcuggccccgcguucccuguccccagcugcuucugauccuucguuacugugcuacgcacggugucccucucaggcggcugcuccgcuccgaccuggagcuguuuugaugugucugcuccuuucccguucugccucugaccuccgaggcccugcauggagagaaucuaauugucugcuuugauguaguccaaagggcacgcuaguccugcucagucuaggccucucacgcugauccuggacucugcagcagcugucggaggcaggcucagggcuguacagugccuuugcuuuggucacccuagggcugcuccuauggggagauacgcucugugcucccccaggcucucuggcucagcucugccuaaacccacagacaccagcucuuugagucuuccucccugacaccauccccagccucuuucuucgguaucucuguucccaagugaagugccuuugugguauuccaucagcaccccacuccagcccaggccacacucacagacagacaaaugccugcaaugcaaagguccccucuacaucuccucauuguuauuucaguuguuugcaccaccgaagcuguccuuguauaggaauaggaaaaggguaaacaugagagucacauuuuuauacuauuuaacaaucagacauaaguuauagguuacaaauuauuacuuuuugaguguguuuuuuucucugguacauagaaccauauguugugaaaaauacgaccaaauugucuuucaaucauucagaacauuuaaaauuguauguaaaaaaaaaaaaaaaauguauucccaagaagacagaccugguuuggcauaaauccgaacuuauccauuucucucuugcugugcuggguuuacauacgcaugcggcuaugccuggcuugcucaugggcuccagggauccuaacucagguccuggagcuuaugcagcucucuuuaccagcaaagccaucuccucaucuccugaauuggcuucuuaaggaacugauuauacucagagcugagcaugaagaaguaugcguggccuagcaguuguccuuggcuagcuagcaaguguggggucagccugagacaaugagacccugucucagaacaaaacuuaaaaaaaaaaaaaaaagcccugcgacugccccucugagguccugcuuuugaaauaaugauuuagccuaugcuaauuuuuuuuuuuuuacuuuaaaacagaaguguuuguugagugucccagauaaggaucccauauuagcauuucugggguuauguugaugugccugucuucccccaagcgucugagagguuauagaaaaacuugagcacagacuucuaaagaacaagaaugggguagggcaaaacaagcucggccuuccugguuggcgcugagugcuguggaguugggugugcgugguguggaugugugcuccaccuggccagcuccugccuuuguucagguugccaagagcucacacugcugcuuucuugaauugugcuuugaaaaucaugguguuuuauugggaagaugggugauguggccuuugaaaggcugcucccugagccggagccuccuguccucuguaauuagggguagguaagcgccucccacgguaccucugggcucugccuugcucaagccccagagcaguuagcuccucuggaaggauuauauuccaaacugucuccuuuuucuuuugguucaggcuuuccaaaauagauaauguucuugugggaaaaugggcuuuggagaaaguauuuuguuuuuagaacacuuuggaaaggguuuuugcucuuugccuuccugcuuaaggagggugcagagaaguugacucaacuggagagaccaguauuuguaggcaagcucugcuaggugugucuagccucuugacaucguaacaagacauugucaccuacaaaguucacaauauugacaucauuaccccacccccacaccccccaccccaccccugcagugagagaacguuugaacguuuuuaaguuugugguuuuauguugggguuucauagcuaucuuggggugcacaguuguagguuggacauuccugggucauugcccagaauaggugauacuuuguucccucacaacugaaguuccuugcuuagaagaacuccccugggcgaucugaaggagauagcauuugccccugguguggcuggagcuccucuuggggauuacacacaguggagaggagaaguggggaguacaguccaagcacccccucccuaccccucacccaccuccagagggaggaagggaaagaauaccuuggccaaagaggaagccucggaucucauucugcagacuccucagaccucugagaacuuaacuuccuacugaaguaaugaaggaugugggaagaccacaagcucccccccccaccuacucccucucccucucccccucuuucccucucucccucaagauaccuccguguuccuggcucacuuugagauagaauaccucuauguuccugguugaccuggaacagauauccuccugccucugccucccaaggacagggacuaaaaggucugcagcuccacccaccaccccaucuuacagguucuuaguuaaagccaggcuucgcaaagcaaggcugcaguagguuggcuguagaguuuaaacucaugcaaaggacccuggcaggggcuccugguuuugccccaguuguagauucucaaguauugggagcagaaaugccagaguuuuagcuacaauaucagacuuacaugguaccuacuaaaugucgugcaccugucguguccucauuuaaugguccccuucucaaugucccugucccuuucuguggaggaaguauuaacaguaaaaacaaaacaaaaaaccuucagcacaagagggaaggggccaguacuuaggauuccaggcauaccuguuucagguuagccuguuugcucugugcuagaguuuugucaagugugcgggagcgguccuuaugacuuaagcaagggaggugccuuccucguuccaaaguggccuuacacuguaggggaggugggugcuuuucacuucggaauagcuuaugguuggcuguaagucagacaaggagaucgcuacagguaaaggucuuuuucucagcauccuuccugaaaagacuugccaacaauucagaaacaggcaugguaggcagcagagccuagaacugcugugugacacaugcuugggcuuagccaggccuuuucuuugucucuguuuccucacuuaaagugcucacuucuaccagauauaaaaacauacacaggccagcaaaucugugaaaugucuuaauggcucuuuggaacauuccucaucugggaugccguugucuuuaagcaucgcaucggagucuguuuucauugccuuugguuugucucuguucagggcaugauguccacauaacuuaucuaccucuuaugaccaaaaccagccagcccuucugucguuuuagggcuuuggggugaugugacggggugaucggaccaugaggauagagcuuuuccaaucagacucaaguguuuuugaugaccuuguuucuggaaggcuuugguagcgauccagaaaguacuauggugaagguucuccuucauuugugguuagcagucaguucucaccacugacgucaucagcucccugagcugcguccccaggaccucacugugaugcacagcuauguucucuuaagaugaaaagaugcacaaaaccugcauuggcugcugagcugucucccaaggagagaagaaggcugcuugcugcgcuuaauuauagcucuucacauguuccuggccuaauuaagguuugcuuuacuccaaggaaggaggaagcacauauggcuuuacaguggcacugcccguaucuugguuacuuggggacagccacauaaauaacucucucuuuguuguccuugggccaguuagugguacagcgagugugaagauagaagcaggcuguuuguuguggccuacuuuuccacucuggaacagucucuccgcugccucucggaagcccaagguagauggcggcccucuucucaguaccucaccccguccauccucuugagccuucuucuaccucgucugagguccugcagcauugugacagaccagguugccagagaaaacuugaaccugggcccugcagagaagcagcagcuacaggaacuuucuaggagcgucuucuccugugugcucuuuguagggcugggaggggcucucgguccuuugcauugagagucucuggggccacugcucauggcauccccuguuccucugacaguaacggaggcuggagaagcuucaaguacuggcccauuuguggagacuugguagagacccagacaaauaaaugcuagcccagguccauagcuugggguauuaaauuauucuggccuuucugacauuuuccacacacacacacacacacacacaccccuauaaaauuugguaaaugguuuucuucuuauaaacagaauucagaagccugucauaaaauuugagccucuuuggaauacuuuuggauauuuuuuaauuucucugucugcaaagcaaaaaaugaacccaccucccucccuccagacagaacugaugucucugucuccuacaaauguaacuugauaccuaguuccuaugaguugugacccccagcagagucacauaccagguauucugcauaucagaugcuucuauuauucauaacaguagcaaaauuacaguuaugaaguaacgaugagaucauuuuuugguuggggucaccauagcgugaggaaguguauugaaugguggcagcauugggaaggcugagaaacacugcuuuagaggacuuugagcuucugucuuaguuucguaucguuggucagcccgcuccucuuuaccagucuguugauguaagaccaaggccuccccagagcuuacugaggggcaugagacccucaugguuuaaaguuuccucauggggcccucacuacacuaucugugacguuugacaagaagcgguuccguuugguaucucgagacacuuugcauuucugucgugggacggaggaaggacagugaucagcugagaaaauuaagagaagccaugagagguugggcuuccagucauggagaaaauagaauucuaacugagcuucggaagauaggagaucuggagaccuggggugccugggacagaauucuagauaguaggaauaaaacagucauugugaauauuuauuaugcucuuguuaggagccuuauuggaugagauaaacuauucacaguucauaucaccaaccuuucaagauaaccuuucugaugcaagaccaugucugugccgcuugaguugugggaccuaaggcuuaagcagauggagacacuaaagccagugucccuaucucagcauagacguuagaggcuaaugcagcccucugaccucggggguuaaggaaauacggaucuggaaaacuguaucuggauaaguagcuuguagguauagaagugaaggggaaacuuggaggcucacuguagaacuggaauaccucagaagguuuguuauggaggcaacagcaagucuuugaaagguuuuaaguguggaauguauugcauugagaggcucccuagcuggcccuaguagaagcggugaguggcagucccaguggagagaaugugacccugaaggcugccuccacaaggaccucagaguggaggaggugugguaggcacaggccaggagcauggccaccagugaacagcauccccuguauguggcuuguuggugcuggcagcucaccacccagggcccaggccugauuucuguccuccaaaggugguguuaacauagagauuuuucuacuccugucccaggcuagaggaaagggcaaguaggauuuugaguuaauuugcuuauagaggagaguucuaccuagauuccuuuagaaacaaaaaugagucacaugucaggagggaaccagagccuuccuuauuaagaggcaccugcaggacugacuguaaagggggcaucugcccgcuuuccuaccagagucgucugaagcgacauacacaugguccucugguccaggaccccaagaugguagcuaaagaaaacagugaugguaggguccagaaugugacuuguauuguugcuuccguaguuuugagacagagucucacuauuuaccuugucugguguugaacuuguuauauagaccaggcuggccacaaacucacuuagcucugccugccucugucucccaaaggaaauuaaaagugugcgccaccacacccugcuaaaaugugacauuuuuaauaugguaaaagauauaacaaagauaaccguuucagcaaauauucacuguacacauuuguccucguggaacccuuacugcauuaucugugacauuuugacaagaagcgguuccuuuugguaucucgagauauuuugcauuucugucaugggacggaggaagaacucuggugucacaacccucucuccagucuggucuccaaaggcccaagcccaccuccucucccuccguuccuuguucauucuggguuugcaucuugagucuucaaaguucucauaggccugugagugacagacuuaacuggccuugaaagaggacauaagacccaaaggauauauaugccucauggugccagucuagaaagaaagcagcagcgugcauggccuguuaugcaguguagcugagagaucguugaaaacuuggacagaaagccgcuggagaggauuuaguccaaccucacuuuugacagugaaacccacaggucucacacuccucccugucaaaccuuccaacccacagccuccacaucugaugguauaccagacucuuaaugcugcucucuggccaugaaaaauauguaaacucagaauguuuucagguagagaaaguaacagaagagaaggaaaacacuggaagggaaguuacaggaaacaucagaugcucccacacacacaccccaccccacccccgcauucaugcacugugccgaggcuggcauuuauuucugacguuugcuuggcuaaaaauguaacguuuugcuuuccaguccuuguccaaaacguucugcuugcuguggggcaucuguaccguuuaccaggcugaguaguugucggagggcagugggggagcaaccugagccuccuagauccuggcucuguuucaguuuccaauuaucgauauucacauugacccggcagagggggcggcacuccucgauauccgccccaguguccuuauguuuuaauaugccuuaaacagcucaauggcugggccacuucuaaccuccacuuggcugauggaccuuccaacucgucacuuaccuguguuccaccuuggcugcccucucagacugaguuuccccagcaccugcaugacagcuguguucucuguccagcaccucaggcguggcaucuacuccuuccguggcaugguggcuaucuuuuucuccccuuccucagucucuugcccaggaauccuaaagucccaccucugucucccugaccagccauuggcugucagcaacuuuauuuaccaaucaaaacuaacugggggcagggucccuccgaauuuuacaugcacacugaggauucuugugcaauuggggggggggauuaacauaauuaaaguggcauuagaccaaaucuacaacaggguucucaguuaccccuucccuugaacaacuuucuuacugaggucaguaggugaaguuacugguuuacagucugagccgcacacugaauucucuugagaacuuugugagucccgggagguuuguuuccuggucugggugaggccaggcauuaguaauccuuuagagcucccgggguuaugguggucugcagcuucaacgggacccgcaguuguuuuccaaauuucauaugaucagaaucagcuguuaaaacacuggccggcuggcaaaaucacagcccucagaggccggaggcaggagaaugagaauuuuaaccuaggcuaccugaggucucucugacacacacaucccauguaggcuucucgcucauaaauuucagggucacaggaucuaggguaaggccuaaagcuguggccaacaaguucuggguggugucagaucugggaucggagacaagacuuugaagcaacaucauuagauucucaagaauuugugaccagggacucuugaaugccagcccuggugaucgaccccaggguuuuagauccugaagguuugugauaguucaagauugcaucuugccagggguccugggugcugcuggcaggauggacaggugcacacacuuugauaacugugacuggguccuugugugugcuucauauguggauggcaugaagcucaaaguauaccaucucaggcauccccuggcauucuguggccaucaagagcacucaagauuguucucgaguauagaagaaagcaagcaagccgggagcugugguuuucagagauaaauagcacacaauaggugguaggaacaugauugaaguagaauaauuaaacuuucuagccuguccguuagaguauguucuaaggucucaucauaggcuaugcaucuuaccaugggccaaugaggaaacaggcugugucacugagccagugaaaacuacagcuuucaugccuguuuugggguccuuucuauaucugcagauggauucugcagauggcuaauccguaagccuagggguauguauuaguuaggguuuuacugcugugaacagacaccaugaccaaggcaagucuuauaaaacacaacauuuaauuggggcuggcuuacagguucagagguucaguccauuaucaucaagguaggagcauggcaguauccaggcaggcauggcacaggaggagcugagaguucugucuucauccaaaggcugcuaguggaagacugacuuccaggcaaauagggugaggaucuuaugcccacacccacagugacacacccauuccaaccaggucacaccuauuccaacaaagccacaccuccagauggugccacucccagguccaaggauauacaaaccaucacauuccacucccuggcccucauagacuuguucaaaaacaugagucuaugggggccauacuuaagcauagcauaaugcaaaaugcauucaguccaacuuucaaaguccucauagucuauagcagucacaacaauguuaaaaguccaaaguucaaggucucuucugagauucauucaacuuaauuaacuguaaucuccaaagcaaggcaggaaaccagcugggcaaacuccaaacucugcaucuccauggcugaugucaaagcagucuucagaucuccacuccuuuuucaucuuuguugacugcaacaaacugcuuucuccugggcugguuccacucccuguuagcagcuuuccucagcauguaucccauggcucuggcaucuuuaacaucuuugagucuccaaggcaauuucaauguuacagcuucuuguuucagugucugggauuccacuugaucuuuuggacuccuccuaagagcuggcaucacuucuccagcucugcccucuguagcacucuaagcucagguugauccacucuacuacggcugcuguucuugguguucaucccaugguacugacaucuccaauacacugggguauuccacuccaacuaggcuucaccaauagccucucauaggcucucuucagggugccaagccucaaauccuuugcaugaccccuucaguccugggccaucaacuacagcugaggcuucaccuucuccaguggccuucccuggccucucacagugcuaagccucagcuucucuccacgaucccuucauuccuucacaagcagguaccaccugagugacucuuacacauuaccaaguccauccgcagcaugagguacaaccuucgguaucucuggaacacagcuucuuugugcucccagaaaacaauuuccagaagauuucaccucagugaugcuggucucuucuuaaucacugcuaauuccuuagcuccggcuaacuagcaucaacuuacccaguaguuccuuccauucuuaacucuagagccagagcuacauggcugaagcugccgaguucugcugcuuacaggaacuagaacaugaucaccuuguacuauuauauuaucacuagcuuuauguuuucuaaauccuucacugcccaagcuuggcuauccuggaucuugcucuguagauugaccuugaaugcagagaucagcaugcuugucuccugagauuaaagguguguaccaccaugcauggauuuaaucuagcuggguagaaucuugccccaaggucccacucccuuaaucuguuaucuccuagaacacaagauuuugcaccauuucacuuccugguaccccuuuaauacucgaaccauauauuuuauauuuuuucuuucuaagcuugcuaugcuuguucaaacuucucuucauaagacuuaaccagagaacaaagucucugcugggcuuuuuagaaacuucuuuugucaaugcaauuaauccaaguagcuucaccuuagccucaggcagacuuuccagacaaaggcaaaaaguagccaucuucuucaccaaaauaccacaaaaacagucuuuaugccacauacugaaauucuucuccuuugaaaucucuugggccaggucaacacaguucaaauuacucccagcaacuaagucuuccauauuccuacuaggauggcccauuaagccccauuuaaagcauuccacugcuuuccaaauacaaagucccaaaauccacauucuuucaaauaaaagcauggucaggccuaucacagcaauaccccacucccauuaccaacuucuauauuaguuaggguuuuacugcugugaacagacaccaugaccaaggcaaaucuuauaaaacacaacauuuaauugaggcuggcuuacagguucagagguucaguccuuuaucaucaagguggaagcauggcaguauccaggcaggcauggcgcaggaggagcugagaguucuaugucuucauccaaaggcugcuaguggaagauugacuuccaggcaacuagggugaggaucuuauacccacacccacagugacacacccauuccaaccaggucacacauauuccaaaaaggccacaucuccagauggugccacucccagguccaaggauauacuaaccaucacaggguagaugcagcaucaggaaaugaaaaggaauaagaagauggacuauaucuguccuaguguuaaaagugugucuccaguccaaugguguugguggccaucgaaggacuuguuagaacuacagauccuugagcccccacccacccuuggggaguccaugacugacuuacacacauggcuccaaacuguacagucagguuucaggagcccaggcuuagggaaagugacaugaggagaugggaugacaucuuggaguuggauggagcuuuaccugaaacagcaggugaaggaguucucaaggcagcagccugggaacgucuucaggcucccucuucacccuuccaguauggugacuggaugaacgcauguggcguugaagacuucucuucacuguucacucugacgaugaaccucacucuguagagccccaaguuaaucuucucauacucuagacuaauaaaguucuguggaacggggcucugauguagcaacuaauuuuucuccccuuuuuuucaguuggugacaggugugugggaaggcaaauacaacuuuuucugccagggaacacgcagcgcgggagaauccgauaugaagguauuguuugaggguugugugggggugagggugucuguguguauuugcuuguuuuguuuuugauaaagaacauauauaaaaggcgaaagagacagcggccucucaauccugauaaucccuguugucguuuuucaaaagagagagaggcgcuggguaugcgguaugguaauuugaacaugaaaggcauaaauaaaaugaaaacuaaauccuccccucuguaaaagaaacuccuguggaccguugacagguuucauaguuacauaaaagaccaucugauuuaaagucacucuuguaagugcccuccgaguauugauauuaaaggaaaaacccugccucaguccagucugagaauuggaguuuguuaaacagaaggcuggcggucaaggcucagcauggccagcguuuccuuugagcauaucaguuggaccagaaacagguacuacacacucugguuccauuuccuuccugacucgugcuuccgcuggcccucaagccccagcauccuucucccagcauccuucucccagcauccuucucccucccggcagcuccgcagacuucagaagagcacugcugagcccggagcugccugccggggcuugugguuuugaguuaguuuugcuuugagacagaguccuuuguagccucagauucuauguagcugaagaugacccugaacccucgauccuugggcuucuaccucuugaguccuggggggugcaagagugucaggagcuuugaagacauuucaguucucccaggcucucaccguggcuggagcugucccuggacggcagcgggggccagugggacucucccagguuuacauccagggugacauuccagcaaaguacuggagauaaaccaugagcccuuugcucuuagaucauccgcguccucuggugguacuacuucuccaaacucaucgaauucauggacaccuuuuucuucauccuucgcaagaacaaccaccagaucaccgugcuccaugucuaccaccacgcuaccaugcucaacaucuggugguuugugaugaacuggguucccugcggccauugugaguaaugggauguuuggggaacaugugacagagacagacuggaaacuuaguccucgggaaaaacguccucucuguaaauccucagguuaauaagcuuuugaguuuguuuucaaguuuuucuuuuucuauguauuauuauuauuauuauuauuacuauuauuucaguuagcauacacuguaaagauuucauuguggcauuuucccugucagucacacuuuucucucauuugucccucuccccaccuucucauggucuccuuccuucugcuuuucaugucacauauguuaguaauguuaguagcaaaguaauccuaaccagaaagagcaaggcugaagacuucauaaggcccagcccaagauuauccacagagccaucguaaugaggacaguagggcacaggcacaaagagggauguguagacuaaaagggguggaguagaagaccagagagaaagucacacaucuaccacauaaccauugacaaaggugucagcagauauguucaucguuuuaaaacagaaaaucacaaauuauucauaagucaauggacgauugaacucaauacacaguucaugaaaagaaacccaaaugcccaaugaauacuuuaaaagugcucagcauuuuuuagcugucaggaaaaaugagauucccgucucacuucaaucagauagguuaucauccagaaagcaaaccaucaggggauguagcucagugacuuggccguaucagugagaugcuagauccaguaucaguagaggcagaaugcuagcaaggauccaggauucauacucaucccuggugcugcuccauacgccuggugcugcuccauacgccuggugcugcuccauaugccaggugcugcuguggaaguccauguggagacuccucagaaacugaaccgaaaacuaccauuugaccuugcuguuggcuaaauagccgaggacuccaaaucacauaccacagagauacaagcacauucaugguuguggcuguucucuucccaauggccaacaaacggaagcagccuggguggccaagcacagaugauaauguacguugcacaguggcauuuuaugcaaguguaaaugugcaggaaaauggaggccgcuggauaucauguuaagugaaauuagccaaacucacauacugcauauauguaaaccuaaauauaaaauuguauaugugcaugauauuuauauguaggucacaaaacuagaaaaagucuggugagaggggaggaagagaucuuaagggagguaggagauugugugggcaauggaguguguguaagagcggaggggacugcucacgggggaggggaggacuuuacagggaaggacacuguggggagggcagcaagugauauccgagcagcaacaggaauguacggagacuccgugaugaaacccauuacuuuggaugcuaauuuaagaguuaaauaagccaaaccccuucaauagauaguucuggaaaaauuacauauccaugugcaaaacaguaaaacaaaacucagaccucucacucagcacaaaauccauucuaaauaggucagagacuuuaaagaaagaccagaaauucugaaccugccagaggaaaccaaugacuucgagguacaggccuuuaugggcagggacuuugugaagaggaccuaggguugcuuuuaguaauaguuuguguuaccuaagggcauagagccuuucucugguuauuguccuacucugauuaagaugaaggagaugccaccuugggcacauugagaaguaggaagggagcaggcagguaaaggugcuuacugccaauccugaugaccugcguccaaucccuggaaccuguacgguggaaggagagaaccaacccucacaguccguguacugucuagugggcaaggugugugucacgggguuaggcauuuguggcuacacauuaggaaguccccauccaaucugauggugugaaguuaccagguguuuuuucauaacuuuugccaaaauuugcuaguuuuuaaaaguugggcaugguuggguucuacuuaggguccagcaaguaucucucucggucacuaguguuuucuccucaccugaagaguuugccugggaaucucugggucugcucccaacguagcugcagacugucucugcccucugagauucagagcucuaucagguucauaacugaaaaagauuuucuaaauaccccagaaguuggcugaguuccaacacucuugaacuagugucugguguucaucccuugucaccuauggguaagcuggcccagauucugguagggaccgcccuccaccugauugcgucugaggaguauuuuaaauuucaagauaccucaugagacaacuaggcccagcuggccuucgcagagcuggagaguguacacgaccucugugagggcugcaggaccaguuucugucauagccacuagacacuccuaacacaaccugaaaagcugauggcuucgcuucgcuucguuaguuacuguugaggaugaaaguauuuaaaaaaugauauucuacuggaaauuaaaagagguaugguaaaacggaucuuucgucucuaaagaacugccucuaaaauggcagcccaucuuaggcauuugggaggaggacuccucccagucugccggccacaccugcaggugccaggucuggggcacaagcuagucauauggcaggucuguggaccacuggguguaagguguccuauggcugccugcccugcccacccaguggaaacugacuuuucacuacacagccaaguagcacuuagagcugcuguguuugucacccucuugguucagaagagucacucuaguuccaaaguggucuuggauuuucccacaccuguuccuuagaaaacucuaaugcaucucccucggucccuuuguucccgcagcauauuuuggugcgacacucaacagcuucauccauguccucauguacucguacuauggucuguccuccaucccguccaugcgucccuaccucugguggaaaaaguacaucacucaagggcagcuggugagugcuuggucccugugcccagaacuuguucccugccagauccaguccucuuccaggccguccuguuguuuaauugaauccaguugauccaguuaaacuugugggcagguaggcaaugcucuuguuucuaguagauggagaaucugcucuggacugggggggggggggugccucaagucuuaagcucucaacuucagguccaguuuuguucuuucuuuguguguauaagugcccacauagugugcacacauguaccuguaugugugcucucacuuccaaacugaagaugaaaacugcucaccuuuguucccaggaguuucagguagaacuuucuggugcugaguccagagcccuuguauuuacuagacagugggcccucucggguaaggugagugccaggugacuacuuuauucugaccccuguaucagaguacugggucgaagcuccugcugccugcugcuucagacccuaguggcccuuggcagaggcagacugacaacugucugucuugaugaugauucuugccacucucccauuguguggcugcuccuuuccccucgugaagccuuccugagcaguuaguaguacucuugauaaacaccggccugcuuuguucuguaugucaggcacccaugcugaggauaugauuucugcaugagaugucuggaauauucccuccauguuguaggugaacacauaaaggcugagggacagaccaccacccagccuugccaugggcauuuguucccgaugaaucuaauugagauccccugaaucaaccuugauuuuuuuuuuuuucaaaauuuaaaaauaacauuuugaaacguuggagcuccuucugugucugguguuucauuaucaccucugccggcugcucugcaguccuuguuaaucuuuuucucaccuguggggaaggauaauuguucucuagccuccucugauacagaggagcaaggaugcagagauggauggauuuaugcuguaaucaugggcucuggaagacaccguaggcauugacauccugcugggcugugugcugucugccuagcucuuagauuagaacuccagacugaagaaaugaggggaacggagcccgugcgagccucuugaguccucacugggcuucugaaggugcuugaggagucaggggccuuuaacaccuuugaguggaucauacagguccaccugcuuuccaagggucgcucaucagaagucauucguggaccuaguuauuuuggccuaugcgucaugagugacgucacuggccccuuuaaacaaguaccucacuccucucucuuaccucucuaugcugaguucuagacuguuagagaaaggugguuuaaguagguaugaggagaaagggcgaaccuauaguagaggcauacacagagaggacagaaauaaacgucauauaaaaagcuaggaagugcugguucagaaacuugggugggaacacugauacauagccccaugguuggaaccaugugcugccaccgcucaacccuggccuuucccccuagguccaguuugugcugacaaucauccagacgaccugcggggucuucuggccaugcuccuucccucucggguggcuguucuuccagauuggauacaugauuucccugauugcucucuucacaaacuucuacauucagguaaaucucacccuccgcuggccucugaccuucguccuuucacucaguggggcuguguggagcacugcuggugcacugcugggagcacugcugggugcuggcacugugcuuugaaagagccuuuguagggauggaggguggguccacagcuugcuuugccaucggguccuaggcgucuugagacccgggugggaaaugaugccauguuucgugggugcuuuguucccuuucuuugggcagugcagagacauaaagagcugauuuccaaucggaagucucagccccacugcccugccuaccauagcuaggaaauuuccaucacauucucugauguaauuggaaccuacuguuuugucccguuuuucuuagauggccauugcucaaguuuggggcuugauagagguuugucuaucugguggcgccuggucaccaggcagacacugaugagucuccugcuuuuguggccagugccaaguggcuucuguccccacuguccccugggcaggagcaagagcaaagguaacgggucccaagaaaaguccaguaguguggacagccaccaggaggagacucagcugcuguuugucuucugugcccccgacguagcuuugugugacuuguugacuccugcuuugccggggccugauaauaggaccuucuuccaauugcuccuggugcccauuguacuguacaugaugguuacugaggcaauaagaaaaacauaaagauaaguaauggcuugugauguagaguggcuacuagccaggaggagaagccaguuugguccccuaggccauugcuccaccauccacauccugaagaggcaaagccgaaugaacagaaacucgguguucuaaguguuucuguuguggucuagggggucagaaccucugagcuaagccucaaaaagucgcaagggugauugaacauaaagugguuauuugagcacaggaaauacguggugagacugaucagaccaggaaaccaggccuagugagauacagaccgguacaguucaucugguuagcaggcacugauucgccuuguacauuucagacuuacaacaagaaaggggccucucggaggaaagaccaccugaagggccaccagaacgggucuguggccgccgucaacggacacaccaacagcuucccuucccuggaaaacagcgugaagcccaggaagcagcgaaaggauugacaagccgagccgaagccuccagaccgcggcgugugauuguaagcacagcgugacuugugcccugacgcucauagcagcugcugucacuagucuggcccuacuaucugcagugugacucauguaggaccuucuucaucaguucaaaaccccuagaauauguauacagauuauacaaaguaggcauacgauuuucucacauuucugggcucucaucgacccccgcgcuagacuguggaaagggaauguucuuguaguauacaacacugcuguugccuuauuaguuguaacacgauaggugcugaauugugguucacaauuuaaaacacuguaauccaaacuuuuuuuuuuuaacuguagaccaugcaugugauuguaaauuuguacaauguuguuaacaguagaaaaacacacaugccuuaagacuuaaaaaagcagggcccagagcuuguuaguuuaauuaggguauguuucaacuuuguauuauucauuuguauuagcucuguuuagaaaaaucaaauguaugauuuaugaaacaagugugugauguguaacuucaagugacuuggagaugcgaaaucugauggcacccuugguuuuauaacgauggcuuuaaauaagcagguucaagucuaguggaacagucaguuuaacuuuuuaacagaucuuauuuuuuuauuuugagugccacuauuaauguguuuaaagagguggggaaaggguccaaagcgucuggagacacuuacguaccugucccuggucccccagaggcuagggugacuauaagaguaggucacuuuucacuucugaagugcuuaguguuuuuauacaggagauaaaaaggccauucgacuucccaccacuuggagagagagaacuaccuuucaggaaaggugacgagacauuuauuaucugacagacacacacacacacacacacagugauaagggacugguuaccuggguccacauuuuuuuuuauucuuuucuguagugcuacuuugacauacacuuccuuuuaaaaugugccuaauuuaccaagagaccaggaagcaccauaagcauuuugagguaaaauuuaagagcuggagcgcgcaggaacuggguguuugggagcaaccgcuuuuuucagugugaaucaugguggcaucuguaauuuuuuucugauuagcaccuaaagaucgguuuaaagugcuuggacugcuuauccuaaaaucgugucuagugcgcucgaggcaucggucauacaaauggggacucuuuucaugugugucauuuuuaaaguguugaaagcuuagccuuugaauaccuucugcauugguaaaaaauccauggaaccacucauggcacaucuuaggagaugauugacaauguauaaacuaauuguggguuugauauuuauguaaauaccaguuuaccaugcuuuaauuuugcacauucauauuacaaggagccaguugguccuaauuagccuuguggguuuucuguuuggaaggaguugcggcaucuguuuacauuucccuugucagaucuagaauguguguaugugugugucuucucccuagguacccgucugcaggugucuuuacauaucucaauacaaaaauuauaacauuugauagugugcugucaaagugugcuuagcucaucuggauauacccacacuguuaaauaaugucuaaacauuaaucauuaaaaccuuuuugauuacccgugc

SEQ ID NO: 5207 - RNA, 3312 nt, Mus musculus
uccucgguacuuugacaaaagacagcucuaauacuugcauaauucgucauuuguuuccaagaugggaacauaauauagucaggccuucugggaauuggcagguguucacaagagcgaaggucccaaacacggugacucaguuauaccaagauuuaaaacaggcaucacucaucugguggguagauaauauauuuuuauugggcucauaauaaccaucuggauuuguccauaucagauuuuuuucuuuuauaggaaaggccauucuugacuaauacugagucacucuugaguuucuuacucugacagccucaaguuugguucuuauaauuauuuauauuugguuaacuacaaaccugguuaggauucuugaagaaaucugucuaugggaggccacuaggucucugucaggacaguggcagaauaaagaugaagcacugaacuauaauauguuuuccuagugcaugcguacacaugcauggacucguagcuacaaauauacacaugcuguaaagaggccaacuuuacugugacuauguuuugucucacccacaccacaccugacugaucucaguuccuugggcugugcaaagcaggcggcccuguguucugaaggaaguacuuccuccucuuacgugugucucccgugaaugucugugaucauuucugugccuucauccucauguaggcaugagguucuaggcucugauguauccacuugguccagcuaagccacccacugggucugcagucccaucauuaugcuauacaacucugcguuuagaaucugaccagcugcuaagcccaggugucuccaggauggugaacacagaggaguguccuucucuuaaaacauugcuacuucccaucaugcaucgccauguagugccuuuucacaucacagucacuuucugcuagagcacagacaaaaguagccuuggcucuugcuuucugagguauuacaggagugccuguuguggugugcauacccagccaugaaccucaucgaaccgcaucaucaccugcugugauaugcauauccaacugucaccacccugcuucugagccugugcaccugucaagcaguucucaguuucugucuuuaggacguccucccuuccauccuccccacagcucuggccuacucucuucguccauguagauucaucagugugaagguccuuccuuccuacacgcccauguaguucccucaguucaaucagcaaucacaugcuaugagacucccuggcucuuuuuugcaugcaagacauucagaaauguaaaaggccuuaacuguuaaagugcuuccaucugcacagugaaaacacugaccauauguguacaugauagaagucuccacacgaagggccugcucuuccugugaaggcaaagaccaagaaccauagccauguggguugaucagaauccccagagcccagcccgcucuuggcaaagcuucugaaucauuucuuggcagaggggaagaauaaggaauggcaccgugugugaugguuccuuagacaaaaugcaacucagccuuggagaauggucaagauugggaucgauacagaugaaaaggaacaggguacauuaucaauggggauccauacagugaacuuaaugggaguaaagaacuucagcugaguggagcagaugggauggguguugggagucauguuuugcagugugguugauugacccuagggcagcaugcaugcuagucagguucuuuaccacaaaaguacauucaucucuuuaaguagaaugaaagagaucagauuuauuaaacagaggcuguguguguguguguguguguguguguguguguguguguguguguaacauuguuuaaauuacuagagggugugagaauccagagaugcucguggaagggaaugguccagccuuaggcaauaagagcugcugggagggcagagugaaagggagaaaggccaggaggaggcauucugagggaaaugugggacugucccaucacuaucaaaagaacagauucaggcuggagagauggcucaguaguuaagagcacuugacuguucuuccagauauccugaguucaauucccagcaaccacauggugguucacaaccaucuguaaugugaugcccucuucuggugugcauaaagacagagcacucauauacauaaaauaaaucuuuuuaaaagccaaccaaccaaaccagauccaacagaacuacugaguacuuggcgauauuguuugaggaggacagauuauuugugagguaguuuuggacaagcugaugcagagacgaaagugacauccagucaggauccaauuaaggauguagcuuuaaggguggcucaggauauaauauuagagaugauaaacagaacuaacacugugggcagaaucaccuaaguugucuuucccaucugagugccagugagguuuagaagcauucugagugaugucugugugggugguaccuuagggaggagguggcuugagguuugcagagccauggauauugccaguaacuggaucucugcaugugccuugaagacucccccauuaaagaccuccuggccacaucuuggcagcaccacuguagcugagacuucagugagcccucauuguuccucacagugugaguuucacaaugcuuaccagagucacaaggcugaguagacaagacccauuaaucuuuuuuaugucucuuugguuuugguuuugguuuugguuuugguuuugguuuugguuuuucgagacaggguuucucuguauagcccugacugucagggaacucacuuuguagaccaggcuggccuugaacucagaaacccaccugccucugccucccaagugcugggauuaaaggugugcgccaccacugcccggcuuuuuuaugucucuuaauuauuuucuguauuauaaacuuaauacaauaaaaauuguugucuuuugacaugguauuagucucaagcuacuucugcugacuugaucgggaugaucccccagccccaggacaguuugguuugcaguuaucucagcccacaaguguauuugaaagugcuuccguguguauaaaagugugcagacuagcuuuggaaggauuuuauauaaggaggugaacgaaacccugagagaggugcgaaggggugacggucaccuacggauguugucaagagaguguuugagcugcagagagcagugcagagggagugugugguuggaucucuucacucucccugcagguuucuuccaccgggacuuaaaacccgagaaccuccucugcaugggaccagaacuugugaaaaucgccgacuuuggauugg

SEQ ID NO: 5208 - RNA, 26580 nt, Mus musculus
gaauaguuuuccacuguauuuaauuggcauuugucauugugggcagagugguuuuguuguuugaagagcuugacuccugggaucuauauaccuugcuucuggaaugcucugcagcuggccuguggugacacugcaauuggaaccuugugggugccaccuuaaagcacgcugcacuagaacuucaggacaguccugaccaccucaacauaggggccaucuggaggaggcuuccucugacuuccggguugcaggaacuucuuaauuguaggaauguugcugauucuugucuuaaaugccugaaaccagaaacagugacgugaggggcuggcccauuagcugucauaaccauuaggaaaucaggauuuuguccuaagaggaggugauuuuccuacaagauauccccacuauguuuuuccauccuuaucuuucuccucccagauccucccacauccucacccauucaacaccauaccuccguuuucucucucucucucuuaagaaaacaaaaggcaaauaaaagacaaacaaacauggguaaaacaagaagaacuaacuaacaaauaaaaggaaaaaaaaaccguaagaaauagcaggagaaacacauuuacaugcagacagauggcaugcacacacaaacaaaacucauaaaaccucaaaaucagaaacauaauauagaggcaaaagaccagugagggggcccagauaaagcaauaugagaccaaaacaaaacaaaacuccaaaaauaucaaugaguuuuguauuggcugucuauuguugggcauggagucugcucuuaaaugugguuuguauuuccagcgcgacuaauuagaagaaacuaauuagaaacaacuguucuuaacagacaacgccuagugguuuucucugagagcgaugugaggagcuggagcaagggccagguaagugugacagucaccggguucuuccccacaagcuggggccaugugaccaaaagguggcccagcaugagggccacuaaaagugaacagcaucaucucacaggagccaggagggaagaacaaaagauuaacauucuugcuucagucaguaaaaauguucagacugcugaaaaaagcucugaauguucugauaguuuagcaauuaucagggacugaacuaaggccucaugcaugccggucauguguuuaacugugagcuacgugccccggcaguuuaaauguucauauuggaaccucaaacccccauuuucccgucauaugaaguuucauucccugacagacccuauaguauaagugagaacaaaggaccggagugaagguaacaaugcuuuaugagccgguuucccuuaaguucuaaguucagcuuccagacgguuauuacugcaggcuuuacuccagcugcaucuuccugagugagguguccacgcccaacagcauccuaccugcagcagagggaagucggacaguacaggggcacugaguucuuccaccaucaaaauggcuucuaggagcuggaugucugcccaacugagcugguugccaacgagaaaagccucuccguggucuuuuaaaaucuacagaaaagaacaaacauaauuuaauggcagucaugaugaucugccuaucuguauucuuguccugagagguucacugaagcuuuugugugaggugugugugugugugugugugugugugugugugugugugugugugagaucuccaguccuggcaagaaaggguuaaaccaacucucaagcacgaaccauggacagauacacucuuugggaaacggacagugauugucaaggcucuuguguggugaaguacccacaaucuuugaaaagcaugggggaaguaaagaaaaacuguauccaccaggacagagacacgggagcuacaacuaucgagagcccagcugcugcgacacaaaauaagucacuaguggaauuagaagaccaaacuugaaaaaaaaguaaauuuuuccacacccaguggaaagcaaauauaaaaagacaccacagucagcuuugaguaucaaauacauaaaagaugguccacuccacaaagagaggauaauauauaugaaaacuugggaaacgucuagauaaacaucucagugauucacagcacauauaccuucuguaacuccagguccaggggauaugacaguucuuuuggcuuccaugaguaccagguacacacaugauacacagacagucauucacacaggcaaaauacucauacaugcaauuuaaaaaaaaaucuaaauuaaaaaaauuuaaggauuggaaaaaggucuuaagcaagaaaguaguagaauugauauuuguuaaugccaaguaguaguuauauagaaauucugcuuugaaacaucuucuaaguaauaagauagugguauaaauaucuucaauauaaccauaauuaucuauaaaugaaaagaaaaugccuuuauuuauauugaaaaacuggauggaaauucaugaaaccaauuuuuagaccccucugugaugaggaaugguuguuucaguuuacagucuacauuuuuaaauaauauuuucaaacaaauuaaacacaauaaaaauuguaguuguuugagugagaauggccccauaggcucauagauuagaguacuuggucaccagggagugacacuauuugaaaggauuagaguguggccuuguugggggaggcaugucacuggggcaggcuuugagguuucaaaagcccacaccguuccgaguaggcucucuguaucucacaacuguaucuuaauauguagggucucaucuuaccgcuccagcaccaugcuugccugccugccugccuguugcuaugcucccagccaugauagucauagacucuaacccucugaaacuauaagccccaaauaaauucuucuuccuauaaguugcuuuaguuaugaugucuuauuauaguaauauaaaaguaacuaaaacagggucaaaacuuaaaaagaaaaggguauuuaaauauaugagauuauggcagccauucucauucaaacuaccacagacccuauaacaggaaagcucugauacagccuguuuuuuuuaauauuuucauuuguuuuacguugugcaacuauguauggagggaugcaugugccaugaugugcaugaagaggccagaggacaacuuguaugaguugguguuuuucuuccaccacuggaguccucagauuugaaaccaaguucucagauuugagaucagaggucuuuacccccugguccaaacuuuguuuaucuuuuugaacaaccuuauucuuaaauauucugcauaucaggugguguacaagcuuaccuuuucaaacacugggaaguaacggguuuuagcucuugacaguaucaaaucauagcucuccucuuuuuccuuggggguuuuaaauggagccacggcaaucaucaucaucagguccugggugccaucugcauacaugucaauccugaaaacacaccagaguggcccauuggaaaggaaccuuggacuguaagccagaucuaaccagaugagaaaugaacacauuugcugacugaaaggauguaugaaagguagcaggugccuacauguugaaaaucuaccacaagcagagugggauuaugaugguuuagagauuauuaaaaacaaaaaaacaaaauaaaaccaaaaaaucccacccacuuaauaaaaaguauacaucaaaacaggagguggaggcacacgccuuuaaucccagcacucaggaggcagaggcagguggaucucuguaaguucaaguucgaggccagccugaucuacagagugaguuccaagacagccagggcuacacagagauacccugucuugggggacuauauaucaaaacaaugagaaugcaugcuacucacaggcuguggaacugugucucuugccaucugcuuuaaggaggaagguguggggguggagagauggcugcugggcuucugagcuuugcucacuccuaugugaccuuucucuguuuucugaauaauggaaccugggauuuuucuauuaccauaacgucuguaugcacugaccacucugccacuucaguguuugcuaugaugagaucuuagggacccuuuacuuaaccccaaauauagaugaaauuuuccuucuuuuuuuucuuuucuuucauuuucuuucuuuuugccuuaagucuacuuaucuacaugaaacuaaacuauauggcuuaauaaucuaacuauccuuagccaggucuggcauagcauauaacagagcagauaucugugguauacagaugcaagggaaaaacaccaaaccucgagcuugucauccuccaguacuuaugaugaguccugucagguccuuccaucuacaggucuuuccccaggcugcccuugugacugacuaaugaguaagguggaaauacgagcgacucauccuggguucaaugcuuauaaggcuuccacucugccacucuuagaacugucugcaugucaugagaagguuagaacacccagaugcggauaaguggccuauuccuccaaacugauaaucagccaauacccaaauccagagcuaccuggcuaacuaacuacugguuagcagacauaugggugagucuggcugggauaacuccagccuaggccagauagaagcuacccagaauccccauagaccagugcuugcuaagugaaaucuguuucaaguugauagcaaaaauugaucaucaauauaaugugcaaggcuucuuugccgaauuggucauuugcaccuucauguaaaauacuuuaguaggucauuuucugagaacauagcuugcuaggcacgaauaugagaauacuacaagcugacuagugugacuagaggguguggaauauguucucaacccaagcuaugccaauucuagcaacaacaucuccccuuuguucccucacuuucucccuuuaguuccuguuggaccaguuucaguuagugugugaccacagacgcuugguuaaacauuuacuacuggaaggaacacuacgguaccugacucucuccuucagguccuucccauacaaguuguacuuggcagcgagguagcugaggauggcccuggucugugucagcaucaucccaucgauuucaaccaaggguacuuggccgaaaagcagguguccaucugggauaugaaagagagggguaagauacucaucuuuaauggcuucaaggguugcaguccaucugcaggaugguccaaccaaguccacuggaugguuucuaguuuucaguuauaagcaugaaugacaggccccaguagauaaggaaaugccaaucauuuguuuugugucaaaucugagcuuugauuacuucaugcauuuuuguguauuggacaguagcaauuuaaacaagauuuuucuauauuuauucuaauauauauauacauauaugcauguaaguauguauguauauacauauacauacacauacauacacacacacacacacacacacacacacacacacacagagcuagcauuucugggccucaaagcuuaaguccuguaaaacucuuugggcauuuggcaugaaagauugcuaagaaucccuugcccuccauauucugaguugggacugaagucugagaguaugcauccuuuccaaaguauauaguuuacaggcacauaugacagcaggaaggacagacacagcaacaagaagacaucauauacaguccuagguucaauaucauuuucaauccaccguagcuaugcauguuugaacaaguuacuuagcugagcuucagcauccuauugcuaauaauaguaucuauuuauagcuggauuuaaaagcaugaaaggacacaguaccuauuaaucaaagcgaaucaaaagcaagcuuuagugagugacugcuuacaauagcuauaguuuaucauugcuuaacagcaggaaaacauucugagguuuaugcguuaggugauuucguccuuguauggacacaguauagugaauggacacaaacuaagaugccuacagagucacuagaaucaucuuaugagaacaccauuuguguauguaguccauuguugaccaaaggucuacuguaaccugugauuauaauguacgugaagauaaucauggugcucuucucaugcagaagggaauauauucucaauuuccuuuaauaccagcacacuguccacaugaguaagaaacuuugccuaagcuuggaaccacacuucacuaguacauugguauagccguaggaccucucuccccucugucccuucuucccuccuuccccacuccucucucucucuccuugaaguagggcuuuucugaguagcccuggcuguccuguaacuuguuauguuaaccaggcuggcaucacacucagagaugugcuugccucugcuucccaagcacugggauaaaagacacgcuccauuaugcccuauuucccugacuucuaaugauguucacuugauucagugguacugcaagauggugaacaucacuuuaagaaacaaugacagcuuuccaagagccagugucccucucuucccagaaguguuaggcaagucucuggcuucucugggucugccuucugagguguaaaugucugaccaucuacauaguugcauuaagugggugaccuugaaaccauucuuugcaaauaucggaugaugaugaauggaaaggcucuccugcuguauuacaucaccagauuuccauauucauucaacacugaauggcuaacuuagugcugaccauugugcugugucaggaguaauaagaccgguuagaagugaugccugcuccgagaaguugaccaucuucuucagagaaauuuuuuuaaaaacccagaucaagaaagcagggaaauagcuuugacacuguuuaguuuaauucuuuucuacuacagaaggcaccucagaggccaagggaagagaguguaaucuaccaaacucacacggucuccgaacagcuaagcuaaugacagugaacuuucugacuuuguuuaggcuucacugcugucccaugcuguguccugcucagaacaguggggccuaggagggcauccucagugcuauagcaacaucauagggagggcuggagcaccauaggaacgaucugggagcacugucugauggaaugcuuguggaaagggcuauggagcuacagucacuuagugcgggcaccuguauccuuuaguacccauaccaugagccagaggcuagaaucaaagagacgaaagaauuucagaaaaauuuccaaguccuugcaaaggaguugaggaaagggagguuauggcuuuucacaucagggagaucuaccggcaugcuuaaacuguggacagaugauucucauccuacagaaaugaaacaagagcuguacaauuguuagcgacagccuguggcaauuucaugacggcugagcagcagcaguggggacgaugugauccuuaggcgacggcaguggugguuaggcucugggaagucuaagcaaugcugauggcguucuacucuuuccuccaagugugagaaaauuuucugaggaucauaauacuagugauuggucuuuuucuuuuggucaaaacucguuuaagccaaacacgaugguccacacucaagaugcugaggcaggaggauagcaaauccagggacagcccuagacuacauaguaacacucuaucuccuccuacagagauacuugcacauacauguucccuguucucuugugcacacuagcugggaaacagaaccagccaagacgcccaucaacuaaugaauggaggaugaaaaugugguccauacauacaguggaauucuacucagcacuaaagaaaaggaaagguauaaaauuuggaggaaaauggauagaacuggaaagcauuguacugagugaggaaacccagguccaggaaggcagaugucacauguuccuucucauauguggauccuagccucaagguuuuagauguuugugcuuaauacuuaacuuggaguaucuguaaaggcuuagaagcuagaaaagggaggggaggggacucaagagcuuuaggaugggaagagaaugcaagugauaaaaacggagaaguggaaaaggcucaaaaaaaauugcagaagacagggaagaaagaacauaagggccaaauaagggggaaacaggauaugauaugauagcuccugggcaugauauagccgcuauaaucccuaacucacaguggcuaagauugccugcaucaagccagcauaagacugggccugucaauguucagucauggggagaagagaaggguaaaccaaaacuuaggugauaugaaaaagccauauggaaaccuaguaauuuaauuaaauauauuuuuuaaaagacagagggugggaaccaagauacacugaagggauguauaaaugcuguucccaggaauagguaaaggagugcccccuauaagucauugguuugggaggucccagaagccccccaauaaugcaagcuagugcaaugcucuagguuucacaccagagcuagaugguagagccuacuucuaaagacacccucacuuuggcuucaggacacagagaaaucaagucugaacugaacuggaaaccccuuccuguggcuagcuuucaccaugaaauagcuuucaucaugccauagcauaggcaacuuggggggaaaaccaucagcagucucucccagcuguaaaccacacaugcuacaguaccaaccucccuaacaaaaugugcuaacugguauaauagugguaugguuauuauggagauaauccacuacuuucugguugaauuuuugaccccuucuauaggaaaggguucaugcucugacuucauccaaggucuguggcuaacgaggucauaaacucaagcaaguaucugcuucuuuggcuaaauggauguguuauccaacuaccaccuaaauguuuauauuuauguucacagauuagcacuacagucaagccuuggucaaaaguuguuucaguuuguugugggugacaaguaacacagaagcuccuuagcuugcaaagagcugagaaaaugacgggagccuacauaggagagauuuauaucacucucuccaggacugccaaaaagagguuagauguauguacaagcaagaggcaggggaugggggggggggggugcuguaauauggugucucuggaucauugcacucaugaaaucgcagcagcuauggcuacugugacuaccucaagacuggguccaucaacauuccaucacggacagaggaggggcuuuagggccccacgguuccuugaggagcuauugauaguuaauagauacaggaagaggaggagucauauucuucaguggugcagccacuuguaaauuuccuuguaaauauccucccaaccaugcaaacaauucuaacuaaauucagugauuuuaaaaaagaaagagauaagaauaggaaggaaacuuggcugggaagagaaagcauucaguggaaggaagagaggagaagagagggugauggggcaggggagagacgugaucaaaauaauuuauauacaugaguagaacuaucagagaauaacauuuaaaaguaaaaacugcaugugguuuagucuuaauucuauccuuugugucguaauuugacaaaucuauuaaaaacaccaagaaaaauagauaugcugauugagguuagauugguccgauaccugauauguauaaaggcuacagagaucauacauuacuuugcaccaggcagacaggguuuguaggaauggcucuucuuuucuagucauuccugagaccuguguucuacaucaugaauauuuccagaaacaaguuuuuuuauuuuuuccaguaagauggugucaagacucacccuuuugcaucuucucauacuguucccuugucucaagaaauucuuccucaaacuagauuaaagacagagagccauuguuauaacuuuaagauaggaagcagggagagagagauucagauaccauucagaaaugccuuauggccuucagaauaaaaucuaaaagggaaccagaaagcugucagcuccccucuguaagugugauaggguguguauuuaaagauuagcuuucagggguguccaaccuuuugacauugugacauuuuguugucgucuacugauguguuggcugcaugcauagcuauccugggaugcaugagcugggggugagugggugggaggguagcuacugguuggaagggacaagacaacaucugggcggaucuccuauaucaagggucccuaagaagcuguucuccguuuuugcuucaccucaccuagcucuucucucacuucaaacuuuugucuuugccccagacuucuccaaugauuuucccucuuucguuuccucucuuuuccuucuuuggcuucauaauuuuuccuucaugugaggccaaauuaaguuuaucuuugagacugauauauccaaagauccuacucaagcgagguuaugcucauuuacugauggcuaaaacuguaauuagccuccaucuauagccaucuaaagcuuuucgaggguguuuuuguccuacguaucuuaagauggggugggacagaugaccagaccagggcagagucucuaaagugggaaacaaagacagcagugaaccuuguuccggggaaacagaauucauacugggagagacagcgguuugaagacauuucuauaaaguccacgaggagacuuagagucaagguaagagccagucagcagaucguacaucugggccagggcuccgggcagccaugaauuccacgagugaggugcugaggcagggguuaaauggccucagaaaaaccaaccaaucccaauggaggaaaugagcuaaucuuccccuaugguuaucaucaucuccaggaacuucagaguaucccaggcccucaacuccccucuuccugggcaccucgugacuguaauccccccuuucuuaucuaagaaaacagguggaaaggaagggaaggaggaggggaugggacuuaugcuccauccccccaacccggaacugaccuccacuccagccgcagccagcagccagcggaucgacuccauccguccccugccauuaaaguaguagagcuuagguuuggcugccaugacuccugcuucagagcuuccuaaagggcggaaguaaaaaaauacguuuagaaaacaaccugguacacaucauacgcuucgccaccaguuacagccgagaugaaacacgguaagaaaagcuccuguguggggugcgcagacaagagcacgcuauggagaaaugcacaaaagcgggauuuggaguuggccuugugagcaggugguuaggacuggggcggagcacuugccuuugcuaggcagucaacaaugucccauuucuugagcagaaauagcagucuuuacuuuuaaccaauuaaaaugggcaguagugguccacgccuuuaauuccaggaggcagaggcaggggaaucucugugaguucaaggccagccuggccuauagagcgaauuccaugacagugaggacuacagaaagaaacccugccuugaaaaacaaaaacccaaaccaucaaacaaacaaaccaaaaaaguagccauuucaaugugcacgcaugguuugccuuacgcuguauaaaugcugucacucacagcuugagacaaaagaaccaggcacacccaccaaggcgucacauuauugagacugucucugguauuuggagauaggaaccaggaauugauauaaugauuucauaaauaucucugaaaaaaaaaaucuuuucuaacaccagcaaagaggcaggcuacuugaagugggcuauucugcgggaacuggggagucuucaauugccgccacaagacuuuauuuuuuuuccagguaaaaagagaucuaugaaauagcauaaaauauaugaaucauaaugacaaguuagaaaauaccaaaguaaagcaguggugacacacaccuauaaucccaguacuugggaggcagaggcagguggaucucugugaguuugaggccagccuggucuacagagugcagauaaccaggacuauacaaagaaacccugucucaaaaaacaaaacuaaauaauacacacacacuguaaauaucuguaaaauacaaaauucugaauuaaauuauuuuuaaacuugcaaagugcuaucuuuuucacuaaucacuucuuccuacacgaaacauaaagugaucccugagcaccaugacacgcaucccaggcagaggcaaggggaucgugagcgcacauuuccacauaucuggucauuuagcaaaauuauuuagcauuuacuaugucuauagaaagcuuuauuagacaugcuguucauaauauguuuugauaaaauacauuauggccaaucagaucaaccucacacuaaagauaaagguuuuugccaaaugaaaaaaauuaucauauuuuuuuuguuaaguauacugaaagaaauaguaucacuaaagcaaagacaaacaaacaaaauauuacauuauuggccuguuugggggcaggaggagugcagugggauuguauuugccucacaagcaugaagugcuggguuacacacacacaugcacacacacaugcacacacacacacacacacacacacaugcagacacacuuauuggccugcuucucaauccuugcucagucugcuuucuacaauagaauccugaaaggcaggaguggacuugagaaccaaaaaaacaaaauaaggaggaucuuuuggcaaggauccagaaccauggggugguaucacccacagcgggcugccccacccaccaccagccauaaaucaagaaaaugacccagcugaaugugguagaacuugauuuuaaucccaggauuugggagauaaaaggcaagaggaucucuugugaguuugaggcuagccuggucuacauaaugaguuccaggacaacaauuacugcacagaaggacccuguuucaaaaaaaaaaaaagguguguggggggaggguagagaacaaagagagauguagaggcagagagacagagagagcaucccacagacuugccuacaggccaaacacccugauggaguuuuaauucuuauuuucuuaaaaaaaaauauuuaguuauuauuauaucuaaguacacuguagcugucuucagacacaccagaagagguugucagaucucauuauggaugguugugagccaccaugugguugcugggauuugaacucauggccuuuggaagagcagucaguguucuuaaccacugagccaucucuccagccccagagguuuaauucuuaauucaauuguuuccuauucccagaugacccuggcuugugucaaguugugggggugggaggagaaacagcuagcacacagagauuguaugcacauguaaauuuguccagccaggauagaagccuaaagcaggucuucuaauacuuuuuucuugauucaacaauguuuaguauaaccuaaagauugguaauauagaaaacuauguccguuuagccuucaaaaaguaaacccaguuaucuccuuguuuaagguacauugucagagugaacaaaauaagugcaguagaaauacuaauuuuguccccaggagccgccaagaacaaaagacaguuguccccgauuucauucaaaugccagcagcauucugacccacacucaucuucucaacucugguuucuucuucucaagaguuguccaaguguguacacaguuccaugagcuaguucgccaagugggcuuuuccuaugaugaccuggggguugaaccccacccagaaggaucagagaaugugcacccauaugcagcuccucaacccagaagccagcgcacagcucagcuggacugagcagaaagcagccaucaugggugacaguuuagacggaaaaagaaguacaaaaucuucuagaaaauggaagaacacuucuccuaauacaauugcuugaguuaggccacagguaccgguucacagcucagcuccaacaaaggcuuaguuccaaggucaaaaggagagcacaugugcaagucacuaaacauggaaaccuagcaaccuaaaaaugucccuucuccgucgcagauuacagcaacauuugcuugugagaaaagaagucagccuggcuucuguuuuagaagugggcggcaaucuccugagcgcgcuuggggaccagcagcagcaguuucuaggugccuaguaggaaguuacaggucugagcuagagguggcucaaccgugaaaagcgcagaggacugggcuucaucccaaaacccacguggcaacucacaacacucaguaacuccaagcccagaggaucugacuuccuuuuccgagcauccuuggaugcugcacacgcgaugcacagauaugcacacagacaaaacacccaugcacaauaaaauuuaaaaaggaaaagaaaugagaagaaaauucuagggugaaaauucaaucagucugcccugggggucgcagucagcauggaaccauuguccauucuucccaugaacuaggucaacauggaacaccagaucucguggcagcucucaguugguuauguggauuuuuuacugcagccauauggcacuccugcgggacacagcaccccugugggacagagacucugacccagcuuguauuagguaucuccuccccaucuuucauacucagaaacuaaacuucuuauuaauuaagccgauugguuaauguucauagaacaccaaugguuuauacacuugcuuagaugaaaaaauaaagccaagagacucaaaucuaccugggucuuuguagcuauguaagaauaaacaaagcaggcugccaugugguauuuaaaggcuagggcaagucugagaaacaaaccgauaaacaccucaccagagcuugcuccuucgagaagcccugcauuucauuuuagcacagcucccugcacgugcaggaccaggaggaaaacuccaguguucgaucauuugaguuaagucuucugaacacguggaggagacgcggagaagcacaaagguacucuauggcuggccccugcuuccuuucuaaguagguaaaaaauaacugagauuuuccuagagagaauaugugugugagagugugggcauguauguguggugugcaugugugagcauguguggacgcccaaauacuaaugaguauuuucaaauucaaauucaguuaaaaccccacuuaagucuuauguauuucagcuaaagucauccccguuggguccuggcaaauguauuuauugagugcucugcugcauauacacccauaugccagaagagggcaucaguuccccuuauagaugguugugagccaccauuugguuucuauggggauugcaaccccaaaggaagaacaauaucaacuggaccaacccagaauucccagagacuaaaccaccaaccaaagagagauucaugguaccagauacuuauguagcagaggauggccuuaucugauaucaaagggaggcccucuguccuguggacauuugaugccccagcucaggggggugcuagaacagucggggggcggggguaggugaauggguggaggagcacccucauaaaggcaaaggggagggggcagaggggggugggauggcaggguuguggagggguaaccgggaaggggaauaucauuugaacuguaaacaaauaaaaucauuuuuuaaaaaaaagucuuauguauuuacuuuguugugcccagauuguaaaaaccccaaagagaccaucaggaaucacaaccugcuauaauugcaugagggucuuuauucaagcucgagcuugggccaccaaccuuccugaugaaacaggaaagagagugaacccccaggucuaagugaaggggguuuauaaaggaaaaaacugcaggccggguuuccaagccuuggcauuccaugagaggguaaaggaauucugcucuucaaaccugauaucagguuuguucugacagcggggcggaacgugcagcuggaaaggaaccuuuccgaccugggaaaaguaccuugugcuauaggaagcugguguaguuuuacaacuggccacagcugucugggaacacuuaauugucucuuuuucauagucuaagagugggcuguuaucauuucaaggguauuggguucuguuuccuucgagggcaggagccaucugcaccugagaaaaguugguuguuaaucaaaaggggguaugagucucaggggaggcuacgggaugcugcuuucuuguucccaaggcuggcauuugcgcucccgaguacguacacacacacacacacacacacacacacacacacacacacacacacacacacacacacacacacacacacacacacacacacacacacacacacgagcaucgucacagggagggagugcuaacugcucugacuccacacagggccaggagaguguaggauuugaugugcagguuucucaggucucuucaacuuuugaaguuauaaugugugaggguguuuuggugugcccagucauacuuaagcugugcacagacaacgcacgcguguccauuggauagauguccauuugcuauuuucuucagaaucaugagagacuagaaguuagacagacagggagaggggccauggauauguaagaaaccugaugaacuuccaagauggcuggcuucuucuauacccuccaggcugagacaaaagccuggccccuuaaaaccagggccuugcaggcuuuuaccucccagcagcaggccacugcugagggacuaacucaacaccuucuaggccaucuggauuagggcugguuuacacgagagucacaggccagagaaacuucuuuucuuuaaagugauuacccuauauuggggggggggggucuucagagacuaaacaaacaaacaaacaaacaaauccagcccucgagaagagaucggggauuuuuagauuuuguggcuucaguguugcagaucuuuucucugugugucugcugcaugugggugguugcuugccuccagcaagcccccuucuucagcugcugagucucugcuccugucugcaggguuugagauuucuucacugcuaucuguugcaguugaaauuccuccugccuuuuaauuacuuaaauggcagagaaaacgaacccuaccaagaccuuuagaccauaccaaccgcucaucuacuaggcagaaaaaauuugugccuuuuauuuggccuaaacaagcuuugagauagugaacagcaaauaaaucacaaaguuaaaacaauugcggauuauaaacuguagcuuuagcaaaauuauguaacuacucagugcaagaggaguacacacacacacacgcacgcacacacauguacgcacucacucaccuuauucuugugggauuguugucuccaggcacuggaaagaagcgguucugcgagcgaaaguucaccguccugcaggucguuuuggaagcuccgcccaccagccauugaacauuuaagaaauguacacgcccccuaggcacguugguuaacgcuuuguuucccggggagaagaacagguuugcucuaaaaguuuucgcugacucauuacugaguacacucuuugggggugcugacgcgaggacuccgauuccugugcuggaaguguuuacauucucuacgggggaacccaguaauauaagcaguucagauaaaugcacuguauucaaaauaacuauaacaucaaccuauugaaagguuagagcuugcagauuugugaauucauuguauucauugccaacaaaaguacaguagagaggaaucagcgacugggagcaucgugcugugguccauucuugugaugcuaaaauagacacucaagacuuuauuuuugaaaacaaauuagagacguacaguucuggagguugggcaagccaaaauugaggggcuuucuuucacuugcugaggaugggguaaaauaaaagaaaaaaaaaagugugcccucccuugacgagagagaaagcggcaagcucgugcauucaccuuagggguggacucccgaugaaugggaaacuuugcccccucccucucuuucuccuuaaagaauuuuuuccccuuucauuuuacccuguagaauggggcagaugguuaaaaaggcaugaccgccauuccuggaacagucauaggcagcccaucaagaaccguuuguaguuaagguuacagguggggcauagcucugccuuugagaaacagagguacagucaugaacaggaauaaaccuaguuugucuuuacuguaggacggcuuugaagccuaaaacugaggcaagcuaguucuucaguaccuaacccgcuccucagugacauuaauucacucgugacagcggagcccucauccaccuuaucaccucuuuaaaagugcugccccucaaaccaguugccccaaugcaaaauggcuuacguuucuguaacaggcuggcaaaaauacauuugaaaagagacacuuugugucucucaguccgacuaucagacuacggaaacaauggaccucaaagaaaagggacacuccccaggaauccagucagagggggaucuugucuccugggaaacauuccuuuggcacaguuucuaagaguuagucagaacgucuuacaagaugagacugaagcacagaaaagcagugagcacacgugaccacugccuagaccaggaccgcuuagaugugcgugccugaggcucucugguuaaacucugaacucacuucaguaccuggaagauggacuugagguggggaagaugggugugucccuggaugccuggaucccuguucuuuuuccauauugacuaaguuuccuuuuucugcucucugcccccacccccacccccggccccccaagacaggcuuucucuggucuagcccggcagcccuggaauuugcucccuagacuagguuggccucaaacuuacagaggucugccugccuuugcugggauuaaaucaaauuuaauuguagaucaaucaucuuaacucuuaaaggugagagcagguuuugauuugguuguggcaaagaaucuugguaggaugaugaggcucgaaagaguccgggaacuuaagaaaggcucaugaagcuacucuuugagguuaaauuaguaagacaguuauggaagagaggcugccuuugugcagcugacuucaagcuguccaauaagcucugggauauagcucucauuacccaugcugagguggacuucucagagacgcagcuucccuaaugucucccauacuccaggaagugaucccucagucacgcucuguaaguaaccaugguaaacuaagugguuuagcaagauaaaugggcuucuaaauaaguucuccuuugucugucacagaugcccuaucuugggugaauagacauuguuuguaucuuuccagggaacgaaagccacuaguggcaccugaacaaggacuuauggauccaaagaugugucaagagaagcaauccuauguuccuugcuauggguaauaaaauaucucaccaaagacagggagugcuggagcauguguuuaaucccacacuggggaggcagaggcuggcagaucucuaugaguuugaggccugcuuggucuacagagcaaguuccagaacaguaagggcuacacagagacacacccccuucaaaaacaaacaaucaaaucucaccaaggcugaacugucuaaggguaggacauccuuggguggcugucuuccucuagguguugugggguuguuauacccaguucucgggaaccccggaagaacucuaggaacugcaaguucgauaugaaaacaaagagagccuuuauuccuggauaaagagcuggauccugcucagguuagggaugcuaugcccacguccagaggcucggaauauauaugagcagggauccucaaauguuggaguuacaugaguggggaggugacaagggaaggacauccuucaaaccugauaacccaggggcuggagagauggcucagugguuaagagcacugacugcucuuucagaggucaugaguggcucacaaccaucuguaaugagaucuggugugucuaaagacagcuacaguguacuuauauauaauaaauaaauaaaucuuuaaaaaaaaaaagaaaaaaaccuguuaacguuuguucagauagcgggaaaccaugcagcugaggaggggaccuuccuggccugggaaguaacuuuauggggcuaucaggagcgaguguauuuuacaaacuggucacagcuaucugggaacacuuaauugcccuucucucaugaucuaagaguggaccucuuaucauuucaagaacauuuaguccuccguucccuucaagggcaggagccaucugcaccagagaaauguugcuuaucuaucaaggagagugucagccucagugacacagaggcuagcuuauguugcuuuuugucuguucccaaagcuggcaucugcuggucgucccccgcccccauuucggggguucguuauggggaagggacugccaccaugaaaaggggaauugcaauauucuggcaccaggcugggcccucucguuugcccucuccaaaggcuggagacaucuaugcugggaaagggguuugaagggggaauucaggcugguuuccugugucucuucagggugacaggccuacuuaaugaauagggucaacccuguggauucaggggcauccuccaaacagcugauggacuagagaauguauuuccaucccugaaaguagccuguauggguuaugauucucacuaugguagccacuguguggcuacggccuucagugacaggagaugcaacuauggcugaguuguccgccuagaaaacaaggaaggacuuacaauaagaaaaagacaugagaacaguauuauacaacccaguccgauuuagcaggaaaagcagaagaaagaguggaggagauggagguguugccucuccaaaucuuacagcuguugguaugucagggaaggagaguacauaguagaauccaaacugaagaggcuuuccucugacccagccaugggaaggaucaguguagagaaaagaagguugaagagauaggcaguaccucuucagguccaacuuuaauauggagaguggagaaacccaugguccagcaugauaggacuguguucaugggagagcugaaaaagaaguuauuucuucagggaucucaggacugguaugggguuucagugguuuggcugggccccauagugggaugugaucuuuauguccugggagaggcuucagggggucacgugauucagagccgcauacagguugggcuugucauaaaacauuuaggaguggaugaagacaagggaaaacagauaaaggggucuguuugggucacucaaaagaauagacauguggcacaauuugugucaagguagaauuccuagggaaaggaucgacaggaguucugugcucauuugccucuggaaggcuuuaaagcuagaauggaaguuuaaucaaggguuaaaguagagaauacaacaguacaggugaaaaagauuagaacuuaacccauagguuaaguaugcaguguacauuucuuuccuguaagagaguguauggggggguggaaacuauacacccugacccaggcccuuuuagcagccagggguggcugacagagaggcauuacccaugguccugggccauggccugucagagccaagggcgcuggcuccaguauagcagggagagcaugguccuccucuguuaugauccuggccugagccaagcacuaugagucggucuuguugaaacuaucauauaugggaagguguauaauggucucaugaugguggcguaugagaacgagggugaguaguccuccacccacacggcuguaccuaacacugcucuuuugaccaaugaugacagaaaugaagagaucuuuucuuucuuucuuaaaaagauguauuuuauauuuugugugugugagugguuuugcuugcauguaugucuaccacaugugugcagugcccguagauccaagaagagggcaucggauguaccggaauuagaauuccagacaguugugagccgccaugugagugcugggaacuaaacccaggucuucugcaagcguagcaagugcuuggaauugcuggugcaucucuccagccgagagagagagagagagagagagagagagagagagagagagagagagagagagagagagagagagagauuuuuucauucuauacuagacuuuaguaauaguuccuuuuuuacuacccccauaacuaugcaacaccaauuggcacuugacugucauagaugacaguagacguucagaaacgcuucccaugaaaagauuucauuauugagcugggcgugguggcgcacaccuuuaauccagcacuugggaggcagaggcaggcagauuucugaguucaaggccagccuggucuacaaagugaguuccaagacagccagggcuacacaaagaaacacugucuugaaaaaccaaaaagaaaaagaaaaaaagaaaagguuucauuauauauuccuaaccuuugagaguucuacagauuuggaaacauauuuagaacaacaacaacaaacacaaaacaaaacaaaacaaaacaaaacaaaaaaaaaaacaaaaaacaacccuagcaauugcagaguuuggaugaaggcauccuuauguagguggaaaagcgaaaaggaaaucagaggcagccauaaagcugcuagguaagaauuccagugcugggcugugcuaccuccagaugaguugaugaccuugcaagccccugaggccccacaagccacaaaggcuauugacaaugcuguuggucgcacaccagaacugcauaccuauugcugaagaaacugcauucuuuuguugcaggacauggagaaaucaagcuagcacuaaucugauggaaacugucuuccuugauggcagacuuuuguaguccagaaggcaaugcccaggccauugcaggagaacgguuguugacauugcugcucagcuauggaucuugcaaacacuaccaacaugacagccaugauggcugaggcaauaaugcuguggcucucaugggugcaacgaccaguuuucaguuggauuuaaggucagcgucaugggaaggaagccauguuugauaauguaauccaagggcacaaaccugaaguucccacagggagacuacugcuauuguuuauguguagaacugccccuaaacauuuggucuugaccccagaugacugcugcuuccagccuguuuuagagggaagcauacuuucugugaagggaagugagcuacggagacucauaacaggucaaauuguugagaauaagugauucucuugaggcauggcggucaaacgccagccauaaauggaacacaauaaguuccauccuccccaaggcuugggaaacauugcagggugaaggcagaaaggaugcuugagaaagggguagagcacugugcagaaacuccuuccaguuugaaacuuaaccucccagagggagcuuuagcagacucaggcaacucaugaaguuuguaagucacaugaggcuguuggcugaaguuacauaagcagaaaauaguugcugggggagaggagacucagacugagcugccuucaaacgggagucgugagucgucucucaugcuggcgugguguucucagugaucccgcgucuccuaugugucuguaagaaaccucccgagcagcaguccaaaaaccaaaacucaaaccaaaccaaaacagagcaaagacaacauacagaaggcagguaccacaugguagugauacacccaaauaugcuaauaauuacuuuaaaauaugaaugguuuuaauauaucaauuaaaagacagaaacaugcuuaaaaaauaagauuuacauauguugucauaugaaaccuacucuauuucaaauuuaaaaauuuuuuuaacuagggacuagagagauggcucagcaguuaagaacacugacugcucuaccagaaguccugaguucaauucucagcaaccacaugauggcucacaaccaucuguaauggaaucugaugcccucuucuggugugucugaagacagcaacaguguacucacuguugcuagauauaaaauaaauaauuuaaaaaaaaaucugacuuugccuggucuacaaagugaguuccaggacagccaggccuauacagaaaaccaaaccaaaccaaaaaaaaaaaaaaaaaaaaaaaaucugacuuuauaaaaaaacgucaaacuacauguagaucuguguuugugugggugcucacugaagccagagguguuacuuccccuggagccgagacacaggcagcugagaugccugaugugcucacuggguagcccugagcugccuccugagugcugggauaaagggaaucgaacuuggguccucuggaagaguagugcauguucuuaaccacugcguuauuucuccagccuaugaaaccuacuuuaauugaaaauaaagaggaaaauaaauccaggagacugagaaagaugcagggauaugcaagguuugcuguagaucucauggucaggggacugcuuucuuuuuuuuccucuuuucuuuucuuuuuucuuuuuuuuuuuuuuuuuuuuuuuuugguuuuuauacagacaggguuucucuguauagcucuggcuguccuggaacucacuuugcagaccaggcuggccucgaacucagaaaucugccugccucauuucucuguguagcccuggcuguccuggaacucacuuuguagaccaggcuggccucgaacucagaagucugcuugccucugccucccaagggcugggauuaaaggugugcaccaccacugccuggccucagcuugcuuuccuauagaacccaggaccauuaacccugggaguagaccacccacaguagacuggaccaucuaccaucaaucacuaauuuuaaaaaugcccuacggcugugucuuaaaguuuuacugcugugaagagacaccaugaccaaggcaacucuuaaaaggacaauguuuaauugggguuggcuuacagguucagcccauuaucaucaaggcaagaacauggcagcaucuaggcaagcauggugcaggagcugagaauucuacauucucauaugaaggcucuagcagaauacuucuagcagaauagcuggcuuccuggcagcugggaugagagucuuaaagcccacacccacagugacauaccuacuccuacaaggccaaacauacuccaacagggccacaccuucuaauagugccacucccugggcacuaucacgacaagcuggaucuuagauaggcauuuucucaauugagguucuccccuuucagaugauucuagcuugugucaaguugacggaaaacuagccaggacaugcuauuaucugacccauuaggugcaucaccucuuccgagaugccaucgcccuggauaauucaucuuuccucugucuaugagcuggaguuucuguaaucacacuuuuauucuguacucaaaguggaugugaugaaacuaugguggaacuauggcugugcacuucacacacacacacacacacaccccuugcuugccuguuguggcuuuuuuaaucagugaggcugaugcuuuccuuauuuaauuaucucccccgcucucucucucucuccuccccucaucccucuaggguuucacuauguaguccaggccggccuugaacucagagaucugccugccucugccuccugaaugcugggauuaaagcaguguaccaccucaccugcucgacauucuuuuucccucacugacagguguaagaggauuugcuguacuuaagaccaacccugaacccuccaguguacuauuuuuaaucucuacuuuuuauaaucuaaaaacaacuuuuguuuuaugaguguuuugccugcauguacgucuaugcaccaaguaggugcaguacucacagaaguuagaggaggaugcugagucuccugggaguagaguuacagcugguuguuggcugcuguguggaugcugggaaugaaucccugguccuccagaagagcagccuguguucuuaaccaccaagccaacucacgagcccuucuagcauacuauuuucugaagauaaauggcccauaacccucuacucuauuaucaaacucuggugacugauggcaaagugagggugguggugggauucugcagccaaagggcaugugaugagacuauggugaaugguaccugaggcaggacagguaagaagagcuauuuuccccuuccagaggaacugaguucaaaucccagcauacacauggcagaucacaacucucuguagcuccaagaccugacauccucacauagacauacaugcaggcaaaacacuaaugcaaaaaaauaaaaaauaaagccuguucuaaggucaugagcuacauauaaacauguggccagccaggcuugugugcaggccaaguuagcagauugaucccuggucuguaugaagggccaucagaccaggaggaaaaggcacaagcauuucaaacaacuagcucaccaucuuugcauuggucucuaucccggguuucuacuucuucauguguauacugaaggcaugagaugagacuggguuuguuuguuuguuuguuucugguuuuuugagacagaaucucacuacguagcccucacugg

SEQ ID NO: 5209 - RNA, 1181 nt, Mus musculus
uggcucuuuucauauuuuaaugacgacgcacauuuuaaucacuucaauuuuauuuuuuauuuagagugguaaccuugggauucacaucagaaugcgcagcagggauccaggaauaucuugcuaggauguaacaaagcuaaaaaucccgccagaaccaaacacuggccacagcuuaaccugcauccaggucggagacacaaggacuggaaacuggcuucacucgauacacuggccuagcuccagggucuucauggauuccuccagcuucagcacuccugcgugagaaacaccaaacaggauuaagugucauggaacaggaggaaggccgcaugauucaccagcucuuuaagcauguuuuuguggaccucuaauuagaaccagggcuccacugggccaguucuaacguucuccuagaaaccuggagaugggagugggguggggcaggguuaccucagauaacccugcccagagggauaagucccuaccccuucucaccuuaagacuuacgucugggcccccgaacucccaaaagguugucagagacggccuagagaccaaggaggagucccaggugaugcccaaaaguaaggcauccucagagggaugcaagcaguggagaugugaaaagggagguaaacucgguggaggcaggaggcuacuccaccgcaccuugguucagggcaccuguuagagacucucaccuuuuugcuggcgcaggugguaccucucagccauggacugaagcauccauuuagcccgaaucuuguuguuuugagagccguaaaugaagaccucgauaaguucuucgggagauuccagguucuucagcucaaacauggccuggcucaccugcucgaugugagacauucgagaucccugugggccuguccggggaaaggcaaugagcauaguuccaagacccggagcuuugggccuuggcagcgaggucaagaguagcuacucaccaaacagauauuucagcaccagcgacuggaccuggaauacuucuggaucuuucaggucuucaggaacuuucacccacggggggauaucuuuacgggucacgagggucaccaucauccugccaaggaaccagacuucagggaagacgagaucaagcuuauccaccacgcacggcccacagcuccagguucaggaaguuuuaguaccugugugggcgg

SEQ ID NO: 5210 - RNA, 2677 nt, Mus musculus
auaugcuacucauagccugugguccugaguuugggggcucaaguauaggcuaauaaauacaaauucugguagaaacauagaauuuuguccagaaguuacuaaaaaguuuuaaguuuuaugcaugaaccuauucauaaaucugcuaaugaugaucaaucugcuuaaacgguauugacuuuuuuuaaaucaaguucacaccagaaaaaaaaaaguaugacaaauuucugugagaaaaccggaguuccugggguggggcccagguaacaggaagcauaguaacagcuuagcaaccuugagcagaaaugauugccccaaagucauguuucagcauccugagcauguuagagcugcaaauuaauguauccucucacggggaaucacuggagaaggggcccaggacauuguuuugaggcccuuccaaagugaauucuccuguccaaccccauuccugguacaaggauucuccagaauucuggcuggccuuaaauucaagagauccaccugccucugccucaggugcugggaucaaaggcauugcaccaccacugcccagcucccaagugaauucuugcacacuauaaaucaaugguucccaaucuuucuaaugcuuaggcccuuuaauacauuucgcguuguguugauuuccaaucguacauuucuuugcuacuucauaacucgaccacucuucugaauuguaauguaaauaucugauauacaggauuauauucugaucccagguugagacuacugccuuaacuggaguagguuaaaaaguacaaaaggguagccagaaaugguggagcacaccuuuaucacagaacuugggaggcagaagcagguagaucggaguucaaggccagccuggucuaaauaggagacuccaggacggucggggcgacauagauauucugucucaauaaggaaggacaaagggaucaagagcugacauuuuaaugaugcccuuuucccaaacuacuggguaacuuaaaauaauuugcuugggccaggcaugguggugcaugucuuuaaucccagcacucgggaggcagaggcaggcggauuucugaguucgaggccagucuggucuacaaagugaguucacgggcagccagggcugcacagagaaacccugucucgaaaaaacaaaacaaaacaaacaaaaaaaaaaaacuugcuugacacaggaguuagggcccacuuuuaagucaacugugccauucuugagggccagacugaaguguuguuagaaaccguaggaauacaaccuacauacuccccgaaccaucaacugaauacucaaguguuuauaaauuuuacuguaugugaucaaaccaacagcauaccaaaaaaaauuuuuuauauuggaauaguucuacaaauugcuauuugcaaagaaaaauaaacaggaggugcucgugaaggcggguaagaaaauacguguagugauuuaagacuccaucuguguuucucuucccuccagcggaagcggaaagccagccaguuuuagcccuuucuuacuuaacuugcuuaggauugaggaggcacgaauuuucaagaacucuucaacuucuuucaccuucacagcuggaaaaggaucaacaccaacagucaggcgggaggggcgcagaguuuuaaagagaagggcuucuggaccuggaaucugggaagacuggugccuauggcugagcaggggggguuaauggaccuuggugugucggucuuucccuaccuuccugccauuuaagggcuuuggaaagggauacccagggacaauguaguuuccugguguuuggaaacugaaagaaauugugagaagcugagacucucccgcggcuuacuccccaggugggucgucaaaaucccuuaccucuuuggaguucguuuucuuugugccaggccgccauguucaagagaauauuuuucauucgcgucugugcacuggguuguccaaagauggugauuucagcuagguucccagaguugacggaguccacugucagcagggcuuggcacauccacucuauuucugagauuuccgcuuggucugugccuaaacaggugaggaagagacucuaagcaauuagaacggcuucagaugggaaggcgcggucuuugaagggcagauuagacugagggauggggcauggacuugcugccccuagcagaguacagagagcuaacccaaaccuuugcugccccuaaaaggauacagagagcuaacccagaccccccuggggugagcucaccuaugacccuuucugccacccaggcuuccauguagagcaccagaggauuacugacuuccugaauugggaaccaccagggccgagugcgaagucucagggacacaggcaggacguuaagcagcuucugagagucagagucuggcuuggcgucagcaucagccgugugggaugccauacugcaagcaggaggacggggcgcugcuuggcagccggucuggucucgcuuuucaaagcugcccagcccgaccccgccccuucuaugccacgccggcgcccccccccccccuccagcaaggcgcgcaccgcgcaaguggguaggcugggucugccaacacuaacaaagguccucuaccaggucuucagacugucacauucuaggcccugcccaggauacugcugacacgaagaauuugauuugguggcuuaauugg

SEQ ID NO: 5211 - RNA, 1205 nt, Mus musculus
ugugauuggcuuauuuuuuauuuugcucgauguuucuguguaaguccaagaugcuuugauaguuugguguuuuauucacauucccccagagaguauuguaucaagagauacuguugcuacaucugugugucaugaaauucaucuauaagcccagcacuugagugcccacucccaggcaggagaauuaaggcuaucuucaaagauauuaguauacauaguauuauauaauauaauuugauguaauuuauuuaacccaggauggacccaaccuuccaguuuuuccucagugucuccuacaagacauucaaugcuaagauucugcguguccucuguuugauggaugguugaccugugaucuagucugacaauucgaggaucccaaucccagcaaaggaugcuggagcuuaggccaggccuggaggacuguguccagcuccaaaauccuugcaaagcugggugugcuucaggcagugcuauuuuuuuuuuuuuuuaacuuuagguauuggggaguguagauaggguauccugcgcuuaggcaagcgcuuucaucgaguuauuuuaagauagagccugaaaguaauugucacgcagacccuccugccccagaucucaagccuguacauuagcccgucaugaaccugaauuucgaggcacgguugggaucguuuccguggcacggagacgcacuguccucaagcugauguucccagccagacacuagccgggcaaauagggguccagguggccgcucgguugcaagcgccgauuggucaggccagccaggccccgcccccgaagcgcggcggccaaugagcgcgcagaggacuggcgggcgagcucgcgggcggcagcggaguuuuuccgacgccgcggccugugcagcugagucuggaacgacgugcgacgcgcggcucuccucagagccaugucuaggcgggaacccgcagccaacgcuuccuccucgggcguugcuccccggcgaagcucgaccgggucccggggcgccgaccggacagcgacggaggagacgaaccggagaggccgggucgguagcaggggugcgggcggcggcuggagagagcccgccggggccgccgaggcuacggccgccggccgccgcgaaccgccgcucugcuucggggugaagaacgauguggugggcgcggugauaggugagcgccggcggcgcccaggcucgcugcaug

SEQ ID NO: 5212 - RNA, 51561 nt, Mus musculus
gccagcacggcgaagggcuguccugccgagagcuagguuggccaagcaacgacgccggcacaucugcucuccaggcguuaugaggccccugcuucgggguccggcgggaaacgacgaugaggagagcucggacagcaccccgcuccugccgggcgcccggcagaccgaagcgggugagcugcgggaccaccgagugauugcuaguggcagcguuccuggcgggcgggugguucccggccgugggcgccuugaaggaguggcugcggggucggggggacagguagccgcuguagugcugugggucgggacggaggugccuguggcgcuggcgggacugaagcaauucagggucggagggguacccgauccgagucaauaagcaaaggggccaaagugcuucuugcuccccuccagcggccgccagguuuccgcuuaugccggccuguaaacaugugaucugguagcgccuuguuggggaggagagacaaaaacaaaacaacaacaaagaagaguuaacagcuguugagugugcgggggacaguugcauaaucccgcgaauaucuugugcuguaagacaccaaaauauugcagacauuucuauuuuuuccuugucuaucagacugcaauuuaaguuaggaaacagguuauucucaagauaagauaucuuuagcacucuaagacaauaugccguacuagaggucuugcaggugcuacuucaaaaagcaucuucauugcggggggggggggggggggcgcauguugcacagagguauaguccuugccugacaagguucuagucuccauacccaccaucccccaaaacacaaguaugugucuucacuggauuucgcuacacuuuuguaauguagcuuccugaagcuacagaaaacuaaaggacaaaucggcuuggacacauucaaggauauaggugugagaaagaauugaacuggaaauuugccuuuguuggcccggaacagucuucugucgguaugucuuuuguugacauuaccaaagaauucuuucguaacuguuuuaaccauccuucccacuuguguggguaacuacccuacuuucugacuuuauucagacuacuucuguuggcuuuugggugaucuguuuugguuuuguuuuuauuuuuagaauaguuuguuagggaacuggaaagauggcucagcaguuagagcacugguugcucuuccaggggacgaggguucaguucccagcacccacauggaagcuuacaaccauccauaacuccagcucaagagagccaacacccucccuacucagacacaccugugguacacagacauacauacaggcaaacauucguacauagaacagauuuuuuuuuuaaaaucuaaaauagaauguuuuauuuugaaaaguguaaggcaucaguaggucaaaccuaggacuugcauuuuuuugguugguugcuugguuuucuuugagacagggucucauguagccccagcuggccucuauuuuguagcugcaggugacuuaguucuccugaccuuccugccuccaccuccugaaugcgugguaagcaagcauucuguccacugauucacaccuccugcccccuuggcuucccucuuggguuagaaucgaaguuugacacuuugccacugcucuggauucccugucccuguccuccgucaucacauccuccuuggugccacagacacguggcaccggaaguugcacgcaaggccgauugcuccgccaguuugguagggauaucuaccuucccggccguccugucuguuccacuaggagccucgugccccacaaagcuuaauuucccacaaaugagaaauacacuucuuaacacgugagcucgaucuccaggauccagagaaggcagugauagcaauucaguuccugaaguuucugugugcugaguaguguucuguguacuuugcgguucaucuucaucguucuguaacaggagcucaauacaguaagcgcucgacgguaaugugaacuauuuguuaguaaaccagcucgggggaaggaagguccuauguucucccugugccucucucacaucccuacuucugcaggcccugguccugcuuuugcuagaauggcugugcucacacccaccccacccccgcagcuaccuggcaacuucugcccguugaggaagccucuguuaaauaucccucuuccaaaaaagaccuuuccuggcucgucucccgagauucucaggccuccuuucucccuuacauagguacguagcacuuuauuugauuagaaaugcuuucucagagccagccaaugauggcacucgccucucaucccagaacuuggaaagcagaggcaggcggauugcugaguucaggaccagccuggccuagagcaagaguuccaggauagacaaggcuacacagagagacccugucuugaacccccucccccaagcaaacaaacaaacaaacaaacagaaagugcuuucucagguauggagauggggacuaugugaauggacacugugagucccugugguuuuuaauccccacagcucggcugauauggauagucucagggaagccugcaauguuaaacaggcaggguugucucgacaacagaagauguguauaaccuguuuuccacccagaagguugggagugggugugguuaauagucuagugaccugugcuaucuguagggccaggccacaccugacucccccagacuuuuguuuauuccagacucuuccucuccagagcuuuaucucggacauuguuucucaaucgauaagaauucaucuuuauggaagagaucacauguacuuuguaaugccauaagcuucgucaugcacacgggauugaguuaauugucgccaggaaaccuuuuuccaaaauuguacuguacuuaaaugugccuaaagcaaacgguccuuccgggcgggguuugaaccaacaccagcugcugaacugcgugcauuaagccagauuuccuucuugccucacuuguaucaacacucugcgggcuguguuguuggcagagaaccccacaaucaacgcucaauaugaggggcucaaccaucagagaugguaagaaauuuuuccuuuaaauagaagcagaaggcaagaauucagucgucuugcccaaggagucaggaucuuaagugggagagugcaaaggaucauggguucuaaagaguccucugugacagagaacuuuguacaauuauugaaacauuugcuaagacccagaggaggggauggagucccacaaccacucaggcaucccagccgggaagucacccaucucugugcauuuggggcucauucuccugaaccgccugacuggaacucaaagcccucaauccacaggcuccuccugcugccuggaucugggagcucagagcugcuuaguguaacaccagaguuccaaggaaaggcagacaggacuccgcugaggccauaugagcuaggucuaggcacccccaaguuuagcguguuuggaauuuuguuugcuuuagggucucacuaugaagcccuggcuauucuagaauucauucuguagaccaggguggcauugaccucagcuccuccugccucugccuccugggugcugggauuaaagcugucgucaccaccugccaccauauggcuuuugauaaggacaaggagcauauguuuuauauacagauuccacaugcuccacaaaaaaugauuguuacccaucccugguuguacagcucaguggucugaccuugccaaucagccagguuuuauuagguguuucuaagccauugaacauuuuuaacugaccuauuauauaaguuagcacaugauggacagaaaugcaccgugaguagaaauccgccuacuugaaaagaaauguugcagaaggauugugaauguacggggaguguaagggaaagauggaaaccuuuggaauggggcccuccaagguggagucucagagagugggaacagaugggacaagagcaacucggggacagaaauggaagagagagacagaaaugcaaaaagguuccgugggcuccuucagcuaaguucccuuccuuugaaaauaaaacauaaauaaaaaaagaaaaaucaauucuuuugaaacacaacagugauacugaacugcuggcaccucugucucuagagaaaacaagcagccaggggcacccauggcuguugcugcuagcaggguugauguggugugugccugugacugagacuacaggcgcagacucugcugauucccagacacagcgagaagccauccagugacucagcgcaucagcaaaauaagaaauucaaucaauggagacuuucucuuucuuucuuuuuucucuauguagccuuggcuguccuggaacucaaucuguagaccaggcuggcuuugaacucagagaguugccugcccaugacuccccaagugcugggacuaggaucucgaaccacuacgaacccggcucaaaauguucaacacauuguggugugguuuuguuuaguugguugcuugcuuuuugcuuaagauguauauauuuuuauguacaaugguguuuugccuguauguaugucugugauccuuuggaacguaugccagcuucccuagaacugaacagacagcuguaagcugcugugugggugcugcgacccggguccucuggaagagcagcuaaugcucuuaauagcugagccaucucuccugcccuggguacauagccauggcugucccugaacucagagauccuccugucucugucucccaagugcugggauuaaaggcgugcgccaccacgcccggcuuuuuuuuuuuuuaauuuguauuuuuguacauuacaaaaauuucuaaaauaacuauguaaauaggcuugggauggauuuaagaaggaaaauaguacauuggaauaaaguuuuuaaaaauauccuauauaauacaguggccaagaaaugcaaacauaauuacauguuucucaaaccuacauguuucucaaaccuccguggaggccagaagggauuaaaccaaaaguccaaucaauagcaaugaauaaaaguuggauuauuuugaauuuuucaccuaaaacuauuuuugguacagccugagaacuccauuacaucauacugucuauaaaauguaauagaaacuaaagccugccaucaaguucuuccuccaugagacuguugcgcuuggguaggguucacaguuguauuucguucacagugucaguuguacuaaucucugcuuuccuugccuaggaaaacccaauggcuuucuuccucagaauuuccugugauuaguucccaggugcugcugaaaacccuguuaccuagcaggagagucuuaagcucaaaauuaaaauggacuuaaauuuuaaagauccucuuuagcuggaacauuugccuuugaucccagcacucagucaaaucucugaauucaaggccagucuggucugcgaaugaguuccaggauagcuagagcuacacagagaaaccccgccucagagaaugaaugaaugaaugaauuccaaaucuuaaauuuagcuuuaaaucuuuaaaacauaaaauccauuguuaauuaaguggauuuuguuuguuuuuuaguuuuaugcuugcccuuggucuaauaaguggucagacccuggcaagggaguuagcagaggcucacaagagccuauccucuacagaagccacuguuuugcacaguauugcgaguuucuggugcauaauuaguagugagugucuaucagcuuggcauuugaagcuacagcugucugucugggacccucccugcugucagguguguagagaacuaugcuggaauguacuucgggcguacacaguacacaccaggcaugcauugggcuccuccucauguuguccuaugaucucugggaugcuguccuguucauaugcaucaaagugagagccaucugggacuuuguucauuuucuggaaagacauaaacauaaccugugaccucaucagucacagaaugcagcccguggugagacacaggaagcuaggagcugcaaggagagucucuaagccacauguggacuacucuuuuguuuguuuauuuuuuuauuguuguuacuuuuugguuuuuugugggcuuuuguuuuuguguuugcuugcuugcuugcuugcuuguuuuugaggcaggguuucucuguguagccuugacugaccuguaaauaacucuguauaccagguugaacucaaacucagagaucugccugccucugccucccgagugaugggauuaaaggugugugcugccaccacccagcaucaauuaacuacacauguucuuucuaggacucauuacaacuaagaaaugauaauggucaugcuuacauuagcaaacauuuuaaagaauuuuacaguuucuguaauauuaaucauguuacuaaaacccuuacaauccacaggguuaagcuguggaauggcuccauuaaauucuuaauuggcaaaaauuagaaauaaaaggggcacacacacccaauucccauagacugugcuacagcuaacuaugcugacaucacuuuagaggauaaugcuuguucuacugcccaaaaauauuuugcccuaaaagaagacacagccuaaaguaagugugugugugugugugugugugugugugugugugugugugugugcacaugugcaaauaguucuagaaacuaaucaauaguaagggcccaauguuguucuaacaucggguucggauccagggucccagauggcucccacuuuggugcauaugaacaagacagcaucccggagaccauaggacaaaugaaucaucuaaagauagguaacaaaccuaucaagacgaggaguaagccaaaagcuugggaaaacaucaagauguuagcucaucaagucuagacuggggaaacgacaaggauccaguacaaccaaccccaaaacgccgcugccuacaugcccauucucccgugcuagugcagcauccaaaugccuuuuggucacgggauaaaagacacaccugcauuaggagacagugugauguuacgcggucaugcuaaaaacugguuuuaggcuuuuuuauugccagucccaggaauaguuacugauacacaaagagaggucucaaagauggucugugugauuagcaaaacuacuaauauuacagcaaaaaauccuagcaaaaaugaaucaaggccgggcguggugacgcacgccuuuaaucccagcacuugggaggcagaggcaggcggauuucugaguucgaggccagccuggucuacaaagugaguuccaggacagccagggcuauacagagaaacccuaucucgaaaaaccaaaaaaaaaaaaagaaucaagagaugggugguuugaggagcacaguuuuacaaaauagagcuacuauaaaugauauguugcucaaacauaagcuugguuaccaacagcuuccugguaugcguugcuuuaaugugucauauuuuucucauaguauugauggucauauuaaugacuuacauaaagagaugcaugagcgaaaucucucaagugacuuuugaaugguuaccaugguuaaggaggccuucucauuugguucuccguucacuagucuugaaguccucuuaugcuugccuauauuaauuagacuagccacggagccaauguauucagccacggccccuguuacagccacuguuuuuuccuuaaaauauuagaaaugggaagauguagagagaacaaggcccuugugcucagagacaagcacgagggaaaccaggaauguuaaacacacgcaggguugucucuucagcggaagggguguauaccuguuuuccacccagaaggcugggagugggugugguuaauagccuggugaccugugcugucuguagggccaggccacaccugacucccaagacuuguuuauuccagacucuuccucuccagaccuuuaucaugggcauuguuucucugucaauagcaacugugcucaugggagcugucauauguacuuuauaaauggagcaaaacacacagagagagagagagagagagagcucacauuuuagaacugaaaaccuugaggaugaaaagauuguuaucuucauuuauuucaucuaagucacucuaaacacagaugcccagagcuaagagugggcccugggccucgcucccucucuacacguuuguuugcugucacacccacucuacauuccuguguggauaaagcacauuucagaggcuggcgcuuguuuugaugagugcuuuguuccgucacgcaagcuugaucuugcuuugaacucagugugguggguauccagugggccggcucucugccaugcaaacuuguuuuaccucggaucacuuucaaagaguauucuaauuaauucauaggcacauuuucuuuccuuccuaaaaguauuucuggcuaaauggguuuacagucacaaccauuuucauaaaccuggcaucgauuuauuuuuccuguaucuuuuaaaacuuuguagucuuguauuuucugauuauugauaguaccuuagaaagguaaguugccugaccgauauuuuuuaaaugauugucauuaauauuuugaaacacuuugcucaccuuuacauuuuuuuaauuauuuguuuuuguguguaugaguuuugccuguguguaugucuguucucugagugcauacagugaccauggacgggagaagaaggcaguggguucuccagaacuggaguuucagacuguuaugagccacacucuguggacacugcucagcuaaccccguccaguuucagacuguuaagggcagucagugcucuuauccacugagccaucccuacagccccuugcucaccuuuuaaaaacccuuuauuuauuuaguguuggggaugggagucagaggacaacuuucagaagucaguuccccucaucaugcugcucucagugacugucaagcaagcaccuugccacugagucaucuugccugcgcuuucuccaccuuccuuccucagccuccagacccacaucuagcucacaugauaaaggacuuauaaagccacagcaaccagggcgugaggagaaacgaacaacgugcaauaaaaggggaacuauaaaaaaaauauugcgaugggaaaauacgauaaaguagccaggcagugguggcuacuuuaaucucagcacucggaaggcagaggcagguggaucugaguucaaggccagccuggucuacagagugaguuccaggacagccagggcuacacagagaaacccugucuugaaaaaccaaacaaaugaacaaacaaaucuuuuuuuuuaaaauuccucucaugauuuagagaucauauaauuuaaaguuuucucuccaucuuaauuucagcuccagugugcugcucugcucgguacaacuuagcgauuuuggcguucugugguuucuucguucucuaugccuuacgggugaaccugaguguugcguuaguggacaugguagauucaaauacaacucugacugauaauagaacgucuaaggagugugcggaacauucugcccccauaaaaguucaccacaaucacacaguaagugcuguuuuuaaacaaaaaugggauauacuuaaaaacugaaauacuuaaaaauaaugacaaauaucugccuuuaucagaaagauaccaaaauauuggaguuuuugguuugguuugguuugguuugguuugguuugguuugguagucuucccaggucaggaucuuuuucugucuucuugggaguuaauugaacaauuaacuuaauuauaacucaugcccccacaucucuugaucuguuuggaaaguaauguuucagguuccugaggagaacuugaagacauuucauugguacaucacaagauuugguuguuuuaaauuauuuuggcuaucccagaacucacuauguagaccagacauaccacggagaaaagucugucccugccuccccgagugcuugcauuaaaggcaugcgcgccaccacaguccagcccaagccuguggcucuauuuugaaccuucagagucaagguuguuccaccuccacaguuccucccauagaacagcauccuagacuggcacacuugcugaauuuuauggcuuucgguucuuuauccacucgcuucuggaagcuacgugugguggcgacucuccuaccuucuagcaagcuugucucaggucuuugugaugaagcaccagaaccgaaaacaacuugggaggaaagauuguacugucucuugcugcuuacagugccucaugaagggacaucagugcaggaagcuggaggcaggagcugaggcagagaccgcggaggagcacagcuugcuggacucuaucccguaaccugugcagcuugcuuuucauaacccagggccaucuuuccacaguagccuaggcccucccacauccaucaucaaucaagaaaaugccaugcagacuggccugugagcccaucugaugguggcguuuccuucauugacguucccucuucccagaugacuguagccuaggucaaguuggggggcgcaaccagcacaguuugcgugcuuugcaguccaaaucagcaauucaaaacuuuaaagucaggugcuggagagauggcucagcauuaagagcacugacuguucuucuggagguccugaguucaaaucccagcagccacaugguggcucacaaccaucuguaaugagaucugaugcccucuucuggugugucugaagauagcuacaguguacuuacauacauuaaauaaauaaauaaaucuuuaaaaacuuuaaagucaaaggauucuuucuacugcuuuacaggguaaaaaguacaagugggaugcagaaacucaaggguggauucucggcucuuuuuuuuacggcuacaucgucacccagauucccgguggguacauugccagcagggucggagggaagcugcugcugggccugggcaucuuaggcaccuccgucuucacccuguucacaccgcuggccgcagacuuaggcguggugacucucguugugcuuagagcgcuggaaggacugggagagguaaaacuuugcguucuuguuuuacuucuuuuuuuuuuuaagauuuauuuauguuaugugaagcuaccuucagacaaaccagaaaagggcaccagaucccauuacaggugguugugagccaccuugugguuggugggauuugaacucaggaccuuuggaagagcagccagugcucuuaaccacugaaccaucucuccaguccuuacuucuuauucuuuaucucaucuucccuccuguucuaaguguucuuuuaaaaauuuauuuuuauuugauauguauguacguguauacacacacacacacaugcguacgcauguaugaugugagugcaguuuccuacacaagccagaagagggcgucagaucucccagaacuggguuaacaaugguuaugagcauccaagugaguguuagaaagcaaaccuguguccuuaaccacugagccaucuucuccagcccagaaaacaucuucuaacggagacaguaccucaugcuucagaagacaagagaaauaacccucugucacaguggcuaagauggcccauacuuaccauacauacauacauuuuggcuugugagccgucaccauauggaugcuggaacugaauccaaguccuggaagaguagccagugucuuaacuucugagccaucucuccagcugcucuguuggcacauuuugcaaaacauguuaaauugccuuauuuuacuaaguuuguuauuauguauggaacuuccucuuuaucauuaguucauaguuuucuagucuucuaaccuagaauuuaugauucuaucuaacuauaacauaugauuuuaucuaacuauaccaacuuacuucuagauuuuuuuuuuaauguugauggaaauaagucaaugaaaaaccaacuugcagaguuccgaguucuuuuacuuuuuacuuauuuuuuuuauuuuuauuuuauggacauuggugauuugacugcauauauaucugugugagggcaucagauuaccugaaacgggaguuacagacaguugugagcugccaugugggugcugagaauuguaccuaggcccucuagaagagcagccagugcucuuaaccgccgagccaucucuccaggccccuagaauucuucuaagcuuuuauaccaugagaaauauuacuauuucuuuuuaugcccuucaucauuuuuucucuuacuuaauuuuguuucugugcugggaaucaaacccagggcccugcacacacugcaaauguucucuaagacuaacccacagccuauuuagaaaucacuucauuuuucucuuuuuuuuuccucuucaugccucuucuguaucucuccaucauaaaugaauggaugauggucuuagugaauggucuccaggcuagagugauggaugcucagugauuaagagccuucaacucgagcacacgguagccacugggucuggcccagcuuauggagcucugguagguagcgucauacaguagugcacuggaaagaacacuggcgugaagacauuagcuucugaccagcagugccacugucacagaaaagcauuagguaaacccugacagcucggccucgguuucuugguuuuaauaacugagacuuaaguaccugugcgcccuuagucacaggaaucguacacuuuauauguggugagauuugcuagaaggcuugagagauuccaagacuuuauuuuauuuuauuuuauuucauuucauuucauuucauuuuaugagacaagaucucucuguguagcccuggcuguccuggaacucacucuguagaccaggcugaccucgaacucaaagauccaccugccucccaagugcugggauuaaaggcgugcaccaccaccuuccaacuuaaaguuuuguuaguaguuuguguguucuuauuccauccauauccaaggaguaguccucacagaagucuauuaaauaauuccuuccagguuauaaaauaaguacuaugggccccucuguccccaauucuucauuuucuucuuaccuaaauacaguauauugauuuguuguuguuauuguaucccuuugcugagcuauucucaugggguaguccuugucuguagauguuuaacguuguagucuguuguuccuacugcugucacagagggccacugcacuuuuuaauagaauuuaaauuguguuuauacuuagucucucaucuuccaccauguuuucugugcauaccacacaccccguccauaaaaauaggucagcaacuuuuaucuuuucugucugauuuugaagcugccuuguauuucaucagaaauauccacccccaggguguuacguuuccagcuaugcacgccauguggucuuccugggcucccccucuggaaagaagcaagcuucuuaccauuuccuaugcggguaagauaacgauccuuauaaaacuuugguauaauucaauacaugugccccagccuugggaagcaugccugagugccagagucacacgggguagauagugugggugccucuuccugggagaaagaaucuuuuaaggggguaucuuuaccaucacuuuuccucuuuggcuccaaaacagaaucaugugcagugauuggugaaugcuguuuucucuugcugcugucauuuaucucaaaauaugcugucuuuucaaaugucacuauuuauaaaauaguucaguagcuggaaaaaaaugauugguuuuguuuuuuuugugauuuguuguuguuugguugguugguuugguuuuuuguuguuguuguuggccuuuguggaacuugcuauguaaaccaagcuacccuugaucucagaggaaucugccugauucugucucccaaguccugggacuaaaggcauguacccccaugcccagcagaguuuauuuuauuaauuuuggguaugugcguguguuuguguaugugugugugcaugagucacaagcaguuuugagcugccugauguagacacuaggaguucaacaguaugugaucuuaagugugugugugugugugugugugugugugugugugugugugugucugagugugugugcuguugcaugcauggagacaccccuagaggacagacgagaaugugggaucuccuggggcuaaucuacaaguggaugugagccaucugacguggaggcggaagggguugggacuuggcucaagacaccugagaucacguucuuagcacgaaggagauuuauuuacccuagaggggagggaauaagagacaaagacaggagauagaggaugagggagaaagggaaaggaacaggaggaugaagggauauuuguccuggagaacaaagcacugccccuagauagagaggagacagagguggcacauuaggcaaauggugguuuauaaagguacagaggaaccccgaguuaggaugaggucuuuugguuuggcuggacagguuaaaguggccaaagggagcuuuugauggcugaacuucaauaguuugauagcuagaacuuggcagucggccucaggaggaggaaguggccaaagaagggaacggaccuugguggguaccuuuaggaauaaucuaacaggguuuagcaaggcagagggaaugggggaaggacccagaacuguguuugccaugcucaggugcugagaagcaaaucugggccuccgcaagagcgacagcaagugcucuuaagugccgagccaucucuccagccccuuuaaucgugauuucuagcuugacugugcaauagacacauuauuacuuucagcucuucccuccgugagucucuguccugugcauuuguucucauuuagaacugcaagggagauaacaugagcuuuuuguguaaauuauaauuuuacuagauuguguaagaaauacuugcuugauuuccauugacugagugggaaauuuuccaccugacuaaucuuaaauacagugguuauuuuuuuuuuucaagacaguguuucucuuuguagcccugucuguccugggacacucuauagaccaggguggccucaaacucagagauccaccugccucugccucucugccucugccucccaagugcugggauuaaaggcgugcaccaccaccgccugguacaguguuuaaaaagaaauuucucugaggugauuuuuuaagccagaaucagaaggguaacuagccguggaguggggguguaacuccacugggugaccacuugccagacgugaggcccuggguucgaucccaggcacagcacaaaccaggcaucagugaugcacgcacgccugugagcccagcccuugggaggccaaggcaagaggauguguaauuggcuuagcagcagcuacauagugaguuugagggcaaagguuacaagaucuuagaggguccccauuacaguucccguuaguggcugcugggaauugaacucagaaccucuggaagagucagugcucuuaaucccugagccaucucuccagcccagguuacagguucuuaaccaagugagagacauuccguuuauaaucuaaaggccucucuuuucuggcaguacugagagugacgcgaaaagucugacaggaaacucaagacuaggugcugcucacagggcugccucucccgggucggaugcuggcgcucuugacagcccugcuccaucucggcccuggcacacagcgccuuccauacuucucaggcuuuaucucugguccuuccuuuuaccucagugaagcucccggacccauuguccgcuuuccuguuuucagcccuugguccuuccucucacugcuuccugcucuggcuuuguuuggcuuuguuuuugcacuugguuuuugguugguugguuguuguuguuguuguuguuguuguuguuguuguuguuguuguugcuguuguuguuguuguuguugagacaccacugccccugauuccugggugcugggaaugaugauauccaaccccucacccagcuacccuacuuccucauugucuuucuuucuuagccacugagacugaauccugaccaucuuuucaaaauccauacaucuugccuuugcuuggggaggucagaaguaacucucauauuugagcucuggguggaucugugguucuuccuaauuuggaauagccauugguuuacaucugucuccugcguaugacacgggaucagaaauagugucuaagccagguuacgguaaugugaaucuguaauuccaguacuucagaacuggaggcaggaagauuaggaguucaaggucauccuuagcuacauauggagaucagggcuacccuaggucaugagacccaucuuaaaaaguaaauacuaucuagccaagcaggguagucugagccuguaaucccagcaccuggaaaacagauucuguaaaucugaggaaagccugagcuacauagugaguucaggaccaccggggcuacaggguauaauccugucccgacuaaaaagagaaaaaauauauauacagaguaucauuuagcucucacucauuuaauuaaaaugucuuacaugguuaaaauguauuguuuuauuuauaaaacaauuguuuauaauauauaaaauuaugaaaagccucauucuuauuucaacaagcaugcccauacccgcuggccuccugcaucagccucucuagugcugggauuccagcaugcaccacauacuuggcucucauaccaaguggcaucuuauauuccucaguaucugcauaguuguaacuguguauguguauguauauguauauguauauguauaugauguauauguuuuacauugucuagaacaugauccuauaggcgugcuggacugucuauucacauguagcugcuucugauuucauagcuccuucuggucuguguccaccguuuccguccuccuuaaaugguagcccuccccaccccaccccaccccggguucaccuuuccccaaggcugacagagucuucuguguugaucuaggagcacagcuugggacagugaucucacuuccucuuuccggaauaauaugcuacuauaugaacuggacuuacgucuucuaucuuuuugguaaguaaauaaaucuucaaaucauaacauaaauuuaaaauguaacaguaguugguugcauuuaaaugugauucugucucccagcuuccuaacuaaaagaauuucauaacugagcaugggggggggggggguuguaaaacuuuaguaaaagguuucugaacacacacugacuaaacaguaauucagagucaagcacguaaggagucugugguccucuggcagcgccagcccagggugugacaugugacuucgcugcagccugggugcugacugcaugcacuuugaauucacaugcugccacagaagcccaaaacacaucaggucagagucaagagcaucgugugcuauaaacugaaauguguucaccauacgugcaaaguguucugcuguucuagaaacagaaucguuuuacuauagaaagcgaaagacaguauccccuacugucauucuucagcuugucaacaucaaauuaguguaucuuuggguuggaucggagugugugacuuuaaaacuuaguguuugagcugggcggugguggugcacgccuuuaaucccggcacuggggugguagagacagauggaucucugaguuugaggacagccuggucuacacuuucaggacagccacaacuacccagagaaacccuaucucggaaaaaagaauuuacugauugaauuacuagguugggauucauaagaaagaaucuuucgcugaguuuuuggcucaggcugaaaggagaauuuccgagaauugaaaugacccuaaacacguucugccguuuuguaccacccaugcauacaaagugcuguucucagaacaaaccgucacaagacgaaagucaacccugaaaaggcuugagaaugcucugcgcauugcaagugggaagcagucaugcgguauuuaaaguucuauguaagaacaaacacaucugucucaguaugcagaucggguucuggcucucauaaguaggcaaauccuuguauauaugaauaacaaagaacuuaaaauaaguuucuuccauuuguugcuaguaaauauuugauuguccuuaugauuuuauguaccuauauacacagaguuguguaaaaauuucucgauagaaaaggcuuaagaaaaacuucaaaucucugaagaaagaaauuaaagaagaucucagaagauggaaagaucucccaugcucauggauuggcaggaucaacauuguaaaaauggcuaucuugccaaaagcaaucuacagauucaaugcaauccccaucaaaauuccaacucaauucuucaacgaauuagaaggagcaauuugcaaauucaucuggaauaacaaaaaaccuaggauagcaaaaagucuucucaaggauaaaagaacuucugguggaaucacuaugccggaccuaaagcuuuacuacagagcaauugugauaaaaacugcaugguacugguauagagacagacaaguagaccaauggaauagaauugaagauccagaaaugaacccacacaccuauggucacuugaucuucgacaagggagcuaaaaccauccaguggaagaaagacagcauuuucaacaauuggugcuggcacaacugguuguuaucauguagaagaaugcgaaucgauccauacuuaucuccuuguacuaaagucaaaucuaaguggaucaaggaacuucacauaaaaccagagacacugaaacuuauagaggagaaaguggggaaaagccuugaagauaugggcacaggggaaaaauuccugaacagaacagcaauggcuugugcuguaagaucgagaauugacaaauggggccuaaugaaacuccaaaguuucugcaaggcaaaagacaccgucaauaagacaaaaagaccaccaacagauugggaaaggaucuuuaccuauccuaaaucagauaggggacuaauauccaacauauauaaagaacucaagaagguggacuucagaaaaucaaauaaccccauuaaaaaauggggcucagaacugaacaaagaauucucaccugaggaauaccgaauggcagagaagcaccugaaaaaauguucaacauccuuaaucaucagggaaauucaaaucaaaacaacccugagauuccaccucacaccagucagaauggcuaagaucaaaaauucaggugacagcagaugcuggcguggauguggagaaagaggaacacuccuccauuguuggugggauugcaggcuuguacaaccacucuggaaaucagucuggcgguuccucaggaaauuggacauaguacuaccggaggauccagcaauaccucuccugggcauauauccagaagaugccccaacugguaagaaggacacaugcuccacuauguucauagcaaccuuauuuauaauagccagaagcuggaaagaacccagaugccccucaacagaggaauggauacagaaaaugugguacaucuacacaauggaguacuacucagcuauuaaaaagaaugaauugggcuggugagauggcucaguggguuagagcacccgacugcucuuccgaaggugcagaguucaaaucccagcaaccacaugguggcucacaaccauccguaacaagaucugacccccucuucuggagugucugaagacagcuacaauguacuuacauauaauaaauaaauaaauaaaucuuaaaaaaaaaagaaugaauuuaugaaauuccuagccaaauggauggaccuggagggcaucauccugagugagguaacacauucacaaagaaacucacacaauauguacucacugauaaguggauauuagccccaaaccuaggauacccaagauauaagauacaauuuccuaaacacaugaaacuaaugaagacugaaguguggacacuaugccccuccuuagaauugggaacaaaacacccauggaaggaguuacaaagacaaaguuuggagcugagaugaaaggauggaccauguagagacugccauauccagggauccaccccauaaucagcauccaaacgcugacaccauuguguugggagccgcgcccacauucgccguuacaagauggcgcugacagcuguguucuaagugguaaacaaauaaucugcgcaugugccgagggugguucuucacuccaugugcucugccuuccucgugacgucaacucggccgaugggcugcagccaaucagggagugacacguccuaggcgaaggagaauucuccuuaauagggacgggguuucguuuucucucucucuugcuucuugcacucuggcuccugaagauguaagcaauaaagcuuugccgcagaagauucuggucuguugcgucuuuccuggccggucgugagaacgcgucuaauaacaauuggugccgaauuccgggacgagaaaaaacucgggacuggcgcaaggaagaucccucauuccagaaccagaacugcgggucgcgguaauaaagguucccguaaagcagacuguuaagaaggauucaacuguaugaauucagaacuuuucagcuggggaacgagaguaccagugaguacagcuuuacgagguaagccuggucuugaacuuucuaaggaaauucaagacagucuaucagaaguaaaguggaaaauguuuggccuuggauuuuuucuaguguuagaagcccuuuuguuccuuuucacauguuaucaagugguuaaggcagggcggauucuagaugaaauucaggacaagcuaucagaaguaaagcggggagagagaguaggaacaaagaggaaauaugguacacaaaauaaguauacaggccuuuccaagggucuugaacccgaggaaaaguuaagguuagguaggaauaccuggagagagauuagaagaaaaagaggaaaaagggaaaagaagaaagaucaauuagcggaggucucuaggaaaaggagccugugcucaucgcuggaugggcucggggagccagcucuuaguagcucugaagcagaugaagaauucuccucugaagaaacagacugggaggaagaagcagcucauuaugagaaaaaaggguaccagccagguaaagugcuagcuaaucaguuaaggaagccaaaagcggcuggcgaaggccaguuugcugauuggccucagggcagucggcuucaagguccgcccuaugcggaguccccgcccugcguagugcgucagcccugcgcagagaggcagugcgcagacucauucauucccagagaggaacaaaggaaaauacaacaggcauuuccggucuuugaaggagccgagggugggcguguccacgcuccgguagaauacuuacaaauuaaagaaauugccgagucgguccguaaauacggaaccaaugcuaauuuuaccuuggugcaguuagacaggcuugccggcauggcacuaacuccugccgacuggcaaacgguuguaaaagccgcucucccuaguaugggcaaauauauggaauggagagcgcuuuggcacgaagcugcacaagcgcaggcccgagcaaacgcagcugcuuugacuccagagcagagagauuggacuuuugacuuguuaacgggucagggagcuuauucugcugaucaaacaaacuaccauuggggagcuuaugcccagauuucuuccacggcuauuagggccuggaaggcgcucucucgagcaggugaaaccacuggucaauuaacaaagauaauccagggaccucaggaauccuucucagauuuuguggccagaaugacagaggcagcagagcguauuuuuggagagucagagcaagcugcgccucugauagaacagcuaaucuaugagcaagccacaaaggagugccgagcggccauagccccaagaaagaacaaaggcuuacaagacuggcucagggucugucgagagcuugggggaccucucaccaaugcaggcuuagcggccgccauccuccaaucucagaaccgcuccaugggcagaaauaaucagaggacauguuuuaacugcggaaagccugggcauuuuaagaaagauugcagagcuccagauaaacagggagggacucucacucuuugcucuaaguguggcaaggguuaucauagagcugaccagugucgcucugugagggauauaaagggcagaguccuucccccaccugauagucaaucagcuuaugugccaaaaaacgggucaucgggcccucggucccagggcccucaaagauaugggaaccgguuugucaggacccaggaagcagucagagaggcgacccaggaagacccacaaggguggaccugcgugccgccuccgacuuccuauuaaugccucaaaugaguauucagccggugccaguggagccuauaccauccuugcccccgggaaccaugggccuuauucucggccgggguucacucaccuugcagggcuuaguaguccacccuggaguuauggauugucaacauuccccugaaauacagguccugugcucaagcccuaaaggcguuuuuucuauuaguaaaggagauaggauagcucagcugcugcuccucccugauaauaccagggaaaaaucugcaggaccugagauaaagaaaaugggcuccucaggaaaugauucugccuauuugguuguaucuuuaaaugauagaccuaagcuccgccuuaagaucaacggaaaagaguuugaaggcauccuugauaccggagcagauaaaaguauaauuucuacacauugguggcccaaagcauggcccaccacagagucaucucauucauuacagggccuaggauaucaaucaugucccacuauaagcuccauugccuugacgugggaauccucugaaggacagcaagggaaauucauaccuuaugugcucccacucccgguuaaccucuggggaagggauauuaugcagcauuugggccuuauuuuguccaaugaaaacgccccauugggaggguauucaacuaaagcaaaaaauaucauggcaaagauggguuauaaagaaggaaaaggguuaggacaucaagaacagggaaggauagagcccaucucaccuaauggaaaccaagacagacagggucuggguuuuccuuaguggccauuagggcagcacgacccauaccauggaaaacaggggacccaguguggguuccucaauggcaccuauccucugaaaaacuagaagcugugauucaacugguagaggaacaauuaaaacuaggccauauugagccaucuaccucaccuuggaauacuccaauuuuuguaauuaagaaaaagucaggaaaguggagacugcuccaugaccucagagccauuaaugagcaaaugaacuuauuuggcccaguacagaggggucucccuguacuuuccgccuuaccacguggcuggaauuuaauuauuauagauauuaaagauuguuucuuuucuauaccuuuguguccaagagauaggcccagauuugccuuuaccauccccucuauuaaucacauggaaccugauaagagguaucaauggaaggucuuaccacagggaauguccaauaguccuacuaugugucaacuuuauguacaagaagcucuuuugccaguuccucaugugggaauuaacccacgcgguauucgaccucuacaggucuggcaaauggauguuacacauguuucuuccuuuggucacccgaaaaauccagacugaccaagggaauacuaaugucccucgucuuggugauguccagggcgucaauaauaaaaagagagcagcguugggggauaaugucgacauuuccacucccaaugacggugauguauaaugcucaaguauucuccugcuuuuuuaccacuaacugggaacuggguuuggccuuaauucagacagccuuggcucugucuggacagguccagacgacugacaccauuaacacuuugucagccucagugacuacagucauagauaaacaggccucagcuaaugucaagauacagagaggucucaugcugguuaaucaacucauagaucuuguccagauacaacuagauguauuauggcaaauagcucagcugggguguaaacaaaaguuuccgggauuguguguuacuuccauucaguauguuaaauuuacuagggcagcuaauuugucaaaaagucuuuuucaguauauguuacagaauuggacggcugaauuugaacagauccuucgggaauugagacuucaggucaacuccacgcgcuuggaccugucccugaccaaaggauuacccaauuggaucuccucagcauuuucuuucuuuaaaaaaugggugggauuaauauuauuuggagauacacuuugcuguggauuaguguugcuucuuugauuggucuguaagcuuaaggcccaaacuaggagagacaaggugguuauugcccaggcgcuugcaggacuagaacauggagcucccccugauauaugguuaucuaugccuaggcaauaggucgcuggccacucagcucuuacaucucacgaggcuagacucauugcaugggauagagugagugugcuucagcagcccgagagaguugcacggcuaagcacugcaauggagaggcucugcggcauauaugagccuauucuagggagacaugucaucuuucaugaagguucaguguccuaguucccuucccccaggcaaaacgacacgggagcaggucaggguugcucuggguaaaagccugugagccuaagagcuaauccuguacauggcuccuuuaccuacacacuggggauuugaccucuaucuccacucucauuaauauggguggccuauuugcucuuauuaaaaggaaagggggagauguugggagccgcgcccacauucgccguuacaagauggcgcugacagcuguguucuaagugguaaacaaauaaucugcgcaugugccgagggugguucuucacuccaugugcucugccuuccucgugacgucaacucggccgaugggcugcagccaaucagggagugacacguccuaggcgaaggagaauucuccuuaauagggacgggguuucguuuucucucucucuugcuucuugcacucuggcuccugaagauguaagcaauaaagcuuugccgcagaagauucuggucuguugcgucuuuccuggccggucgugagaacgcgucuaauaacaccauugcauauacuagcaagauuuuaucgaaaggacccagauguagcugucucuugugagacuaugccggggccuagcaaacacagaaguggaugcucacagucagcuaauggauggaucacagggcucccaauggaggagcuagagaaaguagccaaggagcuaaagggaucugcaacccuauagguggaacaacauuaugaacuaaccaguaccccggagcucuugacucuagcugcauauguaucaaaagauggccuagucggccaucacuggaaagagagguccauuggacacacaaacuuuauauaccccaguacaggggaacgccagggccaaaaagggggagugggcggguaggggaguggggguggguggguaugggggacuuuugguauagcauuggaaauguaaaugagcuaaauaccuaauaaaaaauggaaaaaaaagaaaaaaaagaaaagaaaaggcuuaagaagcgcuacucuaggccaggcaauggugguacacuccuuuaaucucacugcuuaggaggcagaggcagauggaucucuaaguuugaggccagccugguuuacagaucaaguugcaggacaaccaaagguaaaaaaaggaagaaacaaaacaagcaaaaacaacagggaaaccaaaaaaagcccuaagcccuauucuaacucacugaaggaaacauuaucaaaucacaguacaguguucugaaacgcagaaaaccugcuucccagguuguuauggcuggcaggaucagcccagugugaccugcuggacuuucucuuaagcaaaauagggaguucucucuccccugaggagauuaaucuuuuuccuuucuuuuagugugaaggcauucauuucuuaaauugauugucaggaucauacauauucuuaauaaauuacauuacuacacagguauuuucuacagaaaauggaccuucaaaaugaaugaaacagauaucugguuggauggcuagauagauauagauauagauauagauauagauauagauauagauauagauauagauguguguguauguuauagaaauggguccuuuguuuugcuguuuuuguuugguuuguuuuaagacaggguuucucuccuuggcacuggcuguccuggaacuugcuccguagaccaggcuggccucagauucacaaagauacaccucugucuccugagugaugggauuaaaggagugugccaccaccucccagcuagaaauucauucuuaaauuuuucuuguccauaauagacaauccauuagaaacaaaaugaaaauuuaauauuuggaugucacagcaugggaagagauggaaauuaggacuaccuauuaauggucacagguuuucuuuucugguuaugaauauguucaagggauuaauuauauuaguacaaugaaauaaauauuuaaaauuuguacugaagccgggcgugguggcgcacgccuuuaaucccagcacucgggagacagaggcagguggauuucugaguucgaggccagcauggucuacaaagugaguuccaggacagccagggcuauagagaaacccugucucgaaaaaccaaaaaaaaagaagaaaaaaaaaaaagacagaaaaaaaauuuguacugagccaagauggccaugguggcacuugggagacugggaaacuaagggaggaagauuugaacagaacaaaaaucugcaggccauuauaaauccgucuaccugcagacucugaucagcugagucuuggauucauuucauuagagaguauuugaggcugugcauggucacacauaaugugauccuaacaguugaagcaggagaauuaccuagaguuuaguccgagcuucauguugaauaccuagccagccagagcgaccuagcaaagcccugucuggaaucugucccccaugugcauagagaguaauaguuacuguuccacuaaagagcugaagcuugaaauuaaaucuaauuuuacauuacauuuauagaucuguaaucuuuucaagauggguacaaaaugcuguugacacauucaaauuguauuuaacuguuaucuuucuauuuuaagguauaguuggaauugucugguuuauuuuauggauguggauagucagugauacaccagaaacucacaagacaaucucccauuaugaaaaagaauacauuguuucaucauuaaaaaaucagguaaggacucuagcacauuuuaaaaauugauauaauggcuggagagauggcucagcaguuaagaacacugacugcucuuccaaagguccugaguucaauucccagcaaccacaugguggcucacaaccaucuguaaugggacccaaugcccucuucugguguaucugaagagaguagcaguguacucauauaaauaaaauaaauaagucuuuaaaaaaaaaacugauauaacaguuuuugaaauagaucuuucuguuguucaugucuuaggcaguuaggaugagugaaggaaaugaggaucuacaguacugcugagggagugcaguucuuucugaacuaaacucuuuucuucucagggucauucugggaacuacggguguggcucagugagugggcaucagcacccaggaguccuugugaguagucaggcacuaacugaggacagccggacagagagggugccauuauuaacccccuugaauuggggaauucuaccgcaugugacaaacucauacucuagggccaacccauuuauuaaauaguaguaguuuaacgucuauuuuagaauuuaaaugaguauaaauagauauccucaugucuuuuuaaauuaagaauuauuuuuauauuucuaaauuauguauuuuugucuguguaucgcuaugugcaugagaauggaguugcccuccaaggccagaggugucagguccccaggaguuacagaaggauauaagccacccauuguggauucugggggccaaacucagguccucugcaagagaagugugcacugucaacagcuaaaccuuuucuccugccucgucauguggcuuucuuugacccagcacauuaucucagauaccucugcucugaaggccaugucaccaucacuggcugcauuuaagacccucagcugguuucacucucuguuccugcuucuuucccugagaugcugacaggcuagacucaaacucugagcucacaucacccuccagcugaaaccccgugguuaucugaggcuacauguguagagcaccacacccugcaugcacaguuccuauaaaccauuuuaauauaauggagacuggauaaugaaaaacagauccugauaaguccuuccaaucucuucacuuuuccuucaugucagccuccagcugugauaaugacaccguucuccauuuuaccgaagcacugauguaucagguagcucagacgcguguagcuuuggugacauugauaagucuacauacuuauguucacauguagcuuuggugacauugauaauucuacuguacguauguucuccucugaucagucaaagauuuuuuaguuaauauguuuaaugaaacaacuaaaacugguuaauuauuuugcuauuuagcauuucacagaguugauguucagaucuagaaugcacaacuggauuugguguugugugcucuagucugaguuuuagccaaugguguguguggcuaaguguuagcagagcuguagcgucuccuaauuugaccuucccuucagcuuucuucgcagaagguggugccguggggguccaucuugaagucacugccacuuugggcaauugugguagcacauuucuccuacaacuggucuuuuuacaccuuauugacgcuacugccaacuuauaugaaggaaauccuaagguucaauguucaagagguaagaggaaauaacuaucugcucuagaaugcauuuucagagccacacccacaauuccuuuuuaccuuuaucaaauucagucauuuucuucugugcuggcuagauuugaugucugcuugucacaaacuaagucauuugagaggcgagaaccuccauugagagcaacaccccccaccaccauggagcgggccaguaagcagcuccugcuugcagggccccgccugguuugagucccugccagagcuucccugaguagacugugauucaugauaaguaaccaauaagcccuguccucuccgaguggcuucuggucuuggugcuucauuccagcaguagugagccugacuuaagaccuuugugucuucuguguucugaugaacuaauuuuuuuuucuguuguuuguuuuuucucuuuguuuuguugggguuuuuuuuuuuguuuauuuauuucuuuuuugagaaaggguuucucuuuguagcucuggcucuccaggaacucacuugguagaccaggauggccuugaacucccaucccccaacucuaccccaccccaugccugugugugugugugugugugugugugugugugugugugugugugugugugugagagagagagacagagagacagagagagagagacagagacccugagacccuaucucacugagugagguuaugauuugaaaauaaaucuguagcugaauagaaaugcaguuguucaagccgacucucuuuuccuuaaaagucagcguauucaugaaacacaugagcuguccuuugcucacaguagggcugauucugagaagcuuguguguaaaauuguauuuuaaaacuuuaaaguaggacuggcgagauggcucagcagguaagaguacugacugcucuuccaaagauccugaguucaaaucccagcaaccacaugguggcucacaaccauuuguaaugagaucugacacccuuuucugguuugucugaagacagcuacaguguacuuacauauaauaaauaaauaaaucuuaaaaaaaaaaacuuuacaguagcuagaugugguagcacguuccuuuaaucccagcacucaggagguaggugggucucugugaguuugaggccagccuggucuacagagugagguccaggacagacagagcuacacagagaaacccugucuugaaaaacaaagacaaacaaagguaacacccaggaagaccuggagcaggcaguauguuuccccaugaggccggcugucacagggaugagucggacugggugccaugauugcagcugaugcuaaucauauaugugucauauguggacaucgccacauugcuccacuaggucugcuauuuucaagaagucgggguugacuaagacuccuguguucuaccauaauuaauccugggucuccuucccucuuccagaacggguuuuuaucugcauugccuuauuuuggcuguugguuaugcaugauccucuguggucaagccgcugacuauuuaagggucaaguggaacuuuucaacuauaagcguucggagaauuuuuagccucguagguaagugaaauaaaccaaguuuucuuuuguuucccaguuguacacauaacacucuaaaccccuuugucucuggucaugaaaaugggagauuuucccacacacaaucagcuuugcagcacacaagcuaugugaaacagcuaagucucacaagauugcccucuuccaccuuagaggcuagucacaagaacaggcuucugaccuacacuuuuaacuggcuaacuauuaauuaggguucccguggccuguccuugggcucaguuaauuugcuagacugacucacagaacucagggcacagacuuuguuucugacuguucauuuauuauagaggauguuacagggggaacagagaaauagccagguagaaaaauccuuagggcaaggucuauaggaagggcaauggagccaccucccuccagagguugacaccacgaggagcugugcugcccggaagcucaccuagaccucacucacacccucuggguguguuguuaguugguuauugguugcuugguuuguugucacaaaaucugaccauguggccaggcugcuggggaacuugcuguauagcucaggcagccuggaacccaaaagucauccuccugccucacugcccugaguaacugaguuacaagcauggcuacucgguagcucaguugcuugucuccaagacagauucuccaugcuaugcuaccuagguuuggccucaaaaaucaccccuuuccugcuccaacuaucgagagcugggauuacagacccggaccacuauaccuguacuggcuaguuuugugucaacuugacacagcuggaguuaccacagagaaaggagcuucaguugaggaaaugccuccaugagauccagcuguaaggcaucuucucaauuagugaucaagggggaaaggccccuuguggguggugccaucucugggcugguagucuugggaucuauaagagggcaggcugagcaagccaggagaggcaagccaguaaagaacaucccuccaugaccucugcaucagcuccugcucccugaucugcuugaguuccagucuugacuuccuuuggugaugaacagcagcauggaaguguaagccgaauaaacccuuuccuccccaacuugcuucuuggucaugauguuugugcaggaauagagacccugacuaagacaaauugguaccagcagagugggguauuccugugacaaccugaccauguuuuggggaggacuguggaaggacuuuggaacuuugggcuugaagauccauucgcuguuaagagcucugucagauguuguauaggagcucggaagauaauguugagaacagugcagaagauggaggucugguuugugaaauuucagagggaagauuaaagacucuuuucagggccauuucuguuuugauuaugaagauucuguaguucugguuagcuggggcugaagaaucagcugugauuaacaagauaccagaacuacuaaagcaaaaacuuugcauuacugggacuauugaugcugguuagcuggagcuaagaaauuagcggugauuaagaagagaccagcaucguugaggugacgucuucugggaaguguuuucugaaagcacaaagaggcuguguuccagagauagccaaguuuguacuccugcugcagcgggacuugguaauauguaagggucacccaggugguacugguuuugaaggcaugaaggggucacaaagagcagcugaggcucgacacugugagaggccauggaaggccauuggugaaggugcagccgcaguugcaauugaaggcccaggacugaaggggucaugcaguguuuuggagaugccaguaccaugagaugaccaccaagagcagcagcagcaguggaguacaggcaucuggagccuagaggacgacacgugugcuaaaaagggcauggcuggagaagugacccaagcccuuggaggaguccagaagauugugaguuggaucccagacauuggacgguuggagauugauuuuugcuuuugauugugucugugcccugauauuuucccucuugaagguagaaacuauuuuaguggagcccacaguuaagagacuuuuaauuguaaaaagacuuuggauuuuaaaagagauggauauuuuaaagagauugaaauuuuaagaauauguaaagacugugggauguuuaaaguuguuuagaccuuggggaugaauaagaauguaaggguugaggcuuacuagugauguguuugugugucaaguugacaaggggucaauuguacuggcuaguuuugugucaacuugacacagcuggaguuaccacagagaaaggagcuucaguugaggaaaugccuccaugagauccagcuguaaggcaucuucucaauuagugaucaagggggaaaggccccuuguggguggugccaucucugggcugguagucuugggaucuauaagagggcaggcugagcaagccaggagaggcaagccaguaaagaacaucccuccaugaccucugcaucagcuccugcucccugaucugcuugaguuccagucuugacuuccuuuggugaugaacagcagcauggaaguguaagccgaauaaacccuuuccuccccaacuugcuucuuggucaugauguuugugcaggaauagagacccugacuaagacaauacccaagccaaaccuuuuccuuuugagaugcucauuaugucagcaggacugaguaaaucauuggucauugugguccacucaaccuucaggcccaccuuuaucuccuccgcagcgacugguaccuuugccuuuuugauagccagucagcguaguacauacuguauguagucccgaugcuggggaagcugaggccagagaaucauuugaggccuggaauuugaagccaggguaacaugaugagacuccaucuacaaaaagaaaaagaaauugagaggcaggccuggugaucccagcccuugagaaguagagccaagagcaucagaaauucagauaaauguagauuuggggcccagagaacuggcugcucuuacagagaacacagguuccgugcccagcacccacacagcagcucacagcugucuguaacuacagcugcuugggaucugauguccccuucuagcugcacaggcacuagacaugggugugugcacaggcuuacaugcaaguaaaacacccauacacguaaaauaaaccuuuuuuuuaaacuauaugaugaaaagacccauuccagguaaaggcuucaaacaccugccgagcacccacuacaggaguucccaucccauccuguccaguuccugcccugacuuuggucaucuguaaaggaaaucauuucucuuucaguucaaucugauauguuuucuuccguggaccugcuguguguaauaauaugcauuuuuguuaccaacuccuagaaccaagauggaucugauuucuaacuacauccaacaaaguuuauuauuuguguaauauuugugugucugucugcguaugugugcaugugugugcgugugaacaugugugcaugugugcgugugaacaugugcucgugugugugcgugcgugcgugcgugcguguguguguguguguguguguguguguaugugcguguguguguaugugcguguguguguaugugcgugcgugcgucuguacaugcgugugugugugugcgugugcgugcgugcgugugugugugucuguguguaugugcguguguguguaugugcgugcgugcgucuguacaugcgugugugugugugugcgugugugugcgugugcgugcgugugcgugcgugugugugugugugugugugugugugugugugugugugugccauugcagaagccacugggucacccuggagcugggagucacagaugguugugagccacccaacaugagugcuaggaaccaaacuuagguccucuggaagagcaggaagcacucuuagccacugagaccucucuccggccuccaguggaguuuauuguauaauuuguauacuuugaugauaugaauuuuagucgcagucugcaucagcuguugcuucucccuuccgcccugcuuuccagucuuucugucuuugaugaucagcucuguagauguaggcugaguucucaucacaugcagauugaauagcauggcggagggaaggggggggggguuccuuuucuuauuacaggaguuguauccuguauuuccugccaggcuuucuuucuagugaugaaagcaaugaagaugcuuuggucuuccaggcaguuccguguuuguacaguagguggcagcacuguccaauucaggguuauacgguuuuaaauugagcaacuaccguaauggcgcuucuuuuucuccuacaacuuuguaacuccaggaaugguuggcccugcgguuuuccuagucgcggcuggauuuauaggcugugacuauuccuuggccguugcguuccuaaccauauccacgacgcugggaggcuucgccucuucuggauuuagcaucaaccaucuggauaucgcuccuucgugaguacagauacagagguuugcugggaauggcugugauuuucguuucuuacagucauguaaaacauagauaacguaaaacacgcuacuguuugcagccauuaccaccuggagucucucagcuuuuacaucuuugcaguuggaauucugugucccuugaaccagcacuaaugccaccuuucccguucccacauccuggcagccaccauucuuaguucugcuuuccgugacuuugacuacuagaggaaucacuuuaaguuuuuugcuggauuucaguuuacacagccaguaaauuuucaaaccuugaacugccaccauaggguucuccugcacacagaaguguggcugccgugggucugucccagcuggaauaggcgcugugauagcccauccucaggacagucaccaagcuuggcaccucgguggccuuaccgcacagaugaguaacagagcccucuuugucagagacaaagcugagaccucagcucagcugcuaggaugcuugccuagcaaucaggaagcuauggauucagucaccaacacuacauaagcugagcgcugcagcacgcaccugcaaccccagaauuuggaagaugaaaacaggagaaucaggaguucagggccagucuaggacagaagagaccauguaucaaauaaacagacaaauaaauaaaauggagccagcaagauggacgcuuuaggguaaaauuauuauuauauacauauauguguauguguauguauauauuuuuuuuccuuuaugaaucaaggaaguagaggcaggaggaacaaaaugccaggcuuagccucggcugcagcucaaggccagcugcaccaauaagagaccuuuucucaaaaaacaaaccaaacaauuauaaaagaguggagccauugucuugcccagcugacauuuaucacguuaccuguauguaaacacggguguccaggacgaggcugcuuccagucucuuacauaaacauccucuuguuuguccucagagguccagugaguugggggguggggcucuugacuuacuguauagaaacucaaguucaggggaauuaagugucuuccaccacacagcuaacuaaugcuagauccaugauccauaaucugaagcuaaaauucuuacuuugagcccagacagguuuuuauaucuuccucucuagaaacauucucugagccauggagcucuguuuuuccagcuaggauaaagagagggacuagacugagcaccucuccucugaagauuuggggaacuuaacuuauaggaaguaauggaucucuauuuaauuuaggaggaauugcgaaguagguuuuuuuuucuaaccucugaaauaucccagacugcaccuagccagauguuagagcccucugacuccugugacacaccaagacaagcccuuguccacaccucucagagagauccugagcaggccuuacuaggucugguggcauacuucuauaauccugacaucauggaggcugaggcaggaggaucacagaaaguucaaagccggccuaggcuacauauugauuaaagaaagaaccugaacagaccuuugaaauuaaccugcucauaugaaaaaaaaauacaagaauaugaaacaagccgugcagugguggcacacgccuuuaaucccagcacucgggaggcagaggcaggcgaauuucugaguucaaggccagccuggucuacagagugagcuccaggacagccaggacuacacagagaaacccugucucgaaaaacaaaaaaaaagauaugaaucaagauugggguuucauccuggaguucagcuacuagagcaaucccugugcauaugaaguccugagaucaagccccacagcugaagaagagaauaauuuaaucuuuuuuuuucuuuaaagauuuauuuauuuauuauauguaaguacacuguagcugucuucagacaccccagaagagggcaucagaucucauuaugaaugguugugagccaucgugugguugcugggauuugaacucagaaccuucggaagaacagucagugcucuuaacuguugagccaucucuccagcccccuaauuuaaucuucuuaauaaggggcuaagcuccuuccaacuagacggccuuagagcucuacauaggaccauucccagcagaaacagaucacagaacaccaacuaagugugggagaucacaucucuaauuccaacaccugccuguugguuuuagucacaaaagcauacauaauguugggaggauuuaccauauaccagcaaccuuaaaauagcuguaaaauguaaaggaagaggucguugaacuuuacaaacuaggagcuguguugaauauacauaucgauaaggggugaacuaaaggaguuuaauagugaaagcuaauugcaaggaaauuugguuaaauuuagugauaauuugaaaguuauaaacauaacuguaauaauaaacacuuugccagacaguggugauauacaccuuuaaucucaggacugggaggcagaggcagguggaucucuugaguuugaggccagccugauuuacagagugaguuccaggacggccagggcuccacagagaaaucgugucucgggggaggcggggacagaaggggucaggggaaacacuucgaagcugaaagaguugaggcacuagaagcuguuccauuggaaacggaacauagagaugccuguuuuauuaacaaagagcuucauaguaacuggggcaucccuggcuacauaccuagugaguuuacgauugccuaggcaaugagagagcccugucucaaauaacaaagugacaaagaauagagcuauugauuuuuccaguugucaauugcugugcuacuuauguauaaaugccauugucuaguacuuaauagcuuaguagucacuuguacaaacauuuguuuauccugaaaacagucuaaugagguagguagguguucuugaccaguuucacgguggaggaaauguuaacauuuauggagucauaaccaagccugauaaccuaaacagauucaaggagauaaacagugauuguaaauacgagggucuggagccauggcucagugauagagaacuuacugaaaauguguaaugcugccaugggggaggggggaggggggagguuagccucuagcacugcagacaauaaagugaaacacaaagauuaaugcugccccuuaaaccaaaagaaaaagaaucuagaaaacauugcagccggguggugguggcacacgccuuugaucccagcacuugggaggcagaggcaggcagauuucugaguucgaggccagccuggucuacaaagugaguuccaggacagcuagggcuauacagagaaacccugucucgaaaaaccaaaaagaaaaaaaaaaaaagagaaagaaagaaagaaagaaagaaagaaagaaagaaagaaagaaagaaagaaagaaagaagaaaaccuugcagaugaaacauguuuucgauuacauaucuugcgggauccuagagugaaaaguuggaaggguuuugaguaacccauucaguaugcugugcacaccgggggcaucagcugagagcugaugagcaauguaaagucuugggcugcaccacagaaucuccacuuggagaucccugggugaaucucgcacacauucaagucugaggcacuagucaaaaucugucuucccacccccucagcaaacaguucugaaguuuacauacucgcauuuagaaccccacaggacucuaggaaaagauucggugccugcuucugagauuagucaaagacaggaaugaacuacuuuuaaauuaagcaguuguaguguaguauaauuuuuuuucaacaaauacuaaauauccguugguacaagcccuaacagacgcagccuacucaacggugggagacaagaaaaccaugcaaguaaagcgaccugguuuuguuccaggcugaguagaacauguccauaguccugguauucaacaggaugacagguugaagccagccugaccuacacaguguagccuguuucauaaaagcaaaaaaacuauggcugagacauuuaaauaacaccaaggcugaagaaacagugcaaagaaguuagccaagcuaaagaaacaguggaucagauggguuugguggcgcacacuuuuaaucccagcacucagggggcagaggcagguggauuucugaggucaugaccagcuuagucuacagagugaguuccaggacagccagggcuacacagagaaacccugucucaaaggggaaagaaagaaagggagggagggaggggaggagagagagaagagugugucuaggaguugagaauauaguuacgugguagaacacuuuccucaccacgaaugaguccuagggauguugguucccagcaccacaaaaugagggaaagggcuaguaguauagacagaggaauuuguuggagaggcaaaaagaaauugcugccuugguaugucauaacaaaagagguuuaaacaaaucaacuucauauuccaucuaguucugggacacguauugugaaaaaaaauuuuuggcuuuuuguuuuguuuuaagauaaaagaaaccugccgggcaugguggcacaugccuuuaaucccagcacucagggggcagaggcagguggauuucugaguucgaggccagccuggucuacagagugaguuccaggacagccagagcuacacagagaaacccugucucaaaacaauaacaacaaaaagauaaaagaaaccuaacccaagcauguuaauaugcucacaaaagaaagccagugauauuuuacacgcgcgcgcgcgcgcacuaucccuuagccauaagagaaggaaaaagagaauaaucauauccaguucuuccuccucuaugaaggugcuaaggacgcucaggaucccugcagcaaagccacagcucaugcgccugugugcacccagaggccagaagagagcgccagagcacugguccucuuccugugugcauccagaggccagaagagagcgccagagcacugguccucuuccugggccuuuggagcucaagucuuagcuaggcuggagccagcaaaccccaacagucuugcuuaauccauuugcuguaaagcugggguuauaggcacuuucagggaugccuugcgugucuuaucucacgggcacuaagauucuaauucuuuuuuuugguuuuucgagacaggguuucucuguguagcucuggcuguccuggaacucacuuuguagaccaggcuggccucgaacucagaaauccgccugccucugccuccugagugcugggauuaaaggcgugagccaccacugcccagcuuaagauucuaauucucauccucacgacagcccggcuuuuccccacugagccaucucguuagucuucacagaacugaucuuacuauuagaugagauauggaaaguacuuaaaaaccccuuucaguuuuuccaauggacagucaauauuccuaucaacaugaaauauguguguggcauuuuccaagcccuuccauaaauugaaauuaagauuuuuuuuuguuugauuuuaaaacagacuagccucaaacuuguaucaaucucccaccucagcauccucuugcugggauuacagguaugcagcacuguggguaaagccacgguuuaccuacguaugguuuguuauggugccugacacacuccaguaccagaaaauacugacugaaucugugcagcguguuuucucaucuguaggcguccuucuucaauggcacuuccuggccaaggggaauauaaauacuugaaugggcgucuuggugcugacacuuaguauuucacagcaucugucuguacuuaggaucugucgguagaaaguccuggcaacguugcagcugguuccuccuccugccaaggugcuaaugguuuaaaaaaagagggggagagagguccugccaagcuugguuaauuuaagcuguacucccugaggggaaugagccaaaaagaucuuggcuuacuuauuauaugguuuguguaugggcuucaaguauaaaaauauggauguuuguagauggcugaaacaggcaccgcagaauuauuuauuaucaucauuauuauuauuguuguuguucuuuuuauuauuauuacucagggaucuuuuaaaauuagaaaacaauuucagaucaguagcugacaaccuagaugccagauguuaaggguccuaguagaauuugcagcaucucacaguaggacugcaugaaagcuggaaacauuucuuucauuugggccaggacuuugcaggugucugggugaacaucaggaggauccgcuuacaaggccguuuugggagcugcgguuagcugaaacccuccaccuuuauuucuuuaacaaggcaucaaacuaaaucaggagcucuaaaauccagacucuagauccuacccugugcuugggagggacauagaauuaauuauauuaaaugauacaucauccggguaaucuguaaaaacuagaguuuuaaaagacacacauagcaccucaggaaagagagagaauaguuuauagaaugaacugauucauacaacaguuuguagaaagucagcagcccugguauguaauccaaaauguuacacuugguuccaccuguacaaaauuccugaucucaaaugggcaacuuugggucacguguguaagagaggcacuacccuuuguggaacuaggcucccauggugggcaugagccaaugguccaggcauggcuagccugagauagcauugacuaaggcaaggugccaugcaaaggcaguggacagaagaggggaaagugaagccugaguuggccuugagagcgugcgcucggagucagcaagcuggagacccaggacgguuaccugucuugcuaaccgggaugacagugaagauucugugacaacugcuggagcggcacagaaggcuccccuucccagaagagaggcuaaaugagugguagggugcaggaaguguggguggcaggaugaauagugagguaacaggaacgcuguggcagauguaagcaccuggagugagcacacugcgggucugaaggugugggugugccauucuugggaguaaggcucgccacacaggccgcucagcuguucuuccucuucuuuacguaguuaguuagcaucuguaaucuaggcuggcccugaacacaaaaugucaccaagaauugcccacacuccugaucuccugucucccccucccaagugcuaggauugcaggcgggcaccaucauacugagccauuacagccuuuuugagauaaauguuaaacuaucccuguaggcuucucacuaggaaaggaauagccuagcuacguacauuaaaguauauacagucuaaaagguaggccaaccaucuugaaauguuuguagcagcuggguauaguaacacacaucuauaaucccaggauuggagagggagaagcagaagaggcaaaaauuuaagggagaggcaggcagcuggaaaggcggcucugcagaggaucugcguaagaacacagcucuggcugcuccuccagggggucugaguuuuauucccagcauccaugucggcggacagcucacaaccgccuguaaucuaguuccaggggaucugacaaccucugaccccacacacgcacacaaacacacacucacacacacacacacacacuuaccacaaauaaaaaucuuuaaaaggagaguucaaggugaggacugaagaaauggcucagcaguuaagaacaugagcugcucuuacaggugacccaagcugaaguccuaauacccacaucgggugacucccaauugccaaugauuccuugaagagggugaucugauacccucuucuagucuuucucacacacacacacacacacguaugcauaauuuuaaaauauuuuaaaaaauaagaguuuaaggccaucuuuagcuacuuggugagguucaaggccagccuguggcucaggaaacccugucucugaaaguuuguaacugacccucuugcaacaucuaagcccauucuuagguaugaacugucuucucuacgugccucuuucuccucucuaaaggccugggcuuaaaucuguauuaaagcuuggccucaaagagaaauuuaugacuggguguaccuguaaucccagaacucaggaggcagaaacaggaauggagaguuccgggccagccugauccgccuccaaauuuaauaaugagagggcuagagaccugguucaguggcuaagaaugcuuguucugggggcuggagagauggcucagugguuaagagaacugauuguucuuccagaggaccugauuucaauucccagcaaccacaugguggcucacagccaucuguaaugggaucugaugcccuuucuggugccugaaaacaacuacaguguacucauauacauaaaauaaauaaaucuaucuuaaaaaaaaaaaaaaagaaugcuuguucugcaaaggaccuggguucgguucaaagaacagucuauaacuacauuccaugagucucacagcugccuuugaccuacaaggacacgugguagacacaugguagacacguggaggcaaaacauucauacaaaauauaacuuuuuaaaaagaauuuaauaauagccuaucccuggaaccauuuccauaagucucccucacuuuuccagaugcagagguagcuucgugguuaagaacacuuacugcucuuacaucaaaccccagauucaguucccaucacccacaucagaaggcucacaaccaacuggaacuaguuccaggggaaucaagacacucugucccacaucagacaccuguauacauguggaacauauaaacucauacaagcucauaugcguaaauuaaaaauauauauuuuaaaauaauuacauuugcucugcucaaaauaauaauaguaaaaauguuuauagcaguaaacuguuucuugaugaaguacuagaugcaugguuucacuuugagaaaauucagcgacuuauauguacugauagauuuuauguuuuucuuuuuuuuuuuuaagauuuauuuauuuauuuauuauauguaaguacgcuguagcugucuucagaugcaccagaagagggcaucagaucucauuacagaugguugugagccaccaugugguugcugggauuugaacuucagaccuucggaagagcagucgggugcucuuacccacugagccaucucaccagccccgauuuuauguuuuucauaugucuacuaugugguggucaucuuugucaugguggugguugaccucauuagcccauccucagcuuuaugagguccuaguaaucaaacccagcgcuuccugcaugccagcuaagcucuguaccaacugagcuaggucgccugagucacuugaaagggcuuuuuggguuuuuuuuuaaguagaucugguggaguaagagguagagaacucagcaguuaagagcacuggcuacucuuccagagcuuaugaguucaauucccagcauccacauagcagcucauacucugaugcccucuucuggucugcaggcauacaugcagacaaagagacuguauacauaaaacaauaaauccuuuuaggaaaaaaaucugguggcauauaagggaacagcccuguccaugagaaccugaagacaauaaagucugcuguccgcugguccagggacacgucucacaaugguggagcuagcaggcaucuuugucuaagccuuuguucuucauaggaugggaauccaugaaggccucgccaugggagccuucuucaguccucauguuucuuaaauacguuacggcauauuaaacaacagaacucaguugguuuuggguuguuuugguuuuauuuugagacagaauccuggaauuugcuauguagaccaggcuagccucaaacucacagagcuccuccugccucugccuuccaaguaugauuuguaucaaagcauugauaaaaaaaauauauaucugauuccaggggaggagcugugugagggggaggacugggagggaggacuacaaucaggauguaaagucaaucaaucaaucaauggaaauuuuuuugaaaacaggaaaaacaacaauagaagauaucugauucccuaagauuuacccuuaaaauaaauccgugcacuugagaaaccuuuccccagcuuauuaagaaaagucuuucugccacaaguacaaaguagaccuaccuguguaccaggacaaugugugaagauuuacaugucagcaaauauguaauuagugaaacaagugaguugugaaauuguauauuuaauaugaucucaugucuaauuacauguuuggcaguauaagcauacaccaguaaugaguauauuuaccaaggugcuaauuagaugauuaucucuaagugaaggaauuauagacuuuuacuuucuuaauuuuuuucuugucuauauaauuuucaaauuuuuuaauuuagaggacuguugaaaucguucuguagcacugggcggugauggugcauggcuuuaaucccagcacucaggaagcagaguaggcgggucucugugaguuugaggccagcuuggucuauagagcaaguuccacauagccaggacuacauagagaaacccugucucaaaaaacaaaagaaaauaaagaaggaaggaaggagggggagagagaagaaaagaaauaguucuguggguaaauaagcuugccauagcauggugaccugaauuugagcccugaaacacacgugguggaaagagagaaccaagucccaaaguuguccucugaccccagcuagcaugccguggcacuugcgcgcgcacgcgcgcacacacacacacacacacacaaaauaaaauaucuauaaauuuaaauuuuuuuaaauugagcuuugucaccaggaaguagcuuuguuucgaugcuagagacugaaaacaaccucaagcacacuggacaagggcucugcuacugagcuacacccccagccuauaaucuguuccuuucuggguuuugaagucggauggcaggcagcccaggcuaaccucaaacuugauacauagccaaggcuugauccuccugaucuuccucucucuucgccucgauauugcugggguuaaaggugugccucaccgggccacacugccugacugugcgcccccccccccccgccacugccgcugcugccacacugcaccccccuccccaugccacaccaugcccuaacacaaguguuuucacucuuaagcuccugguagauccaugaaacaaaaguucucuaacaagaggaaucccaucugcagccgugucaccgugugugcuguuuuaugggccuuugugcucacuuguuuuuauuucuaacccaguguaggcagucuuuuuuuuuuuuuuuaauuucauguaugaguauauguauagcugucuucagacacaccagaagagggcaucagaucucauuacagaugguagugagccaccaugugguugcugggaauugaacucaggaccacuggaagagcagucagugcucuuaaccacugagccaucucuccagccccccaguguaagcagucuuacaaaaggcucugccacugaccugccugcccuaggcugaaccaacccaccuugccuccaagguugauuucuuugcucaggaauagguacccccuggacuuuaucauaacuacaaacuacaagcagacaguggugaugcacaccuuuaaucccagcacuaaggcagaggcaggcagaucucucugagucugagguuagccugguuuacagaguugaguuccaagacacaaaaagacugugucuugggaaaaaguaaagaaaagaaaaauauaaaugcaagguuuuuacuaaaauauaaaauccugguuccauaagucauuucauggagacagaaugucucaacacagggaucugucuguaaaggagcuaaccuaugacacaggucucugugaaacucucuucccagguaugcuggcauccucuugggcaucacaaacacguuugccacuauucccgggaugacgggacccaucauugcuaaaagucugaccccugauguaaguaaaaauuuggcuuuuaaacuaaaaauauuuggaaguuucacaucuuugucaaauugagcuuauuauaauuaugaguguuuuuuaauguuuauauggauguuuugccuggauguuauaucuaaaccaaauacauacagugccccccaaaaaaagaaggcggucucagguucuguggaccuauaguuacacacaguuaagcaacacaugagugcuguugucggccauuaucuagguccuggaaccaaacccagguuugcuacgcaggagcaguaaauguucuuaaacacugagccaacuccccuggcuuuuaugaaauucuuugugacaaaaauauaaaguaaaauaaaguuuauguugagagcugcugcuuuacugggugggaaugugagucagugaguggaaaaugacgcgccuuaguggaugcaggcgcgucuguguucaggcuggaggagguguggcucaguugcuacaauagaacacuucgcuggaaucgaugaagcccuggguuugauucccagcaguaaacugagcauaauggagcaguuagaguaucucauaucuuguaaucucggcacaagagaagaaaaagaaaaaaguguacuguuucagagaccacgccuuggggguuaggcaggaugguagaauucaaugaaaaucuucagcccagagcucagcacguugaccgggcuggcucuaaaaacagugcuggcucagccgggcggugguggcacacgccuuuaaucccagcacuugggaggcagaggcagguggaucucugaguucgaggccagccuggucuacaaagugaguuccaggacagccaagacuauacagagaaacccugucucgaaaaaccaaaaaaaaaaaaaaaaaaaaaacagugcuggcucuucaagaugguucaguggguagaggcaccaacgccugaguccaaugcccaggacccacaagcaugguggaaggcuaaaacugacccaugaccucggaccuccacacauauacuguaguaugcgugcccacauauuugcacgcacacacacucgcaaacagaagugcaguauaaaaccuuuaagagaacaguggggcuggagaguuagcuccaagguuaagagcaccagcugcucuuacaaaggaugaguucaguucuaacaucuccagagagaugauggauggcucacaaccauguguaacgcuuguccucucaggcaccugaacacacaugguauacacucagacauagacacaaauuaaaaaaugaaaaauaaaauccuaacuuuaaaaaaaaggcuaaaaugacuucaucaaaaauuuuaaaugucaccaggccaugguggcucacaccuuuaaucccagcacucaggaggcaaaggcaagcagaucucugaguucaaagccagccugggagugaguuccaggacagccagggcuacaaagagaaacccuguuaaaaaauaauaauaauaaauauaucuauucgucuaaagacuuaguuacaaaaaauaauaggaaaacuaaaaauguaccugggaacauaaagaaguccugaaacagagugcugaaauuaaaggcacgugccacaacccccugcucuuagagccuagguguuuaacagucaugaucuuucaccaaacacaguguguauguguuggcagggacaugacucaguggcaaaaugccacacucacaaggcucuggguucaaucucagcagcaagaaacacaaagaguauaaaauaauaauugcaugaacugaaucaucaggugagugaggugucaagaaacuggagcgagagugaauugaaagcagccagagucaucaugaacaucuggaggacuuaugguaggccaagugaagaguacuagcuuaagccagcuaauagugugugccuauaggcccagcagucaggagaugggagagagaagggagaggacaggaauuguuagcuccagagcaagaucagggcuagcccaggacacaugggaucccuaaagcaaacaaagaagugaaaaagcaggcacagugucacgugccuguaacccagcccuucggaagcgaaggcugggcugcguagugaaagcuggucucagggaaaagagagagggaaggaaggaagaaaggagaugggagagaacuugguucuguaaagacagguggggacaaguuguaagagagacauuaggacaauucacaaagccuaaggagacagcucaauacacauucaagacauugauaugugugggcagcuguuguccugucauggagcagaacacugccccucagcaaggcuguucucuuuuccugccaugcccccucaccacugagggcaacagccguuagcguugucugagcuuuuuauagaagcagaguggucggucagucugcucugucugucucugucaugucuacaugaaccgguucccccucauggucagucggugcuggacugaagaaucucuccucaguccuccugcggucggguaucagcuuugcucaggcacagacaucagugaacauuucuguucucacagccuucugacugccgccuucuuauacaaacuuuuuuuuucccuuugccucuuccuucccuguccagaacacuauuagggaauggcagacugucuucuguaucgcugcugcuauuaacguguuuggggccauuuucuucacgcuguuugccaaaggggaagugcagagcugggcucucagugaccaccacggacacagaaacugaagacaacaaacaauaauuaauguguuuuuauuuaucauggaaacugaaagugccuuugguauuugaaugugcaagcauucuaugugagagaaaaaaaguacuuauauuuguaugguaaucaugaaauguuacuaguuccaagaucauauaaaaugagcuguugggcuggacagauggcucagugguuacgagcacugauugcucuuggagagguccugaguucaauucccagcaaccacaugguggcucauaaccaucuguaaugggaucagaugcccucuucuggugugucugaagacagagacaguguacucacacacauuaaauaaauaaauaaaucuuuaaaaaaaaagaagaagaagaggcugguccucuuuuaaaaaaauaaauaaaaaauaaaaugagcuguuuuuaauuauuacuaguauaucugccaggccguauacuggguucacauaucaggcugcaggaaaggcaguaugauauaagguaagggcauaggaaaugaagcugaaauggacacacacacacacacacacacugauaaacuugguuaauuaaaucagauaaaucauuucagaucuuauuaaaauaccugcuuuugucuacuucccuuauaaaaaugcuugccaacucucccugacaccuagaccucaauaacgucuccaaagaacugccagccacaguaagagucggcagccuggcagcgguacugggggauccgugcccaggcagcugucaagcauucccucccuggcugcagggcaggaaugcccagcacuuaccagggaugguggcuuccaagugcagggccaaugacaaguguuuggcugacacucuuucccccauggcuguuaaugugcagauaaagcucuaaguggacuggagcagugggagccauagcuacugucuugacacugccagccugccucggcagcacccgggcccgacuccuggcaggugaucuacaaagcagaagcgugguacccagucagucacagagaauagcauccuugauucacaucacuggcccaugaauuggagaacacauuuucacauucagguuuuucuagcuacauuagaacuuuuuuaaaugucuuacauuucuucccuucagucugucuugauuuaugcuucugguuacaguuuaaagggacuuucagggccagggguuuggcucagugguagagcauuuacauaggauugugcuccauucaacaccaaaauagagguaaaaggcagggcacccaaagcuugucaguccccuuuacccugcuuccugaccagugucucccagugguuaggcacacuguaagaggucccuagucuguguggugguaccuuuaaugccagcacuugggaggcagaagcaggcagaucuuugcgacuucgaggccagucuggucugcaaaggggcuuccaggacagccggggcuauaacucaaaaacaaaaacaaaaagauuauccaaggauugaaagccugccuuauguuuuguuguaucuguucaacacuuaucuauaacauuuuaacuaaugauugguuaauguacuguuguguaaauacaguuauauaaauuuguuuuuaauuuguaaauauaaauuaaguugccaugugacauuucuuuuauaaaucaucaaaauccuuuugcauuaaauuuuuguguuuuuauuuuau

SEQ ID NO: 5213 - RNA, 100717 nt, Mus musculus
aaccccagguucccgguggcgggggaaaugggcucccuauguucucccuggggagcaggaaaguuggggccagguuguggccaccgcgugcagagaccgcuuuucucagcaacgggacagcgcgacguuagccugggagaagccagaagcgccauugugaugcagcgggauggguggagccaucaagucucaauuuagaucccucugcuuuuaggcgcgcccauuucagauugcuaaacccuggugugaagcgggacaggccagggcaggagguggccaaccacaccccgcagggcgcgcacuuggcgggcugcagaccccacgggcagacgccgagaugcgcagucggaggcuccugagcgcggcccaccuucucugcuugugcgcggucgcgcuggccgccccaggguaggagcgcgggcuggagggcgcccgcgcaggggaugcgcgcggcaugugggacccgccaggggggcuuucuuuaggguccuugugcugcgacaacuugucaaagaacgucguucuagcuguaguucacgcugcucugccuuuugccucgcaacuuguugcuccucaauaauguaccucuuuuucagagacuuuuuuuuuucuaaacuggauguuucuaccgugacacugucagugugacugaggugaccggaguaggaugagaaugcuauaucaaagacuguaggaagauuaacaaaaauuagacuguauaaauugcuccauuucuuaagugguuuuuuuuuucccccagcaaagaaaucguuauuuuuacguguguguguucauuuguagcucaggcugggcagucuucaguuuugaguggcaggagucuaggcgugcaauuaccacacccggccuccuugggggacuuucauguuuccuaacucggagauuucauugcuggguauuuauuuucagguggucagguggugauuucaauuaaugggacuaguuagaugacccccccccccguuauauagauuugagcaggcugaaucauaaaucuaggggugugugugugcacacaugcgcucgugcgcgugcuuccuaagaaaauaauguggagaugaagucaccuuaacgaggcuuggagacuugcauuuugcaguggcuuauuuuucccuucuggcuccugugccuuugaacuguuugaggaauuaugguuuccguagcauuucauggccuuacgaaacagcagaggcaccacguucacuguaaauaguguaguggagcagugcagagaucccccacccccuuucagaaaucgaagugggguguguguaaauaagauacuuugcuuuucuuuuguuggcaacucuuuaggucccgcuuucuggugacagccccagggaucaucagacccggagcaaaugugacuauugggguggaucuccuggaaaauagccccccacagguccuuguaaaggcucagguguucaagauagcuuccaacaaaucgagauccauccuggaagcagaaggagucuuucacagagguaagagaaacugcacugucuaacagucacacuuggaauaugguaauagagcccugggcuaggcaacacaacagaggagcacaaacaaguuugcagugauuuccacagugccccuuugcaaauuagccgugacuuccacaggugccuguuugauucuaacaccugugaagucugaaauuguccccgaguguuccaacaaguggacaaagagccagauuccuuccguguguggcugcaucgaaucagacugcaggggaagaacauccggaguuuccuacgugggagguguuugugggccuggccuggaaacucugcuugccaccauugcucauauacagauggccaggagggugggaaaugcaggccagugucuacccagagaaugggcagagauagaugccugucucacagaacaccaugguuauugggugcaguggauuuuauuaaguaagccagugggaaggaaagaagagcgacauaauucaguuuuauagaacagcagcagcagcaacaaaaccuaaauaaacaaacaaacgaacaaagaaaaacaaacuccaguagcuuagaggugaugugagugugggagggggaagagagccuugugaaaaguguuggccaauuauagagaaccaacaucuuuuguuucaagcuugaguucuaauuauggucaggaguaucuuuuuuuuucuuucuacuauuaagggaaaauuaaaccuagggacuauuaauacacaaaacaucuuuuuucccauuaaaauggauauauauucuccauuuuuccugauuacaagagcacuuacauauccagugagugcaacuuguuaagcauugucaauaaaagcaaaaaaaaaaaaaagucaaauauaacuaaauguguguuuaucuaaauguguguuuauaccagaaacugagguguaaauuccucuacucgaguuauuuguuuauuuacuuauuuauuuuuaagucauuuaagagcauacaaugcaugcaggauuucacaauaauaccucauguaauaauuugcccuuuaucagcauaggaaaaaaaaaagaaagauaucaucaagugagauagaaguuuaugcaucucugugacucuuucucuacaggaaguugacuggcuggguagggaaauuuaagcugggaaucugaaaaagcguucuaugugcucuggcuggcuguuuuccacuacgggagcaaagucagggagaggaguuauuuccuugggggaggaaauguagacugguucuuaaugccugggcuguuuuguguguguguccugcuugugcaugcaugugugugcaugaauguaugcaggcaagaggacucauggcuuguccucgagucauuugcuuggcagcuauccaccuuauuuuugagacaggaucucucauagaccuggcacuugcugaugacuuuggcuuuuagaacuacuuugauucuaaggagguccccuaacuguucugagcaucagauuccucaucagcacaauggaggugaugcaacuguccaucuugugcaguuauccauuuaaaaucuucuaggauguaguccuccuaggcauucauuacgcaauagcugcugacaguagugcuagcccuaaagaagcagauauagaaggcauauccuuucacacacggagacaggccuuaccuugaauuauuggacuuaucauuucugaaaacgagcaagcccuuguuuaugggaguagcuaaacaaacacuggagugagucaauucaaaggcaacaauacauaaacaauuuuaccuucguucuuuauucaaccagaguuuaugacuuugauggcaguuuuccuggaguguacagguccagaaggcugugaaugaucuugacaaauaguugggcuuugcguggacauuuacuuguauuuuauuuuauuuuauuuauuuuauggacaugaauauuuguccgcauguuuguauguaugcuaucuauaugcaaugccugagggggacagggagggcaucagaucccuuagaacugguguugaagacuguugugaaccaugccgcgguugcugggaauugaaccaagguccucuggaagcuaguucucuuaacugcugagccaccucucuaagccuacgcucuuauuuuagaauucugcucuuucccacacauuucguugccacucuccucuauaacagauagcaacuaccuuagggaugcauauuguuauggcuuguuuuuaaugcuauuagauuuuguuuuuaacuuuggagagguacuuccucauauguucaagguuauauuggaagaccugcccugggcuggaauggaucuuuaaaaaggaaagugggaaaacacaguucccaccgggagucucucgauuccgaggcucacacugccagaagcacucucccgcuuugaaaggagaguccuacuguacagugggcggcuguuaauuguucuccgagcagaugcuuccuguaacgcuaggacuugaggaugaaggcauuccugccuccuucuccucacauccuuugcuuuaucugacuccugcaguccugacagugugcugacgaaugagacuucugcagagccuggaucuuuauggaauuuguguuuugcauuuucccaucacauaaguucaaacaaguucauuuucggucugauuaguucaucaauccccacacgaaaagguugguuuuaauagagaguuauuaucuacuggagauaagauuagaaaaaucgggcuggugagauggcucaguggguaagagcacccgacugcucuuccgaaggucaggaguucaaaucccagcaaccacaugguggcucacaaccauccguaaugagaucugacucccucuucuggagugucugaggacagcugcaguguacuuacauauaauaaauaaauaaauaaauaaaucuaaaaaaaaaaaaaaagauuguuuaaaaaaaaaaaaaaaaaaaaaaagauuagaaaaaucccugggccaggcuuguucgacacaguguaagaauguauuucuagcuuaauuugcaucagaaauacugucacuacuauuauuaauauccagauuauacaguuugcuuaauuuuuuugggugugccuuauuuuaauuuaauuuguguguguguauguguguguggugguuugagacaggucacaucuaucccaggcuggccuugaacucauuauguagcugagguuagcauuaaacuugagauccuccugccucagcuuuccaagugcuaggcuuauaggcaugugccaucaagcucuaaaacaagaauauaccuuauuauaggcacaagaggauggcuuucuuucauggaauaauuuauuuuucugauauauaugggugugugugaccugauuaugugugugaaugguagucuuuuagaaaaaaaaaaauucuucuaagcuuuguggaguucugccuuuucaguauguuauucaguuccuuaucuucuugaccuucaucucugcagcucauuaucuuacuuuccuucauaugcaagaggugguucugcuaacacagacauagugagaucucagcuuguggaguguggcaggggagaggcuuggcuucugccugcugggugaagucugagccuucuuccucuucuugguucucucuccuuugugucuuggaaauuaaccuuuguuccucguuccuuucuucaccuggaacauuuuguuuguaauugcccccuauuuuuuuuuccuaaacaaaauuuacaucaaauaacaaaugaugaccuuucccucagccaaagaaaguucugccaccuguuccaaauaaacuuggucuaagaaaaaaaucuggaggugggaggaagggaaggcuagacagauggcccagagggaaagagcacaggcugcucuuccagaggacccugguucaaucccacguggcaggaaaagucuguaauguuaguuccaggggaucugacauccucauacagacauaugcaggcaaaacaucaauacauguaaaaaaacagaaucauuuuuuaaaaaaagguugagcugaagaugccaacggaaacauuugggaaccccgccugagcaucucuggcgagucucuauuuauuuggucucugugagacagggucuuacuauauauguccuaggcuggccuggagaucaaaauguagaccagucuggccuugaaaucacagacaugcuccugacuccguucuuugccuucucauugcaacacugggaugaaauagucuccauaucuguguccucggauaacuuggcauuugauuuugugcuuaacucuuggagagugacuagaaucuguugauuuuauuuuuuaagaagaaaagcgcuggggcuggagagguggcucagcaguuagaggcacgugcugcuauugcagaggacccgaguucuguuccuagcaccacucgcacugggccacucauaaccaccuauacuucuauucuagggcaucccaugcccuuuucuggacucugcgggcaugugugugcacggaugcagauacacagacacaggcauacacucauaaaaauaccucuuuaaaaauuaaaaaucucuccucuaauaguuuuaucuuucugaguauggaagacuuuuuauuuuccaucacugugaggaaggggaauuuuaaauauuugagguauuagcugaaacauggggaaaaaaaucugcccagcucuguaaggauggucccuuuggcagagacaaugcugucaaauguaccuuucaucuguguagaucaagaucugucccacagauuuugugaaaguacauuaauuaguguaguguguaggaggaucccagggcagguucguacaggcaauucugcacaaagaacucagucuaagccuguacuuacaugagaauuaauuuuaagugguguaggcucuucauuuacacaucuuugccauuguguggguagaugcucguaggggcggauacugaagguaaaagacuacaucaggugcuggccauuccaucuaauguucuaguuggcugugggacaugaggacuacugcaggcuuuaguuuccuuaucugauaaauaaugguuucugauuauaugauuauuggauaguuauuggauuaaauaaagaacuguguuuucccacuuuccuuuaaauaauguaucuaucuauguaucugucugucugagacaguguuucucuguguagcuuuugcuguccuggaacuuguucugcagacuagacuggccuagaacucagauaugugucuaccucugccuuccaagugcugggacuaaaggcgugcacuaccacugccaggcuaagaagaaauauuuaaugcacguaucaggcacugucugagaaaguauuagcuacuguuauuagaggagaguaccaauaauucauauccaaggugauuauuaaucuccuauugagaugacccugaaguugaaauaacaaaaaaaaggaauauaugucauuaagaggcaaugagaaggcauuuaguacauuaaguacuguuugcuuauaauacugaggacacuguuuaauuucuacaaguggaugaaauagacacuuagaaauaagaggaaauauccagauucccugacaaauaagucagggaauggugaggccugagccugagguuagcucugucuggguugcagagaccggagguguacuguacauaucuuucucuagaucagugguucucaaccuuucugaugcuucgacauuuuaguacaguuccuagauguuccuuauguugugguaaccccccaaucauaaaauuauuuuucuugcuacuucauaacuauauuuuugcuuguuaugaauugugaucuaaauauuuguguuucuugauggccuuaggcgagccauguuaaagagacauuucacccccaaagggguugagagccacugcucuaaaucaucuucagauuugcuugcaguagauuagacuugcaucuuaugagaccucauguggaucuaaagaauugucaguugaguuaggccugguaauauacaccaguacucucagcacuuaaaagguugaaacagaaagaugacguuugagucagccugggcuacauaacaauacuguccccaaacgaaacaaaauggacaauagaagcuugaaaccaccugaguccugugcaguguccugucuuauguuagcucagguagggucauuccugauggaccgacugagaagagagguuuggucagagaauagcagagaucuaaauucuaugcccguguuucucagggugagaacugcauuuacaaaguguagauucagggccgcccuucggacucggcuaagguccaguaccuacgucugaauuaucgucaucacagaugagucuccgcacugugagaugagaacacugaccugccagugucucccaaauucuaguugaccaagcuuuggaaugccagugagugagaggcaagcccuggcaagcucgaugacucacagacucugagagaaggccccuccugaaucucugugcuugcuuuucaaguaucucacgaccuuaagcauugguguuaacuuuuagcagagaaacagcauguccugggguuugguugugaaucagggauugaaugagguugaggguaaacacgcuaauuuuuuaaacuucaaguuaaacgugcauugcucaucuaacacugagugagucaccguccucaugacucacugaagagcugugguggaaauagaaagcagauccuggaagaauuugggcuggguuacuauugagccuuuauauuuuguuagguugguuuugaaaugcuaaaacuuucauguucccaaaggcguuccuuuaauuuaacauuccauggaugaaugaaggguaggaguaggaggaaggauaaauauuggaggauccagaagaauaauacuuggaauuaaaaucgcaaaccugagcaagugugcacuucaaucucaguacuugggaggcuuggggcaggaggauugccaugaguucgagacaaguagggguuacagcaucaagaguuucaaugguuaccuuguuucaagaaaucaaacacacugggcagugugguagccuacaccuuuaagcccagcacuugaggcagaggcaggggcagaggggcagaggggcagaggggcagaggggcagaggggcagaggggcagaggggcagaggggcagaggggcagaggggcggguuugaggccagccugaucuacagagugaauuuuaguauaggcagggcuacacagacucucucucucucgaaaaccaaaaccaaaccaaaccacucucaaaaaccaaccaaccaaagacagaagcugaauucuacccucccuaaaauugcacagguggauugggggcacuacuuuauagauaugugagagggcaaagcagcucuggggugcuguuucuuaguggagugacuagauguagcauaauguuuugcgcaucaaaagcuauaauaggcgccaguuagaugggugaguggguaaagaugcuugcagcugagccugaaauccauaguucggucccugagacucacccauaugugacagaaagagaguuuguccucuguucuucauuuagguucgaugacauguacacacacacacacacacacacacacacacacauacacacacaugcacacacagagucacacagacacguaacuuaaaaauguaaaaaaaacccuacaagaugauuuugaaaguuuuaaacuauaaaguguugauaaauguuugauccaugauuuaaaauagacacaaucuccccacacauuaaaacuuuacauuguaguccaugaauagauguaauuuuaguauagcuguuacuuuaaauaaaauauauagcuugaaagauugggccaguucuagucucaaacacugaaugcauccagagcaggagauguguuuccuucccaugugugcagaugaaaugcaucaaaguuugcaaacagagcuucuuucucacucugugccaugacacuguuuucuucucccuuuagagggcuacagaugccccuucauagcccccuccuuggcuaugguauagucgguguuugcugggaaccauuauuuccaccuuagagaugggaaggaagggcaugcugcaggaaugaacugacuugcugcaguguggugguuggaguggcagccuugaggggcagguagcaguuucuguauguguuuucugagaacaugcuucaguccucuccgggagugagugagucuggggaggcagccaggugguuuuaaaauuauaucuggggaaagaauuuaaggcaugguuuucauaaagacuaauagauaaccaagaccaucugagcugcacaagagauacaacuuaaaagaacaugacagagauggcugaagugugcaugaggaacgguaggcauuggcagagcagagacggguggaggacgaaagggugacaucccagaaagccaggagcaagagaaaagacaguccugggcaggaaguuuugacugagucucucuugguagcccaggccgaccucaaacuugugaucuuccugccucucuuucugagugcugagauuacagguguguguuuccaccucagcaccguuguuuucauuugaugaaagagaaaauggaaaaguaaggcaagaaauauuucugaaagaagcauacaguuaguagaauuuuaggaggaccuugccauaguuaccaccucccucuaaaucauguaggccuggcuaccuucuucuaggaaguggggccaaggagaggaauguuaaaaaggaaaacucuucccuggugugucaugagaugggccgcugguggauugugagaaauuggaaugaaagggcugggcugugugugugugugugugugugugugugugugugugugugcguguguguauguguaaagggcuguuugugaugucauugugccucuuuagaggcauaaagggauaggaugaguuuauucccaccaugcuuauuuguauaugagguggcauucugauucaucauuuuugacucaucauauuuuggucagggucaagauaacuaucauauaaaaguguagugcuugacagagacagagcuugaggcagaaggcugaagugaguaccagucuugcuauuuauuuauuuauuuuguacuguuuucauagaaaaguucuaggaacugacuuuguuucgauuauuacuguggcuuguuugugcaaaaugacauauuuuauaaugacauuuucauaaacuucucucauguacuugcucauguucccccucccuucucucauucccaccccuccugguugucuccuuucuuacacacacacacacacacacacacacacacacacacacacacgcacacacacacaccccagguucugcguaugagaggaagcacgauguuugucacuacucauucaucaccaugguuugcccgccaggcccugggugaaguagcuccaagaucuagugggggaaaagcaguggggaacuagugggcaggucugugggacuuuuaauuugaggaaaugauucaugaguuaaaaaucuaaaagccagacugaauggcaaagaaguuggaccaaguggagaggaacgucuucuaagaauagggccguagcuuccuuguagcaggcagagguagggaguuguguuuaugaacagguagcuacagacuaguuuagcauuacuguguugaaauauguguuaagucucuuaaggaacauagagaaggcauucauuauauucagcauuuuaaauauuuauuguaugccaaacucuauacgauuauguuguaaugacuguuuuggaaauaauuccuggguccaugccauccuaucaggaagcauugugggucaaagugggaguuuuaaagccacauugaaagugcacucucuugaaucacccagcaauaguaguuacugaguagcauuguuacaugagcuauuuuuuggcacuguagcaucuaaugugggagucauuaguuauaugcaguguuaauaauaguaauaguaauaauaauaauaauaauuuagacaggguccuacuguguagcccuggauggccuagaguuugcuguuguagaccauguuuggccucaaauucacagagauuuacauauuucuaucucuugaguauugguauuaaagacaccauggccaaccucacaaauaguuuuugaauauguggaaugggacuuauauggcuugagauaagccaugacuauaaaguacauacuagauuuugaauauuucuacccaaaaggauuaaacucauaacuuuaaauaaauauguuugacaauaguauuuugaacauacugggucaaguaagauauguuauugaauuuaauuucacucaaguauuuucuuuuuguuguuaauacauugcuuuagagcauugaccacaauaccugacauauaguaauauuucacaguuagguagcugucuuucucuuugcauuuucugggguuagauauggaggcucccaccucuuucugagcacaaacauguccucucucugauguuggcauucauggacauucaaccuuguuccuuaaggaaggaggagggagucucccuacagugcaccaugccacagggggaugacagccuucuauuaaaaaggguaaaaccacacacauauacacaaaagccagcugggcaugguggcguacaccuuuaaucccagcacuugggaggcagaggcagguggauuucugaguucgaggccagccuggucuacagagugaguuccaggacagccagggcuauacagagaaacccugucuugaaaaacaaaacaaaacaaaacaaaacaaaacaaacaaaaaaaccccaaaagguaaauguaggcuuugcuguagacuucugucuuuauugcuguuacugaacacugccuuauagcuuuaaagcagccauagagaaacgggugagcaacuugaaagucuguacgccguugacuaacagugaaagauuguucucucugacccaucuguuuaaaaaugaaaaaccauuuuuaguucaugaacuuauacaaaagugugggccaagucuggucugcaggcuguggauggccugcuugccucaguaaguacucuguaagucaggaaccugccugacucuugcuuccauuuguauugaaccuuaguuuaaauuuaucuuacuuuaguggguuucuguuugaucuuaucucacuggguuauauacauggaacauguaugaaugucguaguuacugaaauauuuauaagcaaggggaaacaggagaggaaaaauaaccaagagugucuaagaguccaaaggaggguuuaaaagagaguauaaaauacuuacacauucuguauugacucaauuuguuuauuugcuuuguuuuuguugccaaaacuacauuaaacugucaaagagaaacacuguacuuuaaaguucuaugucccacagauuugugguggaaagugcucaucuuuuuguaguucauugggagauaaaauacuuuucugcauaaugagaggauauuuaauaaacugguaaagagguaagaaguuuaacauaaguuuaauuuugcacaugacugcauagcaaagaacugccaaagauauuaagccucagccucaaauauuaaguugggcagaucacaguggaaaauuuuuuuuuuuuuuaauagagagauauuuggaccuaguuuuauuaccaaauguccucuagucuuucuggucaccgauucuccagggcuacuuggugaggacagaugucaggugaggcagcagauguguguuuuaaauauugaggagagguucguuccucuguaugcucauuacacaaccuaaaaccagccuugacucuauuuguaaaucaaaagaccaguuuucccaccugugccaagugugaagucuacaaacaaggcuucuuuugaguuacugccugcugaggggcagaggcagcaguccugaaggcucugagaagugaucggaggccacaguugccuggaacaacgggcugggcuguaagaacuuuacaaaggggcgugcauccucagugauugagagagugggagccaccuuucaggagacagccauuucccaugucugaguggauccuggccaaaaaaaaauguucccaaagguuugcaaauauuaucugcuuagcucucacccuagcaacagcagggaaagggguuauuauuugucuucuauacugcuucccuccccacccucuaccccacacuuuuaugacuuggugacccaaguuauuguaaaaucuuuagacuuucaaauaaguccuguacuaggacuuaaugagugccuaggacauucuaagauauacuuuuaaauuuacagagacgacagcagcaauagcaauaagcaauguuacacauuuaaaguugaccuuuuaauaaggauucaagagauuaguggcaggccucaacuguucaaucuacacacgaucugagaugcaggauccagcgggaguuaggaaggcugagacaucucugcuccuguaggcucccuccugucucugcaucuuucuugguucugcaucuuuccugguucugugacggaugucaucauaggucuguagugggacccaggcacgcaacuccuccagcuuugaucuccugagaaacccuucaaaguucugagcugacuaaaagcuacacccaaaacaaacaaaacaaagcaagacaaaacaaaucgagcguuaaugugaaaugagauuucuagugagccuguuuggaauggccagcaugcuugcucuccaguuuagucaggguaagagauucauuuaucgcaggcucccaacggauuuccucuuucuccuugccugaugucacguggguagcgaucaguacucacauuucuaucucuccucagacuuuguaaaucugauguccgugggaggcagcccgugugugugaaaucagggucaaaaaggaagcacaggguuucugccaucccccgggcugacaaaauagcuaacccuguagauuuauccagaagcgaugaaaacuagguaccucucaggaaccagcugguuugcuggggcacgauucucggcacuucagccuuuuauacuugauuauggugugggacaucguggugccuguuguuuuguaucacccacauccacugcaaggagaaaggcucuuucaucuaaacuguagggugugucccagcucucugauccucauuagcuagagaucagacuugcgcaggguugcccccuccuggggauggccuguuuagguaccaggauccacacagaugaggaaaacaaggaauccaagaugagauuuaaaaccucuauguguaaaggaauuagggacauucacaaauugacaauagccagcgcugcaagagaggauacugagaccguccacagcuggucuaauccaagaggcaggcugccuguugagagucuugggugauccaggguuccagauuccauuuguaaaauaaggauaaaagaauuauuggaacauucgcucagaaugucucucuguccacgaagcuccuacuuggaacagaaacuucuacacuaaaccgagcugaaacggcgagacccgugguaucgccgcuguuagaauuggcgcaaacuauagaagaaacucagaggcagacaguuuccuugauuucaguuuugugaagauaguuggaguguagguccauagaaauauauguauugcuuugauucauaaaaaauuuuaaaaaaagguguuuugucagaucuuguuggcuguuuuauuguuucuaaauaaugucagagcuccauccuccaggacaccacuguaaaacagaaauauaauucaacaauguagauaauagaucauucucuagugacaguauuacaaaaaaguaaaaugaaauauauaaauuaauuuugauaguacacuuugagcgggauuacagauacagugacuacacaaaauccuuauaaaaaccauugcugaauauuuugcucuguuuuggucuaaggaaucaggugccuuuuacaggugucacaugugucuggugcccgcugugugggauggccuagcuucuggugccugcuaugugggauggccuagcuucagaaguuugcuggaguuuuuucuuuugucaucccuguaugcuuguuugagauuuguuuuuguauuuguuauuuuugagcucaggcuggccucaaacuugugauccuccugccucagcccuccaaguacucggaugcugguguacuccaccaugcuggggugagcuuugccagcuaauuuuguuuguuuccaagauuucccaauuaucuauugcugggaacaagccaucccaaaguuuaguaggucaacauaaaguggugaccguuucucacuggucuccauuggcuugcacgcccaaggcucacgauuccugccugaucagucacagagucccagagccucaagguuucauuaauacuaucugacugcagcuuuucuucgcuuucauucaucaugcauacacacacacacacacacacacacacacacacacacacacacacacauaucgaguccagacucaacaugcagggacacacccugugcacacacacaugaacauggagacacaaauauaccaugaaagaaguagugugaccaaacaacuuaaacacuuaauaaauaauggaucauaaccuaccaaacaaaacaaaauaugaggucaugcugauauauacauauuauauacauagauacauauguauguauguauguauguauguauguauauauguauaauccuacagcauauaaucauuuccucuuuccccucuucccuccagcccuucccaugagccccuuugcucugucucaaauucauggauucuguguaauugucuuuuacguuuuaucucucugcccuuuuauguccccuuagaguauucuuucucuggccacauccacgguuaacugaccccucuguggaguuguguauacuaaucuguuccuaaaugcuugucugggaggacuacuuccucauuuccaaguguguauagagaauguuagauaguguauuucugguucucaaagaagccagucaacaacuuaaaaaaaaaaaaaaaaacugugaaggagguugaauuuauauaucuuucaaaguuuuccuuuuuuaccaagucuaguuccugauacggucuuucaguuucacuuaaguucaguacagaauauaaacaucccgugagaagugaacgcuuaguaaacauagaguguuccuguacaaccguguuuauacccagcugugacaucagcaugucagagucaccugcauucuucuguuauugcagcaccacacauaagaguugagguggcaacaaccuaaguguccauuaacagauaaguggguaaggaaacauaguguauauauucacaguggaauacuguuugacucugagaaaggcaacccugccacuugcaaugagggugaauuugaggacaugguaugauuucacuauauguaguuuugaaaaguugaaguuuaagaaaaggagacuaaacugcugguuauccagcuaggggcuucaugggagauguuggucaaagaauaaaaaaaaggcuaguuagacaagaggaauaaauaccaguguucaucauggcuccgacuccuagugacauuuuuauguacuugagaauugccaauaggguaagagguaguugcucuagcagcaacucugaguaucugugaggcggugcgucucaaguuagccaccccacagguuauacacgugucaaaacaucauacuguacaucauaaauuuaaguuuuccccuguuaaauaagauaauaagaaacauaaaaaggauaacagucagauuagacccaucuuacaaucaccggcucccagcuuggcucagcccagccagcucuggcuuugguagggucacaguguccugcucugcugugcauucucuguccuggcucuucccucccccccccccccgaccgacuccuaucccaccgcacuagagaucagugcuaacuucccaggcaccccuucgaagugcucccgccucugucuuccaacauccaaucaacucucuucacguuuuccacauuuuguucaguguccuauuaugucagacucccucucuuugcaggagugcuuauaaguagcugcuccaugcuggcugguaaucagugauggggaauugccuggggauccugcaaaccuauuuccugucccuugacuucacuggaagacagcuguuuaaaauggauguguacacaucugggaauauacacgauuguuucauaaugugaaguuagaaaauauacuaauuuucacuuauuuuauuuuugaggcagguuuuugauaugcagcccaggcugguguuggaugcaugguguaguccaggcuagacccagacucaagaugaucuucccacuuuagccucccagaugcucccaggugugagccaucacucagcuacuucuauuuuuuuuuuuuugagcaugauuaagcaauucaggcucuugauauuuaauaucuugaaugaggaaguauacauaucccacuuuaaaaauguagauugauauuggugauauaugucacaagcuuuacugaugguauguuuccucauaaacaacuggggaauguugcuauagagacaagcugacauccugguagacaccucucuaagcuuucugguacucugaugaccuucaagugcuucuugugugucuguauauuacagguaacaacagccuccccacaaaacacuguguauguuuggaacaaugaucagcacuuuccuuuuauggaugaaacuagugagcuguagaaacagguccaaggacaggcagggcaggagaagagcaaauucaugacagaacccuguguguggugugaguucagagccuguuguuaauucuuacucuguacugggccaucuuguauuucccugcucucacaugguagacucaauaugucuucaucugagagagacacuguggcuccuucaauagauaguucuucaauaaagggucuacuuucacaugugaugggaauguuggauaaggucuuuggcaauuuuaacucgaaacucuuuuuccuugaaguaaauggguuugaugaaaaauuggcaugcguugaaccaucgguccuauuuuuagaaagugcacaugagaaauagucuggaccagccugacccuugugaaucacugcugaggccuggcucacccuggcaugacuaaugccucccuuuaucaugagugucugagagcaugaagagugaaccacaugggggacagaucucagggcagagcacaagccagauaccauguagcccugggugcaaucuccuguacuacaacccccaagagaaauggaacaauaacaacauccccucccugagcuccaauccccagauucucugguccucuuugaagccucccucaaacccuggaaccuuaacagcggcaagagcagcucuggugagaauagaacuggggaccgguagaacuugcuggaauuucaucccugguugaucaccuuucaauuuugagcuucuccauaaggauggucuacaaguucuugguuauuugggggaaugaauaaagcuauuuugguuuggccaaggaaguugaugguucuauccauagcgaaagaaauucuuguuaaaucuugacaaauaccuuuccuuucuuguuguccuuuuaggccauuucaagacucucguucuuccggcaguaaguauucauuuaaauuauuuggcuucaauaaagaaauaaaugccaaaaauuggcuucagaaauacauugcaagcuggguguagugcuguacaucuuuaaucuuaacacuuggggugaagggagggcagaggaagacagaucucugaguuccaagccagccagggcuacauagagaaacccuguuuccaaaaaccaaaaaaacuaaccaaaaaaccaaaccaacucuccccgccccccgaaaaucucaaaacaacaacaacgaaagaaauauauuauaacgaugacauaccuuuuuacuggcucuuaauuacaucacuuguaaguuuuacuugaguuuacuguacuuuuuaagagcaaccuuaacuuuagagagauuggcuauuauguucuugaaacuccuugcagggaguuuucuucaauuaacuggaccauuagaucacuuuauuguguuuggcccuauuccugcauuaauacuuuucuuucuuuucuuuguuucuuuuuaaagacgaggucucacuauguagccaaguaucuccggcuggccaugaauguauagagauuuccccgcuucugucucuuuagugcuggauuaaagccaugcacugccaaccacacccggugacuuuuaaauuaacguuuuaaaacgacacauacuaguuuucacguuaaacguuaacauguguuucauuuuuuuuguuuuaaauguauuucauguuuuuuuucauaccugcauguacucuauuuugaucguuagccuuucauuacccucucuuguccccuccuaucccugcugaccccuuuccuguucucaacucguuuucccuuuauuuccaggccuuauuuugguaucccagugcagacucuaguuuuugaagcgagauagaucagagacuuucuggacauauuuaaaaucaccacaucauguuucuucuagagugauauagcacgugcuagguuuagaccugggcuggcagccuggagugcugucccuaacucucuaaaccuaguuucuuugugaaaugguuuuagcagaagaauccagucaaggguggguguggaauugggcugagggauuaucuugaggucaaaugacagagaacaugugaacugcucaaugugguuuguggucuguucguaccacauggucguauucuguuguuauuaauaguauuaaaaauggcggcauggccaccaaucgcaugcugaacaggguauaggaaaagaaagcaucacagaugaguguuugagagaauauagcaaggaaacaaacacugguguuucacaggcugauugccucaaacagugaaagcgugggaaagcucacgggauaaggguugggggcggggugggggagggggugggaugagauuuccaagcuuaacagcugugagaacaaaccugcaguagaaaaggaaauggugguggugguggugcaacauuugaaauguaaauaaaugaaauaauuaaaaaaagaaaaggaaaaauuaaaaaaaaaagugacguaacuccugcugagagagacagguauggagcgagcgucccucauuccagaaucucucugaucuaauugaagagcagaguacaggauuuuaaaggcaauaaagcaaaguauucagcuuugauaccuacaaaggauacguuuuucccaacacuacaguucuuuuugauaauacuauggguuuaauuguuuuauucuaacuuguaauugaaacuuuuuuuuuaaaaggugaaauggugagacuuugauaugucugaucuuuccccauccagcuaccucugagcagugcagauaagauuuaugagcuacacauaaacggacaaucagagaaugagaucguauucuccaacaggacacguuuaacauuugagagcaagaguauaucuguccucauucagacagacaaggcauucuacaagccgaagcaggaagugaaguuucgggugcucacacucugcucagaucucaagccuuauaggacauccguggacauuuucauuaaggugaguggcaggcugacgugaaggggggacuucaagccaucccucuaaggcugccuugaggguucugcucauagucgugacacagugacacagaguuucaccucucaacacggcgauccuuuggagggaggugauggaaccucagaguucaggcaauggagucugccaguucaugucuaauccuggcugcaucacuaugaccuauccacucacgaguuugcuuacuggacuuuuguuauccagacacugagaacagauuaagucccuguucauguugaauuuaguuuucaauggguggcaaaaagacagaugauuaauguacagacagacagacauacacgugaggggguagauauugcacgugcgugauaaugugugaucaggagaaccagagaaccagagaugggacagagagcaugaguuuaugguuagcacuuuccagagaguugccagagaagagcggugugagcagagaccugaaugaaauacaaggguggacagauaagaacagagaggucacuacauaugagugcccgaagggcacugagcauagggagugaagagauacuuguuaagaggugauguuagauacagcugcuggguugaagcauugagcucauauuagaucuuguuagggauuagggauguuagauggccuggacuuuacaaaguauauaugacuauauaugagaauguauacuugccacauuugacuucugggaaggaugcagagagaccuuccucuguuaggucugauauaaagggguccaucuggccuggccaacguguagugcuccugccuggggaagguuguucacacugaaguucaaugcuuaggaacagcgagcagggguggucauaaaucccccuugaugcugagcuguaaggucaggacaugcacucacaucuagccacacuccuuaccgcagaggccagguaggaggcuguggaugucugcuuuguuguucuccagccgaaaauagugauuugggacaggacaucuaauuuagccugcaugccgacuugccgauaauggcugagaugccgauacucgaagauaucauccuuagggucagauauuuaucauggcggcauuauugagggguguucugugugucugugaggagcauugucuauuauaugcccaucuuuucuucugucuuaguaacucaccucaggaaggacagugacuuuagaggucuuccagcaguggagaaagcaagcccuaucuugcccugcauucucuccuauagccaguuuagcauuacaguguagaaguaaguggcuuugacauugcgguggcagcugccacagcuggcuucugcuucaaaaauuugcucugguuacaggcaaauaaccuuguguggauauggcuauuucugacuuggaggguauauucuguuugaguacaggugacuguguguggauacagcuauuuauggcuuacaggguaugcccugugacugcacacuggugcucuggcccucuagcuccaagaacaacguuguaauguggaagugucaguuuauccuucuuuugcuuaaagggccaugacaccaucuaggagaaaacucagcaccauaacauaucagcagcauuuuuguguuccuucucucguaggcaacaccuagaauuacuguauuaguguuucuuaaagcuuugcuuacuggacagaagaaccccagccuuuaauugauuuuacuuccuuagccacaagacagcauguguuuauagcuauuuguauuucuuccugagcccuuucgcugcacaacucucccuugcaucacacuguggcagguacaacagagccaacugcuggucacagugcacaaaccaggaauuugcccaggagacacucaucugcuuacucuugaccugccuuacaucacugauuugaagucucuggcugccacuacucaguucucagaaccauauuuaccuacagcugucuccuuuucuaauacuccuucuccaggauaauuuuuuuuuucuggccucuaauaacugggugggcucaguauguuuagucaaaggguagagaauaagagaaagugugugauccuuggucucaagaguucauaguguagcuggaaacagauuuuuguaaaauaaaauguguaaagaaagauuuucacugcauuuuacagugaaucguacucaagaagaguaaaccccagacaugccagaggccauucacaaagagcucccugugcagcagggagcugagcuuauuuuacuaguggaugagagagggagggacagucccuguagcagaggcccagcgguguagaguucuguggugaacugcaaagaauguuuaugcugggaagaagaaccuagaaguagagauccugcaaguguguggcccucagucuguggauaccaggaagccauugucaccuaggggccugcugugauuauaacugacucucuuuacuguuagccugggucaagcuuuucaaccccaugugcguucucagaucaacuguucgggaugacagggugagcaucaagcaagaguggaaggagggaucaguggcuuuguuagagucgggucugguggauuugugaggggggagggaccagugucaucguuagagucaggucugguggauuugugaggggggagggaccagugucaucguuagagucaggucugguggauuugugagguuggagaggaggcaaaguagacaaagggcuggacagcauugccaggaaugggacagugagaaaugaauacuuugcauggauacuguaggaagccacuuugucugugagguuguggggagaugagaacauuccucauggaccccuaacuaaauaguucucugauauacuuuggcugagcagagaguugacaugaguuugaaguuugagucccaucauguguuguugcuauaauagggagccacgccagucaaugacagcugaguguuuacuaacgccuccaacaggcagcuuucucaacaguagggaaaggacaauucuaccucuucuuucugucccugcauaguaccauuucuguuuucauaucacacaugcacauacacacacauacacacauauacacauacacacaugcacacauauacacaugcacacauacacaugcacacauacacacaugcacgcacacauccacaugcacacauacacacaugcacacauacacacauacacaugcacacauacacaugcacacauacacacauacacaugcacacauauacacaugcacacauacacacauacacaugcacacauauacacaugcacacauacacacauacacaugcacacauauacacaugcacacauacacacauacacaugcacacauauacacaugcacacacauguacacauacacauacacacaugcacacauacauacaugugcacauaugcacacacauguacacacauacacacacaugcacacacacauacacauacacacacacacucccuuuauauuaaaauguagauuccauauaugagagaaaauauagcauuugucuuucugagucugacuuauuuacugaaggagaauuauaauguuuagagguaagcuggaguaccuagcccagugggccuuuaaugaaugaggauuuuaucucaacagugagaauucauuucucucucucucucuuccuccuuuccuuccuuccuuccuuccuuccuuccuuccuuccuuccuuccuuccuuccuuccuccuuuuuaauacacacaaaguugugcuuuuaugauuuucauacauguacaucacuguauuuuauuaauagucacccucuaucaccugguuuucuuuccaauagaggcuuucauguuauauguaagcgacaugaauauauauuugcauauaaugauggccaaguggugcucauucuuuuccucucauuucuauguguucuuucuccuuuugcauaguccauuucuacuuucaucucucucugucucucugucuucugucucugucugccccucuccucucucucucucucuuucucucucucucucucucugucucucucucucucucucucucucucucucucucacacacacacacacacacacacacacacacacacacacagauacuuccucuauugaaauauagguuccauuuaugaaugagguauuugccuuugugagucuggcuuauuucacuuaacacacugucuucaguuguauccacuuuuccugcaaauggcagaacuucauucuuuuucuaaaaaauuaaauuaaucuuuuuuauuuauucacuuuacauuccucucacuucccccuuccaguccucuccucccacaguccuccucugagaggcuccacccagcagcuguugcagaccuucauucuuuauugugcagauauaccauucuuuauuuauccaauucucuguugguggccauuuuaggcuggcuuggcaucuuggcuagugugacuaauucugaauaaacauggaugugcauguauguugacuuagguccuuucaaauguauguugagugucagggucagaucagguggugacccuagcuuaguuucuugaggccccuguauuuugauuuucaugugugugcacuacuuuguauuuuaguggcgguuucuuuaagccacucaugcgaauuugcuggcgugcaugcuguauguccucuguagggggagcuauggcgucaggaaugaaaagguggaucagagucagcuuggcuucaggcgaaguaagaggaaaggaagaaaccuugauuugucuuccuuagugccauagauaugucauuucccgaaaacuuucuguaggguugcuuuucucauugccaugacaacauaccuuucagaagcaucuuaaggaaggggugguuuugguuugugguuucagggugcagucuaccauggaagggaugguggcagugagagcagcucuugccugguggcaggugugugaggcagcuggucacacuacauccauguucaggaagcagagggagaugagcucugccugucuccuggcuucucuucuccuuucccuuuuacucagucugggcugcuagcuaaaguucgcuggaagcaccuucaccgacccacccaggucuaugucuccugggugauucuaaacucuaauccaggugacaauagugcuuaaccauuacaucaucuuagugccauauuuugggggaaaguucuagaugugucugggguggugggucugacaguacucucaggcaucauuccuaaguagcacacacgugccccugggcagccuuccacagcuaacacacacuuguuucuguugcaggauccgaagucuaaugugauccaacagugguuuucucagaaaggugaucuuggagucguuuccaaaacuuuucaacuauccucuaauccaauauuuggugacugguccauucagguucaagugaauguaaguauaaauguaucuuugggggagaauguaaaaaugguuuaaauuguucauaugguaaaguuucuccuaagccauucuauagacagaaauaaauuacuaugaauaucuagacaauuuagugacuuauuguuaauuugcuauauuuuacaacagggcuuccauuacagucauuaucuuuuucuaucauagaguguuuggagguuuagacauuuuggcauuuuguucuaaagcugauuaaauauuuauuuauuaauugugugcauugaugcuuuuuagacugagcacuuaacacaaauuuauucguuuggcacauuugauguuucagaauaaggauuaaaaugggauuggacaaaccugcuuugaucucguuguaagaaacagaggcuuuaaagagucacauugaccccugcucuucuggccuugucccucaagguuccccuuguauucgcuucccucacacgcagguccgugacccggcaggguaggagcagugcagugcccucuguugugucugccucagcuccccgugggcgcacuacuuucuucucaguuaguuauucuauuguugcgguaaagcaacaugaucauaagcacuuugcagaggaaauggcuuaugucauuuccacaucauagucugucacugaaagaaaucaggacaggaacucaaacagggcaggaaccuggaggcgggagcugaugaagaggccucggaggagugcugcuuacuggcuugcucucgccauagcuugcucagccugcuuccuuacagcacccaggacuacaaauugccaacccuagccggcaucaaucgccaacagcucccuugcuaguguuacacuuuauaaguuccuugcucaucugugaugggauuuugguuggcuugaucuugugcaggcauuccucauguauuuacauccaccgugaguuuaugugugcagcaacucugucguggcugcuaccucuggcucuuagaaucuuuuuauccucagaugacacaauagccuugaaggcgagaaggugugauguagaugcuagucacuucacaaucuuuuaauuucugcauaucgacaagccgugggcuuuguguuaguaucuacaagaagcuucacuaacaaggguugagagaugcaugaaucuaugguugaaagauaagaacuuagcgggcaauuuaauucugucuacuuagugaaagaauaauauagguucuccucuagggccugugaccuagacagccauggaccuuuugccuaguuacuugacaugaguucugucuuguggagugggccuuaaauccaaguagaaagugguuggcugaucaaauaucacuugugcaccuugcccaagugggcaugucuugccaauuaccucacuauuguagacacagggucacaauugaguaagaguugauuauuuucuucuccuaggaguauuuauagaaccucccagauagccaguaggcacuaacuuucuagauugguaccagcuugauuccuccauguccuguaguuugaauaugcaguaucuucuguaauagggccguaccaucagguucuggaguguaacuaggaauaaggacaauagccuguaauuuuggggguuaugggacccccccaccgaacaacuugaaaagaaccccauacugucccugggcuuuuuauuuucuaguuucugaaaucugggagaggcauuucccuacccuacccuccucccccauuauagggcaacucgauuuuaacuccuuuuauaugauuauauguauugauuuuaggaaacuuaaaguaguaguuuccuauauguaguagguuucuauguggccuuaaaaaagucuuuaguguuaguugucuccucuccccauggcucaauacucucuucucuacaacacagauauucuugacucaaacaugauaagaagaucuuugcaagcacauagaaugugguucuuaugacaucuuagaauuauauaguuccauuauuaagauauuuacaaggaaacaacccagaagaauaauuuaauucaguguuugaguuauuuaagauauuuaacuucuuagaucuuuuuaguugguacuuuuguuacguauguauguauguauguauguauguuuuucaagacaggguuucucuagguauauguccuggaauucccucuguagaccaggcuugccucaaacucacagggaucugccugucucugccuuccaagugcugggauuauaggcauguaccacaacugccuggcuuauuuacuuauuuuuaagauagggucucaauaugucugccccugucuccacgguacggggaucacaggcauaugccaccacacauggcuugcccuauuugaaaguagcgugaugggucgauaugucuuccacaucucaaucuuggggugcuucucaacaggcuccaguggaggggucauaccugguauaauggauaagcucauuuguccggucuuuaugauauuagucaaaauauucacagaugugauucauuauuggcagaaauuaauccauccauuugcacuucaaaauaaagggguccucaccuuacagaggaagaucauucauucacgugcugugacucaagugagccucgagauugcucugaaugaaaucagccucaaaaggacagcugcugugugcucucguguaaaugcaauauuuaggauauagaaaaccagugaaauacaaaguggaauggcagagaccaggggguggagcgaugaggagguggaguuguuuggacgguguaguuucuguccugcaaggugaagguccagggauuuguuuccaaccguguagaugcacuuagcacgacuguccagugcucagagauggcuagauggcaaacucaugucacuguaauuaaaacaagugaaaaaucaaugucaacuaugagauaggguggucauggaguguguaauaucuauauuacuuuauauuuuaugauacacaggugaguaauaucuaauuuuuauguaaacaccagaggugcuugacaugaugugucgggugagauguaugggauagcucuugcuugaagcagccugugggauacggugagggaaccgacuuaaaggaaggagucggugcuaggguccuacuagacgcuuacaucugcugacuggccagaggugccuuugccgauguuuauauaucuaccaauuugagccuugauaauucagcugcucuuacugaauguguaacaugguuuuaacgaauguuggaggcaguguugcaaacgagguucauacaggcagugaguaauucguaaggauuaaaguuaaugucugugagaucuguagcugagggauuugcucauuuucuggauuuauagcuuagugugguaaugaccaaacaaaacaucuaaaccugaggauaauaauauuaauuuggagaagauacaggauaccaugagaaauguugguuuuuaagggucucucagugugaucucucaguaugauggcugauauaccauuaugagaaaauaaacacauuuauauuaugucauguagaaaauguuuacgaagguuagggucuacucccaggaaagcacaggugcaguauuuauauauguucccauuuguucuucauagguaauuuugugacauggguacaacuauguccauuuugugacaggaagaccacagcauagcaaguuaacuucuuagguauacuucuguagaaaggagaccucuugcucaacuuuuaguucaguucagaaccaauggcagcuuucuagucacuguauugcuuuaagacugaggccauccaugcuauagcaaagaacagcaaugauaaucuacaaauauauaaugaguguguguguauuccagccccgggagcuggcaacagugcuugcauuaaguuagcaguuauuagaugucuuagucuaaaugccguuucccccuggaacacuuuugaagguaucauuauccuucugacaaagacaaacaccaagugcucauuguucaugaaaugucaauaugaagcauacaacuaagaaaacaacaacaacaacaacaacaacaaaaaacccagaaaaaacaaaaaacaaaacccccaaacagaccucuuuaacaaaaucgguguccaccagggggcaguguaaucaaaggcaugcuugaguggugagcugagaccucacuucuggcuuuugucuuugcuugacuccugcuuugcauucggggcuuuuuuauauuuuauuaccuacuuuuguuuuagcagugagucaugacaauggaugagauauacucauuauuugaaugcuccaucaucauauauacuaguuuuuuuuuuuugagucaguaaccauucucaauauaaacugggaaaaauuauuuuuagaagaggaauuagaaauuucauucuauuuguagaaaaaaaaccccuaugggaugcuuuaagcaccacagugggaggacgugcauuagcacuggaggcuuuaucaggggucugagguguagugaccguagguaaccaggcaguggcaucuuuagucacauguucccucaggucagcaaagggaugcuuagugaaacacgcugugcgcucccuggaauuuauccaauucuaccauguucauuuaaagcagugguucucaaccuguggggcaaaauccccugaggauagggugaccuuuuugcaggggucucauaucagauauucugcauauuagauauuuacauuaugguucauaaaaggaaaacugcaguuaugaacuagcaacaaaaauaauuuuauguuugcaggucaccacaacaugagacccuguaguauuaaaaggcugcagcauuagggaggcugagaacuacugauuuacaguguaagacagucagucacucacugacucuuagacgcucuagaauaaucgagauugcauuuggucaucauguauugcuuucauuuucagcauuuugaaguaacaagugugcgugcgugguguguguguguguguguauguauguauguauguaugugugugguaugcauauggaugcaaguguggaggucagagcaucuuuuucuaaaaauuuuuaaaaagauuuauuuuauguaugugagaacauuauggcccucuucagacacaccagaagagggcaucagaucccauuacagaugguugugagccaccaugugguugcugggaauugaacucaggaccucuggaagagcagucuuuuucuauuuuauuuuuaaauaaaauagaaaaagauuuaaauuuaaauacugaguuucaucuuaguuuuuuuucuuuuucuuuuuuuuaaagacagacucuaucccugaaccuaaagccccccacccccuuucugggauccgccugucugcccuucucaguuauagaugcauuaggugccuccacacccacccugcauguaggggagagcugggcuccuguucucaggcuuaugcagcugcuagcaucuuucaggggacguaucucuccagcccaagugccuuugacuguggaacauuucuaggucuucauucccauuccuguagucucucacaugcaguacaggguagcugugggucucagugaauuuucuauccauucauagaugggccaguuuuccaccacuguuacguaacaaaaguuacaaagcaacagagcgcuuugaucugucuccucaucuuacggaugaagggauguggccgaugaggaucacacuguuuaacaagguuggugcucccagaggucagaagagggguuggaagauggugaguuggaaugaggauguugagagcugaacuugugcuuucuggaagaacaucccgugcuaucacccacugagccaucuuccaaccccucauuaaaaaaaauuaaaccccucauuaaaaaaaaauuaaaaccauguuuuauguguauggauguuuugccugccuccaugccuuuguaccacaaaggcucguggaggccagaagagggcauuggagccccugaaacuggaguuacagauggcgcucuuaagcacugagccaucucuccagcacuauuagucuuuuuuuuuuuuuuuuuuuaaagauuucauuuagcuuauuaggcuuuauggaaagauccaguagaaauagggaccuaaguugaagauguagcagaagucagagguuagggaugcuguaaaucuugugagggaacagaaaagagaugcuagguauagggaagucuguacuguuagacaucaagaauggaagaacauaaagccagguguaguggcgcauaccuuuaaucccagcacuugggaggcagaggcaggcagauuucugaguucgaggccagccuggucuacaaagugaguuccaggacagccagggcuacacagugaaacccugucucgaaaaaaagaaaaaaaaaaaaaaagaauggaagaacguaaaucguuaaaaggagagacugagucaaaugauaaacacaacuuuugauuuuaccuucucucccgugggcauugcugucucugucuacucaguguuccacaaagaaaagcaaccgucugcucuccccaggcauuccagcuugaagguuccugcuuucuugugcauuuuacacaguuugcucuuaaguucuuuucauaauucauuuuaggcaaguccacuuguaggcacggccucaacuuccauccccaugccaacgacucguuugucgcugagaggacccaggccuccaagccccagaucgguaccauccuuuugaucuucucucaccacaucuggaucuuuuccagcauuuuccacuucgcugaacuauuucacccuccuggcaguugugcuagcugguaaccuuggcaucauccuugacaucuuacgcucacuuaccacccaaguccagccuccacgagcuccuguggcauugacucuuauggacaugucagauggacccauuucuuuuucuuuucuucucuacaucccuuguuaaaguugccaucacaguuucaagagucuauuaguuauccucuguaaauuuccuuguuucuaacuggcaaaccauucucuacacagcaguaaauguaaucuaaacaguagcuggaucuguuauccuucagcuuaaagccuucuaaacacuucucauugcucucagaguaaaauucauguuucaccauuguuuacccaaggccuugcuugaucagauucugcuucuucaccucaucuccagucuucgucucugcagaucugacccacacaguuuguuauaguugguaacugcacguaaauacaguugauaagcgccuuuucacuagaucauacucucauucuacuuccaucaagcgcccgauauucauuuuuugcgguaguagaugaaagaauggucaaagaaauggauggaugaauggguccuucaugcuuccacuuggagauucugauucaguagcuccugcugggaaauggacaucucucauuuguuaagcccauuguagaugacucugcaugaucuagguuggaauuccuagagaaagacaucauaacuacagaucagaguacagauguuugggcucuaaacacagcaaagaaagggcaauauaaauguuaauaaauauuuucagucacuuggcaaacccuuuuauuaacugucaugcuuccaaguaagucagaauaaacacagugacacuuuuuauaugaugauguuuccauugugauauuuuguuuauuuauaugcuuuuuaaaaaaaccaauuuuauggugaaaauaaaggaggaaaaaagauugccuaauaguuuauagucaagauucaaccuuacaauaaggaguugagguggcuuuuauguaacacagugaccuggguugggagucaugaggaccuuagaggcccuagauuucauguaucuaauguagagaguaguggaccaggaaucacaacgcuccagguucccaggccucaugcacaaaugcagagagcacuggacuggaaauugcagagaugagccuuagugauucagcugagggaccaugggaacaacugaccuggggaugcgagccaaccaguuuacucauuuguagacgaauucauucaauagauaccaacagcaugcugaauuagcuacugugcuauaaggacuucacaguuccuuaaagaagauggagcaaagcaaaugauuaugcuaaacggggagcaggauauugugggagagaagaggcauucugaacggcauggggaaggcuauugggaagaggccccacccagauacaccaauccaggauguuugggaggacauaaugaaagacauguucagcaaggggauuugagccugagucucucuguugagauuuggacuagagauaauaauuuaggaaucuucaguauagaaacaacaauaaagauccuuaggacucgucuaccauuaaagaacuucauauguuguuuuucauguacuaauuaauguuugcuguguaugaacuuuaauucaacagagaugaucucauuccacaugcuuuuaaaaauuuaaaccuuuaaaagaucaucuaucuaucuaucuaucuaucuaucuaucuaucuaucuaucuaaucuauuauauaaaauguccugccagcauguaggcauguguaucaugugcaugucuggugcccauggaggucagaagagaacauuggauuccuuagaacuggaguuagagaugaugugagccaccauguuggugcugggaauggaauccagggccucuggaagaacaacugcucuaaacccugagccaucuccccuccuccuuaugcuuauuuguguugaucucagcauuuacuacugaggccaaacuauuucaaagaagaauuauuuaucagcaagucagguaaauguagguaaauuacugcaucugaauccuacucauaguggauucccuuguuagcaagccaccauccagcugaucugugugccagauugcaacaaaacuaaagacucuucauaugguuggacauguuggcugagagcaucagaauuucugauaagacagaaagcaaagaagcauaggacauucccggagucuggcuucgucugugccuuacagugucuaaacuugugauguauauacuuuuuguuguuguguugagacacaguuucucuguguagucuucuuuguugucagguuguccuugaacugagagauucaccugcuuucuuccaagugcugggauuaaaggcguguaccaccaugccucgucaucucuacuuuuuaaaacaggguagcacucugcugucugagccugcaguuacgucuuuuuaacacuagguaggacucugagcagaugugugucaauucuacugugaucuuagagucauauaauauaggaccuugguggugguagugguggcaauuuuugaagacugcaguuaucucuaguuauacaccacuccauaaguaacccauaauaaacucguuuuauccaccacaaugguauugcuugaggcacuuuuugggaugcuggugcuguuuuaauuuaggugcagauuuuaauuuuauaucuuccuggaaaaucaaacuacaguuaccuucuugauuugguuuuugaagauaaccaacuuuagugaaucagauacaugcagcuuauaauauucccauauaugacaugcaaacauuugaaguagggaguacggaucauugauaaggaaauucuuaaggcucauuuaaguaacacauuuauuuacaauguucuuuaaaacauccaaagugugugugugugguaugcaugugcccagagaagccagaagaggguaucuaucagaucuggaccuggaguuacagaaaccaaucuuaaguccuuuggaagagcagcaaaugucucuuaaacacugagcuaucucuccauucccuauuuaguauaaccauuaagugaugauauuuaaaccaaauuguaaacagcuuuucuucagcauuggcaauuaaacccagauacugauaugugcuccucaaggcuugcuacugauuuacgucccagaccuagacaacuauuuugucagcauauaaagauuuguuuuguauuuugaaguaucuuuucuuucaagguuaaguaaugagaaccauguguggugaugggaagcugagacaggaggauuauuauugguuuuaguugagcuuuaaccacauaggcugauccaguccguuuugagcuauaugugagacugccucacauaaaaaugaaaugaaacaaaacaaccaaucccaccgccccaauuaaaccaagucaaaacaaaaaaccaaccaaccagcaaaaaccuuaaaauacacacuuuagauuaguuguuauuucuaggaaagcuacaguucuaauggugcagcucuguuugcuaggacaaauauagaaguuuaagauuugugaaaucacuuggccauuuuaccgagguuuuuguuguuuagaauuuguaguuaugaccaagccugcucagucagucaacagguucuccagugaaggagagaagauuaaagagaaaaaagacaauuagacaacauuguagcagggcucagucaauucugaaacugaaggcagguuuaauuuuucccagucugcuuuuauaccauuuuaguuacaugcaaguauuaagggcgaguagcacaaugaggaaucaagcaagacaauagucaaggaacaagcaagacaauaaagccccaugaucacuguuugaucaagauguuccaacugguaauaaggacacaugcuccacuauguucauagcagccuuauuuauaauagccagaagcuggaaagaacccaaaugccccucaacagagaaauggauacagaaaaugugguacauuuacacaauggaguacuacucagcuauuaaaaagaaugaauuuaugaaauuccuaggcaaauggauggaccuggaggauaucauccugagugagguaacccaaucacaaaagaacucacaugauauguacucacugauaaguggauauuagcccagaaacuuagaauacccaagauacaauuugcaaaacacaugaaacucaagaagaaugaagaccaaaguguggucacuuagccccuucuuagaauugggaacaaaacacccauggaaggaguuacagagacaaaguuuggagcugagaugaaaggauggaccauuuagagacugccauauccggugauccaucccauaaucagccuccaaacgcagacaccauugcauacgccagcaagauucugcugaaaggacccugauauagcugucucuuuugaggcuaugccugugccuggcaaacacagaaguggaugcucacagucagcuauuggaugaaacacagggcccccaauggaggagcuagagaaaguagccaaggagcuaaaugggucugcaacccuauagguggaacaacaauaugaacuaaccaguaccuccagagcuagugucucuagcuguauauguaucagaagaugguaugguuggccaucauuggaaagagaggccccuaggucuugcaaacuuuauaugcuucaguacgggggaaugccagggccaagaagugggaguggguggguaggggaguggggggggguucugggggauuuuggggauagcauuugaaauguaaaugaagaaaauaccuaauuaaaaaggcagauaauaaaguucuuuugcauuagaauuuuaaaaaauuaaaaaaaaaagauaucugagccuacuucuuuguucuaccuuaaaauuagauucuuacuuccuuguccuuggccaaugucaggucccugccugaacuuacuucuucgucaugcccuaaugucacauuccugccuuggcuuacuucuuuguuguggccuaaggucagauuccugccugguggcaccccaaaaggcuauccacauaguuagaauuguaaguuagaaaaugacaaaugagaaaaccuauuuucuugugagucuuggaaaagggauuaauuaauaucuguuaaaucaggauaggauguauugguuuaaauauuacaguagaaaagaauucaagggauuagaagguggaauauguuguuucaugauaacuuugucgucaugauauuuauaaacauuuuaauuacgaacaauuucauuuuuuucuguauuuuaaaguuauauucaaaacacaguugaaaucauuuucuguuugguauguguugucauggcuucauaaguuuaugaacucuucagccuaaguuuuguuuugcaaaugaugaaaaucagauuuguuuaaaugacuuguaauuagggaaguuauguguuuuaaaaaugauuuauuuuguguauauugaugcucugucugcaguuauguuuguguaaagguguuagguccucuggaacugaaauuaacagacaguugugcgcugugaugcaggugcugggaacugaaucaggauccuuaagaagaacauuucaugcucuaaacugcugaguuauauaucaucaaaaauucaauucaaaauuaaaauuuaaauacuuuuaugcagagaagaggguaagauuaacucauauuuauuuuugucuucucuucccaauaggaucagcaauauuaccagucauuucagguccuagaauaugguaagaguuauucauuuuuugaagggaaacuguugcauuuauuacuauauauagagaugagaaaauuucaagagacaugcuauuuaaaauuaaaaucccaauaaagauauguuuaguauuccuucuaggauuaaacauuccuuugcaaaugcucugaaauuauauuauuauaaagcaaaaagggggcaagaucuaacauuccacaaugucagucuuuucuuaugacaauuuuucuuuuucuguuuuuuuuuugagauuuacuuauuuuuauuuuauguguaugaauguuuuaccugucauguauguccgugcaccacaugugugcugugccugugaaagccagaagagggcauuggauccccuuggaccuaaagcuacagauggcugugagcugccauguagauuuuuggaaucaacccuggguccucuugaaaggcaguugguucccuuaaagaauuagcugucucuucagccuucugguuuuguuuuguuuugagagagggucucuucauguagugccaucuggaacuugcuuucaagagcaggcuugccucagauuuguggcuaucuucuuaccuuggccucccaagcaccugguccccccuguacuuauaaaauauuauuauuuuugacucuuggaauacuaaacauuggaauuggggaugugguucagcugagagcaugggcaaggaccugaauucaguuccccggaccaaaaaacccccaaauuaucaaucugacaucagcuacuuuccauaaaucuuuauuugguugacacaguggagacgguguucagcuaagguagaacaucuucgugcaggcgccauauugcauuuauaaguacacaggcgaaagcaguggcuggcuguucuugguggauagagagaaggcagagaugaguaaaagcauaaggccucucuaagagcugaucaauuagugucuuugaugagcccuuuaauuugacuuagaaagcccuuugugaucacuuuuaaccugggcaaaagaauucugaaaucuaguuuguuacaucuuugugauuccagccccucuaucuuccaugguacuuuccuauccaugccauggccuggaacagggaccagcaaaguauuuuccugugaugggacuguaagccauaguaucuguuucaguugcucaucugugucucuauagaaugauagcagacacagccaacacauaagcaaaugccacuauccugcagcaagcuuaggcaucaucacacauuucccuuuuguuuguuccaaccaguuaaaaugaguaaaagccacucuuagcuuaggcuggccauaccauucugccacuccuuaacuggaauuuugugugucacccagaggcccucacccuauauagguguacagauacagacauguaucugguuccaauagagauguguuauacauguaaaauucaucccaacacuuagugcaagaaaaagaaaguccauuuauaauacauuuuaaauuuuugcuaaauauuaaagcaagaagacuuuagacaaguuaaggauaauauugcaaaauuuacuuuaccuguuuaguuuuuaaaaugugaucacuagaaaugaaaaauuaaacauguggcucguauuuuauucccuuuggucaauguucuaaaagaaaucauagggaagcgacuuuucauuuucuugagaaaggauuucauuggguacucuccacuccuuggaacuugcuaaguagagcaggcuggacuuaaacucauagaaauccaccugucucugcuucucaaguguugggauuaaaguggugagccaccauggcuggcaugaucaaaauuuuuguauguuguuuucauauuucacuguguuggugcuggggguauuuuacugacuuaagagccuuuuugauauuuaucuuacauaaauuguguuggugaggucccuuauaggagucucauguauuucuuuggucacugacauuaaaaaaaaacuuuucuauaggcucaagcuaagaccacaaacauuuuuuaaaaaagauuguacuguuuuuacaaaagauuuauuuaccuauaugaguacacuguaacuguacagaugguugugagccaucugugguuacagggaauugaauucaggaccucugcucacuucugcuccucucacuccgggccugcgauuuauuuauuauuaaauauaaguacacuguagcuguugucagacucaccagaagagcgugucagaucucauuauagaugguugugagccacuaugugguugcugggauuugaacucaggaccuucagaagagcagucagugcucuuaaccgcugagccaucuuuucagcccaaccacaaacauuuuuauugugguagaguauuuuauuuuaaggaauauuaauugcaaaacauuuugugggagcuguugagaugggucaguggucaagaaugcugccugcucuuguagaggaccuggguuugguucccagcauccauguaauggcucauaagcacugcaacuguaacugcaauuccagggacgccacauucucaccucugcaggcuccucuugcacaugugggaaugcacaugcauacuuucuggcacucacacauaugcaaaauggaugaguaaauaaacaaacuuaaagcaagcaaacaaaaccauuuuguuauuguauaaaguugaucuaaguaagacuaucugauugaguuauauaaagggcuuuugauuuauguuaacacauggauccuaauacagccgcauuuaagaacuaccaacuaucaacuugugagaacaacucuuauuuuugugugcgucagcuucagagguugaugaaacagauuccuuuaacagauugauuuucuuuugcaguguuaccaaaguucgaagucaccgugcagaccccgcuguauuguuccuugaagucuaaacaguuaaauggcuccgucauagcaaaguaaguugcauuugccuuuugguauggcucuaaacuguuguaaaacagcgugaaaaaaaaaaacccuucacaaacacauaagaguacuagcacaaaauuuuccuuuaaaaaaagacuucuacucuguaguaaucgacugucugcaauacuucauuuagcauaggagagauguccacaucuguacuucaagcugucauuccuaaaauauuucccacagacuagugaguaagagcuuguagaaugcaucgucaaauuucuaaagcauuggguucuagggggcgggaaaauaguucagaauggggaaaaaaccuuaacuacugagucaucucucuguagccucugcuucacguugaagccaaaauuaaaauaaaaaugccuuugagaauacauuaaguuauuauuuucaagcacucuaaacuaucauaugauacaaccauuuaaaaaugcaauauccuggcauucugguuuugccuuuauuuaauaguuaacaagacacaggcccuguuaggugcagagggcucgggugagugauuuugaugccaugguuucuagccagguccccaauaacuucacuguuuuugcuuggaaggaugguauauuugaagguggauuuucuuucuucuuucucuuaauuuggaaaauucugcauuugcuuuggaguuggaccagaggagagguuauuucugugucuaauuaacagauucaggaaacaucaguuuacuauuacaauuugugaacugcagaggaaaacuggcuuuacggguuagcccaacguuugaaauagagauggaaagaauccauuuuaaaaagacuuucucacaguaaaaugauuuacugaagaucgccuuuccuuuacgugaagaaaugucgccauuaugagaaggaauaauuaaggaaauaaaauuaagaccauucuggaaaucagucuugcgguuccucagaaaauuagacauaguacuaccagaagauccagcaauccucuucugggcauauacccagaagacguuccaacuuguaauaaggacacaugcuccacuauguucauagcagccuuauuuauaauagccagaagcuggaaagaacccagaugucccucaacagaggaauggauacagaaaauguguuacauuuacacaauggaguacuacucagcaauuaaaaacaaugaauuuaugaaauucuuaggcaaauggauggaucuggaggauaucauccugagugagguaacccaaucacaaaagaacacacaugauaugcacucacugauaagcagauauuagcccagaaacuuagauuacccaagauacaaguugcaaaacacaugaaacucaagaagaaggaagaccaaagugugaauacuucacuccuucuuagaauggggaacaaaauacccauggaaggaguuacaaaguucagaauugagauggaaggaaagaccauccagagacugucccaccuggggauacaucccauauacaaccaccaaacccagacacuauugcauaugccagaaagauuuugcugacaggacccugacauagcucucucuugugagucuaugccaaugucuggcaaauacagaaguggaugcucacagacaucuauuggguggaacacaaugccccuaaugaaggagguauagaaaguacccaaggaggugaaggggucugcaacccuauagaaggaacaauaauaugaacuaaccaguacuccccagagcugugucuaguugcauauguagcacaggauggucuaguuggccaucaaugggaggagaggcccuuggucuugugaagaucauaugcccuagaacaggggaaugccagggccaggcagagggagugggugaguaggggagcagggcagggguagggaauagggggcuuuggggauagcauuugaaauguaaaugaaaauaucuaauaaaaaacauaaaaaaaggacugugaagugucagagaauccggauugacaggagaagauuaguuugaaaugauguuuaaaaaauuaguuuuuaaaguuuccuugcuuaaaaacaaaauaauuuucuuuuugguagcuauaaauaaaugcauuugguacucuauagucuaaggucugacaaucccuccuggagaguucugggacagugugugacaguugccuauggugauuauaacuucauuaacauccagacauuuuuacaggugugaagacauccaggcgauggccaguccagguuucuagccugagaguuuucccuaguuuuuuuuuuuuuuuuuuagagcucauuguuggagaagcugugccuucccuuaauguucacacuucuguggugucuccucaguagguggaggccucagauuggcagcauuugagcugcucuuagaugcuuuaauucagaguuucauuuagagacccaaucugaaggaucacuauuuguuaagaacgcucuucauucuuugugcuuuuguuggugcuuuauguuuucuugggacagaucauugagaaguagcucaagccgaccuugaacuuguccugucucagccuccugacugcugggauaacagugcuacaugguggacuugugcuuuuuuuaaaaaauugcuugagaggugcacuuuuaauguaauucuucucuguugaauugcuaauguaugcuuauugaaagugauauauauuuuuuucuagcguguuccucugacaccaucaaguugaaaauguaauaauacaauauuuuaaaaaucguuuucagguauacauacgggaagccagugaagggaagucugucacuuacauuuuuaccuuugucuuuuuggggaaagaagaagaauaucacaaaaaguuuugagguaacuuuugcagaucuuuuauaauuuacaacagggauaauuucaaucucaauuaaaaaaaauaacuauaggacccaguggggugugguuuauuccgauuauuccagcccucagggacguggaggaaggaggguaagugguucaagaccagcuucagccauggagcagaugugagaccagcccaccugugcuuccugagacuccuucucaaaagucacaaagggacgagcaacaggaacagcaggagacuauaggacccagugaacacuuauacccauuuccaacauaacgcaauacagaugugguaaauaauuaugauucagaucacaguguggaaaauuuaaauuuauuucuaaaaguaaaguuuggauacagccuugcuaaaauaagucuguaagaaaaaucgagaacuuucuagcauuagaugagagaauaaagaacucuucaauaugacuguguacgaguuuuguuucuagaauuugaauuccuaaagugaaagguaaaaugaauuuuuuuuuucugaacaaaacagauaaauggauuugcaaacuucucuuuugauaauuaugagaugaaaaagguaaugaauuugaaaccgcuaacggaugucucggaagggaguuaugagaauguggacccguccuuuccugggccggcagagauuauagcuacugugacggaaucacucacagguuuguaaaacucuguguugucuguuaccugcccacugugcuagcaagucucaggagaggggauuugaugcuuuucuggggagcuuauuuaaugcuggagacuuuaacuuguggaauguuucauaaaacagugaaacucacgaucuaugaaaccuggacuucaacuucauaugauaauaguugcuauucgucgucguccccccgccccccauuucaacuuuauuuuucuagccugagaaaaacacagggggccuacauuuucaguggacuggcugacuuccucuucuuucuuuucuccuuugucacuuccuggacaguuuacucuuuuuaauaagaacguuagaguuaguugguuggagccuugcauuacuauuucagcagauugauucaguugacccaacaagcaaaaccucuucggucugugcuuucuucugggagaagagugugcuaaacuuuugucuuucucuugggauugugaucaguaacaggaguagacuuacgugcccugauaucuuuagccccuucagcagaaacuuagguggauacaucccccuggugaaaaggaacuuucacagccuacaugaugcaaucuccaauauagguaucucaagaauggcaagcaccaauguguuuuucaagcaacaugauuacaucauugagauuuuugauuauacgacugucuugaaaccaucucucaacuucacagccacuguaaguugguguauuuguuacuaggcaugaguccuggagaaacgaggcagacuaggagaucauguguucugugucuuuaaguaaaaaaggagauggcuuacuuuuccucuucagaaauaugaauguaguuggguggugguggcacauaccuuuaauccuagcacuugggaagcagagacagguggaucucucugagaucagaccagaacagccuggucuauagagaaaauucuaggacagccagaacuacacagagaaacccuguuuugaaaaacaaacaaacaaacaaacaaacaagcacaaacaaaaaaaaaggaaggaaagaaaaagaaaaaaagaacacggagaauugcuuccaagugacuuuugucuaauauauuuuucuauaaagucauuucuuuuucuuuuguuuuuuuuuuuaagauuuauuuauuuauuuuaugcauaugaguacaccaccauggcucucuucagacacaccagaagagggccucagacccccauuacagaugguugucagucacuauguaguugcugggaauugaacucaggaccucuggaaaagcagccaguguuuuuauccgcugagucaucucuccgggccccauuguuaauuuuuauaaggacuaaaauuuaauuucaucaaagauauaucaucaaggauauacuguauuuuccagagagaaugcagaauuaauacuuauuauuugaguaaauugaaaaaaguaagcuaggaaucacucaaaaugcugaugugauuuuucaugacauuuucacauguaggacauuuggucauugcuccuaucuaggcuucaucucucaacuugagugcauuuugccagugugcaggaugugguguuuaugaagcugagggagacccaggaagggagagcuggcuuuguggguggagauggagguuauuaaggggugcccauggaagagggagccuuaaugauggaugggugacaagauuuguaguguuuuaaauguuggagcacauuggugggagguagggagcaagaugagauaaugcaaaaagagcugugguuggcaagagcagagcacauucagaaaagugaccgggccuguguguuugccacagaggacuuggcuggauuuaacaggaggcaaagcuucggaaacucuaggagauccugagcgucagacagucucucagauggguugacuguuauacuuuaggcagugagauuuggagccuauggacacaggugggguggaagugggguggaagugggguggaguguguguguguguauguaugagacagagagagagagagagagagagagagagagagagagaggaggacuguuggagguuugagagaagagagcagcaguggccaggugugagccuaggaggcauccuguggugguggcaauggagguggagaggaagggcagagaaauauaggucuugguacucaaugaacuuaggaggugggggaguggggguuggugggaaaauugagauugccggucugucaggauuguggugguuagugaaaacaggaaacauauugauggucgcuugguacuaaugugccgacucugaaguaauuggcugucagguagagaguuccucagauggagcuccaggauaaggcggggaugagaauuuugagcuugggguguaaacacaaagaacuaugaagccaguccagcugagaguuggaaauuuugaaggaggaaaaaaacaaggaacugacagggagucagagugucaucacagcuagcgacccagugagccauguuuggccaccuguccucgguaagcugauuaaagcaggcaaauuagugaugaaaaacagaauggagauuuauucaggguggccacagugggauccagagacccagucccuccaggcucacuguuggagucaugaagugaaggcuuaaagagaggcuagcaguagggaucucuaaacagucucgaggcaaagcacagagccaccaacagaccaucacugucccuccucuauggaaucuagaaagcugggacucugggagaaaagucucccuucuggcugaugcagacccucuucuucucccgugagauuccugggggagcuggagacuuccgugacuuacauuccauauuucaauagucucauaaccaaagcgcaggauacaaguguguauuuagaauaucuucacuccugucaauuacaacagaacaaaaaggagggauauaccacaaaagagcuguguuggucaagagagccacaugacuaagguggcagugaucauggugccagaugcuuccuggagaagaguuuacuagauguggauuagggugcuaccaauaauugucaaaaguccagcauuaugagaacgguauagacagacuacauucaacugggcuuaacucuuuugcuuuuccuauuaucugucuuaaaauauuuuguuuuaacaauuaggugaaggucagccgcucugauggcaaucaacuaacuccugaagaaauagaaaaugauuuggucacaguagugacccagcggaaaaauaaccacccugagagucagagagaucaggaaauggauuauauccagaccguaaauuauacuaucccccaaaauggaaucauuaagauugaauucccagucauguccauuuccggcgagcuacaacugaagguaugaucuggcuucaugucacagcagugguguuauugcuauuguaacuuugugagagauacuaacauccuuagaguucaaagaccauggggccugggcacaugucugccucacauguaggggaaguguuagaacucacuggccacagugccuaagcucuacuuuggauguuucccuguaauuucaucuuaaggaccacagaaaguauagcaaugugaagauuuugauggagaagugacccacacccucaucuugguugguuuucaguuacuugaaaucaccuuuccugagcuuucucuccuagccugggcugccugagaaagucuaugguucuuguaaccuuuguuuugguaccagcacugccagagccagagcccuaacucggugggaacaacacuggugggaaugagcuccggccucacugcauaccccagccuggccuggggcucacuguguaguuccagcugcccucaacucaugaucuuccugccuuugcuucaugagugcugggaucacaggugugucccuugcuggaacuugcuuuauagaccaggcuggccucaaacucaaaacagagauccuccugccucugccuccugagugcuggcauuagagauaugagacacuacaucaggcuuguccugguugaguuuuugacucuucacuuaggugggucaagcaaggugugcuguuucuugcuucuguaugagcuuccuuugggaaggagaggauccaucuuacguuuaauuccaucuucuauuagcauuucucuguuucugaagugagggcuacgcuuucuucuucugugcuacaaugccaaagauccacccucaccuuuuauauuuuaaagcugucaaauucuguguaguaugacccacaaaaugacaaggaaccaaugucuggugaaugcguuucugcacggacacaaaaaucaaggaaucuggcuuucugugguuguucggcacuuagcauuucuucucaguuuacugaagcuggacauuuacacguuguugcuuuuguuacaggcuuauuuucuugaugguacaaguucugugacaguccacaguauguucaccucuccuaguaagacguacauccagcuuaaaaccagagaugaauauauaaagguaaugcuugugaccugccugagaauugcagccugauuugauguucuuauaauugguguguacauauuaauuaauauauauuuuuucuagguggggucaccuuuugauuugaugguuaguggcaacagacaauucaaggacuuaagcuauaugguaauugauuuuuaagguuuucuuuauugauuuacuauuaugugugugugugugugugugcccauguguaauguguauguaugaaugcaggcacuugugugucauggcauauaugaggaggucagaaagaacuuucaagagucgauucacuccuuuuaucauggauuccaacgguugaacucaggccaugaggcuuguguggcaagcaccuucacccaccuggcugccucucaggcuagugauuucuuggaguuuaaguguaugaucugcuacagauccaucuuaaguaauauuuaccuuaugucuucaucagacuuccuagcucguuacagauuagucugcucuuuuuuuuuauuguguaaucaauuuucuuucuucgacuauauuuauaucuucauuuaaaacacauaauuaaauuuuguaccaagaacaaaacaacaugugaauuucuagucuauagacaacaugaaucccuuggugagaauuaugaaauaugagaaaggaaauuaaagccugccaccuuggucuuguaguuuugcuaacugagcccucccauuagagcucuguauuucuuuccaucucaugcuagguuccaagacaaagaaguggccagugcaauaggggcauucucagaaaugacccugagugcacagaccaagcucagugcugggcuggcgagauggcucaaugucuaagaguauguacuacugcuuuacaaaagacccuaguucagaguggagcgcaccuguugggcagcucacaaccaccuauagcuucagcuccaggggguuugaggcuuuugcucucuguggaugccuguacuuauaugcauaaccccccaguacagaaacagauguagacacaucauuaaaaaaauaccauaauauuaauguaauguauuaaacauaaagaaaugcacuugucucaauggaugcagaagaaaggucuugauauccacacuuguauguuaaaaauacucaaugauguuuuauugguggaaauuacccaauuugacaaaggacaaauaauaauaaaaauuacugccgacacuuaaaaaaaaagucaaugcaauaggggcuagaaagagcaguuacuuuaauuuagucauuauacauuguauaaaugcacagaaaacuugaauggguuccauaaacauguacagauaugugccaacugaaaauuagaagugcaaaaaggaaauaaaaaucgggaauuaaaaauaacauuuguaaagggugacaugaacuguacugcgaucuuuuuuuuaacuuacguagauuuuuuuuugucaauaucauucauuuuuuucaaagauucauuacuggucuuaacaaucacaacauauuuuuuuguuguuguugaaauuuaaccaucucaaaauuuaucacagauuuuugccuguaaagagguugugaagauaacuuaagaacuuauccuagagauuauuauaaauauaacuucaguugaaauaugacaaucuuuagcaaaaaauuuuacucucuuucuuauuuauuuguuuauuuauuuauuuauuuuucagguaauaucaaagggacaguugguggcugcaggcaaacaaaguucaagaacuuucucuuuaacaccagaggcuuccugggcuccaaaggccuguauaaucgcauauuauauugcagaggauggggaaauuauaaaugauauucuaaaaauccccguucagcuuguuuuugaaaauaaggugagaauuaaggugaugauauuuaaaaauucauuguagugacaucugagaaauguaauauuucuuugcagaagaaucaguuauccacauugcugggaaacuuguauuacucccuauauccagaggauguauauuuuuguauuaggcaccacaguuauuugucagcugugauuccuggcuuuaagacuuuaacuuaaauucaucaaagucauuucaguauuuaaaaaaaaaaacaguugauccaaaauugcucugccugaaauuccagcggugacauggaccacgcguguguugaccucaguguggcaaugaggcagguguagagagcagggccauuggagaugugcacagaagcagagccgggauuuggauggccuacuccaucaucuggaagcuaacagggacaaacuuucaguaauuuugaugucucgcauuuggggcucugggugaagucuugucuccagugcaccaauauuaaguacuuagucugaguaaccagccugcacaggagaccaccucagccccagcuuugacaagaaacccaguguaaucaucucaaagaugccagaaagagccauuguucucaccgcuuccuuuacccuccuaugugugaaauauuuaaaaucaggcacccacacuagcgcagggucucgaugauccucauccagcgccgcccaucgcgagguuguguugauggggauccugcucgcauucccagccaucugcccucugugaucacaaauacccguaaccuggcaaaaucaaaacucuagaggcuuguaauuuaucagucagcuuuauaucaguaaauugucaacccacaaaaugcccacacaaagaacuuaaaacucaauugauauaaacaaaagcugcacacccagauggggcaaacgcacccuaauuauuaaucaucuguuugaaaaaucccuaauacuuacggcucccgggacugcacgguucugguuccuauuccucuagauuccaucuugucuccucaucuccaucucccucccugucucucuggacucuaaaacucccagccugccuucuuuucccacuuccuaaccacagacucuagccuuaccuugugccugcuuucaccugcauaaagacagcaauccacaagagaaucaguuucaaugagauuuguauagcucucaauauuaccuuuaaaaguauuaaaguguugaaaucaugcuuucuuuuguuuaaaauguuuuuuaauuuuuuuuuuuuuuguaugacagagaguaagucuagggcccugugcauucuagguaaaugugcuaguauugagcugcaccccagcccugaguaacucuaacuuucucuaaguauaauauaaacuucuauguuuuuaaucuuaugaaaaguuuuuuuuuuuaaaagaaguagcaauauauuuucucgugucugucaaagauucacuuuauaauaaccauguaaaaugggugaauuuuagaaaggaauuauggaggccuaaauaaggagacacacaucuagggaccagguaugaagcuaagagcaggguguaagauuaccuacuccagagaagcagaguauagcaaaggguguuuccaaagaauauuuuuuugacaaaugaaauagaaaauuucaauuucauuuucaaaaagauauuuucucugaucuuugcauaaugaucagaaagacuaaagugaaagaucaguuaggggccacacaggagguagccaggcauauuaauagucacuuagagggaacgucuugguugggcaguggaauccagggugcaguuugcuuuuaggauugagcuagaugacucggagguccucggcaggauuggaacuuucccucaugacagagaaguggucuuuaugaaguauuaguuggaccaggguuuguggaacauagacagaugaaguucaaggagccauggagacagcagagggggcagaugguugcuucggaccuaccgugguuuuccuuucugccucuucguuaagaccgugggcuucuccagggauuuuagauaugacuguucugugcuuagucugaggacugagaacugcaagauggaaaaaggaagggagcaagguagagaggugaaggauaauuggugcuuauaccacaugaauauguuucauggauugcaaacaugugggaauuugaauuaaaaaacaauuccguuccuuagggaaaaugguguaugguuuuuggaacuauccacgggccaaggcagagauggcaccaauggguuuugagccaucugaucaggaggaaaguuaguuuugcccucuccuuuucuuagguaaagcuguuuuggaguaaaccuacagucaagccaucugauaaggucucucucaggaucucugcgacacagucugacucccugguggggauuguagcuguugacaaaaguguaacauugauggaaaacuccaacaguauuacaauggaaaccgugaguuuaauuuucucuuguucgugugaaaggguugcuaacuauugcauuuauuaccuuaaagauuuaaagcaaauucauuagucccucugaauaguaacagguaauaacagaaaagccuuuaaaaggaaauuagcugccaggcgugguggcgcacgccuuuaaucccagcacucgggaggcagaggcagguggauuucugaguucgagaccagccuggucuacaaagugaguucuaggacagccagggcuacacagagaaacccugucucgaaaaaccaaaaaggaaauuagcugccuuccagugugaguugggcagagguacauguguauuuucuuuugguaucuauuauauuuuaaauacccauuauugccuuucagguuuuaauuuuugcucuuauuacuaauuauauauauauuacuaauacuuccuuguaucuuuuauguauauuuaauuauauauauugcuaauauauaauuauguaauauguauuccuuguaucuuuuauguauacuuacugugcuuacuuaaaauuuuuaauucguuuuaauauuuauuuacauuuuucacuaguucuaggauucaaugacaguuuuuuucugagcacuuuugaauccuaugaggugugugcgugcauguguguguguguguguguguguguguguguguuuguguguauguguguguguguguguguaugugaucuuagaaacucaaccuaggccacuguacuaugcuaggccacugaggacaugcuaugguuacuuguuuuauuaucaaugauuaauuauuauuauuaguuuuuuugagacaggguuugugugugcguguguuguugguugucccugaacuagcucugaagaccaggcuggucucaaacucacagagauccuccugccucugucucccgagugcugggauuaaaggugugccccaccaucaccugguuuuauuauuauuauuugaggcagauucuuauuauaugacacagacuguucucaaacucaugguucuccugccucagccuuuuagguuaucagcauguguaaccacaucuggauuucuugugcugauuuuaaguucuagaagugacuuugucauacuucugccuccuaggucucguccucuaaccuucuggcuguucugagugcugcugcagugaacauugguguagaaauacccccacccuggagucuuugcuuuuaguucuuaugaguauauaucuagguguagacuugcuggguucaauucugaucucauguuuaucuuuuugaggaaaagagaaagaaccuguaccaauccuuuuagccuguuuugcccauucuuacuagcaguauccuuaaaaacaguuggauugcuaaaguaauacaugcaaguaucccauuauuaaaaaaacuccuaggcaggcaugguggggcacaccuuuaauuccagcacucgagaagcagaggcaggcguauuucuaaguuggaggccagccuugucuacaaagugaguuccaggacagccagggauauacagagaaacccugucucaaaaaaaacaaaaccaaaauaacuccccaaaaaacccaaaaaccuccuacagguguaauucugaugcuuugauucccaacaaagcugagcaguguucugaauauuuauaacuuguauuuauuccuuugugaauuuaagugacuggcuucuuaugaaauguguguuaacccucuucacuuuagccugcuugucucugcuaagaguaaacuucagugcugaccucuaugcgucgauugccugaguccguaacacuuucgguuccucucaggaaauucuuaaguguaucuuuauaaggaacucuguauuacugagcagaauaaacguaauuuuaaauaagaaauguaauugugguugguugaaugugauaagcaaucauucguauauucgcgguuccuugauuuguguuauuuucaaguugagugaacacgaggacugcuuaccacguuucuucuaagaagccaguggcgggcagguggaugggugugaguccauucaccgugugucuuaucuucugugcagaugguccaugaacuggaacuuuauaacacagaauauuaucuaggcauguucaugaacuccuucgcuguauuucagguauguauagucugaaaagauauuagugucuuuuacuauuaugaacccuuuuauaaugaaauauaauggagacuaaccucuauuggagguaugacugaaauucacugucccauaaaucuaaccagaguggagaaauacguccuuucaguuuuaaaagccaguggaaaaaugcacccauucacuguuagauuaguggaauugccauuaaacacauuuuaaaaauauuacuauauuugacuuugaaaaggauguuuuuaugacugugugagagaagggaggaguuaaacacacacacacacacacauacacacacauauacacacacacaugcauacacacacauacacacacacgcauacacacacacacauacacacacauacacacacauauacacucacacacacacacacacacacacacacacacacacacacacagacacacagacacacacaccacacauacaugcaugcaugcuauguucucuaugauuagagaacauuuaaacuuugauuuugguuuuauuuuaguuaacauuuuuuaauuaacuuuuucuuuucuaggaauguggucucuggguguugacagaugcaacccuuauaagagauagcauugaugaagucuguaaguaaagccuuagaacaugcuuaacuaguuguauuuuacauguuuagcuaguuguacuaguucaccucacauauugcauaucacuuguaugggacaggggcuuucuaggucaacaugacugcugugugcuaacauguuugcauuuuaugaacuuagcaagucugugugaggauggcagggaauggugccugggcuccugacugcauuucagaaaugaauaccugggcuccugacugcauuucagaaaugaauaccuuucuauaguuuuauuaaaguagggguuauaguagggauauauugggucauccugugggucuaauuuguguugcaaacugugcuguuauuuuagaauuaguuaagaggaacaaguauuugaagcguuugcauccucuaacuuuuguuucuugguggcuuauggcuuauuaucaccucuguguacuaaaacuaucaguguauuuagguuucauccuuauagucucuauccuacacaacuuuccaaauaugucucuauccaguuucucucacaacuuaaaaaaaguguuuucagacuuacuuuauguguacgaguguuucaccucuaugcaucacuaugcaccacaguguuuuuuuuuuguuuuuguuuuuuguuuguuuuuggagacaggguuucucuguauagcccuggcuguucuggaacucacuuuguagaccaggcuggccucgaacucagaaaucuuccugccucugucucccgagugcugcgauuaaaggcgugugccaccacgcccggcucacaguauuuuuaaaaagagauuuguuuauuuauuuuauguauaugacuucauuaucuucaugcacaccagaacaugcaagaguuaagucuauagauguucaguaaagaaaucauuuuuaaaguuauauuugugaaggacacagccacauuacugacaacagacagugcugugacaacagauguuugugagccaccaugugguugcugggauuugaacucaggaccucugguagagcagucagugcucuuaaccacugagccaucucuccagcuccugacucacagcuuuuuuucuguugucccucuacaugugcagucuugucugaugcucccagcagcacugucuguuucuuuacugaacaucuauagacuuaacucuuguucuuguguaguauaauaacuauacaacauuauguuaauauaucauaccauauuauuauaugauauuagauaucagaaguaguauagaggugauuuagaauguaugggaauauguacguuaucuaaaacaucacacugcuuuguguauaggaauugagugcuuagagguuuuagccaggaugcuaagggaaggcugcaccaauugcauccuuggcugagaaguuucacuacacguuuucacuacaagagaaaccuucuaccucaguagcaaauaggacccuggacagcuacccaagugauggacauccaucuuccucuucugucucagaauaaguagcuacacagaggucaaggugcucuuggucauuuuucgaccauguugagauaagagccgcucaugcuuugaagagcaaacccaucaauggucacucuuucaguuagcauuaacauugucaacuuccuuuuaggucuaugauucgaagucuuaguuuguuacccugggggauuucaagguccaccuaacuuguguugucuuuugaucaccacuaugcugguacuaugguucaguauuuaaaagcauuggcugcccguccagauucccagcacccacccaguaccacacuggcuuacaacuauccguaacuacaguuccaggggauccaauguccuuuucuagucucugccugaacuguguguacaugacacacagacacaugugcaggcaaaaaugcccauacacauaaaaacaauagaguaugacccagggcaaauuagucaagcuuuuaagccuccaguuucucccuuccucauagauuuaauaauauuauguguuuuguaggcuuauuaggaaauuaaauguaaaaaucauaauuuacccuguacugaacagcuuccuucauacaguguauuaaauuacucaagaugugucaugcaugcuugauauguugcgaacuucccacuuagcuuaucccucagguuaagaucauugauucaguauucaguagacagcgaugaaauuaagugcgugccuagcauguaagaggcuaugaggguuucaccuuggccuaagggggcagauggagaagauggccugugccagggccaugauggagacgcacagcaggcuacaggaguacugaagggccccagggcagagcagaguuguuucuuaacuauuuuuuuuuaaauuuuaaguuuuuucuucauuuuuuuaaaauuauuuuuugagauuauaauuuuaucauucccccucucuuuccucuuuccuccuucuaaacuuuccuguagaucuguccuugauuguuuuaaaauucauggcuuccuuuuucauuguguguguacguguguauauuucuagauauauaaauacaaccuucucagucuuuauaauguuauauauauauacuauauauuauauaugcauacauguauguauguuuuacaggugaccauuugguauuggauaaccaguugguggcucuuccuuggggaggacuguuucuccugcucucauccuuucuuaaagaugcaggguugaggccucuugggcuuuccucuguccccauucuucuugcccuuguucagcucaugcuuagacagucucauuggugagaauauggguguaacuucugacauuccuagaagacacaaucucacuuccuguuccucuggcucuuacagucuuuccacagucuccuuucugaaaugcucccugaaucuuagaugcaagaguuguacuguagauguaucaguugggacaaggaucuacaacuuugcauugugauugguaguuuucaguagcagucucuugucaacaucuaguguguugugguccuaaggguagagccgcauuaacaggacacagggggugcacagcggcagccagccaaugcacacuuuauucaaaguuucagcauauuuuauacaaaaggcagaauaaagauuuccccacaguuuccaguuuacaccagaugcuauuuuaccuagcaauaucuuaccuuggcucagugacccaaaccuccuugcagacugacaaaucugucagcaguccaacucuuagaugcguugcuucuuauaauuaaagaguggaaaaauaagcauuuucuucaugagaaaaggaucaugaaggucauuuccucagguuuacagcuuacuuggcagaacaccaggauucucuacuugagaaagcaugcuuccucugucucagucugcugagagugacaaagacccuagguugucuggcaagcugggaauagucucuccucaugccauuucucuacacuaucuauugcaaagagaaacuucuuugaugagggugaggacuacacuuaccuguauauauaaggacaaauacuuagaauguaacuagggauuauguugguuuaguaaguggggcaguuuuaaguucucuucaaagaucuaugaccucacuaggccuggguaguuggcuagguuucucaguuacccagauaugauuucccucuuguuaggagguuguuauuauuauuauuauuaauuauuuuauuuauuuacaucccaaauguagccucucuccaagccucugagagagaaggugcauccccucucccucaagcaucaagucucuacagaauuaggcacauccucucccacugaggccagacaaggcagcccucuacuacauaagugccaggggccucggaccagcccauguaugcucuuugguuggugccuuaagucucugggaguucccaagggucaggguuaguuggucucucuaugguguugucauccccuucagcuccuucaauucuccuaacucuucauagggguccccgacagcaguacaaugauuggcugugaguaucugcaucugucucaguuagcugcugguagagccucucagaggacagccaugcuaugcuccugucugcaaucacaacauggcaucaguaauagugucaggguuugguauacaccaugggauggauuccagguugggcugauuacuggacagccuuuccuucagucucugcuuuaccuucuuaugcaccaaagcagcagcaaggcugauacagcagcaaggagaagagaugacugcacgccuguggcugcauugucacacuagacucacuugagacugagaagguggucuuggugcaaggugguagauuuggaucuaauuuauucucuuugugugaacauucaguuuccccagcgucauguguugaagauuauuucuaccaauguauguuuuuuggcagcuuugucaaauaauguugagcuauguucccuguacauucucuaguacuuuuaucauguuugauuuuugucacagacuauuuuuuuuuccaucuguugagaugaucacauggauacaggaugcguugcuccaggcucuucuggcuuucaaaguuuuugcugucaaagcagcugcuauucugaugauuuuccuucauauguggcucaugguuuuacuucugcagcucacaagcaucuuucuuucuuuuguagacuuaggguuuuaacaaugauacgcugugaggauuuuuuucucugguccugucuccuugguauucugugugcuucuuguaucggcauauguauaucuuuccuuaccuuggaggaguuuccuucuaugaucugguguaugcuauugacuuggaacucauacgagaggaacacagaggacaugcagaagcagaguagauaugucucuuaaguguguuuuaaauuuuuuuugcuuauugcuuuagaauuuuaauucauuaaucaaucaacguuauauuccuauugcagcuuccccuuccuccuguccucccggucucucccucuccuuucuccuucccccauucaccucuacucucuuuccccucagaaaaggggaugccucccaagaauaucaaccagccuuggcauauuaaguugcagcaggacuagguacaucgucuauuacugaggcuagacaaggcagcccaguuagaggaaagguagacaauauagccagagacgacuccugcuucuucuauaaggguuugacaugaagacccauguacaacuguuacauauaugcagagggccuagguccaggccaaguaugcucucugcuuggcaguucagucucuguggcuccugugagcccagauuaguugauucugaggguuuucuuguggugucuuugacccccucuggcuccuucaauccucucuccucccucuuccauagaauuccucaugcucccccuaauuuugacugugguccucuguaguugguuucuauaaguugcuggaugaagcuucgcagaugacacauauguuagccucuggucuacaaguauagcaggguaucauuaauagugucugcagggguggacuuucucuuauugcaugguucucaagcuggccagccauucccccaauuucugcuccaucuuuaccccugcacaucuuguaggcaggacaaauuguggguugaagguuuuauggcuggauugguguucccaucccuccauugguugucuccccugguuauaagagauggugucauaucucuuauugcuaggagucuuagcuaggguagcucuuguagauuccuggggauuccauugcccuugguuucuggcucauccuagagaagcucccccaucccuguugucucucucagucucucuccuccuguccuccaccccacuugaucccuccugucccuauccccaccccucccccaacugaucucuuucuucccuccaucccugacaucuauucauuuccccuucucaguuagauuuaacuuucuccuuuuggugucugcuuguuacuuagcuucuuugggucuguggauuguagcaugaauaucccauacuuuaugguuaauguccaauuguaagugaguacauaccguguuugucuuucugggucuggaucaucucacucaggguauuuucucguucgaucuaguugucugccaauuuuaugaugccauuguuuuuaauagcugaacaguauuccauuguguaagugaaccacguuuucuuauccauucuuugguugagggacaucuagguuguuuccaguuucuggcuacuauaaguaaagccacugugaauguaguugagcaagcguccuugugggauggugaaacauuuuggggguauaugcccaggagugguaguggauccugagguagaacuauucccaauuuuuugagaaaccaccagauugcuuuccaaagucuuuaguaugacuuacacacucaaaaucugaacucaaccaucccuucuucucuccaugaugccauuuuaaccaaauacucaguauugucuucuggagaugguuuuguaugugguccaguuuucucuugugcaugguuugcccuugguuguaagacucgaagaaaacggaaugcagacaacuggcuggaaaaggaguauuuucuacugaaauucuuuucaucauucagauuacuuguaaauuuaacuauuuuuuguuuaauagaccuuacauauuaucauccuuucauguuuauuaaaaauuuuuuaucuucucuauagguuauaaaauauuuuauuguagucauuuuauagcuuugguaccuauugcacugugauguaauuuucuuuacauuauauuaaaauuuuuuuuuugagacaaggucucccuacauagcauuggccauccugggaauuggcugguguugaacuguccgagauuggccugccucuacugaguacuaaguacuaucuaugcuggcucaaaguuuguaagaauuuuagacuuacagaaaaauugaaaaaaaaaaagagauagauauaugacccaaauaucuugauauccacacgcauuuguuuaaauguguaauccaaaauuuaauugaguauaauguccuaggcugaacaaagccaauagcacccagcaccaaggaacauucaaagaacaguacaaaaaaaaaaaaaacacaggcagguuuaaaaaugugauuuaauuuuaauaauuuaaaauuaaauaaaguaggcaacuaauaucuaaguuuucagcuauuggucauuggaacagaggagacugaaaacauauuuuuaguucugcguucacugucugugugguuuugguaagucauauggcuugucuguuaucuaggauaauucuucagaaaacagaguugaacaagauaaauucugaacuucauucuguugugagguugagggucccgggggccaagcuugcaauucuuucugucuggugccuuuccuuuccccaccaugguccaugucuauugcagacgauacugaagaguauucugaacgcuuugcagaggaaaaugaggcaaaccugguugauuuugaagaugcuucuucaguuaacaauguacaugucaggaagaauuuuccagaaacauggauuuggcuagacgccuacaugggguaaugaucuguaaagaaaguucuuuguccauuugugcuuugcuuaguguauaucuugaauaauauuuuccuacuuucuaauguauuuuaaguaucaaucuuguguguugaggaacuaaguagaugaaggaguuugggguuuaguaugaugucgauugccucuaauuguaguguuugauugaaucacaugagcauugugaccacagaguaucaucaaggagagagugacaggcuuuaaaaaaggaagggugaauuaaacuuccuugaagucuccuagccuuuauuggaggaaaacccauaacagacaugauagggauacagauaaaacaaccaaccaaacacccacaaacuuaucuguaaauugagagaggaguauuggggcaaaacuggaaaauaaguacuuaagaccauugcugaaaauaguaguagucaacugagaaggauuuuauuggaaugugcauaguaugauauuauaaacuacuucuugagaaacugagaugcucagagacuuuaaacuuagauauguaaaugacauaaauguaaacaauuaaaaauuuucuaauaauuguuuguuauguugacuuauuuggaaugaugugaaauguugguuguguaauuucuguauuuguguugacuucagaucuaagauuuaugaagaauuugaaguuacuguaccugacuccaucacuucuuggguggcuucggcuuuugucaucucagaagaccuggguuuuggguuaacaaccguuccagcagagguagaaagaauauugacuugggggaagggcucagaaaucuaaugaaaugaggcucagagaaugaucagcuaucuauuacuuuauugaucaugcuuuacugugacauuaccuuucugcuuucaauuguggcaacaucuuuuaaaaaauaguaagguauuauuauuuauaaguuuauuuauuuuuauuuuaugugcauugguguuuuaccugugcauacaucuguacgaggaugucagauccccuggaacuggacacaauugugagcugccauggggguacugggaauugaaccugggucuucugggagagcagcucuuagucguugaaccaucucccuagccauacauuauuauuauuauuauuauuauuauuauuauuauuauuauuauuauuauuauuucauuguuauuauuguguuagugugugugcaccgcagcacaagcacacacacauggaagucagagggcaacuuuguggggucaauucucuccaauuauguuuauguuaauucugggaaugggaauugaacuccaauugccagacuugucuagcaagugccuuuacccacugagucaucuugcuggcccuguguuaaauuguugaaucugaguuauauuaaauugguagauuuggucauaagguuaaaaauauuacuguuuaaacuuuuuuuuuuuuuuuuuuuuuuuacuuuuuaauucuagguuuuuauuucauucuuugagccagaagucuuuuuuuuuuuuuaaagauuuauuuauuuauuauaugugaguacacuguagcugucuucagacacuccggaagggaguuagaucuuguuacggauaguugugagccaccauguggcugcugggauuugaacucaggaccuuuggaagagcagucggugcucuuaaccacugagucaucucaccagcccccaagucagaagucuuuuagucaaaucagaaaaugcaugcaugguugaagcuuuuuccuuugaaaaugaagucauauauauauauuuguuguaagaacguauguuuagggcuggagagauggcucagcgguuaacaguaaugacuaccacucuuucagaggucuugaauucaauuuccagcaaccacaugguggcucacaaccaucugugggauccaaugcccucuucuggagugucugaagacagcuacaguguacucauacacauugaauaaauaaaauaaauaaaauaaacaaauacauaaauaaaucuuaaaaaaaggaaagaaagaaauaugcuuaaaaaaugcauguuuauaaacucugaguguaagagccuggugugggccaagcaguggucagcucagugcucugacauucucuuccuuuacuguagguuguggucaggguucaaugucuucauacauggaaggaaacaccagaguaaaauuaaauguucuguaaauggugcauauuuuugcaaaaguaaauauauauagauaauuguaauuaacuaagguaaaugcaucacauacuacuaaaagcaguaauuuuuuguuuguuuuuuuauuagguauuuucuucauuuacauuuccaaugcuaucccaaaagucccccaugcccuccccccaccucccacuucuuggcccuggcguuccccuguacugaggcauauaaaguuugcacgaccaaugguccucucuuuccacugauggccgacuagagauacauaugcagcuagagacacaagcucuggggggguacugguuaguucauauuguuguuccaccuauaggguagcagaccccuucaacuccuuggguacuuucucuagcuccucuguugggggcccuguguuccauccaauagcugacugugagcauucacuucuguguuugcuaggcccaagaauagccucacaagaguaguuuaguacaucauaaauguaucuaaaacauucaaauuuagauaacacauaacauuuuacagauuuucuauauuuaaaauuugcaucacaguuugcuuaauuuauccuuuucaacauuauaagccuuaauuuaccuugucacuuauuuguaggcauuucuuccuaauuuccaauucaagucguugcuauaaugcuuauuauuuuucaagauuucaguguugaauuaauuuucauuuuauuaccaguugccacuaucuuuacuaggacaaagcuccacauuaugaucaauuuuagguaacccaagcauuacuaugcuaagucaauaagcaaugcuauuuaugcaauuaauacuucauugcauagauggcaggaauuuccuuacuuaaucauuccuggaaacagaaaacggguaucauuuguauuauaacuuacuuuuaagcuuauaguaauagagaaaauucagccuuuuggcuauaucaaguguaacauuuaaaaauuuuauacauaggaguguuuugcccauaucuauuuaugugcacuguguaugugccuggugcccaaggaagcuagaaaaggguguuggauccccuggaacucgaguuuugagcugacuugugaaggcugagaaucaaaucucgguucuccauaugagcagcaaguguucuuaaccucuuaaccauucauuucuccagccccuauuuuguuauaaagcuuacaauggcuagauuauuuuaaagaugagcacaacuucucaaggugucuccuagcaggcauuccuucauguccaugcucaaaugucaucauacuuuguuuccaguuacuaauaagaauauaaggaucaugaauggccucaauacaguagcuaucacuacuauuauaccugaaagccucaauaacagagguuuuguguugccuccuuaggaucuguaagugaaauuuguagaaauauuaguccuuuggguuuguauaugauauuauggugaaagcccaggucauuuaaacagaugauuuauuuacauaaacgucuaagcaaauagucaauauuuauuaguacuuacaugguauuuuaaauuauaagaucuguaaucugcaacaaaucauauuucugugucccaaauauaaaccacacacaaauaauaaauaagucaagaaucacaaggaauacaagacaguaguuguuuaugguuugggacaauccuaaguguuguagaacuugauuccacaaaaugcugcuacuacuguucggccacugugacaaucuaaaagguucagucuacacaugucuacuuaaaucuggcagacacgcccaucuucuuuacauuaugagguggucuugucaucuacaaaguucauaguugagaagugugcaaucaaauuucaaaaaaaucaaaaaaccaacccacuuacccccaugcuuaauguuguauugggucauguucauguuggcuuugcuguauguggcuuacagaggcauggguuggaggcacaggguaugccuacuagaaaccacuggccuaaagucaucaggcuuuauuucaggagggggcauugugagcuggccacacugagagauuuccucaagugagacucaaacaggaaguguuggauuggacaguaacuguugaagcgcauuauggaaccaauacaguguaacagaauggcagcuuguuuugguaucucagagaauggguuauggcuccuucacuuguaguuacagaaauuucugaacaucauuuuaaaaaaauaaauaggaacacagcacccuuauggggguauaaugauugcacaaguaacauaugaagugcuugguuacuccuaggugcuuaacauagugcaguaauuacuauguuaaauaacagcuuuccaccacucacucaguguaagcuguugcuaggugaugguagauaggcauguggacaccucuaggaguuccaggcuguaaagguucuaugaauguugcucuuguaaauaaugugaaacauuuuuaaaaaucugaaucaaaacauguccucauuguguccucucuagcugcaagccuuccaaccguuuuuccuuuuccugaaucuuccguacucuguuaucagaggugaagaguuugcuuuggaaguauccaucgucaauuauuugaaagauacaauuaagguacuguguucaaagcuuuguuauuuauacuuuggaacaaaaugcaagauuugguugguggcauaguaugcauaguacuugagcaucaggaucuucaagcauuuguuguuguuguuuguuuguuuguuugcuuuuuggcuuauauguguuuuauugguuuuacucuuuuaacuugguaauuuaaaauuuaauaaguauuaaauuuauucuuugacaguuucacacccacauauaguacagucuagucgaauucacuuuacccucuccuacucuccuuuucucccaggagauuccuccucccacuucuaugccuuuuucucuuaauuuuguacuguggcccgcuugccuuuaaccagggccacccacaugaacauguguguggagcuauuuaccgaaguauagauggcuuucuagugccuacaccacugaaggcaaugacucucccuuucagucauuagaacguacaauagcuucucaaggauggcuggacccugugaaugccaucccuagccguaagucaaugggcuaagccuugguauuaaccucuguucauugcuuuaacugagcuggaaaacagcacuggucuacugguacaaacauaaauagagugggccuuagaaugaauuggaaagcagugguuacugccauaucuuucacuccacuauuguacccgugggcauuucuugccugacagauugggacuguauaacauacaugcaagauccacauauggguaagagcauugguaaauuucuaaguugccuacauggcagcuuuuggcacugggagggcuagccaacauggaggaagcuuccggcucaguuguagcauuauuugucuuuguaguauaacuaaaguuuauguuaucuucagcaauagggucuaggcaaccaagacaauggcaaugaccaguaauuuucugggguccuuuggagccuccaugacuaacuacucauagggaggaagcacacaucugauaguccuccacgaauuuuguaugaugaugggagauugaaaguauauauauauuuuguuagugauuucuucugcuuauuaaugucuggguauaucauuagaauaucugugcauucucuuaguuuccuagaacagauccuccuguuuagccagggaacuuucuuuuggccuuggggaggugccggucuuucuucuaccuccugucuucuuccuggucuuccauaccuagaauguguuuuucuucuucucauuaccacuuugaaccuacugcaguguggcaggauuuucucuguccacuuaauuuaaauauuagugcagcaggaggcccuugauuggacagggaagagggagguggagauaauuguggagacagggagcaacacaggagaaggagaggaagcaaaauggagggugaacagcaugguucagauucaguguggcuuuaaauagucacagguagcuauaauaucauauagggauagaauaauugggguaaccugccucaucuagguuggcagcuuggaccauuaucaauugacccugaauuuauugguugguuaucuuguguauugagaauuuauugauauaugaaucugaccaauugauuauaagcuucuagaguuuugguuuacugaguuaaggggauuugugauaaguagccccuggagauaaauggcugagaagguaugggcagcacugagacaagccaaccggagcugggaggacugcgauugguugcugcuggggcuaaauggagacagaggcagcaagaccacuguuggggcagagaguagcuggguguagugcgggaacugcgguuccuuuuaauauuuccuguaacacggcaguugguaagaauuuauucuaucugagcuagcuugcagcuaggauuccuuuccugaggaauucgcccauucuguuagguuuguagucuccacgguuauucagagcauuauguuuucaggauuuuuuuuuuuuuuuuuuuuuuuuugugggagucauguuccugugucuagucaggcagucagguugcuguaaugcaaggauuaggacuuaacuacugcuugcgauguaccuacagcugcauuagucaaauggcuuaguuuucagcccuaggcauaugcugauaaccucauuguaugaaaagccauaaucucuuuaaguguguacaucugcauaguaaaucaaaauguuuacuuauuauuuucuugguguuggagauggaauaggcauaagccaaccacugagcuauacucccagcuccagcauuucacuuuuuaacugugcuuuuugauguggccagaauguugcuguauaaugagcagaagauccaaucaaaaagccuaauauccaguuugccucucacuaccagauaacuuaauaacaugauucauaguuuccuaaucuauuuuaaaagaaucauuauuacuauuaugugaacaaauuauugugaaaaaaugagaaaauaaauuagaaaauacuuuguaaaauguaaggcccaugcugguuguggugggacacaucuaucaucucagcacuugggaggcagagucaggaggauuguuggaaguuugaguauagccuggucuacauaaugaguuccaggcuagcuaggcuuacaacguuagacucuuaaaccagugguuuucaacuuuccuaaugcuguggcccuugauacaguuccucaugucauggugacccuccagccacacaauuauuuucauugcgacuucauaagucuaaugguggcucugcuaugaguuguaacauaauuaucgaugugcagauggucuuaguugaccccugugaaagggucauucgacucucaaaggauuugugacccacagggugaaagcugcugcucuaaacccucccucaccuuugggcauagugguguauaucuuuaaccccagaacuuggcagaggcagaggaagagaggcagagaggcagagaggcagagaggcagagaggcagagaggcagagaggcagagaggcagagaggcagagaggcagagaggcagaggcagagaggcagagaggcagaggcagaggcagagaggcagagaggcagagaggcagaggcagaggcagagaggcagagaggcagagaggcagagaggcagagaggcagagaggcagagaggcagagaggcagaggcagaggcagagaaggcagaggcagaggcagaagaggcagaggcagaggcagaggcagaggcaagcauaucucucugugaguucaaagccagucugaucuucauagcaaguuuuaguucagccaggccugcacaauaagaccauguuucaagaacaaaacaaaacaaaacaaaacaaaacaaaacaaaacaaaaccaccacuccagccuggaagaauucuacuuaaggagagcagaaaauaaguuuguaaauagcauaugcuuuagaaugaaugcaguagucauaguuuucauugaauaauuuuugcugagagccucaguagaucaaacaggauuuuaaucugucucaugcuucccuaauagcaccagugucuccuaagaugacacaguuaagucaggagaugcugaaacuaagguuugaaguggacuuucuguguauaguuccaucacucaguggcuuuguguagugagauaaguuagcgaaaggacaggaaauuaagccaaaaaaaaagccugagucuuugucccauuuuucucugguuuugagucucauacuuguaauauaauagcgauagacgacacuuuacaggagagcaauuuuuuuuuuaaacacaaaauuuuggguuuuacuuuuucuuucuuucccagguugugauacucauugaggaaagugacagcuuugauauuuuaaugacuucaaaugacaccaauggcaccauauaccggaagacuguucaaguucccagggauaauggggucacucuuguuuuucccaucaagcccacgcacuugggagagauucccaucacagugacggcugccucacccacugccucugaugcugucacccagacaauuguaguaaagguaaauauuugggguuuagauggauauaguugaaacuuaacgcggaauuaaaaagcaaaugggagaugguguuucugugucaaauuuuuaguaauccugaaaugucuucuccugguaauguuguuuucuuaucugucuguaaaaauguuacacacguguguuauaaagauacugucauuuucccuuuuaaauuugagcagaagcaaauuuaggaaugucaaguauugcuaaauaguccuuauagcuacaaauaguguuacacugggauccuacuggaucauagguugaugagguagagaguaggcauuuuagaacuccucaaaguagauuuccuagacucuugguuugagaggacauuguguauaaaaacauagcccagcacgaugaauggccacucuucuucuggggugucauugccuuggaucuggaucucuguccaguuaaaagugauuucaguuaaggccuuuggugcuuuuguuuggauaacgccagaugaaucuguucccugaggauuuucuuugucgcguucuuuuucaccucucccccugucauuuucauuuccauuccaguuccauaaaaugcuuucucaauuuaacuagaaagcaagugcuuagcauguuccgagucagaaucaggaaacgguagguagguauguacugagcagcuguguccacagcggacuagaucuuugucuuuagaucugcacaccauucccuguuaacagauaagcagaugacgugcuguguucuuuccccuacagccugaagggauagaaaagucguauucgaaaucugucuuauuggaucugacagauagcaacguagaaaguaagcagcaaucuaugagauucuccuuuccuccugauacggucauuggcagugaaagaguucagaucacagcaauugguaagaguaguguguggcauacuggcugauuugcauuugauaauauuuuuuccaucuauuuauagcuauauugucuuacuuagccccaaugggaaaagauugugggagguuuuaguuggugucaacuacuguaacuuaaaucaguguuuuucaacaugcagaaugcauaugugaguguguugucuugcuuaacaagaagcucugguuuaguaugucuggggugggucugagcuugcucccuuucuuccuuccucucucuuuccuuccccuccuuccucucuccuuuaaucuuucucccuucuucccaagaugaaacacagugcuuugcgcguacuaggcaaguucucuacccaugaacuauaucacuggcucuuuguuuuaugagauaaggucuugguauguagccuaggcuggccuugaaauccagauccgugugccucagcuucuuugcugggacuagaagcaugcaucgauacaccugguuggaagcuuuggauuucugaugguguugcuucuuauguauagauaaacucauguacagauacaaggccacaccuucuguaacagcaagagggaagagugucuucuagagaagagcuuccggacucugugccucuuggccacuguugggaaucuuaaucuuauauaacauguuuaaaaacacaaaugucuguuuuuuucuagacguacuaaacuagaauuucuuagacuauggucagggcaagugcagcuuggaaacuuuacaccagcgagucugguaagcaaggcuugggaacccuugccuagaauaguuuccugugcaagauaaaagcagccguuacuguaggaaugucaguuacuucuaguucccuuccaguaaccuaaagugcuuuugaauuaaacauagucuuccccaaugcauguugagucuccuuugaagaauuaaaugucuugacauuuaauuucugacacuuguuugacucucuaauuuaaagaaacacuuaguuuauacccuuuauuuaggcagaagcauccugacuuaucaugcaguccacaaguuaagaucuaugguauugccgggcaugguggcacaugccuuuaauuccagcacuugggaggcagaagcagguggguuucugaguucaaggccagccuggucucuagagugaguuccuggacagccaggguuacacagagaaacccuguaucuacgguguugcucucauuuugauuaaguuucuacucugucccacuggccucuaugauagauaccuguacugagcugagacugccuaccaccaagcagguaagagugaaugauuaucacucauugaaccaaauguuuugugcuugcaggagauauccuugguuccuccaucaauggcuuaucuucacugauccggaugccuuauggauguggugaacagaacaugauauauuuugcuccaaauauuuacauuuuggauuaucugacuaaacagaaacagcugacaguuaauuuaaaagaaaaggcccuuucauauaugaggcaagguaagcaguaggcgcauagacuuuuuuuuuugguugaaaacaaguuuccaguuguuuauaggucagggucucccuaagccauguuuucgaauagauggagguuguguuuagugcgugauuugugggacuacucgguacaggugugcugaaggucaggcaguggggcggggccgcuugucuucagguagccaacuguugcuuaacugcugcuaauuuaaaacucuuuuauaaaauaaaaugaaugaauuuuauccauugcucauuugugagcacguguucacgauuuuuucuucagauagagucuuaggugguucagguuagcuuugugguaggacagugcguauggaguggaugcuugcacaucugacgugacugucugagcuacaagaacugcucagcuauggcuacgaccugcccacaguaacguuagugugggucuagugcugccgauguggcaggccguguuguaagcugucuacucgcucaagggagccaggacacaggaaaguuaaauagcuuucccagggcuauguauggugagcuaguggcuagccugggauuugaacucacuguucacuguguuccgaguccuugccuccagcguccauggccagagaaguugaagguuagugaaccauuucuaauaaucaaaugcaaaauuccgaguucauaaaacacuacaaaagccagccccaaauaacagucucaucuugcuuuugccugcauggauuauaugaugcacacuauacaggaaacucaucaagaugggaaggacuuauauaggaaaugacugggaagcgcuuacucagcacagucugggaaaauauaguucaauguuuucuagaguguguauauguguguguguguguaugugugcgugcgugugcguguguguguguuugugugcgugcgugugcgugcgugugcgugugugugugcgugcgugugcgugcguguguaugugugcgugugugugcgugcguauguauguguguguguguguguguguguaugugugcguguguguguguguguguguguaugugugugugugcgugugugugugugugugguuucuuucucuccucuuccucucccucuucccuccucccucucccccaaccccucucccuccuccucuccuuccuucuuuaaagauaaauggacuaaaugacagagaggcacaccaguagccaucaugcccacuuuccauaaauugccaaacucaaguaaugagacuguuuugauacgaacccuccuuuuagcguccuucauuauacagaaaacuguuuauaccgaacugcgugauaauagaaagggcagcuaauguuauggaaaagcuuugcauguuucuuuaauucucacagaacccauuggugggguugcaccacuaucuccauauccuaggugaggaaauggaggcacaggaagagugacuggaugaugaucaauaucaaauuucugggcucucaaguucauccuuuuaauaauggaagucagguccaggagaauucugaaguucuuccacaguucagugauuaccuguagacacuaaccagucuaccuagccuuggcacauccuuagcagccaggaagugugaucaguguuucuggcuggcccaacagcuuccaucugaaggagaugguccauguuuccugacaucacucuacgugaugacaucagagucucacuucagagauugucuuuucuaagucuuguaaauuaugaaguuguuuuuauuuuuuaagucauuaaugaagauuuagugugaauuaugauuacuuaaaugucacuuaggaacagcgcauuuucuuacuuaaguguugguggcccagggguccuauaaccaauagcuacaucacugagugaaacacaguuugcugucaagaaaagaaagaacuguaaaaagaaaccauuuuugacaaggaguggaaauccugagccuguuaauugaaacauuaaguggcuuguuuucuucauauacucagauuuguuuuaaaguuacauuuuauuuauuuuuauuuuguguaugugggugucuuaaguaugggagcacauuuguguagaggucagaggacaacuuuugagacuuaguucucuucuuucucaugugggaaucaaacccaggucuucaggcuuggcagcaggagccuuuaucuauugaaucugcuuaaggagccuuuucuucagauguuuaaaugacaacaucggcaguuucaagacucugacugagucuugaaauccuguuuuugucuguuaaaauacucucuucucucagaacuggacccugagcaaggcacacacugggcaagugcucuacugcugagcugcaccccagcccugggcuguucuuuuuuuguuucuguagucagugcuuucaacuuuaguuugauaaguugugacuacguucaugguuaguccagagaaaacucaugacccagaaagauuugcgucuuaucugacccacuguaggcaguaguuuauagauugguacccaacagcuuccuaacuucuguauuuuaauuuucagagauguuugauaauucugauuauuauauuaucauuugccacacaaaaagagcuguuuguaaaacagugaccaugugaaugauacucuuauuuauuuguaaacuuuuggagaaaaccaagcuuuugacuugcucaucuauugugcugaaaaaucuccaacuuagauaauaacaguggaaugaagauuuuuauacuaacaguaaacauuauagccacaucaucaguguccuuuccugcuaauggaguggagguuaggccugacguaggcaguugcuuggaggacaagcagccaaggcuucuccagcaugcauggccaguguaggaugaggaagggagugucagaagagacugcugcagagagucaaagcagcuuuucucccuggcuucccuucuuuccuucucuuuuccauaggagcagagcugggggucugggaucuguuuuauugauccacuugacaacugaaaaugguugagccccuguuuccucuggacuggcugcccuuagugggggacuaaggcuaguuuuugacacggauggggggaguguuggaggauacccaccugcgugguaauuuccauaaauucugauuucaugccuugaucucagcucugacucaauuuauauuaucuuaugaaaagguuaauaaugacaucacaucuuaggguuauuagagucacccaaguuuuuacuuauaaggggcuucucacaguucuuuguacaaugugaauacaaaauaaagauuuacaauuugucuaucagaaauauuuuaggcauaaaaaugaagauuauaaacuaauguucucuucuuaaaauuaagaaaaauugcuuuuacuauaaauauauauacauuuccuuuauuaucaaucucaaauaucaccgugaaacauaauguuccgucuuauuccuuaauccagaugcucagaugcaggcuuuguaguagaaaauccaagggagagcagcucaggaauucauaggagagguggacuguucagugaugcccacgggcuugccacacgguuucuaacacuggauguugaacucuguauggcuuugcaaaugugaaccaacuucccuucguuugaaauaauuuauuugcaaguauaagaaaccucugcuuucauuaaagcagguguauuaacacuuccccaacuuacuuuauuuguguguguauuuuuguguauguacgcuguuuauggguacauguaugcacaaucguauguggaucccagaggcugauacgaggugucucccucagucauaucuccgucuuauuaguuuuugagacuggucuaucacugaaccuggagcucauugacugaccaguaaauuccagauagucugccucuucaguucugggguuauaggugauugccuuuugggguagugauaggggcuugaacucagguccgcaugcuuguguggugagccaucuccaaaguacccuaaguuacuuauauaguaauacuucauuacuaccaccguguguguguguguguguguguguguguguguguguguguguguguguguaaacaugaaguauggaauugguguggaagaauaccaguugguuuuaucuuuugccucagguguccaugaucaaggcauuuaaaaaacacugccuuagauugucuguaauauucccucuguugucagccuaaggacacaaaucagcuguacucucuguacucugcuuuaaacuuuaguuaugauaaugucuucccuagaccacagacaaucuuagcuaagcauggaaacccuuuggugaacacuagaagucagcgaagcucagccucgucuuugcuugcuucuggaugacccaaagggucuuggguaucgcuucuuauuuccccucuuugccgacggccccagcaugaagccauagcaaguggauugauugugccuggauuuauguaucuucagguuaccaaagggagcuucucuaucagagggaagauggcuccuucagugcuuuuggggacauugacucuucugggagcacuugguaagugggguuuuuuucuucuaaucaaacaauuccgcaucacagaucagguguuuauuaggcugcaguagccacgggauggacagacaagacuaucuguguggauguuguaacugauuuuuaccaagcaggccuuuaaaagaggucacuaaaaaugauuguaaagcauuugcaaaucaagugcuuucuauuuagaaacagaaaaaaaaauacaacuuuuuuuuugucagaaaagcugcaacaaaaauucuuuaagaugaugguacagaugacgagaaaaaugccgcugugccauuuguguugcuaguucugauuuacuagugcaagagcuuuguuaaaacagucugggugguuucccuacaaccauacuucuugaaaaaggaagaauguugggauaaaggaauaagccuacagcgugugccuccaauccuugugguugauuugggacaguuacccccacuccuuguucugucugcuauggcugacuucaaggacugggguggucuucucugucuuccugcaauagaggagaccuggauguuagaguaaguucccauagggcuuugaggagacauacugcuuuggccauugucuuguucagaagccagaugccaaucuguaacugagaccacuuuauuuuuccacuuggcauucuuugcacuuugcuguucuugcugggcaguggcucaagcuugaaacuccagcacuuuggauggauaggcgggaggaccaaggccaccgugggccacagccugagauccugucucuccucuaacccucuccccacaaauacaaauguuuuguaucacgguucugugaaguguacgagaaauacuauacauuuuuguuaugagugguuucaguuguauaaucucucuuccugccuuccacuuuuguaccuaccuuucuuucauccuuucuuuccccucacacaucuaucuaucuaccuaccuaucuauguaucuaucuauguaucuaucuauguaucuaucuaucuaucuaucuaucuaucuaucuaucuaucuaucuaucuaucuaucuauguaucuaucuaucuaucuaucuaucuaucuaucuaucuaucuauccauccauccauccauccauccaucuaucuaucuaucuaucuaucuaucuaucuaucuaucuaucuaucucuguaccuguaccucuaucucuauauaaucuauauaucuccucucuucucuccaccuucauaccccuuccuucugcucugcucuauuauuauuuuaaugccuuuucuuucucucucuaaaauuauuccuagggcuggggagaugcuacacuuaguacagugccugucacacaagcaugagaacugaguuuggauucuagaauccaugugaaaaacugaucauggugucaugagcguaugagaugggagggauuaggugguguuuuuagagacaagcaggucucugaagcucauuggccauccaguuugguacaguugguaaauuucggguucagugagauaccuuguaucaaaaaacaaagguaggagagaaugaggaaagacacgaggagacauucaguguuaaccuugggcuucuacauaggcacacacacacacacacacacacacacacacacacacacacagacacacaccauuucuagguauuggcagcagaugauaaacguucauauguggaucagggaggcuugacccuuaauuaacaguucuacaggacugaaaacuacccuuuucucucagguaaaguacugagcuuugcuugugaacgucaaaugcuuaucuaaugcuuugagcugagcauggugaaguuuuuuuggugcaugccuggagcagucaagaggugugcaccauuuuguaauuuaaccaucauggaaggcuagauucucaaccuguaaaauacgggcauaagauuauuucuaaauaaccagcagauaauuccuaaauucauuuucaaaugugacguucugugaauugaucugaaauuucuuagucauucccaaauaagaaccagguccaccagcuaagacacauuuuuuuuuuuuuuaaauauugucucuucgcugucuuuccuuuuguuuuauaucuggugaauuuuccgaaggggaacuguuuuguguuucaugugcucagugugaacucagggcuuaaauguaucuuaugugcuuucuucuuuuuucuccaaggcugucagcauuuguuuuaagaugcuuucuggaagcugauuacuauauagauauugaucaggauguguuacacagaacauauacuuggcuuaaugcacauaagaaauucaauggugaauuuugggagccaggaagagugauucacagugaacuucaagguggcaccaaaagcccaguaacacuuacggccuauauugugacuucuguccugggauacaaaaaguaucagguauuuuuuuuucacaaauugaaauaaaguggaucuugcugagucaaauaugugucuugaaauggaaaguacuuuguaauuuuacauugcaugugaaaucuguguuuguauagcuaugcccuuugcauuugggcacacauuccaaaauuuagagaaaaauaguaacccauucuuaggggacgcugaaaggcuuuguaauaauauaugcauugugcuuguuauugggacagaggucagcaauguuucauugcuaggagaaagcacuuuagaauuuugaaauguguccuagcaaguugaagugauuuuuuuuuuucagugcuauggauugagcccaggguuugcucuggggaggcagacgcccggccaagcuauguccuuagucacuuugaaggaauuguuuuuuucuuaguuuuuuuuuaagaucuuuaaaccuguagggaauaauugcacugucuguuaauuuagugaaaacuucucaccuuugaaacuuggcagaaagugggcaaggcuguagaugaugauggaugcccaugcaaagauguaaucaucuuuuaaaaaauugguuauuucauuuacuuacauuucaaauguugucccccuucccaguuuccccuccacaaacccccacucccacaccccucugcccugcuucuaugagggugcucccccaccccccacccacuccagccucaccacccuagaauuccccuucgcugggauaucgagccuccacagagcuccccucccauugaugaauaaggcaauccucuccuucguaugcagcuggagccauggguccuuccauguacuuuuugguuggugguuuagucccuggguacucugugugugucugugugugugugugugagugugugagugugugugugucugugugugagugugcgugugugagugugugugugugucugucugugugugugucugugugugugugugugucugguugauugauacuguuguuccuccuauguuguugcaaaccccuucaucucuaaaaggccuucuucuaacuccuccauugggguccccgugcucaguucgaggguuggcagugagcauccauaucuguauuggucaggcucuggcacagccucucagggggcagcuguaccaggcuccugucagcaagcacuucuuggcaucugcaacagugucuggguuuggugucugcagaugggauggaucccuagguggggcagacucuagaugaccuuuccuucagucucugcuucacucuuugaccaugcauuuccuuuugacaggagcaauucuguauuaauauuuuugagaugggugaguggccucaucccucaucugggggccuugccauauccacuggguauggucucuacagguucuuucucccuuaauguugccauagggcucucuggcuguuugaugccauauugcuuauuggccccacuucucaaucucaguagccauucucuuuauuaaaccugacuguuuucucacuuuaguacugggccugugcaagacaaacuuuucucugggcuuagagauucaauuccuaggguucauacgggaagcauauuccugaagccauaguuuucuuuugccauuuggauuuauaauacucagcaggauaaagagguucuagaaguugcguuuauuuauuucuccuuuuuaaagaauagugucuccuugguuacagcaacagagcaguacuauuauuuucaggacauauaggagauguuuaaaugucaguggacauuguugauucccauugucuacaccgaggucagauauuuaacaggccuggaaucauccuuugaguggaugcuuccacaaacuuuuaauuuucauauggggaaguaguaaaguaugcauguuuuucuuccaagccuaauaucgauguacaagacucaaucaaguuuuuggaauuugaauucagcagaggaauuucggacaauuauaccuuagcaauuauauccuaugcccuguccacagucgggagcccuaaagcagaggaggcuuugaacuugcugaugcagcgaucagaaaaggaagguaaugccugggacacagccgaggcuuguggaauguugggcuucauagaauagauugaaaaacguuuguauguuaauuaugauauuuauaacauuugcaucguuuggaugagaugaaaauugcagaucaguacaagaccugaugugaucugcauguuaugcuauauugaauugauccuugucaucccaggaguugaacauuguauguauguauguauguauguauguauguauguauguauguauguauguauuauguaucuuaucuaucuaucuaucuaucuaucuaucaucuaucuaucuuaucuaucuaucuaucuaucuaucuaucuaucuaauuuaucuaaucuaucuaaucuaucuaaucuaucuaucuaucuaucuaucuaucuaucuaucuaucuaucuaucuaucuaucuaucuaucuaucuaucuaucuaucuaucuaucaucuaccuaccuauggguagguagauggguguuuugccagucuguguauuaugugcauguagugcccacagccgccagcagagggcagugcauuucccagaauuggaguaacagcuaguucuucuuggccagaaaucccaacuccccaaccuggcaucuucuuuuagacagguucucccuugaauuucccuuugaguugguuacucuuuugaguuucuggccugugaaguacagauguuacucuuccaaagguucuuauaaaguagucagagaucaaagugugucuuagggugaaaugguguguguguaaguacuaaaauuacuuaucuaaauaguauccaucgauucaaaguucuguucauuugaaaagagauagcguggggcuggagagaggacuuggcaguuaagaacauuugcugcccugucaugaggacuggagucuggaucucaggacccaagcagcucacaaaggcauauaaccucagcucuaagggagccagugcccuuuccugguuuccauggggcaugcacacacacauacacacacacacacacacacacacacacacacacacacacacacacaaacacucacacacucauagacacacacagucacauacauacauacauacauacucacacagacacacauucccuuuauagauauauacacacacacaagcacacacacuuucacauacagucacacacacauccacacacacacucaaacacucacagacagacaaacacacagacacacucauagacauacacagucacauacauacauacauacauacauacauacacagacacacacccccuucauagauauacacacacaaacacacacacuuucacacacacucacagacauacacacacauacaaauacacucacagacacacacaaacacacacacucacagacauacacacacauacaaauacacucacagacacacacaaacacacacacucacacauucacagacacacacacacagucacauacauacauacacacacagacacacaacccuuucauagauauauacacacacacuaacacacaaacacacuuucacacacagacauacacacauucacacacacacuuucacacacagucacagacaccccccacacucagacacacauaccccuucauauauauauauguauacacacacacacacacacacacacacacacacacacacauauacacacacacagacuuacaggcacacauacucacacucauacacagacauacagacacacacacucacacaugcacucagacacacagauacgaacacucacagacacacacacacacacacacacacagucagacauacacacacacucacacacacucaaacacucacacacucagagagagagagagagagggagagaggagagagagagggagagaggagagagaggagagacuaauucucagaacggacuguagagacagacacuaagguuaauaguuuagguccaguccucguuacuugucaggguugcagagugaauguaccacacagacgcuaccaugcaccugaauuuguucugggccggacugagauucuugucucacuuuccaucaccgucuugaggaugagagcaagcagaggccuucgugcaggagggucuagcaggcuagagcaggguuaucuugggaagguuguugaccuggccgugcuugcucaguuguucuuggggccuggauuuugaauuuauaacauaagcuuugaguggacagaaaaggggagcggucugacagaccaugagagcugguuucugauagauuccuggaaaaggauucuuucccaagugccugaaacuauuuguggaaggaaaaaaaaaguguguguguguguguguguguauguaguguguguguguguaugcauguuuccccuuuuaauuuauaacuguuuagucuugcuccagacauaugguguuucccuugggaaaauguuuuaaucaaaacauuuucaaaugcaggcaacaaagaaaggaugaaaauuuauacacuguaacaguuuaaaauguaacauguuuaugugugcuuauauaggcauauauauauaaucugcuuuuugcuggucaaauagagcuugaacguguacagacauguuuuucuuguauaaaccauaagcuuuuuggcguuugcucaguaugguuuccuuuuuucuuaggagacacacaguucugguugucaucaggaccugcgcucucuggguccuggcagccgcgcuccguggacaucgaaaucgcugcuuaugcacugcuggcgcacacucugcaccaugugucugagggaaucccgguuaugagguggcucauccagcaaagaaacagccugggagguuuuguauccacucaggugagacaugauagauuuuuuuuccucugaaaaaaagauaauuucuaaugucuaugaagagcauagcugccuuucauaacgaguuccguacauuaaaugaagggcuuaacgugguaauuuuagugcuuuucucauuugagcuucauauccaguacauaaagauuauaucgguucuccaucuuuauuagcuauuuugugucugcgguaacugacguaagcauguugcucaggucugugugguaguaguuuguuaagccucuugcauacucccagcaagaggaccgagaaagcagucuucucccaagaagagugaaaaacugugcagcagguucccaaauguugccuuuacuguuuucuuuggagaucuugcuggauacuucaagaaaaaaaaugcauagcuguuguuuuuuuuuuuuuuuuccucaacaggauacuguuguggcccugaaggcauuaucugaauuuucagcccuugugcacaaggaaaauacagauauccaacugaccgucacagggcccggcauccccagauccauacacuuccgaauugacucccagaaccucuuucuccuucaccaggaagagguaaagacagggguggucguuuaaaaccugcguagaugguucuuaauucuggaauacuguuuuaguuuuucuuuuuagagucaaguuuaauucacuucaacaaagaguucuucccagagcuccauagaaagguagagacaggcuguccugcuuuugguuggauuuucuuuacuaaggaaggguggaggagaugggaccuuugagagaaagaaagaugggcagaagagaagauauggacaccuucccagugggaaggagugauaucuacugagagucagcguugcauggacauugugcuagguuagaguagaggugcucccgcaguuaggccucaggccaagccugcuguccacaguuugacacagaaaacucucaguggagacaagugagggaugguagagcugggauuuagagccacuggcucauauacuuauucuuuucagcuguauuuccuguucucuuaguacagcgaggacugggaguaggauuauuguuauauguuaaucaauuaguuaguuaacuaacuaauuaaguaauugauugguuuuuuaagacaggguuucucuguguagcuuuggcuguccuggaacucacuuuguauaucagacuggcccugaacucacagagauccaucugucucugccuccugagugcugggauuaaaggcgugucccaccacugucuggcaucaccaucaucaucaucaucacuauuauguuuuuucugguagcauagaagucacuauguaguccaggauggccucgaccucauaauucuuuucugccccugccuccaggauguugggguuagaaacacguacaguccuucuuccuuuaaaauacaauaaaagauuaugcugccagauaggugaagaaggagucaugacacaggaaaagaaggcuagagcuaggcauagugauuguguucauggucggcccugaugaagggaggucggggagacgugcuucaacuccaccaggggagcacucuggucaggagcacggauugugccuucccaaaggcuuggggcgaaggagcuuggagaacacuucgcccagguuacccgguugaugcagagccuuugauaguugagaccaugcagagcucccagcauucuccaggacuaccucugcuucuggugugggauacggcacagaacucgugcuacugggaaggaucugucuguggcaaauuugacucccucacuuucucucucuuaccuuuaucagcuucaugcgcuagaucccaucaccguuaauguuucugcgcauggcucgggauuugcuauuugccagguaugucuaugugauugucucuuuguguggugaaguaugacuucuguuaacaauccuuugcuaagcuuagcaacuuagacagcuugugugaggcuuuuaaugagggcuggcaagaugccuccugggauaaagguguuuguugcugagccugaguuugaucccugggaugcacauagggaaaggaggaagaaaacacauuuuggaaacugcccaacaguucucaagguuuuuguaaaggauuauuuauuuauuuuuggugcacaugugcauguguauguaggcguuggugcacacguaccucugugugugugugcggaggucugcuuucuccuuucauuaugggcuccaggaaaagaguucagcuggucagguuugcacaguaagcguuuuuauuggcugagccuucaaucuggcucccuaagauuauuuugcaugauagucacgacacaggaagcaucuuaaaaaaaaaggcaaggaaaaauaauuauagugaaaugaaauguuuuuuuuuuucaaugagaauaaaagaaaaauagggaauaauuuaugugguucuauaugaagaaccacggggaacuccuauucccaagacugcugcuuguugcaaaacauaaauccaagaguaacuaugcagcacuuuuuagagaaaauuggaaauuuagucuucuuaaaucaccacauuuguuggaagcacugcacuggcuggaggcuauuguuggagguuugaaggacacugggaaacacagaccuuuuggucagauuggucacuaguugaugucuguaucaaaauucagaagacaagagagagggacucauaggcauuucucacgaaagagggaaaaauguaaaaagcucaaccacccagaaauaagaaucgagaucccuuuugugaauauuuuuauaagaucucuggaaagagugcaaagggagcucucggguuugcaguaaauguuuaccuacuggggcaugaaaagucuaagcgaugaugaauacauucuuuugaaguugugugaguagaugauugaguuuuacugcuggcucacugucaaccccuauccuuauagauagauguuagccauugcucuagugacaagcauagccaucuugcuugaugacacuagcgggacagcuucaugcauggaaaggcagaugcuaaaguuaacagauaguuuuuggauguuagaaagcugcucuucaauugcucuggggacaauccuaguucauauuauacuuaauaauuaauuguuguaguuugaaaaaaagagagacuuggaaaauguccagaguaacuaaucagaaggagcaagugaaugaacuuguacuguggcaaaacagaaaaaugagauuugaggagaggaggcuuaacaagagauauuuuaaagugcuuaaaucuaguaaggguaccagaugcuugcuucugagaugugcacgggucauguauguguuucaaguagaauuaaagggaaauucaguauuacauaguaauaucagguucuaugaacucuguuccaaacuaaguagacgcaggaaauauuuaaaaaguuccauucuauuugggaugaggcagccuaggggaauuugagcacauuccuaagcuucugauuuggggagacuuugagaaaggcacugguccucacauugcucugcuguucccauggcacgguucaugccacagcuagguacagaagaugcaugugcugaaaaggacucuguugaccugaaaucucucauuuguuuuaccauauuugaaaaaugguuuaugaugaaaacuaaucuucagcacuuggacaggugguauuugaauuugaccugucuuacugggaguuccgaaguuccauuuaaauagcaaagcuuuaaaaaaaauagcaaagcuuagaaauuaguaaacuaauuacaccuuagucaaugcuuucaagaagguugucuguagcuuuccuuuuuacccccuuucuuuuucuuaccuacaaauaucaucccuagugcucugacauuacuuugguguaucaccuaauaauuuucucaauaaaaugacaaacauuuacaaaagcauuggauaaggauacuuacuuuuuuggcugguauuuuuaaaaaaauaauaauuuaagcauaaauuuaaaguaauuuaaaaauaauuuuuaaccauaacuuuaauugguuuuauuacaaaagaauuauuaccuacuauuuagacaauugcaaacaauuuacugcuguuaauuugucacauaugcuaaguuucauguagauagaaauuguggugguuuaauaaagagguagccaucaucucucugaugucuauaacuucacuuaagcuaauugaaacuuuuuuuuuuauugcagcuuaauguugacuauaacgugaaagguucagguucuucuaaaagacggagaucuaccgaaaaucaagaaguuuuugauuuagacgucauugugaauaaugaggacgacauuagucaccugaaucugaaugugugcacaagguagguaucugugaacggcuccuuuaagaaaguagauuucaaggguuaauuuguaugguuaucaagugggaccauugcaggagucccuauuaagagauuucuuuuaucagugcuccacagauuucauacaagaagugcagguaacuauguuuaagcccuucuuaggucggccaaaaauguucacaaguuuucuuuguauuuauaacaaauucggauagaaguaaauaaauucuuuaagauuauuuuauuuuauugagggaaucugagaaagcccugagcaaacaugaggcccucuggggcaggaguuacagaugguugugcucuacuuuauaugugcugagaauugaacccagguccuccaugagaacagccagccagcaugcucaaccaccuagcuagcucuccagccccuaaaauguucuuguuuguugauucuugcuggguuuaggcuacaucucagugagagcaugcguggggcaugguauguaucaggaagucugagaacuacuuucugcaguugauucuucccuuacaccuuggguucuauggcucgagcuccaguuacaaagcucauuuuugaucaacugagccauuuagucauaaacuuucaaacaaggaaguuguuucuuucccagugccaguuguggauuacccuccuaggaguugauggugggagaggucucagaggaccccaaaaguaggcaggcuauugccauuacucuuggcuguucaucagaaccagaugguaagacccuacugaugaagacaucacacauucugguuacaggauauagagaauuggagguggacgagcuggaagcucucuccuuccuggcuaguguucauucugagggaaggugcuauguaggguguggggguagaacacucaccagugaucuccuccugcugucgauccuguguauuacaauucuaacccaccaggcaagaugugcccacugaugugauaauggugcaaguauuugggggcuaacuagauacuuuaugaugguauuugaggcccacuccaagugaaccuagucaaaauccuggugugguugaugauaaaaauauaaccucauaaaacuuaagucuaauuuaggaaaacuguaaaauauugaaucuuauuuaauguuacaaacgguuauuuucuuguugaaauaauuucauuuugguuucagauuuaccuuuaacucuugguccaaaauuuauagcagcauacaaauccagcaaaaaugaauaguuauuuuagauacugaaaacacuccacuuuagaagauucuggucuuggguaauugugugcugguaacugaagcuuccagaaguguucuuaaauuggucuguauccagaagcacuugagaaucucauuucugcagaaaugcucauggcccaguagaacugugcagcugucuucuccagcuguugcuuaugcuugugcacaugauuuugagaacaacuacgagaaagcucuuaaauccagaggcuucauaagcuuuccuuggucagucugucuucucaccccagcauugcuugguguugagaaagaagcgaccuucaaauguucugcaucuaggaugcuccuuucaaauaucucaaggcauuuaaaugaugaacucagcuuguuguugggcuggaagccacuggugcucaugaagguuaucucuggguguugaucuagguacucagcuuucuuggcuauuuacuccuaucuguuguaccuuuagaucuugucguuugacugagaugaaacagcccuuguguuugccccauuccccccucccccaccccuucuugagcauuuugaccagcaguuggugcuauuugcauuucuacagcaccuuccuucucagcuggaaaggaaacaggacuuucauuauucuuuauuuaacuuguaacuggucucuauuaaagauauuauuuacuaucauaggagggaacaauauguaucccaaaccuauaugucagacauuaaacaaaauguuuacaugcaucucuuuuaggccuuacuagauaguucuagccagucaguaauuccacccuugauuuucucuuugauugauugauugauucauuuaucaaauaguggcugaguaucauaccucugugucucauacuggaaccuacacagagaggccaagugacaccucucuucaucuguugguuuaagcagcggaaguugguacugccaacuuuugaaagaaugucaauguuuugagaaauauuuaguuuagaaccaguauaaagugccccuagaaccccuugaaugguuaugcacugucccugcuacagccugcaagucgagccuaccucauugcaggcaccgcauccuauugaagaguccacugauagcucucguuccacuugucaccacaaguuauaaaacuaccauagcuagaagaaaacgugcucuaaauguuccuauagugaauuuuaguugugcaugaacaguguuuagagcaguauuuggaagacuuaaguuuuacauaaagaucauguguugaaguuuuuccuaaagguuuucuuuuucuccuugugucuuccuuugaugcagucacuuggguucagagaggacaggcaugguccuuauggaagugaaccuucucaguggcuuuagugcaucuucagauucaauuccucugagugagacccugaagaaaguggaauaugauaacgggaaacucaaccuuuauuuagauucuguaaguaguaagauguuucauaagccuuuauuggggaugguucuguguaugguguuuagaagccuguuaaguauuaggucaucauuucagcuuuuuugucuuugaaugauuuugauaugacaaucagacauuuuucucuauuaaaagaccucacuggggcugaggagauggcucaguggguaagggcucuuucuguacagugugauggccugaauuccaguucccaggacccauacaaaaaacugggcaugacuacacaugcuuguaaccccaucauuguggagggcgaaaacaagaggauccuggggccuccuggcggucagcccagcuccagguuuagcaggagacccugcgucauaagaauaaaguggagacugauagaauagaaugucuggugcucuuuucuggcuuucauaugcaugggugaaucuauaccaccccccaccaaauacacauaaaccacauauacauacacacaccauggauauacucacaaguuuaaaaaaagauaucacuaugugagaguuacuauuaaugaugaacccgaggaaggucuuuuuauaaagagcugaguaauuuuuuauuggaguauuauguauauauaguauauguauauauuugcauauauauuauacagucauuuggaagauuaauuuuguguguguacauuuggugugcaugugcauguggaguucauaaauugacacugacuaucuccuccaucacucuccaccuuuuuguuuugagugaggauagcucagugacccuggggcuuaugguuccuguaggcuggccagucagcgagcucuggggauuugucugucuucgacuccugagugccagauugagggaacauggugucaugcuuggcuuucuuaugugaauuccagagaucugaauuuaggaccucuugcuugcauaagacacuucacagaacccucucuacugcccugauaagcaguuucuuuuuaaauuguuuuuccuuuuuaauuaauuuuuauaauuggacaaacaaggcgaaggguuugauuauggcaucuucauuuguauguagaaaugccucuaugccccugcucacucuagcuaacacacuuucucucucccaguagccuccauuucugcuuucacuucacauauauuccauuacccuuucaccacauuaggauccuuuucgcccccacccuuuccaugcuuuccuuccuaguuuagugucucacaccccguccugugcauaaacacguguaaaaauuaaaaucuaggcucuucaguugagcgaaagcacaugguauuuguugagcacucugggucugacuugguuuaacacaacacuuuccaguuccauuuguuuuccugcaaaugcugugauuuaauuuucuuucaggcuaaacggaccuuccguuguguauguauggcacacauuuucuucauucacucaucuaggcugcuuccauuucuuugggguuaugaauagcgcaggaagaaacaugaauggguagguugugguugaguuagaguccuuucaguacauacucaagaguggcauagcugugucauggaauauuggguauaugugugugugguguguauguauucagauaauauauacauacacauacaugcacuauacacacagacacacacacacagacacacacacacacacacagacacacacacacacacacacacacacagagagagagagagggagagagagagagagagaucuagagagagagagaucuauauugaguuccaugauagaugguuuacauuuucauaguuguaagucagggucauuuauagaaacaagugucagucccucaugagcuguggcaugcauuccuucccuggggucucucuggaaggcuucuauggaccgguccuugucuguagacuuaggcuucucugaaucauucgcaacagcuagaacugagaugcacugcccgagccacagauuuggguggucccaggagcugucuacuaaaugauucugaaucucaagcaucccuuuaguagacggggacuaagaaccauuccucugcuaucaguguuguuuuggaauuuaaauaagaaaaauguauaaugaguucuuaacuauauuaccugacauucagaaauucuccccagauauuaguuucuauuuauuuccuaaaaugaaagaaaaauugaugucccagauauuuuuaugaacacacugugugccagcuucuucaaaucauuuauuuauuuauuuauuuauuuauuuauuuauagguaaaugaaucccaguuuuguguuaauauucccacugugagagacuacaaaguuucaaauauucgagaugguucaguaucuguaauggacuacuaugaaccaaguaaguggaucugggguuucuaagacuuugggaaucaaggcaggcauuuuacucauuuaaagugacaucucacaggguuaguuuugugggacaguugguuggaaggaaaaacguguggauggaggagaugcagguggcaggcugucuguaaaugaagacuauugacaauuuauaaggcucacgcggcauccuuuaguauagguaggaacguuaaaaagggauauucugccuauaguguuuaugaguguguuuacaguuuaugccauaauuacaaacuuaaaagaaaaacaacagugucuaguuauguuuaguuuccaaguuuuuguuucuuuccaagccccuagucugucugacccccugaggugaagggggaucccacaggaggggaauaauagcgugggguuuaauucuucaccaggaacucgaguguuuugguaaaacuugugcauuauaacauuuuuuuccucucucaggagaaacugagugcuugggaugauagcuugagcaucuuugauuugagugguaacaucuuaguuuauaaaauagaaaugaucuagaccgcgaaaggagucagcugcccuggcagacuaccaaauuaauuaugaaaaguugaacucagacugaagcugagugaggggguaauuguggcuagaguuucuaauauuaaagcuuuguucugcauaagugcucacgguacuucagggauauuggaaugcaugaaaugggcaaacauaacuguguaucagguaauugcagguaauuucauuugaaacaaggcgagccagcucacuguucuggaaaugcuugauagaguacucaaagguauagagacaaaggugcagugccagcgguucucucuccugggauuaaccccacccccuuugguccuuugcuuuuugguccuuuuuuugaugaggauucccccaagguuuugugggauauuugaaagagagguguaggaccuuuucccuaaggugaagggauagaauauacuauggggaccuauugacaguccccugcuauccaaaguauuauuuaaucuaguugcaaaaaucccacaacucauagucuuuaggugcauacaaaauauuuuaaacauuuaagaaaugaaaagauuugcuggguggugguggcgcacuccuuuaaucccagcacuugggggcagaggcagguggauuucuggguucgaggccagccuggucuacagagugaguuucaggacagccuuggcuacacagagaaacccugucuuggaaaacaaaacuaaacaaaacaaaacaagaaacgauucaagguauauguauacauauuuuauuauauauaauaugucauauaccaaauauuuaauauauacauuauacauauuuauauguguuuauauaaauacauacuuuguggaaaacaacuuauuuaugagggaacuauuuuacaaugaauuuaagaaagauaguaaaaauuaaaccuacuaauguuuuuuaaacuaucugaaaauacauuuguaauauugaaaacaaucuuuaaaaaaacaggaaaaaauaaaaauaaaauuuuauuagaauuauaaaacgaaauguuuaguuuuucagugaacuuuuuauaaugugauaugcaccuuauauagucuuuaaaauagcauugauaguauaaaagguaccucaaauugaucgguuauaaguuaguaugcauuuaguguuuuaaaaacauugaaacaaagcuguuuuuguuuuggugaguuuauuauauugugauaggcuauuuaugcaguuuaaaaauaucaguguguguuaugaauugucccuggugugagcaguguuggcuagugugccccugucuaacaucaggcauagaugacuuuccaucaucuuuugagucucuuagugaaaccuguguuagacacucuucccagggauccuaauggaguagaaaauaucauccccaaguaagcgcuugagaagaugaaacuaaucaagcuuuaaaauucuccccgcuucaguuagagauuagugugugcagcugccgccuguucacugccuuuuaaugcuggccaacagcuuguggaugacuugggcugaacacauuguuucuuggcguuuguuuacaaucugugugcccccuuagagcacugcauuuguuucugguaaagaaaaaacaaaccaugugaagacuaaccaccucaugauacacuuaugcucagcaaggucacuguuccucagcagaggagacguaaccuggaugucugccucuuuaaacagggagacaggcagugcgaagcuacaacacccaggugaagcuguccucauguuaccucaguccagacaccaacugcaagucacacacggacggagccacggacucccuucgacguucuucgagccuucucgucuuuugcuccguccuucuguacuuugugcaacauugauuaugauuuauuuuucaaggacuccgucuaaaacuagcauuuccagaaagucaagugugauuguuuucuuucuacaccugaugauugccucugacgguucugaaaaucaauuguuucccuuuccugggggggccuggggaguguaacaggccagagcuuguguaagcacguaaaacaauucacccaaucuuuguguggaagaugaccaggaugacgacgccaugucucuauaucuccuucucuaggaaaguuuauuagaugcauuuguuuuugcuagaauaaaaauguuauuuuccauuauuccuguuuuguaaaagaugugagggguggggguucuccuguauccaguccuucagcaucugcccugguguuaucaucgcagcaacaggagguacuuugcucucuguuccuucccacaucuggccugacucugcuguaggcccaucccacugucucagugagacucucugaucagcacgcugacucuuucuuagaauguagguaguaaguuuuuaaaaguaaaauggucuuuuucugcugcagcucugaugaccugccccagacuugacucuccccaauuucuuuauagagaaauuuuccugucuuaaacauuuccuguaucaugcugcuguauuacacugaaaguugccuucaaggguugcugggguguucucuucugucauggcgacagucucacucugacccugcuucaggagugcaagcuggagagcccucugacauaugcccacgugacuuggccuagaagagcucauuccaggagacacucugaacugagaguaugaggaauauugcucugugucacagccuacccauccccccgggaaacaagcugagcuugaagaccucagagagucaggacacaauucugcccgaaguucuauagugcugguccuggcugcuguucagucucuuccagccacagggucuggguauugggcuguauggcgcccagugaugcuguaagucauuaagaagauucuuguguucucagucaaauuuauucuggaguaugggauuuauugguuuuucuuuuuuguaagcacuuaaagaaauauucuuuccucaucucuucauuccuuuucuccccucuucucucccuuucaguguucccuguugaguacucugaaauagguuacauauguaaaaauucaaagauuaaaacaaaucaaucuaagaagugau

SEQ ID NO: 5214 - RNA, 3306 nt, Mus musculus
gcacucgggagccgggaagcgcaggcgggucacgccgugggccgcggcggcgaugcagcgacgacagcgcgcuccgcccgcgucucaaccggcccaggacggcgggcgaagcgaggacguggaggugcaguucuccgccgggcguuugggcucggccgcgccugcggggcccccggcgcgcggcaccgcggaggacgaggagcggcuggagcgcgagcacuucuggaaggucaucaacgcguuccgcuacuacggcaccagcaugcaugaacgagugaacagaacagaaagacaguuucggucccuuccagagaaccagcagaaacugcuuccucaguuuccucuucacuuggacaagauccggaaaugcauugaccauaaucaggaaauacugcugaccauugugaaugauugcauacauauguucgaaaauaaagaauauggagaagaugccaauggaaagauuaugccagcaucuacauuugacauggauaaguuaaaaucuacacugaaacaguuuguaagagacuggagugagaccgggaaagcagaaagggacgccugcuauaagccaaucauuaaagagauuaucaaaaauuuuccaaaggagagaugggauccuucuaaaguaaauauucugguaccuggugcuggacuaggaagauuggccugggaaguagcuaugcuagguuaugcuugucaaggaaaugaauggaguuuuuuuaugcucuuuucuuccaacuuuguacucaacagauguucugaaauuaacaaauauaaacuuuaucccuggauccaucaguuuagcaauaaucggagaucagcugaucagauccgacccauucuuuucccugauguugacccccacagucuuccuccugguucuaacuuuuccaugacagcaggagacuuucaggagauuuacucugaaugcaaugccugggacuguauugccaccugcuucuucauagacacagcucacaauguaauugauuauauugauacaauauggagaauacucaagccagguggaaucuggauaaaucuugguccucuacuauaccauuuugaaaaucuggcaaaugaacugucuauagaauugagcuaugaggauauuaaaaauguuguucuucaguauggauuucagcuagagguggagaaagaaucuguauugucaacauauacugugaaugaucucucuaugaugaaauacuacuaugaguguguuuuguuugugguccggaagccacaauaauggucuuaagugcuauuacccagaaaaacauuuaauaagaguaaaugaugaaauaaacaacucagagucaacuaucggugacaacaggacacaaccucaaaucaguggugccuucuuauuccuaacaaaauuuagaaauagugucuauuuucuuaaugaugucuauugcuuuuuucagaaauauacuaugccgugcaaauuuauaccacacaaguaaaaaaaaaaaaaaaugaagacauuaucucccaugcagauaucuaauggaggaacuaucuucaaguacuuuuuucuuugaagcccugaauugucuuuaagaaaauaaacauaaacuccagguuucaugaagcuauugcgagucugcaauagaauuugaaacuauucuuucaucauucaaaauaguuuuauuuuauuuuuuagcucagccgcauuuagagaacaucaaacaugucauguaugaaaugcuaaaucaguuguaucacagguuaaaacucaugaacuacaguaacagagaaagucuuuguccauguuaaacugaaucuuauaucaaucacuggaucccuuugaaauguauguaaauauaaauauuuggagguccaaaagcuucuuuuauaaagcaguguuaagaaacuggaaaaauaagaauaaaaucugcccaucugaaauacauaauuucgaauuagaaauuaauuacaaagcuugucgugugauguuuacaaugauguguuuuauaaaguauguggcuuauggaagcaagcacuuuuuuaguuaacauguauucuagugaaaauuauaauagaauuaaugugagaaguucugaguauaaaauucagggauaaauuaaugccuguguucugugucuuccuaggcagcagccauucauggaauuucagauuaauacuaauuuuguccccagauaagaguuggagcugaaagaguauaugcugcuuuaauuuucuaccucuagagaggccuggucagagggaguuuuccuuguuaguuguaaugcuuguuauuccguuuccauuagcuaggaaagaagagguggaagguguuuuaacuucugcaggaaaaggaaguucuugcugaguguugcacaaaugugugaccucuguggcaucuggauuagauggauuuaauauguacuggugacauaacugccuuguugccaugcuuuaauaggacgccuuacuuuaaguccuugagccuuuguguugcuuagguuugagucuguaggaucugguaucuuucuaguugggagaauucuacacaguaugggaauuuuugucaucuguccuuccaucaugcaguacauggcuccacagagcaaauuuuacuucuuaggcuguguaaauccauagucuaguuuuugucuaaaaucauuucuuguucuucuauugcucacuacuuuacaaauguucauuugguggaaauucuuaucacuauauacaaggggggaauaucucucagaauuauuuuuuuaaggggaaaaaauaaccuaaaaaauguauuuuaaaagucauccagugaacagcgaggaaugcaugcuuuuuaaguuguuauuuaggaaugcuuuuauucaucgaguguuuuuuguuuuuuuacaaagguaagagcagucugacaccagaggguugguuuuguuaccuaacgauuuuuuuuucuguuauguuuuacucuuuaauguuacuacuuacauuucuaaauuauguauuuuacuuaacucugaaaucaguuauuucacuuauuuuuuucuucauaucaugaacguucuaaaaauauuccuuauaaauuugcaucacuuuuucucuuguggcuuuugaaguuacuauauucuaaacuugagaagaugguauaaaucaauaauagaagagucacuggggagcuggugagauggcucaguggguaagagcacugacuucuuuuccaaagguacugaauucaaaucccagcaaccacaugguggcucacagccucccauagugagaucugaugcccuauucugauguguuugaagacagcuacggugaacuuauaauaauaaauaaaucuua

SEQ ID NO: 5215 - RNA, 119738 nt, Mus musculus
accuucucaggcguuucguaaccgaguaaacugagagccgggaacagcccucuauuaaguagcccgcggcgcggagucucuucccagucggcaaaggcggccgcugcagacgcguccgcccgcagcugcauucagucccccugccuccgcucacucugcgcacuaggcgcugcugcugggugcucccaucgccuuuuccacaccggcggccgccaggugcucccggagcgcagcgcccucccaggcccggggggucccacgcgcaggcugcuggacgcccgcucccucugucaccuccggcucaggucagucuggcuucuguuccccaccccaacccccaccccucgcgcccuuucccaaagauaacuggggaaaguggcuucuugcuugcaccuuaacccggggcuggcagaaugcccagcaggggcugcuuggcuuuggaagcgauugauuagugugcccgagauagaucuguggcacaggaguuuggcgguuucuuuggaguuuuggagggagaaggaaagguggcuugcuugugugccaagugggacucaguguauccaucuguagggcaauguccucuauagucucugucgcuuucagugaagugcacgggcugcauaggucgcucuuuauaaucugguggcuuugccagggacuccaggcuugcagcagggacucaaggcauugccagaaaacgaagugaaguacuguacgcuccgcgaagaauuccauggagggccaguggaaagcgcuccagcuuggggagacuaggcgcuaguggcaucuccagaugcucgggggagcugcccuggcuccauccuccacugcuuucaaagugcugcuggguuaggccagcucucgcagcuucugagacuuccuuuuuggguuccuccugaaugcacugggauuaaguuuuacccagggucagucaaugggaccuuugaggaggguucuccuccagucuuugagugcacagaucagagugcguggagucagugcauuugagagcaguugacaaaugggaccugcaucuggcuuccucagccaccauccccugaccaauucagaucuuuggcauacaccuccucucagcuccaagguuagggucuucuaaagaauacugggguaggauugggggaggggggcgaagaaacaagucuaagcucguccuuggcuagguagccuuuauagaagacguaggugacgccuggacucuagaugggcccacgaaacauuugugugccugugugugcguuugaaaaaaaaaguuaaauugagagaguuaagaaguuggcuccuuccagcaaggggugggggaggggcaaguuguccgaaagagaccaguucccauagugcccccacuccgggcaguugauucauuuucauucaugaggggaagugagggaaauccuacugccacguaagggcuaccgcuuucagacaucuaugucugagaaugcucaaugaaguguugcuaagcacuccgauaaauguuuuggcuaagaaggagagagaaguuuuucuuuaaaacguauacgaacggaauucuuggcuggcugagauggcugaguuauucaucagauaccccaaagagaagugauucauucuugaugcugagacaggaagccgauagguggcgcacuagacuaagacuagacuaacucaaguuuuuuguucacccuuuuaacaccccccccccccccaaauacugcacaccgauuuuuguggguagguuaccacucuuuaacuuuucgugagcacaacugcggacugcauucuaaauuaucauaucagcguuauggccgggugacgacaacaaugaagcauuuaugcuuuuuuaaucuuuacaaauuuugacuaauguaggaaaggguuuguuguuaauuagggggagaagacauuacuaaaaccccuuagaucccagagcugcgccaaaauuuuaauauuggcuucauaaaaaggagcucugggcaauuuggcuugccugcucaucagacauguaaaaugcaauuuacacucggaugaggaaagcugcccuaacccucgugccaaugauuuggaaaggcaggguuggagacugucaguuccuuuuuucucaaggagagcccaaccuuuggcuuauuuuugaauucccaaacacaaaugggggagugcuccccgcuauuugucaugaggccuaugguguagccuuaaaguuaugugugcacuucugaaucuccucguucuguuuuuugcauuuggccacagacaccuucccaguccagcuaauugcugguaacuuuuguuccuggauuggaucauagaauauacuagggcaguccuuucugcugcuaaaacagcuacuguguguugagaaaguaaaaaggaugaguggaacucuuugccguuaaggaagaaaucuauuugcaaaggcaggaaaaauuaagaaccuucucaccucuggggcuuguauuaguuauaaucguccagcauuaagaaauagcuaaacacaaggaagaauuauugcgguuuguacaaucuaagaauguuugggaaacagacaagggcauuuugcuuuuucuacggcuucgucucuuuuuauuaugcauuuuagaguugguucccucucaucuuugguaaagguuuuaucagaugugaaaacgacacgguuaucagaagaacugggguucauuugagccuuccucaucccucuguaaucuauuccagaucuuaaagacauacuugcauauuuuuagucaggauaaacuggagaaaauagaauaaaugagguuuauuauuauuauuauuauuauuauuauuauuauuauuauuauuaucaaauuacccugggaccacuaaagcacaguuaccuaaagagguuagcaguuagggaaaaacagccaaaugaaauacccagcuggaagacacauuugguugagucagggauaaaaugaccucuaaauuauccaucaccuuggcaguaugaagucaugugcggucuggucaggccuuuacagggcaccaggcagcagcagcucccugggggaagaauauucucuuuaaacuagaauuuccuacuagugcccugauuaaaccuauuggaagagcuugacuuccaugguuccacaauggguccauuaugugcugggcugggcccuguuguuuuauaggcagauuuggcucgguucugguccauguuuaggcucuagucuaaccuuguucguggccugcucaggcuggguucugauggaucacugcuuccuccugcagaucccuucaugaggcugugagcuugaggcccaaacaugcagaccaggcuuccccgagcgcuggccgcccugggcguggcccuacuccugucuuccauugaggcagaagguaaaaugcuuuuacuucuccuaugacaagugaaacugcagaguucaagaaaggaaaagacuuucaucuccugcuucuguugcuuggucuguuuucucugcacuucucaggugcuuucucuucuucagagaaacaccugccuucugagguguguccguuucugaacuuuaaagguccagcucguuuauucugcuuccacuauucuguacagugcuguguggucuccuugcgcuugucucugcagugugcuguccacacugccaccugcacugccgccuuccuugacgaucaguccccuggauagggcaacaacuguauccagcucugacaagaggauucccgacaucuggacaccaggaaccucagaauauggacaccuuuacaggaucagcagcggaucaccugggucaggacugugaccuuggugacaacaugaaauaaaagacuccaacacugccagccccgagcgucugguuuuccuuucuuuucuuuuugagcagauuagguuggguaggcagacuuucagacaaaggagccaaccuucaaacugccaguagcuaggggaggugggugggcgggggaugagugacaagcagaaacugaccccuagugggugcucacucgaucuagaggacccugcuguuugcguuugguucuaagguuucuaaagcacacgucccagaacaacccagcugugggggagggguggcucggcugggugccaggguuuccagccuguaggcggcugggauccgggcaccccuuuggcuugcucuugcguuugccuggcucagggagaccuggccgcgucuaaccucagcgucuuggcacuagguggucagggacaccacaaugugacuccaaaagccccggcuccuuguacccugccaucuagaaaacuuuuguuagacuuuuaaccuaauuuccguuuuguuugaugcacuuagugcuuucaugucucaguauuuaucgaggaagccacuuccauguaacaaucuuaguggcccuuucaauuaucauucgggacguugcaaacuaaucguauuucgcaagauaaauggguuaaucuugaaaaguccuuuuacccucuucaauuaaaaaaaaugccuuuaaugaaguuagggagaugucuguccgcucuggaaauuccaggguagacuguguugauacuaaagugguuagguauguagggcuguuucuugaccauccugauuuuuaaaaaaaauguucuacuucaaaacuauagguauagagaguuaauguuagggaaccaaccauagcgcacugcuccuggccuggcuuucgugacgagucugaucuucccuccugaaggaguauucugaugagguguccuuucaguaauccuugcugugacgucaguuaggaaggaauuuuauuugagaaacuucuggaagcacuacugaagauauuuuuagauaaaucacugaaguggccuguuuguugcccauuaagaaaauaguucuuugaaaauaaaaguuuugagaauucuuaaguauaggguuagguuggugauuaugcuaaguggaaaacaucucuuaagugguauugaccaggcagcaaaauacaguuaaaaaggacauuauacgauaugucuuuauuauuagcucauauuuuaucuucuaacuuuauauuaauuuccauaugauguaguugguuuuuccucaaucuuucuuaagcucaugucuccuccuccuuuaggccaguauauuuuaauaaauucauuuuuggauugcuuucuaguuuggcagugucagacagaaauaugaggcacaaauguaagucauacguagaacuccaacauuucuuauagucauauaaguaaaacaaaagggaaaagaagaaaaauugauuuuaauguaaaaggucuuaacacaauauuuuuguuucaacaugcaauugauagacacagcaucagcuagcacuucugcauuucugugcuaaguuuuggaagcuggacguggacuuuuuacacuuguagcacauuucauuauggacuggccacacuucaagcgcucgguagccacguguggcuguuugccccuuguugggcugcucagcccugguguuaacuacuaacuaaauggccccaggagccuagagaaggcuaacaaaauuuguggccaaagucuuucuggagacguugggcuaugaaauagaauuuuucucccugaaaucuuucugugagaguauuucaaaauuucagcuugucccucuguguacagucuucugguaggguagccaaaguuacuuuuuuuuaauuuuaauuuuaauuuuuuugguguggcucauauaugcucuuguaguucuauggauaauuuuuauuugcuuuuuuuauaugcugaaagcacaguuuuuuuauguuaauugaaauuauuuuaaaauuuacauuuuaccuucaaaaaaucauaauaaaauuuucaccgugcuugcauuuguaugguuaaauuauguuaccauucuagguuacuguguccuauagacguaaacacaaaggugauuuuuaaaaauuuuugucuuaaguggauauuaaauagacuagcaaaguuaaaacuuucucuaguuuaagauuaaaucuagguauggaccuagguugugugaguuagucuggguuuggguaacauauauuaauagauuuuuagaaaaauuagcuuugcauuaaauagcuaaugguuauuauuccuugaaaacuggacacauuuuuuuucauuaaucuagaauuugagauggauauaaaauuugugaaauucaguuuuaaauuuuguauuauuuauagcuuauaccauauaauaaacaaucauuaucaauuuucagugauuuuaauccaugccuuuaauaauaauugccuugcaucuagauuaagaaaaaaaugauauaauguacacacauauauguauuuccucucacaauccuuccuccauccccccuccccuucuaaugaaagggacuguuugccugugggugucugcaucugucugaaucagcugcuauguggagccccucagaggacagccacgcuagacuccugucugcaagcaucacaaaauaucauuaauagcaucagggauuagugcucgcagcccaugggaugggucucaaguugagcugguuauugguuggccacucccucagucucugcuucauccccuggauaaauuuuggguugaaagucuuguggguggguuggugucccucuugcuccauagggauuccugccuggcuacaggaggugaccucuucaggcuccauauccccagugcucugagucacagcuaaggucaccaccacugauucuugugggccucccuuaucccaggucucuaucuccuggagaugcucccuaacucugucugccccacugucaguugcagauuuccauuuauucagugcuguuucuaauauacaacaaaacauucaaaccagagaagguagaugccaucuauccugauuguucuauuuuucagaugaggaagugagaguuccuggaguugauauuuuauuguagcuuuuagauuugcuuugucuuagcauauuauacacauugacuuaucuaucuguccacucacccaccuauucaucuauccaucaacccaugcacucaaccauccauucuuccaucuacccacccacucauaaguuuucuaguaugguuacuacauagcacagacaggauccaggaccagugggcuagugcugauuuuccuuuguaccuaggaacuguucaacuuggccaauuuaauggaaaaaacauauuuuauaaugugcaucaaguaaaucauugcuagucugaaguguuaauuuucagcugcuauuuuugguauuuauaaaugcaaacaacaugcacuuugguagcaucagaugcucaauaauuaaguuaaugccuauggaauauaacagacucaucacacuuuguacauccaaggcuucucuaucacugagaaaauauccuuuccaguguuauuucaaagaucagaacaaagaucuuacuaguuuuucaaguugauauuuuaauguggcuuuuauauuuguuuugucuguaauauuauauuauauucacccauccaucuauccacucauccauccauccauccauccauccauccauccauucauccuuucauccauccauccuuucauccauccauccuuucauccauccauccauccauccauucauccuuucauccauccauccuuucauccauccauccauccauccauccauccauccauccaucuaacuauccauuuguuuauuucugccauucuugguuauagacuuuuguuggguacucuaauugaaaaaaagguuauuuuucuuuaagccaagacagacacaccaauuuuaaaauuguuugaacaagugugugaaguuaaucuaucaaauucuaucuaaauacauacuagugguauaguggugagcauagcuaccuuucaaauccuaucuauauuugaguugcaggugucaacgugauacauauauguuauugggcagauacuuuuuuaauaaugacuuuucagagaauagaaaaauauguauguacacauuaacagguaguauaaauguccuaaaauuucugauugaaacauuucuucuguuuacauuuaaucuaauguggcagaaaacuauacagacugcaagauaaaauuauugauacccauaagcuauaauaacuucguuugaauuucucuuguaauucaaugauugcaaggccuauaguuagguuauuacaaagacaaaccugacaaaacaaguaaaaugucuaaaugucugcacauuauacagaagacaccgaauacauuucacauaguaugaucauuccuaccauacccuaaauccuauagcuuguguaacagaaaucucaucagaauucuacuuucuuuucacaguauuuugauacuaaaaauauuauguuuaaguauaaaauuaaauuaccgguuauaacuacucaagguuuuguuucuucaugauaagaagccagguuuuaugaaucagauuauuauuuauaauuuuaauuauguuacccuuggcuuggcuauggugguuugcacuuacaacuguauguagcuaguuaguguuuguccuauggcuauaucagcauuauuuuagggaacaccuagacucugugacgaugugauagugguugugaauuauuuuaacauaaaaaucuucccaaaucaauaaaaacauguauuuguacugauuuaaauagauguggguuacacccucacacauacuucauuauguuuuucauaauaaaucacaaaauauguaaauaaaugacagucuugaaaugcugcauauuugguaaauugaaccagaaugcgaagaaugaagguguucugcuuuucacacaucgcuaggccauuuuuccugcuuucaaaucccagucaccacaucuggguuuccacgagccucuuacgauccucuaaaauguucaagaauuuuccccccacagucauuuuuucagucuaucuggaaugcuggucacuuggacaucaacaaggugggccgcugcugaccuucagcaguucuaaccuaauguccgcuccuucaggucaauuuccaagguuggugguacuauuuuuccauguacugauuuuuuauuuuuuaaagcugcucaggccgguugugucugccuuugcauuaaauuuguccugagccauugcuaucagaagaauauuuuauaaugauauucuuaauacccaucaucccauuaacaucuguugcaugcucguuacguauacuaagggaugacuucagcuaaauauugcaagaugguuccagacagaagaaugcugaaugauuaaaccacgcauguagauuaauaguucuaaucucacugccuguguauggauaguaagaaaguaacguucauucuucuaguguauccaauaaaaauaaagccagcuccuacaguuggaaguggcaauuuauuaaagcagauguuugccugaugaguuucguuuccuuucaaaaucugcuauggauguuaaagauggcucuaauccccauuaaauucugacuugugucucagagcuauuacugcacuucaauugacuuucacaaaauucgaagaggagaucucuuaaaacugagauacaccuucucacucccaaugagucuguagacuaagacguuuaaagaagcaaauggcugaaagucaucuguguugaacuugcuucaaguguaaugauuuucaaagcaucgaccaugcacugacagugagucaguccaaugcugcaugaggaggcaugaacauugugcggagaauaucauuauaaaauauuucaggaaugucuuuguguaaugacuacuguacauggaggcuuuuguucauugugggaaacuaaaaacgagucaaacauuucauugacacaugcaugaugcuguacaguuuuguauguagacuguuccucucuguacuucacaguuauuucugucauugaguucuccaagauuuuaugcaagucaugucuuccauugcugauccuucauuucuauuuccuuucaaguucuguaaauaauugcccuucacuauacauugauguugucuuuucauaauuaaccauuguuuuuuaaagggccacacuggcauuuuuacuuaaaaaugcuacuucuaguauggacugugcccccuauaaaggcaaugaccauguugguuuacaccuugggaacacagcaaacugguguaaaugggcagaauauaaguuuuauaaacauuucuaguacuguuuauauacucauaaaccauuaacaucucauuuuaaaacuuuucuuauuuugauaugaauauacauuuaaauguauguuuccuagugagacauuuuacuuuuuaaaugauuuaucuuuuccauucaaauacauuuuaaaagcuucugccacagacugagauguacccagcaacaaugcagagguugaacccaaaccaucagugauuuucuuucuacauuauaaaagaguauggugucaguguucuaaauuaacgucuaugguuguaagcagguugugauuuggcaugcuuguucaaagugcacucagcauguauugaauuucuuuaauuguuaugugaauuguuugcauaugugguuauuauaugugauuucauuguucucguauccaaacauguuucgauucugcuugauuuugcuggucauucuugaauggcuuagcaacucaaguaucaaguguuccguggcugucuucuguaauuuguacacuuccugauguuuugucauauccugucagcuuuuaauuuuuuucugauccaacaagauaucuuuuauauuuguuggaaacaaauuuaugcaaagacaacuuuaguaagcuuugcucaacacaauucuucauuaaucacauuaaccauuuucugacacuggaaaacacaacugaucccaacucucuuuuugcaguugacccaccuuccgacuugaauuuuaaaauuauagaugaaaauacuguucauaugucaugggagagaccaguugauccaauuguggguuacagaauaacaguggacccuacaacaggugaguuucaagaugcugagguuuuuggacagagacaucaagaguauauaguuugccaaaccucacauuuaacugcagggagggcaagaaugagcaagccagagggauuugguugaugucaccagguuuuuggcggacucagagcuacagauucggauccuaauauuuucaguaaacaagacaaagcaaaacaaaacuuauuuuggaugcccuauuguguuaucaacaguguuaauuaaccauguugcccaaguguggaggaccaaugucaaaaauggugggaagguaaucauuugcauaaaugauaagaagucuucauugguuggcagugaacauggauauugccaauauugcuaaucacuagaucuugcuuauaucucuuggccuuuuagaauaccagcaguuuaaaauacuuucucaucagggaaaaaaaaaaaaagcgccgggugugguggugcacgccuuuaaucccagcacucaggagguagaagcaggcggauuucugaguucgaggcuagccuggucuacagagugaguuccaggacagccagggcuacacagagaaacccugucucgaaaaaaaaaaaaaaaaaaccaaccaaacaaaaaaacaacaaaaacaaacaaacaaaaagacauuauggccaaagaacugaagaaagagugaaaacguuacccuuuccuguuucucucuaaguaaauuuggucaauggcuucauuuauucuaaagaauacucuaaaacaacccaaauaggggucauacaguuucuagauacugggaauauugacucucaauguucaaaaugaguaccacaaggauacaauauccucaugucccacagugcuccgguuauuguauguggcccacauagaaaccaggggcauuucuuagagucgugcuauauaugcuaccuuucuuaauuaugcuuugugaaauauuuaauauaauugauauguaauauaucauaucuaugaugauauauaaugcuauauaaauguaaauaauauaauauaauugaaguauucagucaauucagaggacuauuggcauuaauuagcauauggcccacauuugaauguguuuuuuucuaucuuucuguucucuucuaauuuauaacuuaaaguuaaauuauuuugacucauaucuuauuuaugaaauugauauguuuuuggucugauauucugacauaccuuuaauuuagaaggauuucaagccuuuuaaguuuugagugugauugucagauaaaggcaauacuauugcauauauuaguuuucuaaaaaugcaaggccuuauuuuuggaagacuguuaagaauaacucuugaaugucuugacaaacgcauacgguaaaaguuucaguuuuggaguacauuuagacuucuuuguaauaucuuauuuucaggaaaguuuauguuguauucuuauuuuucuuuuuguguuuucagaugggccuacuaaagaauuuacccuugcagcuaguaccacugaaacucuauuaucagaucuuauuccugaaacacaguauguggugacuauaacuuccuauaaugaaguagaagaaagugugccaguaauaggucaacuaacaaguaagaacacauacaauuuuaaguacuuuaauuauuuuucuuaauuauuuuuuacuuuauuuaauuuuuaauuauuuuuguuuuuaaauuugaaauaacuuuuguauauuuuaaauuaaaauaugauuaugucacuuccuucucuuuaucgcuccagagacccuccccaccccucagaaaacccucccucaaucuccuuccauguccuccucaauuucaaauugacagccuauuuuucuuugauuauuacuguuacauagauagauacacauacauguauuuugcagacaauuuuccagcuucagguuuaaucuccuauuauauagguaacauauaagugccacuuucuacgacucuaguuauuagugguuauaaacaguucauuugugccuuuaaccuuagucucaagaaguagcacaauaauguaagaacucuuuugaaguaucucuaacaguucaucaaaauaauucauuuguaaggaaaucauuguuugguacuuugaccagcuggacaagaccaaacauuugaaauaaaauauuaaaaaacaauguauguguuauguuuuuacuauauauuuuuuugguuaauggugggcuuuugacucaguucaaacaggugguccuacaaagccaggggagaagaaaccuggaaaaacagaaauacaaagugaguuucuuucuguauuuuugcuuggauuuguagaagucacaacugcacuguaguagauguucuaauuauagacaaagcuuaaucauauucccuauguuaacagauauaagcuuucucuagaaggaguagauaacagagaaauguauaacuaaauacuuauaaaccuugaggucuucccccuccuauaaauugauagcaauagaugguacuuacagauauaugggagcagacucagagaaucuuaguaguugaagcaacucaagugcugugaaauacacuuuagguguacuugcauauugaacucaucccugggauauuucuguuaccuuggcucaugacgucagcuuucucaaucuucccagaguuucugcagcccauccaucucuaaggacuuggugaauucauaaccagaugaaaaauacuuuuauuuauuccggcugugaggcucuuccccuccauugucugacacugcuuugcguggcuugcuagagugaacucccaaggaguuucuuggacgucugauuuugccacuuuguaagcuggauuuaugacccagacugaccauaaaaacauuauaaacacaaaggccucuuucucuggagcaguucccucuagaucacuguuuaucauuuccucagauguccaauaaucuaaaaugaaguuucucuuaugcaguuauauuaauauuuucuccaaacuaucaauauuuauucuaaaucaaaauauucugccagauauggguuuuuaauagacuaaaauugcccuauuaaacagcauauaauugucuugcacaauuuuccaagaccuuuuccugcuccucuuugccaaauacuuuuuuuuauuaucuaccaacuaacuucaaggacaaaaacaucuucagaaauccacuaaauguugccuugcaaauauggauuuucaugaaaaccaacuugccuccuugaccacggaagaaggaaauauaaugugaggucauaagaguccauugcauucuaaucccuuaaggaugccauauggacauuugggcuuuugacuuacuaguauuuccuccuuuuguuuaauaguggagauuuuaguugucaaauuugagugcauagauaacaaagacauagauaguuuggcuacuuugcaugacguuaugcauagacuacccugacuauaaacuuagacguuuacauuggaaaauaugacagacuauuaaaacauuugcucugcucuucaacccagaccaaaucugccugaagagcacagauugaauuuaucuguugauaaauaacaaaacgggaggagacacuguugacauuucuuuugugugucucccagauguuuuauguaaucuucauuuggggaaaaugaaagauaugguucagaaaaacagguugucacugcaugugcuccgacugcaguauccuggguagcguaucacaucucuagucaguucuuugcuaucgugcauagcaauguaaaggcauccugucccauacauggaucuucauaugugcacuaaaauuacuucaguguaauuuuaagguuguauauccuuuuaaguguguagauagaaaacagugggucacauauauucuagugaagauuuuugcaauguuaggcugugcuuuuuaaaagacggacugauuucaucaguuaaaaauuugucaaauucauuucagagugcucugucagugccuggaccgaccuaguguuucuuguggacggcuccuggagugugggaagaaauaauuucaaguacauuuuagacuucauuguugcucuggugucugcauuugacauuggggaggagaagacgaggguuggaguuguucaguacagcucagauaccaggacugaauuuaacuuaaaucaguauuaccgaagagaagaccuccuugcugcaguuaaaaaaauaccauacaaaggcggcaacacaaugacagguauguuuuagagauuauauuauuguuuaaaauaaaugaaauguuuauuuugaaaagaaauuuaagaaacugguuauauaguuagcaccuuuggaauuaguaucuuagccuuuaacuuuggcaaaaugggugccuacaguaagugaaaauauugcuuuuuuccuucaggggaugccauugauuacuuaguuaaaaacacuuuuacugaaucugcuggcucacgagcuggcuuuccuaaaguggcaauuauuaucacggacggcaagucucaggacgaaguggaaauuccagcgcgggagcuucggaauauuggaguugagguuuucucucuggguagguuaagucugacuggccauuuucuuuccagcucuccucuaguacccuugaugcuugagaagauaaaggcugauuccucagggaaggaugcugucaaaagugcuuacugcauuuuauaggaaagcauguugccaaguugucuuugaguaaaaauucuacuuaucuauuuccucauaaaacuuucugagcauauggaugaagugagcugauagucacaugguuugccaggucucuacuuuucaacgaacacucugccagugguucuaauaaagauccuccuuguguuaucauuaaguggauuuuaugcauuuucugcauuacaccauacuugaaauauucacaggucucuagcucauucagcacuuuguaguaaaaaaaaauuaucuucacagauggcagagacaagcaauggcauaguuagaauggaggcucucuccauuaauuguuuguuuuccucauggcuggacacugugaaauuauaaaacccuuugucacugaacauuuguuuuucaucuacucucaucuauaucuauuaucuaucuaccuacuuaccuaccuaccuaucaucuaucuaccuauauaccuccucucucucucucucucucucucucucuuucucucucucucucucucucuuuccaucccuccaucuaucuaucugucaucuauuugagacugggucucaauauguaggucuguccuugaacucacagaaaucuucaauccucugccuccuaaugcuaggauuaaaggcacgugccaaagcaacucuggauuuuaaauuaaaaagggucaaaauaucuucaguuuuacaagacuaagaaauacugcaaaaagauucuuacaguugguacauuucccauuuuaucauauuccccacccuuuuguuuuuaaggcauuaaagcugcagaugcaaaagaacucaaacaaauugcauccacaccuucccugaaccauguguucaauguggccaauuuugaugcaauuguggacauccagaaugagauaaucucgcagguguguucaggaguugaugagcagcuuggugagcuggucaguggagaagaaggugagugcuuguuucuugaggggggcauaugugccagcucuuucugacagugguuccugcuuugcagguauucuagaauagacaaaucuuaaccacuuccuccagugauugacuggugucugaacucaacuuguuaauaccuuggaauuauuuucucucuccauuggaagauuugacaaaauauuuauuuuucugugaaguuucugaacuuuuuuuggggugaggggaaauuuuugauuagauauaguuuauuuaauauuuuaauuuuaguuaaaacauuuuaaaauaugucagguuucuccucuuuccuuccucuaagcuacucuaugugccucuuugcuucccuucaaguuaaugaauguuuuuuguucguuauuguuucguauauauuugcgugccugugugaaaaaugcauaaauauauaaauacaaccugcugaaucucuguaguguuauguguauguauauaauuucaaggacgcacuuggcauuggagaagcauuaggggcuccucucugggaaaauccuuuucuucuacucucagcauuccuuaguugccuacagucuuugucuaagggugggaccucaugagaguccucuccuccauggauuagacuuuuauaaaagucuuuuggcauauauugucuaugcaucaucaggcuuuucugggagucgauuuaauuauuuuauacucagacuuaagugcuggcagauugcagacaauuauuuuuagcauucuagaacauaagugaguaacagcauugcuucuaccagacccuaaggacaaggacuuuccacuaucagguguccccuaauguguucaagucuuaggcaucuuucagaguucaggucaguuugauacucccacaucuggaacgcuuuccuguuucucucaguuauuacuucuaaguacauagaggagagaagagguauuuccaaaggauauuuugcaaguauccaucugaacaccgaaaauccugguacuuccccaugauggucuccacccacucugggaauugacagaugguugaguguagcuugcccauggugccaucuucaauccuauuuucauaaguuccuuggcuuuacuucucacacagcuucuuauccuuucugaauccuuucuguuucucuacugucuaacagauaacuuucccucacccugagucuguaucaucauaaaaucuguauguccacuuucacuuuacuuggauuaucucucuuuauauuaaacagguuaauuauuaguggaaugcaguuuugugagugcccagaucaggcgaggcuuuuguugugccccuauuugaaccuuccagcauggguagugaugaccacaucacagcaucuauacuggaacaugaaaauaaagacaaggagugaaaugacaaauucgacaugaaaaguuuggacagagaaggauuaaacauuaaauauacuuucaucauaauugaugaaaaaauuucuucuccccaccaaacuuuucagcacaguaacuaaaaccuuacacuaggacucauacagauggaaguaaggagaaaggguaucagccaacacuuuuugauacagacauugucaauucgaauaagaagaauugaagguccaaauguaaaacauacuagaguuguaccccauuauuaaucacuacaugcuucuucuuuuucuaauuuuuuucuucuuagucaucgagccuccuucaaaucugguagucacugaacucucaucaaaauacauuaggcugagcugggauccgucucccagcgcugugaccggcuauaagauccuccucacaccaauggcagcgggaagccggcaucacgcuuugaguguggggccccagacgaccacgcucaauguucgugaccuuacagcggacacggaguaccagaucagcguuuuugccaugaagggccugacguccagugaacccacuucggucauggagaagacgcagccaaugaaaguucaaguggguaagguagccauuucauugcuaugguuagaguaccacaccauggucugcuaguucagacuucguuuuaaacauaguauuuucaguaguuuuccccuccaauggaguuuuccugaaacuggucuaaacuggcaagcaagccccaggaucugccugucuccaugcccucagcacaguguuacugaugcccuugguucucaugugggugcugacuauccaaacugagguccucacacuuccucaggaagcacuuucuccaacuggucuaccucccuagccuuguagcaguuuuugaaaagaaguagacuuacaaagaaagcgagauauuuagaaauaucuauaucuuaauuuuauuauauuuuaauuuuauuuguuuauguuuaauagauuuucuuucucuucacagaauguucacgugguguggauauaaaagcugacaucguguuuuugguugaugguuccuauagcaucgggauugcaaauuuuguuaaaguucgagccuuuuuagaaguucuugcaaaaaguuuugagauuucuccgaacagggugcagauaagccuuguacaguacagcagggacccucacaccgaguucacauugaaggaguucaacagaguugaagauauaaucaaagcaauaaacaccuucccguacaggggaggauccacaaacacaggcaaagccaugacuuaugucagagagaaaauauuugugccaaacaaagguuccagaagcaacguaccgaaggugaugauucucaucacagaugggaagucaucagaugcuuucagggauccugcuauaaaacucaggaacuccgacguggagaucuucgcagucgguguaaaggacgcugugcgcucagaacuggaagccauugccucuccuccugcugagacccacguguucacaguggaggauuuugaugccuuucagaggauaucauuugaacucacacaguccaucugucuuagaauugagcaagaguuggcagcuauaaagaagaaagguugguagagccuccgaguucuaaaaccauggguaggguucuucuuugauuccuuggguacaagaaaacauccaacuucuauggaaaaccaugggacuuaguguacuugggucugacacuuuuuagcuccguaguagagcacuugccuagcaaguguaaggcccuggauucaguccucaguucugaaacaaaaaaacaaaacaaaacaaaacacaacacaacacaacacaacacaacaaaacccaaccuucuccuggguaugcacaccauuccauuauuggugaaaaaaaaugcuuacccaaaaugagauuuccuuccuuagaucuucaaggaagucuaggacccagcuucaucauaccuauuugucauagccaauuaaacaaccacuuaccgaguuucuacugucuaaauacaaaucuggguccuuugaacccaaagcaacuaaaaguguuggaacuuugaauucuuuuuguguauucuuuuuuuuuuuuuuuuuuuuuuuuuuuuuuuuuuuuuugcuguuuugggcaugauauauuacauccagaauucucuauccuuucuugauuugucuaaauugugcuuuccaaugcuugcuuaaaaauaucacccacuuuauaaacccaucuuaaguucucuaguguauuugcaucauuuacacauuuagcuuuuuuuuguuaguaauuuuauauuuucauaucugucccauuuguaaaccuccaaaggacaaugugaauuaagcaucaccucuucccaugaucaguuuaaugcaugcuuaguuuaauaaguauauucuaaaaauuauucuuuuguauauauguauaugauggacacacacaugcugugguguguguguggagagagagagagagagagagagagagagagagagagagagagagagagagagcagagacugagaccucuagugucuucgauuuccaccuuguuugaggcugucuuuuguugcacucuccugugaucucaagcugagcacucuugccuccaaggccuuuuucuugcuguagaagcucugggauuacagaagaacuccacuguaugccauguuauauggauuuggggaggucaagucaguuccucauacuugcaugacaaaugcuuucccaacugaggccccuuccugguuacuauaauuauucauuugccagaaaguuccuuugcuuuacccugggacaucugucuaccugucacuaagggguaacauucaaguaccaggaugaaugggaaaauuguuaugguucauuuaaaaucugccacuaucuaaauauacacuuguggggaaauauuuauuuuauuaaugcuucgucuugagaagcucauuuuaauguauuacuuucuccauauaauauaaucaccguuuuuuauaguuaaggaaaaugaucaggacuucguuuuaagagggaagccuucucucaguggucauguguaugggucucaaugacucugcuccugaaugaaacucaaccauuucagaagcaaaggguugagaggucuauuuuuaugggucuuucauagauuuaaaauuuuaaauucuuucuuuuuucuuuuaaacagcuuacguuccaccaaaggaucugagguuuacucagguaacugcuaauaguuucaaagcugaauggucuccuccuggagacaaugucuuuucguaucacgucacauacaaggaugcuaauggugaugaugaggucacagugguggagccagccuccagcacuaguguuguucucaacaaccugaggccagaaacccuguacuuggugaaugugacagccgaguaugaggacggcuucaguguuccuauaacuggggaggagaccacugcagaagguaugggaggaguucuccuauguuauuucaaaacuuugcaauuaauuagagagcaauguuauagcaugaauaaaccaccugcuuuuaguucaucuuuuaggugcacaguucaauuggauauauaucucauacaucugucauuaccaacauccauguguagaauaugcauaaccagaacccuguagccaaugugggucuccauuucccagguccccuacuccuucugucucuuugaauuugauuauuuuuagccuguauacaaugggaucauguguuauuuuuccuugguaugacuucuuucacuuugucugguuacuuauucaugucacaauguugguuuauuacuuauuuauuggcucaggaucucacuauguagcucuggcugaccuuaauuugcuagguaaaccagacuagccuugaacauacagggaucugccuaccuuugaccccugagugcugugauggaaggcuuguaucacuacacuugggcagaauuucauuuuuaaaggaugacccgucucucauuguaugaauacaucuauucagguugugccugcguuuagcuauugugaguaacgcugcugggacaggagcgaaauaacucuacuaguguuucagaugcguccucuuugcugaccagugcugaauaccuuuugguuuaauuaauuucauuuggccuuuaauaugacuaagaaaaaaaugaaggccagucaaguaucacugcuuaauacggaagcagcaauaaauuacaagagauguagauucgcuuccuaauuuugacugggugcaaggaaaagaaccccaaaggggaaucgugagaauuuaugauguauaaagaagcacuugaagacagagccagcacacguugcaugccuuauuaguaaaauuagggaaucuucaucucuaaaacauuuuucaaagaagauugauauuuuccuuuuguacaugauauagguauauuucuggcaacaggccaacuaaaguaccuaaucuauuuguuuuuaugguucuauaacuuagaucuucauaauuaagauaugucugccuuuuuauugauugcuuauaaugcccacugcggcucaagaagaaacacaagucugaaagccuuuaaaacuuaaauguaaagcaaucugcuuagcuucuugaaacagaagagagaaaguuuuuuuuuguuuguuuuuuuguuuuuuuguuuuuuuguuuuuuguuuuuguagcaagaaguagaaaguacaggagacaacuauacuauuagucacuuuagggcacuaaccuugagauuaaacauuuucuuaucuaaacucuuaaaguugcauuuucuguacuuacuuuuauucucauucuuuuaauuggcugaaaaacuacauugcuuacaaauaaauugacauuguuugcuucuggcuauggggaacugguuuucccuuuaauauugcuauuacaguuuuuucauaaaaauaaaauguagaaauaaacacuacauucuccugccuccaucaccacuuaccaccaucacaacagcugagaaggaggggaagggggaggggagggggaagaggaggaggaggagggggaggagggggaggaggaggaggaggaggaggaggaggaggaggaggaggaggaggagggaauuuugaguugaggccaauguguucacaaauacucaacuguuuagacauugggccaccacagaagagcuuggugauugacagcccugcuguuucucaugaaacuguagcaucuaaaguuuccuuuguaaauagucaaguuuuaacauuuaacaucuuaauuaagcuggugccuuuugagcuuuuacuaggugucauaugcuauacuaaaugcuucucauggauuaucuuauuuagguacuucaauaaucuaauauguagucauguuuaacugcugaacaaucuguggcuuaaauuauacauccauuaagcuuuagggccaggauucacagccauuagucauucugcuucauuuguuuugaccaauucggucuuuuuuucuugacauacuuaaucauggauaaugguugccaaauacaacguucuuucuucucuuucuuucaucucuuuggucuuucuguuucuuuuucuuucuuucuuccucucuuccucucuuucuuucuuucuuucuuucuuucuuucuuucuuucuuucuuucuuucuuucuuucuuccucucuuccuuccuuccuuucuuucucucucucucuuucuuucuuucucaccaucucuuucuuucucucuuuccuucucuuucuuucuaucuccuuucuuuccuucuuucucuacuucuuucuuucuuucuuucuuucucucucucuccaucucuuucuuucucucuuuccuucucuuuguuucucucucuuuucuuuccuucuuucucuacuucuuucuuucucuccaucucuuucucucucuuucucucucuuuccuucuauuucucucuccuuucuucuuucucuacuucuuucuuucuuucuuucuuucuuucuuucuuucucucuccaugucuuucuuucucucuuuccuucucuuuguuucucucuuuucuuuccuucuuucucuacuucuuucuuucuuucuuucuuucucucucucucuccaccucuuucuuuuucucuuuccuucucuuucuuucucucuccuuucuuuccuucguucccuacuuccuucuuucuuucuuucuuucuuucucucucucucucucucucucucucucucucucucucucucucucucuuucuuuuccuuccuuccuuccuuccuuccuuccuuccuuccuuccuuccuuccuuccuuccuuccuuccuuuugggaggguaucagggucuuacuauuuagcccuggcuggccuagaacugguuguguauaccaagcuggccuuuagccaauagagaucuaccugccucugccuuuucagugcuaugauuaagguauacaucaccacucuauccaaauauuuguuuauugcuggauuuauuuuauuuuccuuucuuuucuaucuagagugaucuauugguguguugaaauuuucuuuaaaaauuuucaucuauuuauuuuaguuuuauguguuugccauguccccagaggccagaagagggugucuaauaaccuuaaaauugggaacaacagcugguugugagcugcagugaggguggugggaaccaaccuagguggucuggaagagcagcucuacuuucaaccacacaggcaucucuccaguuccaugauguguugaaauuguauguaaacuucuaauucugcuugucaccugcauacaaccacaucccaccacagcgucaguccagugaauugagaauggguucaccuuuauugacugugcuguccauauggacaauauuccuucuugaucauguuuucuaaacauaaagucuaaugcuguccauauuugggcucuuccuugaaaauuucauugaagacccuaaguuuguguuacccacagugcaauucaauuucaagauuuacaguuacugacauucauuaagugcuugucauauacuucuucauauauagagucuaguuuuuccucuauguuaaaugaccauacaaauaagaaauuacuugcaggauaucuucaggaugucuggcuaaauaaauguuguaacuagcaugcuuguaaacaaaacuggucauggaauucaguuagaaaaaucuuauaauuaauguucaaagacuacuuuuuguacucacauaaaaucagguagcuuuuuaaaaaaugauguauuuuuaaauuucaguaaaaggaguuccacgaaaccugaaggugacagaugagacuacggacaguuuuaaacuuaccuggucccaagcuccagggagagucuuaagguaucggauuagauacagaccaguuucugguggagaaagcaaagaagugaguaccccagccaaucagaggaggaaaacacuggagaaucugacgcccgacacaaaauaugaaauaucugugauugcugaauauuccucgggaccuggaucuccacugacaggaaaugcagccacugaagaagguagagaagauaugccaaccgcauggaaacaaagcacauuagcuuguuccaguuguaggaaagcuuuagggaaacuauuuuauguggaagauucugaggucagauucuuuuuaaaauuuuuuuauuagguauuauuuuccucauuuacauuucuaaugcuaucccaaaagucccccauacccuucccccgacuccccuacccacccacucccacuuuuuugcccuggaguuccccuguacuggggcauauaaaguuugcaugaccaaugggccucucuuuccagugauggccgacuaggccaucuucugauacauaugcagcuagcgucaagagcuccgggguaaugguuaguucauaauguuguuccaccuauagggucguagaucccuuuagcuccuuggguacuuucucuagcuccuccauugggggcccuguagauccauccaauagcugacugugagcauccacuuauguguuugcuaggccucggcguagucucacaaagacagcuauaucagggucugaggucagauuuuacacaaaagauuuucacccccuuugagacagaauacucauauguaucccaggcuauccucaaacuuauauuugucuaucuuacccuucuuacuguggugauugcaggauauugcuauuaugucugacuucuauggaagauuuugauuuguguaaacucagaaaagcaauuacauguuuuucauuauucacuaucauuuaggauccuauucagcaaugcuuaaauauuuagcuaggcagugguuuauauugccauagaaucauuacauaggaugcaaauuugauaugacacacauaugaaaaaaugaguauuuuucaagucauguuuacuaaauaauguccuuugacacaguauuuucuauucuuuuucuuuuucuuuuuuuuguaaaaauaaaguuagagggaauccaagagaccuaagaguuucugaugcuacgacaucaacgcugaaguugucuuggaguagggcaccaggaaaggugaagcaauaucuugucacauacaccccagcagcaggaggugaaacucaggaggucacugugagaggagauacaaccacuaccauguugaggaaauugaaggaagggacacaguaugacuuaucugugacagcacuguaugcgucuggggcuggcgaagcccuuucuggaaaaggaucaacucuugaagguaauuaauaucucaaguucuggcugugugugauuuugcaugaagaagcuggaaguguuuuuagagaaugaaaucuggacuauauggucugcuuuuuuuucuuaaaaggaacauguauuaaaaauuaaugcuauaaaucagccuguuguauugcaauauagcacaagcaacugggguaagaccaugggauucugaaaugaauaaagugggaaacauucaagggaguggaucuuggggaacauguaaacuugaggagccuucagaggucucaaggucacauggcucuacucuccagguccacaugggggccacucucugacucuagucaucuuuuucauaaaacauucauaacugcucaaggaaugugagacuaaaccauaggcucuuauguuuauauuauuuuaaucauauuuuuacauugcuuaugugaaaugauggugagagaguuaaucugaaguauaucaugagugcaaaaaaaaauccaguggaguugggcaaaguacccaacauuaguuggaucaaggagcuuggagaagaauuguagaugcuguaaccaucagcgacaacgccuguucggaggcuuucucccuucccugagugauguugauggggccagucucgugugggacuagugcagguaaugccaguugguguuuacaauagcugaauccagucuaggaaauggugugucaucacccauccuucugaauuuuaaaaauuauuuuucaccaagaauaauguccuaaaaaucucacaugcacuuuuaaaacauucuuuuuggcuugugauuuuuuuuuuuuuuuuuuuuuuuuuuuuuuuaggucaaauggguaguguaguuguuccuaaguuucugacuuuuuacaaguggcauagggcaauuuccagauuaccaucauguaugagugccagcacacaaacauuuacaucuauuugaccagaaguuguuucugaggaaguugcacaagaagaagaagaagaagaagaagaagaagaaaaaggcaguuucuuauuucuugagaagaagggagaaagcaaaauaguuagugaacuaacuuaaaaauauagugacgugaaacuaaauuguguugaucaaagacuucuuuauauuagaggccuuggccuauccuguagauuacaaaagcgcuguccugcuuuuaugaacguauuuaucccauugcauuaugugugguaagcuugaugaaucuguggaaguggagcuguggcuaaauuaaaagaauagauuuuuuuugccccugcuuauuccauuucauuuuauuauaucaacuuagccaaauucacauaccauauacaggaauaggauaugauggcaaauguggggaguggaaagcccggagcagagccaggcaaaugcuucugagggcugcugguuuucuaaucugguuuucuccugggagaggcggugguaagugcagcccuugaaggaaugcaucuucuauccagggccuggagucaaccagcagcgcuucuguagguugaaaaauuugcggauuaccuugagaacacgugguuuccaagucaaaggaugaaaguucugucuuuccuuuucuagaauaggucgcauggucugcaacugucucuagccugaauuugcuuccuaggacuuuuuuccuuuugaaaugcagccgaugaucugaaaauucccgugucucuggaagagagauuuauuagcguuggcacuagggcgguucaugguuggcuuaggacuguugugugauagaaucacaaaggcagaguuuauuacuauuucagauccaaacuucagaggaaucugagcagaagccauuaaguuugauuuauauuguccccagcccccguuguugucauuggaguagauaggcuuuaugcaauuacuaaaacgcugcugugcaugcaugcaaauguacuuuaagucuggauagaaaccuuccuggucacugcugggacuugagaguguagggaaccuacuuugauaaaucuaaaugaauagugcuuaucuuugauucagagauucaccacaaaugaaugaaaacaucagcuugggaaucauacauuucuguuuuugaauuuugaguauuuucuggcuauggaaaccaugccuuuucaggauucccuuuguuuccguugcuguagcaaccugcuggugacugacccgugaauggcuuccuauagaucaaacggaguugacucagcugacauuuuguuacagugagguuuucugcacagugugaggauucugccuucugcacaguaacaugagcuucuccaagguggacuaaacaaggccucucuguuuucuuagauuuacugcuaucucauaauuuaaaaaaaucauacguugugggguauaagcagccugacaucgccagggaauuuuaccaugaucauggaaugccaauccagguucuuuucuguggcucaacugcuugccagaggaauaaagcuaagucagacuuggagaggcaauaaauaaggaagagagaugucuacuugggcaguuuuaaaacugaacuucaauguaguuguuagguauugacaaacugcuucugcuuuuaaguagcugaauugaguugccgacagugaacuuuguccucuggaguggugauucugguucuguuuccacacacguguuauccaggagcaggucuucugcagccugcuguggaaaguuggaugacuucugagcugagcgcuaacggaaaagacacguugauuuagaggagcauuuacauuacauuuucaauuggacgucuauuucugaaagugcugugugacguccagugaaggcuggcuggagcagucuauaagaugaaacacagcuucaguacugggugauucauucuucaguuaucaucgucggcuaauuuauauuuuaauuauguuugaauuggaugcucauuuccuuuucggaaggugaauggaaaagcacuaaggaaacauaggaaaguuacuuaaaugagacauuaguucuuuggcguagcauguggaaaaaauuguauaauucaacucuuuguggauguucagaucaugagaaauacaccugugugcuaacuuucacagcaucagcaaugagacgaugcaagcagacaugacacacacaugcacacacgaacaaacacacacacguguguguauacaugauuuagucagaacagaaaugaaggacaucaaaauuguuuuuaagaauauucuuguuuuuuuaaaacaauuucauacauguauacaauguaucuuaauuaaucuauaccuaacucuccucccacugacugugaacauuuugccucccacgcugaguacacccuccuccuaccuucaugucuucauuacaaaguauaaccuccuggaguccacucagugccacuagaaugcauagacuaucagccugagcauagacaaucuaccaacgccuaggaaacaagaauccaccucccccaguugucaauaacgaccaauggcuccuuagcuagggguggggccucauggaccccuccccuuucuguguugaaauaucaacugguuugacuuuguccacgcuaugcagguagccauagcugcugcuagcucaugacugcaacguccauaucauguccaaaagauggcguuccacagccuuccccauccuccccacuugcacucuuuccaccucucuucugcaauguucacuaaggucacuuauucuccagccauuuggcugaauaacaagauuucaaaugccgauugagccuucuaccuuuaacuccaugaaagaacacacuccuauuccuuguacuuacacuggcccuaggaagaauguacaggcacacuacugagauggaaucggaggaagagaagugaugacacuaggaagauacauugaaacaaaugcaguagagucuauuccagagauaaauggaauauagaacauguaguucagagcaggagaaagugagcuaugagauuuaagcauuauugagagacauucacuuaggaaaaaccaugcgcaagccucaggaucaugacucaaacacuugaggagcucccagaagccuguugggaucugcucacugccccgguacugugucuggagagcagacucugacuuccugcuuaccuuuucuccucucucuccucuuccguauucuaaaaguggacaccuggcucaagccuagucuacccaaacuauuuucugguaguuacugauaauugaggcagaaaguagaaguauauuaaacaagcaagagccucccuagaugacacuuuagauuuagauugacuaaauuccauaagagugucacugaguguuuaaaagcaaauauguugagagccauuuucuucugggacgugauagggcagagagaagggagggaggcauccugaaccacauuucaugacauggaaagcgugugaugauaagcuaaaucaacuacccagcgcuccgagggucagucuugauuugaugugcaugaugcuauaaccauacgauagaaagaucaccacacagucucagacauccacaucaugacccauaauuugaccaguuuggcuuaucacaaauuucucauuuuccaggagcuguuauucuagacaaaagcuggagugaaaguucacugccccucuggccacaugugucuucugaacaaacagcuccauagcaucaucauuaucagcagcagcagcagcagcagcagcagcaggaguagcagcagcaagaaccuggggaggauugagaggguaacagaaggagagucgggcauguguggaggaaagagauaagaguaaagcgacauagaggaaugagucgcaggacagauuuaaaagggcuuuagggacucuuaguauuuagacacagucucauaucuucugacuugagcagagaugagcuuugccucucaaagguacauuucuauguacaccauguuuuauugcuaaggcacuaggaagugacauagcuggcuggugacacacucagcuggcugcacacuuaacuucaccacuagccgcaugccagccaguauccugccuguuucacuacaguuuccuaaaucguuucuucaauuuuugguaaucugaugauuguuaaaaacaaacaaacaaacaacuuuguagauuguaggucugauaaaacguucucaucuuggauuaucuuuuucucaaaaauccauguguuacaaaguaccuuguauuucauuagaguacauggcuuccuacuuuguagacaaagcagcagucagucugcccgaaaagagaacaaacuuaacuucgaggaguacucauccuccugacugauagaagaaaccagcacacaccuuuaaucccagcaccugggaggcagaggcagguggauuucugaguucgaggccagccuggucuauagaguuccaggacaagccagggcuacacagagaaacacugucucgaaaaaccuuaaaaaaaaaaagaagaagcauuugucuuuucagucuuggcuucugaauugaggugcuuuuacucuauggggucugaccuucgucuuuaguguggaauguaugucugcagauaauauucauauaccucagucagaaacucugaucuaaaggccuguuucuugugacucgaaaucuucucugaggccauuucagucauugcuggugugcuuucagugagaaugaaaacacuuuuuaguugcuauuucauuuguaucuuaaagaguuuuuuuuuuccaaauuaaucucaugucauuaaugcacuugaaagaucuuuacugugauuuugcuagcauuuuguucuagcuuuacuggucuuuugaguguuaaaauaguugguuaagcccaugggaagacaugucuagugaacugaaaucuuuuuguucuaagcacagaaacaucucugugaauauauuuuugucucaaccacaauucucuuccuguuauuuuucucauagugaaaucacuugcguguguuuaggagauugaugccuguugucauggaaacaaacaaugcuacaaguucagugcuguagaaagugggggagaaaaauagacuaaaaaacauagcccuuagggaaaguagaaguuggugauuacugugguauuaauuuggaagaaaauucccauauuuuaagcuauuuuuguauguuugggggauaucauuaauacauuaacuggcuuauugaaguacaaagugacuaucaagugagcucauuuuccgguagcccuucugacugcaggcuaagagauucagaagcaaaggcacauguggaaaaaugaucuaugguaggcaaaggaagagugcauugcagacuugaaacuuaaugggguugugggaaaucagucaccaaaacaaguagaaaacaacgaacaaccaaaccaagccaagaagcuagugauuugaagaugcacuuucauauuuugcaaguaaagaaaauauaggguuauucccaugcaagcagcaaacacuuccccuauaaaggaaaauaagucacuauguucuuggaaauaagugcuuuuggguccagugaaacaugcagauaauuuccuucuagagaggagaaguccuguuugcuuucaaaguuauuuauaauggaauacgagguucccauuagggucuggugugcauuccagcuucucuauuuaucuuucccucuaacguauagcauguaugaggagugugugcaccaacuuuguuguuguuagucauuaucuuuacuuuuggcugaugcuuaauuguuuauaaguaguucuaaaauguuaauuuucacucugaguugagaaaaugacagauuucaaaaaucuaguaugcacgcuaucauuuacaucaauguaaaacaauugcuagcauaauacauacucaggagguggauaguucuauauuuaugucacgguguaucauaaacucuaguaaaagcagccaauauaaagugaccaguauauuuauauuacauuuaaaaaaugguaaguggggauuuuauuagaaaucaucugcgccuauuaucaaguugagauuucuacauuuuuauuuaauaguauauguauaauguacauuaguauauauaauaguauguauauauauguagacaguuuugauaagauauaauaagugguguacucuauuucaaugacaaaucacuuuuaaguuuuccaaaguauuggugauuuuuaguuucauuggaguuaagcuauguugaaaguuuguauuuuuacucuuuugaauugaauaugcaaguaaaagucucaacagaaaacauuugugggaguuuagguuugcaagugguguacaauuguauuuacuauaauucauauaacaaaacugagacgauuaagacuaaacagaaaggaaauaaaaccugguaagaacuuuaagaccuuugugaacagugggcuauguccuaaaucacacugaagugcgauaaaauauugacauuuagacauauuuuucucuuuggaaagaauguuaaaauaugcauuuuuuucaaauuaagaugugagcccuggccuagaggacucugcacugaaaaugaggaccugggcaaggcugauaguuaggaaucgaucaccccggaguguucuuccaccaguuugucccauugacugaaaacagccccaaagcucagaaagaaugguuagcuuuagauagguugacuuugaguccaguauguuaggaugucuaccgagaugaaugaauacuuaauuauccagcugacaguuaaaaaaugcuacucuuuuacucuccauuccagaacguggcucaccucagaaccuaguuaccaaagacaucacagacacaucaaucggagccuauuggacaucugccccagggaugguucgaggguacagggucucauggaaaucgcuuuacgacgacauugaggcuggagagacaacucuuccuggagaugcaauucauacuaugauagagaaccugcagccagagaccaaguacaaaauuucaguuuucgcaacuuacagcaguggagaaggagagcccgugaccggagaugccacaacugaauguagguaacaucccagguguguugggaugcauguuggugcuaccuaauggcuagucagcucaagugacacgcaguuuaaccacugagguuguuuucuucacuugguaguaacugacguucaaauuagauuuggauuugaaaaaugauaucacuuggacaauuuugaauucuuuccagcuauauguauuuuuuuuucauuuuauuuuucugugaaaagaucagcuaaauaggacacucaacuagugaaaagacagcuuccauguagacaaguagaauuuaggagcauuucugguuguauauaaucuuguucaagagccuuugcuuuucuccaagagucgguuuccuaaucuguagaauauggacaauccauuucuacucuuacagugccacaggggugaaaggaaaugauaguaaagagcacaacaauuaaacacguaugacagugcauacguucagcaaugucaagaaguguacuucuuuguuggggaaagcuguguguuuaugcaggcaaagaaggauaccuggugcauaucugugcuuuuugaucacuauuguuuauuuuauauuauauauauauauagccagcaagggcuagcuaggauucugcuugccucugccuccugaguacauguaucaccaggucugguuaguugagacugcugguacucuuacaggguucacccuccuccuuagcuucuuucagccuuccuuaauucaacaacaggggucagcuacuucuguccauuguuuggguacaaauaacugcaucugacuuucagauguuuguuggcgucuucaagagggcagucaugauagauuccuuuuugugagcucuccauagccucaguaauagugucaggccuuggggccucuccuugagccggaucccacuuugggccugucacugggccuucuuuuccauuuccauucuuguaauucuuucagacaggaacaguuuugggucagagaugugacugugggauggcaaccccauuuugaagcuguuucauuaugauucuuauccaucugaacauaaaaauuaucuuugaaaauuaagaaagacaagauuuuguuuucuucagcuuuagugccuucuaaaagugcuuaggagucguugagucuuaagagucuugcauugaauugaaugaucuggcaaguaaagccauuguaagaaaggggauauagguuguuugaagauauuuggugaucuauuuuugaggguuauucauaauaugaaauauuaaugaaagagcuagcuuaauaaugauguaagcuauguguuagauagguauuaaucuacagcacuuucuaaaauacuugaugugugugcuuucaucugcuagcuuuugagauguuuuaaugugucagaauugccuauuuuguguucauugucuuauacacacagcaaugagaggguuugugucaauuguacugacccuggccagacauuuacagacugcagcuucugaaaaggccugaauaaaauuucuaacucuguacuuuugaacuuuagcauuccuuguggcauuaugaccagaggaauucuuuacagauaaaacauaacaaaaaauuuaagaccacaucuuuggagauugacuuuucuuuuuuuccccaaaucucuagaaugcagauaggaaaucccugcaauaugaacuuuuauuuuucuguauuaacuggauaaagcgagagcauucuacugaggccacgcugagcuuaggcucacaugccaucaugacaccacgacugcaacauuaagcaagacaucuguguccacacuuagaaucuagaguuccuuccuacacgaagggagaggcagacaaaaauguuuuccuuuaacaugcuguacauuauuauuauuauuaucaucaucacuauuauuuauuguuauuauuuuuuauuucacaguaucucaagauuccaaaaucuuaagaguggaugaagaaacagaacacacgaugagaguuaccuggaaagcagcaccggggaaagucgucaacuaccguguuguguaucgcccucaagggggugggaggcagaugguugcuaaggugccacccacggucacuucaacagugcuaaagagacuucaaccccagaccacauaugacaucacaguucucccaauguacaagacaggagaaggaaagcucaggcaaggcucaggaacaacagguauaaaacaaugauaaauauuuuaauugaaucuggggcuggggggcugugucugaguuauagaguauuuagccaacaggaauggguccuuggauuuaagcucuagaacacuauaggcaaauauuuauaauuguaauaaacuaaauuauauuuauuagauggggugucuaauuaguuuauuacuuguuuugcaaaucuaguuccuugugaacugaucuuucugcuaauguaucaaugcaaaacucacuugaauugugccaauugugugugcugcucuugcagaacucaauuucccagggcuuuuauugagccugacauuuuaugcuaguaguagacuugacccuucuuauacauacacauuuuuucuugugggagugaauccaaaacaccuaagccuaucuuauccauaguauuguucuuaaaaucuuuuauuuuuacagcgucucgauuuaaaucgccgagaaaccucaaaacuucugacccaaccaugucaaguuucagagugacuugggagccugccccuggggaagugaaagguuacaaagucacauuccacccuacaggcgaugacagaagacuuggggaguugguccuuggaccauaugacaacacaguugucuuggaggagcuuagguaggaaugaacuguauuugugcuaaggacuguaucacuuagguaaauuuaaauaggcuuuauacaaagaacaaccucacguguuugcagaaaacagaaaagaauuaagucugacaaacagcuuguauuguuuagauaacuuuuguuacuaagugaucagggaugacuuuuaaaaagaauaccuggguuuugacauguccguaucacauaguuucauuacaguugcagucaugugaaaauguguggccaagugacucauucugagacacuccccugcccccgccaggguggaugucccugcagggaagcacacuggagcucaaaggccagagucugugcuuguggccagcuggcagaagagcuuugaguugauuagaggucuaguuuuagacagugagauggaaaacaaaggagugugaacuugaacagcacuccacauucauccagagauaccaauggguuacuguacauuccucuuggaaacuuugcuugcucaaguauucauucaauaguguuggaaccuguauaaugcuugcuguucauuguaacuugaguagguaggaugaaauuuggaaggucacuguuugacauugcccagugcugagugucuuaggucauugggcagacacagaacauuucaaucauucuaaagccggcaucucaggagcagccuaagcagggcagcuaauuuuucccaacacugagcggcaugggggaaaugcugucucucugaccaguccugagacagugcuguaaauccccagagcucccuggaaugcuggguggcuaguuuccugugauuccuuaccagcaagcuggaaugugauggcaacuaucuuucuucuuucacaauacugaacauuauucauuccuaugggugaaaguuuguuagugaagauaaguuaucuuuaacaagauggaagcuguuccuuugagaccauagucccuacccacucugcauaucacuauuucagggcaggcaccaccuauagagucaauguuuuugggauguuugauggaggagaaaguuuaccacucguugggcaagaaaugacaacucuuucugacacaacugugacaccauuucuaucuucugguaagaaacugaguuauauuuccaugagaaaauaguauuaugaaacuaucgggcaagugaagugugaggcuauuaagcaaugaaaauuauaacuuucacuacaauuuauuuaaauaaugacaaacucuuuuauauuuguagaaacugcuucaaauauccaguugagccuacuuuuuucgcuuuucuuuuuuuucaauuucgcauuaauuaaauacuggauuauuuaaaaaugaguuuuuauuaaguguaacuuucuauuuuuucuuuuuuaguaaugugauuuucuuuuauuaagauaguuauauauuuuuuacuuugagggcuuacuuggauggagaaagaaggcucuauacauaaagaaucgggcaagcaugacuuacaagcaugauaguagcacagcccuuuagagguuuuguauuugccauaauuacagcuuugauguaggcgagccagcauuuaauagaauuaaaggugagaguaggagauagaguuuccuucuaaacuuuaagaaaaagugcuuauuaaacccaguaggucuuagcauaaucagaguaggcuguaaagauguagguucuagaacaguacacagcaucuuccauugugagaaaggcuaugcacagaugguacuucuguaauuagcagugugaugaacauugcuuaauuuuuguucacuuuaaaagugaugcaaauaugaucugauaacauugcaguaaaugagaaaguuuauaggcugcaagcuucuaaaaaaaagaacguuuacaauuaaagguggauaaaagaaagugucaaaauuugauauuuugcauuguuucauuguuucucuuaugaugauauuaaccggcuuauauuuuuauuuuguagcuugucacugaggauauugggauuauuuucucuuuccaaagccccuuagcuuuguaucuguguuugcguucguugucucgacagcucucaauuuguguauuucucugcauccuuucccaaauugucuuccuucuuccucaauucuuuaaaugugcaaacuuugcugucugaauuuaccuaauuuuuaucugcaguaggugaaaaacuugaacaguuaauaaugagauaauagaauaguguuucgaguuuucaaaacgugucuuuacuucacaaaggucugauuuuaagacucauguauccaguccuccauaacauguaaugguuaccugguggcuuaauuauuauaaagaauauuuuuggcucacuggaaucacuuacaguuuagacauuuaaccaguccaucuuaugcuuauaugcuaaugucuuaaagagugaaggaggaugcuauaucuuauagcacauccacaucuuauucaaauuauuaauauuuguuguuagauagcuaugcauucucauuuauuauuuuagguauugauugugugagccuuucaaacuaaccaucauaguuuaacuaaacucucuagggucuaugguugugaucacaauauauauauauagucaccaauggagaagagguuugccacugaaaugauauuuggagaaagggauucacaugaauaucauuuaagguuaauaaauuauaguugggucuuuaaauuaugacaccuagcugcaguguuaaauagacaacuuagguggcacaggggacaaccuaccaacuaugugcuucuuaucguccugucuuaccguugccaugucagggauggauugucucaccagagcugaagcagacauuguguugcugguggaugggucauggagcaucggccgugcaaauuuuagaacugugcgaagcuucauuucucguauuguagaagucuuugaaauuggccccaaaagaguacaaauugguagguuuccucaauacugaagaccuuugauaacuuacuugcuaucuuuuacacaucauaauguccaugcuguuauuuuuagcucucgcucaguacaguggagaccccagaacagaguggcaguuaaaugcucauagagacaagaagaguuuauuacaggcuguggcgaacuuaccauacaaaggaggaaauacccucacaggugagucaggaugcuuuggugagguuuugacacaaugcuuuuuggucaggcagguagcugagaggugauaugacuggcugucuuuuaaaaaucccacuaggcauggcuuugaauuucauucgccaacagagcuucaagacucaagcuggcaugaggccucgugcucgcaaaauuggaguucucauuaccgauggaaaaucacaagaugauguggaggcuccauccaagaaacucaaggaugaaggcguggagcuguuugcuauugguaagcacuggagaugauagugaugcccugaggugacagguacauugaggacauuuucuguauuuaaaaaauauuauuggauucccaugcuuacugacaccaaugaaugucagaauucuugacccuccuaaacaaaagucuaaugagagagcaacaaaauuaauuaacaaauggggaaaaacuaauacuaaucccagcucuaguucuuuuggaaugaacaagacuuauugguaucugagaaggagaaauaagaagcuuaaaaaaaaaagacauccauacuuugucuugauggcauuaaaaagugggcuuuauuugccuacaaaaagaaguucuggaauuagggaaagguaccauauauauuuagaggaaacauagcucuguuguguuuuagggaguucauuacaauaaagggauuuuuauauuuaaaacuacuacaggggagggagagauggcucagaaguuaagcaugguacugcucuugcagaauaccuaagucccauucucagaaccuacaucacagccaccaggguaucuagagccucuguggguaccugcacucaugagauuaacagaccaauauagacacagugauggagcacugauaaaaagaaaagacccgaaguauuugcuucauaccauuaauuuuuccugaaaggugcuuucaauuuguacuuaacucuuuuuucaagguauuaagaaugcugaugaaguugaguuaaagaugauugccacugauccagaugacacucacgcauacaauguggcagauuuugagucauuguccaagauuguggaugaccucaccaucaacuuguguaacagugucaagggcccuggugagcuuggucagaugcuggugugucuggguggggacccucucaugugccuuuagaggcuucugccuccucgauaccaggagauuccccugaguuguggugacuaaagauaacagggcaauuuuuaguaucugcaucugguacaugguaaauaguugaaggcuuugugcaaguuaauuaagagacuugguccuuauuacaugugaaauuuuuucuuuuuauauaggaauauuagaguaaaacuucccuccguuaauuuauuuugguucugggaaaguuagaaugaauuuaaccucauagacacaguagaaaugguuccagauguuugcagaauugccauuacuagugcuagaugucugcuuugaggaacuuccuaguuaagggacacugcuuuaguucauuuuaaaaugauuuuuuuucuuuuuuugguggcggggauggcaccaaacuaagaaauggcuucuagcuuauuuaaggauuuauuuagguuauauggcuuaguugaugcaaacaaaagugggaagagacaaaauaauggaaagagaguugacagacacuccuauucuagcacagaccugcuugggggcaacacagcuucacuucagugcuacguuauucagacagcuaugacuuaaaaguugaccaauuuggcuugcucaguaauguuugguagcuuuuuuuuucggcuuccuaauguauaggggaagacaucuuaugucugauuuccuuucuucagcugcagauuuucaggucugaugcucugcacugauaauccccaaaugugaagagaaguuacagccuuaaagcuuagaccauacgaaaucacaagaagacauagaccuagagcaguuaccuaguuagggucagauagauaggggugcuguugugggacuuugcaugauguaaccauggaaaacagauuaugguuuagaaacaauaucagaacuggguuuguagugacaguggagggcauagaaugguuaaucucugugcaaacuguaggacaagacaauggaaguggcaauacugaagggcuuuucagaauuaaugacagauccaugauucuuagagugugaggacauuucccuuaaacauguggauuguguagaagcagugugucauuagcugacagugguuucagagaugcggaaugaacucuuacaguguggcagaaacacuuuugaaggucuguguccuugguuacauccacgcugcauauuucauguucuuucuuguacaucugucuucaaacuuuugcagauauucucuuuugaauuuugaacaacagacuggccuuuucccuggagaaacagaccagcugggcagccagaauuuguaggcuucuggcuuugggugaacugagagaauugucuuuuuuuauucaauuggagugaacuuugaauggggauggagacaucuuuuaucuguuuuuuuucuuuauuguuuuuuuaucaacuacguaauaguugcagucauugaaguuucccaggccauaaaacaacuugauaauuuugcaagcuugauuucgacccaacugcuaagagcagacauacucacucaauuugggcuuacaaagaaacccagaggagcauguaugaaagugauuugucaugcucauggucacauaagagcaacuccucucucuuuaaaucauuauuuguaacaacuggcuguuggucuuaauguauuuaucacaucaauuuuuaauuuucuaguuacuguuacacauuguuuuacccauaucuucccacaggaagcacaaccacaggcuauuuaaauaugccuauagccauauuuuaaaauauugauauuugcuaguuuucauucuuuuuaaacacauaagaaauaagugcucuaaagacacucaacacagacaagccacuaguguuaucuucauagaacacaagauguguagaaaugguaaugggguagggaacuuggucuagccuuagaccauggaaaaguagaauugucuggauuuagguccuguuuauuaauuauguagaagggguugagagaggagagggcaugagagaugacucagagguuuugugucuaggugacauuuuaacuagugguuucagaaagaacaggagaucauguuuaaagaaggacaaggcacucugguuugacgcuucugagacuaaaggaauccuuuagccauuuguucagagagaccaaugggcaaugggcuuucguacagauucaucaucuacuuuccauguuaaagggagccugugaaaacuucuguauagaccagcacucuuucaagcuaacuuccuccuucaccacuuuccuccagaaaugagaguguguaucuuuuaucuucacacacaggugacuuggaagcaccgacuaacuuaguaauuucagagagaacucaccguucuuuuagagugagcuggacacccccuucugacaguguggacagauacaagguggaauacuacccugucucuggagggaaacgccaggaggugagcaggugacccuuaagcacuucuucccuauagugaagacugggugagccucauuagagcacagaggaaaacguugggugaaagacaagagaugaaugaagagugguacucuguuccucucaagacaggcacuucuguuuggaucucauuaaagggaaauagcuuuaaaaaauguucuuaaugguuucuaaguacuguagaauaucaguccaaguuuucaaacaaguuaauugauucauaaguuuggacuagacucauaaaguugacaagggaaacuuacuagagauggcaaauuguacuacuucuacaaacauggauaucauagcugggaaaauaaauuacauugucaccugagaucgcucuguaauccaguaauuucucaaaauaaagggcaaagucuccugggauaccuucuaaaccuccuggagguggcuguuuggaggucucucaggaagaacggaguugagcauccuuuuuauuuucccuuccaguuuuaugugagucgacuagacacuagcacagugcugaaggaccugaagccugagacugacuauguggugaacguguacucugugguugaagaugaguacagugagccucugaagggcacagagaaaacccguaagucagacaugagacagcaagagggacaagacagcuccauuauuucauuuccaagacaaacaggggaggggacaugcaagacuucugccagccuuugacaaauccacugugucccagucauugauguguaaaacuuacaucuuaaguaucuuaaguaugucguuguuguuuuuuuuaaagaauuaaaugaaacaauguguuggugacuucugucugaaguucuaugacuaaagaauaaaaauagcuuagugauguuccagaaaaagggauuaaagucucagcaaguuuaucuauuuuggcuuucauaugguuucauuggaaugccauuuguaaucugaacuuugagcauucuccucuauuuauuaguuggaauguguaucccagagaauucagugcaaugaacacugauggguuuuuuuauggguggaaggagcuauagucacucauuaauuucucaagcaauacauucucuauuuagcauauauauuuauugauaaaauaggaaacauuuguuugcagggauccaacugauauccuuuuucauauuuuccuagugccagucccuguaguuagccugaauauuuaugauguuggccccaccacuaugcaugugcaauggcagccugugggaggagcuacuggcuacaccguaucauaccaaccuacucgaucuccagaaggaacaaagcccaaagaggugagagauggcuguuucuuaauuacuugggguuuuucagacuuuauagauuuauuacuacauuacagucauauuauacugcaaucuuuaugaaucaauuuauaauaucauaccccccccaaaaaaaaaaaaccagaaaugagguuugugaccuguagcacacuaaaaagauugacacaaaagaaaaaaaaaucuccaguucuuauauuuggguguaacagcuguguucacaaaugguuacaaacgggcuucuacugcauuuccugcuaaguggaagcauuugacuugaaugucuuauuucccucuggcauuuccauguguagaugcgcguggggccaacagugaaugaugugcagcugacuggccuccuuccuaacacagaguaugaggucaccguccaggccguccuguaugaccucacuagugaaccugccaaagcucgggaagucacauguaagauguugcuuucuucuguuucuuauugguguaaaauugacacagauguuagugauaguuugacaauuagugcaugguuagaguuauuaaucuuuuccuuuuaguuaguguaugaaaaaaugggcaucaacugugcgcuccuuauuuugucuuccuacuuccauauucccuuaccauccuuucuuucucuuuccaaguagaacccuucugaauaucaugcuaugucauaucauguuaugucaugacugaucaacaaucaaucuaccuaccuacuuauuauguaucaucugucugucugcauauuuaucuaucuaccuaucaccuaccaucuaucuauaucuaucuaucaucuuuacauauaucuauuuuucuuuucauguuuaaugaagcuuauauucagacauaucuuauaaucaauggaguuuagaguugcucuuggcaacguguuaaucaaggaauagacaugaaauaauaguguauuuuuuagaagaucuauuuauuuuauucuauguguauagguacuuuccugcaugcauauacgugugcaccaugugcaugucuggugccacggauccccuggaacuggaguuacagauaguuuugagcugcuauguagaugcugggaauugaaccaggguccucuggaggaacaccuaguggagaaacugcugagccauuucuccagcucaagagugcauguuuuaaucuaugaaguacacuauguaagauauaugagaccgggacuauuguauaacuauaguuuggagaaggauauuuaggagguuaaguucaagcauuguugaagugaaaacugguacuuaaaaaugcuuaguucaagucugucaacucaucagucuacucaaucccacaacacauugcucaugcauuauaucccagucaucaggcuugguguugggaauauaccucugaaugaugcuaagcaguggcuguggggugcuuucuuugucugcaguucuucuguguauuguuccaugucuugggcugaugagguuuguuuccaugacaguuuaaaaaguucccuucuuuaagaaguuuucugcuuggagaagaagaaauuucugugauagauguauggcuuaaaucuagugcucuuuagccuauuguuguaaggaaauugaagaaggaacuucaagggugaaaaggauauugagaaaacauaaaaaucauauggcagagaaaagaaagagcccaucaguauaaauuuauugacaacauguaaagauuuaucacuuuuauguguuagacucuaaccagugcuugagguuuuguggauauggguagugauacaugagaggugggauuugguucagauuggaaacacguucagcgguggcugggauagagaacccaagauucacagugguaugucagacaaauggaauaagggauccgagaacgguucuagaccucagcaauggaaaggagaagagggaaaagaugcaggugcaaagaaacaaaagcaaugagaagacagaggggggcagaaggacggcguuagaaacagggcuucaagaagagagaccugcagaguugaagugaaagaugaagagaaacgguccagugggcagcuacaaggaggaacaucuauuauaggaagagaaaaaaaaauagauccaaggaugauggugcacagcuuuaaucccagugcacaggaagcagagccagguagauuccuguagguucaaagacuggccuggucuacauaaugaguuucaggacugccaaggcuauguagaaagacccugucucaaaccaaccaaucaaccaaccaacccccaaaacaaacaaacaaagagaaagaaagaaagaaggaaagaaagaaagagagagaaagaaagaaagagagaaagaaaaaagaauuaaagaaaaagaauaaugucuucugccuauuuucuuuuccauuuuugguuuauuuauuuuuuaauuguuuuuuauaguacagacuuuuacccugcuccugguucacccuccaacuguuccaaaucccacaccuccuccccacaucuccaagaugauguccccucccaccuuaccagaccucccuggggccccaagucuuuugaggguuaggugcaucuucuccgacugaguccagacccagcaguucucugcuguauauguuuugggggcuucauaucagcuuauguaugcugccugguugguggcucagugucugagagauccuggggguccagguuaguugaggcuguuacuggucuuccuauagggucacccucuucuucagcuucuuccagcuuuucucuaauucaaccauaagggucagaaucuucugcccauugguuggguguaaauaucugcaucugauucuuucagcugccuguuaggccuuucagagggcagucaugauaggccccuguuuguaagcacaccauagcaucagugaaagugucaggccuuggggccuuccccugagcuggaucccaauuugggccugucgcuggaccuccuuuuccacaggcucuucuccauuuuugucccugcaguuauuucugacaggaacaauucugggucagaguuuuugacugugggaaggcaaguccaucccuccauuuuaugagccgucuuucuacuggagguggacuuuacaacuuaccuccccccacuguagagcauuucaucuaaggucccucccuuugaguucugagagccucuugccucucaggucuccgguacauucuagagggucccccccaccuccuacaaguucuacgguugccugauuccauucuuucugcuggcccucagggcuucaguccugaucaugcucacucuuccccucccugucaucuuucccacccaggcaccucccugccugccccacuugugugauugcuuucuucucccacccaagugagauugaggacuccucacuugggcccuucagcuuguuagccucaaguucuguggauuguauccuggguauuuuguacuuuuuuggcuaauccacuuauuagugaguauauaccaugcaugucccacugggucugaguuaccuccaucaggaugauauuuucuaguuccauccauuugcccauaaaacucaugauguccucauucuugauagcugaguaguauccauugugcaaaugaaacacauucuauguauccauuuuucugauguggggcaucuggguuguuuccagcuucuggcuaucacaaauaagucugcuaugaaaauaguggaauauguacccuguugcaugguggggcaucuuuugaguauaugcccaagaguuauauagcugggucuuuagguagaucuauuuccaauuuucugaggaaccuccagauugauuuccagagugguuguaccaguuugcaaucccaccagcaauggaggaguguuccucuuucuccacauccuuagcaacaugugcugucaccugaguauuugaucuuagccauucugagguggaaucucagggucauuuugauuugcauuucccugaucacuauggacuuugaacauucuuuaagugcuucucagccauucaagauuauucucuugugaauucucuguuuaguucuauaccucguuuuuuuuugauuggguuauuguuuuuguggagguuaacuucuugaacucuuauauauuugggauauuagccuuuuuuucagauguaggguuggugaagauuuuuucccaaucuguagguugccaauuuguccuaagcacaccauagcaucagugaaagugucaggcauugggaccuccuacugagcuggaucacaauuugggccugucacuggaccuccuuuuccucaggcucuucuccauuuuuguccauuuggugucuugcuuacagaaacuuuucaguuuuaugaagucccacuuaccaauuguugaucuuagagccugagccacugguguucacuucaggaaaucucccccugugccaaugaguuugagacucuuucucaccuucucuucuauuugauuccguguauaugguuuuauguugagguccuugauccacuuggacuugagcuuugugcaaggugauaaauauggaucuauuuucauucucuuacauacaauuaccaguuagacuagcaccaauuauugaagaugcuuucuuuuguccacuguauguuuuuggcuuuuuuuuuuugucaaagaucaaguguccauaaauguagggguuuauuucugggucuucaauucuauuccacagacuggccugucuguuucuguaccaauaccauguuuuuuuuuucuuuucuuuuuuucuuuuuucacuauugcucuguaguaccacuugagaucaggggugguuauucuccuggaaguucuguuauuggugauaauuguuuuggcuauccugggguuuuguuuguuuguuuuuccauauuaauuugagaacugucucaaauuuuuuccaugucuaugaagaauuguguuagaauuuugauggggauugcauugaaucuguagauugguuuugguaagauggucauuuucacuaugguaauucuaccaauucaugagcauggggaaucuucccauauucugaggucuucuucaacuucuuucuuucuuucuuucuuucuuucuuucuuucuuucuuucuuucuuucuuucuuucuuucuuucuuucuuuuuuucuuucuuuuuuuaagauuugaaguucuuauugcuugguaagaguuagaccuauuauucguggcuauugugaaggguguuuuucccucauuucuuuugcagccuguuuaucauuuguauaaaggaauguuauugauuuguuugaguuaauuuuauauccugcugcucuucugaaguuguuuaucagcuuuaguaguucucugguagaauuuuggugguugcuuauguguacuaucauaucauguacaaauagugauucucugacuucuuccuucccgcugaucuccuuuuguuguccaauuguucuaguuagaacuuugagaacuauauugaauagacagagggagaguaugcaaccuugucuugucccugauuuuagugggauugcuucaaguuucucuccauuuaauuuuauguuggcuguuuguuugguauauauugcuuuuauuauguuuagguaugugccauaaauuccugaucucuccaggacuuauaacaugaaggaguguuguauuuuguggaaggcuuuuucagcaucuaguuagauaaucauguggguuuuuuucaucaugaguucauuuauauaauguauuauguugauggauuuucauauauugaaccaucccugcaucccuggaaugaagccuauuugauuauguugaaugaugccuuugaucuauucuuggauuugguuugugagaauuuuguugaguaucuuuugcaucaauauucauaugcaagaucggucugaaguuuucuuucuuuguugggccuuugugugguuuaaguaucagaguaauuguggcuuuauagaaugaauuagguaguguuccuucuguuucuacuuugugaaauaguuuuaggaguguugguauuagcucuucuuugaaagucugguagaaguuugcacuaaaaucaucuggcacugggcucuuuuugguuugauuuugaugacuauuucuguuuccuuaggaguuaagggacuguuuagacaguuuaccugaucuugauuuaacuuuggcaugugauaucugucuagaaagucacccauuucaucuagauuuuccaguuuuguagaguauagguuuuguaauagguucugaugaguuuuuguauuuucucaguuucuguuaagucuuuuuuucuuauuuuugauaauuuggauacugucuuugugcccuuuaguuaguuuggccaaggauuugccuauuguguugauuuucuuaaagaaccagcucuugguuuuguugauucuuuguauaguucucuuuguuuuuaaccgguugauuccagcccugaguuuaaauauuuccugcugucuacuccuuuuugcuucuuucuauucuagaacuuucaggugugcuguuguuuguaugggaucucuccaauuucuucaugaaggcccuuaguacuaugaauuuuccucuuagugcugguuuaauugugucccauaaauuuggguaugauaugucuucauguucacugaauuccauaaagucuuugguuucuuucuuuauuucuucccugaccaaguuaucauugaguagagaguuguucaguuuccaugaguaugugggcuuucuguuuuuguuuuuauugaaguccaaccuucaucuguggugaucuacuagaaugcaugggauuauuucaaucuucuuguaucuguugaggcuuguuuuaugucugauuauguggucaguuuuggagaagguuccaugagguguugagaagaagguauauucucuuguuuuggggugaaauguucuguagauucuguuaaauccauuugguucauaauuucuguuagcgucacagugucuguuuaguuucuguuucagugaccuguccaguggugagagugggguguugaagucucucacuauuauugugugagguucaauguguguuuugagcuuuaguaaaguuucuuuuacaaaugugggugcccuugcauuuggagcauagauauucagaauugagaguucaucuugguggauuuuuccuuugauguauaugaaguguccuuccccaaccuguuugauagcuuuugguugaaagucuauuuuauuggauguuaguguggcaacuccagcuuguuucuugggaccauuugcuuugaaaacauuuuuuuccaacuuuuacucugagguagugucacugagguuuguuucuuguaugcagcaaaaugcagauccuguuuaugaauccagucugauagcuuguguuuuuuauuggggaauugaguccauugauguugagagauauuaaagauagaugauuguuaguucuuguuauuuuuguugcuggaggugguauuauguguguaugauucuguucuuuuggguuuguugugaaauguuuaauuuuucauguuuucuugugugcaguugcccuccuugcauuagaaauuucauuccagcauccuccguagggcuggauuaguagaaaauauuguuuaaauuugguuuugucauagaauaucuuuguuucuccaucuaugaugauugagaauaguagguauaguauccugggcuggccuuugugcucucuuagggucuguaugcaucuguacaggaucuucugucuuuuagaaucucuguugagaucucugguguaauucugauagaucugccuuuacauguuacuuggccuuuuccccuuacauauuuuaauauucguucuuuguucuaugcacuuaguguuuugauuauuaugugaugagaggauuuucucuucuuguccaaucuauuucacguccaguaggcuucuuguacauuuauggccaucuccuucuuuaauugagggaaauuuucuucuaugauuuucuuaagguuguuuucuggcccuuugagaaaauaauaauaauuuauuuauuauuaaauuaauaaaaaauaauuuucuauuucuauuauuuuuagauuugaucuuuucauuguguccuuaauuucuugauuauuuuggguuaggagauuuuuauacuuuguauuuucuuugauugauguguaaauuucuucuaugggauuuucuauaccugagauuaucucuucuaucuuuugcauucuguuggugacgcuuguaucuguaacuccuaaucucuuuccuaaguuguccauuuccaggacugccucccuuuguguuuucuuuauuguuucuacuuucuuuuuuaggucuuggacuguuuuauucaaauccuuuaccugcuugauuguauuuuccugaauuuaucuaagggauuuguuucuucuuuaaggucuucuaccuguuuaccuguguuuuccuguaauucuuuaaggcaguuuuuuaauauccuccuuaaaagccucuaucaucuucaugagaugggauuuuaggucauuaucuugcuuuucaggcauguuaggguaucuagggcuuccugugguggaagaacuggguucugauggugccaaaguauauuggcuucugcuacuuauguuuuugugcuugacucuggccaucugguucucucuaguguuaccuggccugggugucucugacuggaacuggccucugaguuagggcuggucuccuaggaggcaggcagcauugucucuggcuaggguggcccuccucugucucugauuaaaucaggcauccugugccccugguaacuccagaccuccugugccuuuguuuacugcugaccuagaaggcuugcauacuacagcuuuuggguagguaucaggcugcuucccaugugaggaagugggcuagaaggaaaguggaccuugggguguucaguggugggggaggugggucuugugucaauugggcccuaugguugugccagcugguauggguauuugggcaagauucucacguuugacuuugguuucuguggaucuccugagaagaacacaggcuguagucuaucuucuccuuuuuaaaaagguaaucucuuguuugaguuguuuuuuuuuuuuucuuucuuagauuuuuucccaaccauuuaggcaaauauaguuguucuuacaacuuacaauuuuaguggguaccuacuacugacccauuuuuauuuuucacucucauaagcaguuuauagagcaucccccauaauauucuuuuaaauuaauuuuuugagacuuucaugcaacacauuuugaucauauccauccccugguguuuaccagagcugccucucuuuccuacucucccaacuuuguguucuguuuucuuuuuaaacccauugaguccaauuugugcugcccauauauucuugggcacauggauauauucaaugaaacauauucaguucaucagggcuacacucucuaccagaaugcaucaguugccaauggcuauucagcaaggaugggacuucaugcucucuccaaucuccaggcugggcuuugucuggcuugaauuugcacagaucuuaugcaugcuaucacaauucuugugaguuuguaugugcaacuguucuguugacuuuggagaauacuguggccuuguaguugucuaccaugucuagcucuuaaaauauuuuuuguccccuauuucagaaauuguuucugagcuuuggguuguuauauaguuguccuauuuagggcugaaucuuuauaaucuuuucuuuacacccugaccaguuaucauucucccuguuacucaccauauacuugcaaugaacuucucugaggauggcucagagaugcauuaauuuauagauaaaaugauguuaucaagaauugaucuaauauuacauuuauuuaucuaucagaguaauaguaguaaaauuuccucuauggauuaugaccuguacagucagagguuuuuggcuuugauaaugguggugauaaguauauauuucaucuuguggagcaggacuuaaaucaaaucagaacgugguugguuacucccaugacauuuuugccaccguuguaucaguaggcauauguuauuaggccagacauuauuguagcucucaggguucacaguuguauaagaaugaugacuacuuucccgcucugaugguguauauaacucuauaccaccaugaaaacuaaucacuaggaugcaguuuuuaggucagcaccagcuuggcuucuccauguucuaugucucagguaugugauaucuucaggcauagggucuuacugucaaguucugaaagguuaucaagagaucuauaacauccuuaagggagcaucccuugauggauuucauuuucaauauuaauuuuuaaaaaauaucugaugacauauaaaugucuaaagacauuuauggcugaguagcaaguaguguuagcuggacugggagauugucauguaaacaauaagucagcagugaaauaaaagcacauaucuuauuucuaaaagucuuucuacagaauaaagcaacuguguguugaaaaaaaaaugguauugcuauuuaaaaaucaaacugggcauggugacacacaccuuuaaccccagcacuugggaggcagaggcaaguggauccccaaguucaaggcuaggucuacagagugaguuucaggacagccagggauacaccgagaaacccugacuugaaaaaaacaaaauacaaacaaacaaaaaucauuuagcuacauagcuuuaaguuuucuucuugaaaagcuuguucagauacugaaggcuuuguugugacucacaucugguucuaauggcuugugcuucuucagugccuuuacccagaccucaggaugugaaacucagagaugugacccacagcaccaugaaugucgucugggaaccugugcuuggaaaaguucgcaaguacauuguuagauacaaaacuccagaugaggaguucaaagagguagguuggagaugagaaaggauauggaaauaguuguguuccugcaaggguuagcaaaauaaccuuaucuaggcuagaugauaauguguuuugaauauuugucacuuuguuaaugaaagacagaaaacuugugcagucaaaacauuguuuugaaaaucaguaauauauuggacugcauuagauuuaguuuggaaauguucugcugugauuuuaaucucaaaaacaucauccaucaguggauaaagaguuauagaauccgugagguauuuccuucucaucuaguugccuuauaugguacucucuagucuaugaaugacuaaaaguuccaaauguucuaaaaauacaagguugugagaagauguggggguuggggaaggaaagggaauguguuggauaaugguaagauagucaguugggcaggucagggagaaaggaggaagaggcuauuagaggacugugucuuucagacugaucuguuuugaggugauguugggaugcacaacguuuuacauuguaaugugauucaaaaugggagcaaaaugaagaagcuguuuuuuggaagauggguuuaaaaauugggugcucuuccaggggcagcccaaaagcuguugcuuguacaugggauguguucuucuagguaggcugccuugucuggccucagugggagaggaagugccuagccuuccugagacuugaagugucaggguguguguguggggggggauacccagggaaacccccaccugcucagaggagaagggaagggggugacuagaagcgggcaaugagugggauauaaagugaauuaguaaaaaaauaauucggugcucuugagggaauuuuaaugccagaauuccagaggcauuuuuugugaaaccaaccuuuccuaccuuuguauauauuugucauuuauauauuguacaaguuauuuuauaugucuguacacaucuguuuaauuuuggauuuucauuucaaauggaauuacuggucagugggucucaaagcucuuaugcauuacaaaugagauuuguauaaaagaucauuucugaaaguaguaagacaauaauauuaaaagaugcagauaaaaauaguuucuuugauugaagccacaggcagucacugcuugccugaaaaaucagguugucauggcucuagaacauacauuuuuuuccuacuuuggaacauuuaaguugugcacauuuucuggaauuuuaugcaaacugaaaauccugauuuuuugguaucaugauccuuguguuuuuccgcugagagcucuaguaagcagcagaagagaggccagagaaaauccuuucuaagaggcccccacugcuuucuuccuguuacagguggagguggacagaucaagggccagcacuauccucaaagaccucuccucucaaacccaguacacagugagcguuucugcuguguacgaugagggcacaucucccccagcaacugcauaugacacaacccgugaguugcacccuguuuuacagacauguuggaaauacuuaacgugcuugcaaaucucuacuuauugagacauuuuguuucucaauguucuuuggccagcauugaugaugcuagggucuguagauuguuuucuuguauucucuucuuguguaaaaugcuaucaggagaaacagaacacauaagccucuuucccuucagcaguucacaauuuagcugucaagauaaaagguuaauggaaagucccagggucaugaaaggaugaucagaugagugggacucagaaugggaagucagaccccagaaggagagagguggccucagggacaguaugacacagacacccaggauaaccugcuccauugcuccauucuguuccaaagccaugcuuugccuuuucuguaguguuugacucagugaucaggcuugcuguuccuuucauaguuacuccauccuccugauuccuuccuagugaaggcagaggauuuuauuuuguaucucuacucccugauuuaauuacuuaacucagugcugggcauauaaugauccaaucaagugcucaauuuauaauaacuugaucauaauauugauuaaaaugaaagcugacagccagugcuauccuaaacuaacaacaggagccucaaauguaauuuaaaaaucucgagcaucugcauuaaaaaaaagauaaagugacugguaaaauuaaauuaucauuucaacacuucagcauaacuauaaguugucucacacuuucuggagauaguucuuauauuuguauucacaaugcaucuuaguuuaggcuagccacauugacuuuucaauaucacauguggcuagugguucccacaguacagcacacaucuagagaaucuaaauagcuuucuggaccucuaauggugggaacagcaccaaggucuggaacuuuugcagaagccagagucuaacaucuuugccuuggauacaguaggagggcuggcuguuaacccacacccacagucagcaucugcuuuguuggugccaguuugucuauauuugaucaggguagugucagugcuacaacccacuccuuaauucagacaugcacauuucucccucuuuuaaacuugacugugaugggagcucuuguaaccauuuucauuuucuccuugcugccaguucucaucugguaagaaagaaaucacagauagagaagaagaugccgcugugaguccacaguucuguguauacaacagauaaaaagagaggaaacagauaauucagcaaugagauuaaugcuuucaaugcauguuuucaaaagcuaagaguugaaaucuuagguggaucuaaaaggcauccuuaauaguugaguuguuuugagcuguacuauggaagugguaccacuaucuauuuccauagccauuuuaacucuauuccuagaacaaacuucccauggguuuguguauacucucauauaguaggcuuugagucccaggaaauagggacaugauuggugaugagaguucaggagugauagucuucuuugucaaucguuacuauuucuggagugacucuaauacuguuuauaaaguccuugcuuaugucuaauaucuuuuuuuuucccauuuuuuauuagguauuuagcucauuuacauuuccaaugcuauaaugucuaauaucuugaagcauuuucucuacucuugucuaacaccuucaggucuuauauuaaggucuuugguucauuugggguugaauuauuuuuuuccaggaugagaaauagggauuuacuuucauucuucuacaugugauauguaguaaguauauuuagcacuagauaucaagugcauugucuuugccgggaguguauauuauuuuugauguuuuugucaaaaaucaaauugguguagcuguauauauuuaugucuugguccucuauuccaucaaaccauacauuugcuuucuuuuuugaguccgugucaugcuguucuuuguaguauagcucuguaacauagcucuguaacauccucuaucaugguaccucugauguuguucuuuuugcuuaggguuuauuuauuuauuuauuuuuguuuguuuguuuguuuguuuguuauaugggcauuuaaaaaaauuauaugaagaaugacacuggaagucugccugagauucuauucaauuuuuagauuacuuuaguuaagacagacauuuucucaaugucuguuccuuaaaugcaugaguauaagaguucuuuucauguccuggugucuuuaauuucuuucuucagccuuuccuuauagaggucguuuauaucuuuggcuaccugauauaaaaccaaguuaauuauggccaaugaucuuuugauguguucuugaauuuauuuuuaaguguuuuuuuuuuaaugaguuuugcaucuauguucaucgggaagauugccuuauaauuuuguuuuuguucuuuauuaguuuugggaucaggguaauacugacuuuguuaaaagaguuugguagcauuuauuccuuuucuuuuuuuaauggaacauuuagaaaaucauugguguuacaauuuuuguuugguuauuuauuucuuggucugauaaaauucagcaguaaauauguuugggucaggaauuuuucuuuugagacugggccucccuauauaucccugguuugcuuggaaauuccuacauagaccaggcuguacugaaacucauagguaucugcuugucucugccucuccaauguuggaaucaaaagugugugccauccuacccagacuggaauuuuuuauauaaaaauauuuuauuuauucuuugagacauucauaaaugaauacaauuuauuuugagcaugccuacucuccaucucuuccuuucaacuccuauaggaucugccccacagugaauaaauacuccuuccaacaucauuggacuuuuuacuuuuuuuuuuuacauugugguuucaauauuguuguuuguagaucuguuuaagcuguuuaucuggucuggauuauuuuugguaggugauauccaucuagaaauccacucauguuuucuaaguuuuccaauuuacuggaauauuguuuuuuaaauauauaucucaauuuacugaauuucaaugguaucuauuguacugucucuaagaugcaauaucuuuuaauggaaauuguuggaucucugggaucaaugacagacugggugaggaccaugagcugcccaacugcuggucacaguuugcacguuguauauugcugcuacacuagauccuuaaaguauugguauacaaaacguuugggaaccacacuaauagaaaaguguuauugaacaguacuuuaaaaagaucaucauuuuaucagaccuaugcauuuuacauauuuuaguaaucuauacauuauaaccauacacugcuugcccuauguuguuuuucaaaugagauaaacugauaaaauauuucauucuaaugcuauguuuuggcaguuuugguuuuuaccauauccuuuaaaauaagacauuuuaaugguauuaaauggaauucauaguuuccacugaaacacauagucuuaccuuuucuuaugauagggcguguuccagccccaaccaaccuccaguuuacugaagucacaccagagaguuucagggggaccugggaucauggagcuucagaugugucucucuacaggauaacuugggcaccuguugggaacccagauaagauggagguaacauuagcucucuccgucuuucccuucugucccauuuucuuucuauuugcuuauacgaaagccagcagacagacauggcagccagagcaggaagcugggaagucauguccucaacugcaagcuaggagcaaauuagaaguggagcaaggcuguacacucuuaaagccuaccucugugauguacuuccuccagcaaggcuuuaccucccuuuugucucuccaaacagcaccagcaaaugaggacugaguauucaaauccccgggucuaugacagauuucuuauucaaagcaccaccuuccuuuaaaaaaaaaucaucuuugacaaguggcuucgggcucauguaccuguaguggugcagaagagcauucaccugucagcacaauguuauuggggaugcgucaucuaaauggauauuaauuuagugugcaaaugauuuuuccuuuuuaucuaagaccauuuuaaauggagaugaaaauacuuugguguuugaaaaucugaaccccaauacuccguaugaagucuccaucaccgccaucuauccugaugagucugaaagcgaggaccugaguggcacagagcgcacacguagguguuuaacauuuaaauaggauuuugauaguucaaaauuaaauguuaagaaaaggagcuacagcuguaucacuaacgauuuacaaauucuguuuucuuuuagugcgucugauacccuuaacaacacaagguaaaaaguuaaccuauuggauugucugaaugaacaaaguuuaaauucacaaauaaggucaucaaauccauugugaaaaggccuucugcacuuuaauagcgagguuugccuuuuccaggaguggccuuucuugagacacuugcuuuuucuguuacuuuuugaagaguguaugagucagcucgggcuuccguaacaaaauacaggauggcauaagcagcaaaaacguauaugcugguaauucuggagaccagaaggcagauuuggugcugcaggccuguaauuccaguagcuugggaggcugaggagaaucauguguucaagaccaauuuggucaauucagugagauccugauuuauaauaaaaaacaaacaaacaaggguggucaagaugacucggcaggccaaggugcuugccgccaacccugacagacguaguuaaagcugcaguauccaccgaguuuuuggaggagagaauugacuccuucaaauuguguggcagggguguuccaccauaagcaaauaauaauaaaaaaauagcauaaugaagggucaugaguagagcucuugccuaucaucuguaagccuuaccuucaaucucuaguaccacuaaaaaaugucuggagaauaggauguccaagauaaagauacaauggcagccaguucuguucuugggcagggaucugaauucaucucacuguuauguggcggacagaaaaugcuucuauuuauaaagacuaaucucccgugagggacccacuuucauggcaucauugucaaaagccccauuugcaaauucuacugcauugagcaugagggcuucaagaggacaaaguuuggggggacacauucauucaguaccaaauaaccguuuaauauucaaugaccucaugguuuaaauuuaauucuaaacccagugguauguagcucucuugauuuuccugggaauuauacagauuuuguuuguuuguugcucuugguuuuuaguguauugggggauuguucuaugugcuaaauauguuuuuaacaaucuucuuucagcuccaaaaagugguccacggaaccuucagguguacaaugccacaucuaacagcuugacuguuaagugggauccugcuaguggucgugugcagaaguacagaaucaccuaucagccuucaacaggagaaggcaaugaacaaacgguaauuuguuauauaaaauguguaacauggguaggcucugccugcugcuuuucagcuauuucccuggaacauuuauaauauucaccuuguuagggcauguaggauuuccuguauuggagagaaucauuugaauuuagcugacucucccucuggagugcaugacugagacacacaggaugcucuggugggaccugauaguuguucuucauagcaaguucacacaugugcccaauuagcaugaugauaucuaaaaccuucuugagucaagguagaucuuugauaguucugauuuuaucagaucuuuuguuuccagaucuagaaguccauugaucuaauuaaaaauauuuaccaaauggaggaaauugagaaugggaguaaugcauggagcugagcugucauuuuugcuguuccagcccucccuuauuuaauagagccuuuguaugccccacucauuuaauuuaguggcuucucugggaucccuccagcuuugccuuuuaugagaugcacaauuuuuauacagauaggguuauguuuucagauucauuuucaaaugucucuugaugagcucuagagcuuugcugguccuuagggaagcaggguauggguuauauuauuuccuuauauaaccucacagagagacaagguuugaauuuucaauauuaaauguguugagcucaagcaaguggaucauaucucucaucaguuucaaagguuagcagaauucagguuggcaguggauacuugcaugcaguaaaggcucuugccuagcaaaugaacuuagcuggaccacagauguuccaaucccauuggaauggcagucuaugaaauacucaaagcaacaaaucacuaacucugugcuuauuuuggaaaguuggaugggagauauaaguagacauccauuuccuuccuuauaauauuaggucuucuaacuaagcccucccaaccuguuacauaucaaaaguuucacaaacacagcucuguccauccgaacucuuuucuuccacgacccaagaggagaugguuugaaauuagccauuguaacucaguuucuucaaacugagauggcuacagugauccaugaaguguuuuuuuucucuuuuucuggaacuccgaucguuugagugaaugggugcuaacuuggaaacaucuguuaguacuaauucauccagaccuuuccaugagcccuucccgugggcagcgcuccauuugcgugccauuuucaugugacuuuaauuaccauggcauaaacaucugaauucgguagacuguuaacaaaucguacaaauuuucuuucaacaagauagcaagagggcuuugacuaacgaauuaaaaacuucagacuucauaauuggaggaaauugagacguucauaccucaaggcugguaucauggagaucacugggaaccacugccugaguguggcuuggcgaggggucuggucacgugguuuacacagcuaaugcuguuagaguggcagcguuugggggaaacaccaagagcuuuacauccuuugcccaaccauuuaaauguguuucuaaagcaaauaaaaaccaucuguaaaauaacaagaauaauacugaaugguguggagccuguaaaauuacacaguucuuugguaucuaaaagacccuuuguagcuuacuuaugauuaaugccuuauuuuugggaagaguucugugaaauguguuuuggaugaaauuuugcagugcuggcggcucgcaauuugaaauaucuuuuuuuuuuuugagcuccaguuuaaagcuuggaauccuuuuucaugacucgagacacauacucuacauauaaaauuaugccaugagauauauuuuaagccuucauugugggacauggcuccagaacuuggcaagggucucaaauaguucccucagagaaagaauaaauuagugacuuggaaagaguaaggcugaugcuuaccaagaaguguuuuccucaagaucacaguaggaggacggcagaacagcgugcuccugcagaaacugaagccugacacuccauacaccaucacgguguauucccaguaucccgauggugaagguggccggaugaccggaaggggaaagaccaguaagugagaccagagucccuguagcuucuuaauuaucaccacggaaccaaaucacacuucuacaaacacggaggaagcagaaugucuuacagaucuuuuauaaaauuaaaaaaauuuaagaacauuuuuaauugaaauuaccuuacuuccgguucccuuuccuuuuccuucuagcccugcccaccaguugccuuacuucaaguucuuccgaugacccucuacuucauucuuaagccuuucucucuuuaucucucccucucuuccucccucccucccuccuucccuuucuucuuuccuuuuuacuauuucuuucuucccucccucccacccucccuuucauuuuccuuuuuguuuuuuugaaacagauucucucuauauaaaucugguuguccuugaaaucacaauguagacuaagcuggccuugaacucacagauaucuaucugccugccucugccucuuaagugcugggauuagaagcauguaccaccaugccuggcaauaggcucuuuuucucugagauguguguguguguguauguguguguguguguguguguguguguguguguguauguguguguguguguguuuacaaauguauguaaauacaaccaacugagucuguuuuuguuuuuuguauguauaugguuucaagucuugccacuuugcauugauuaaccaauaaaggggcucaucucuggaagagguuaaugcuccuuuuaccagaaguugaucauugccuguaguucuuugucuagggguaggaucucaugagaaauucuccauuccaugccaaccugcccauugguauuucuauuguucgggucuugcuuaugcagccauuuuuaggagagacuguuuucacugaagacuucugaauauucuuacagucuuucugucuccucuugcgugauacucccugagccauaggcgaaucuuuuaagaugguaguuguucuuuuuaacguccuugcuugugauaaugucuuuauuuguguaaacaaaagaugucauuaucuaccaggaucaaaaacaaaaaguucagggauccauaauguccuacagauagaugagacauauguaccacagaagugcaaaucuuuugcuuaauaacuacuucaacaaacaucuaugggguguuugcuauguucuagguggcuugaagauauuguuuaacuuguauuuuagauauaauuucuaguuagagcgucacuagaguguacuuccuguguauuccagaaccucugaauaccgugaggaauuugagaguguaugacccgucuaccagcucuuugaguguccgcugggaccaugcagaaggcaauccucgucaguacaaacucuuuuaugccccaacaucagguggcccagaagaacugguaauuauuauuuuuugagacagggucuuuguauguagccuugguuuuccuggaacuugcuauguagaccagcuugcccuugagcuuacuccuaaauggaaaauacuagucuguuuaaacuucaggagaucaaaauggaaauagaaagagguaaauuguuuagaagugaagaauuuauauuaaggugaaggacuugauagagaacucauacuugauguuuuggagccuaggaaguagggagacaguggguugggugcuggugggaaccaggagauaaagugagacguugaaugcagagacuuuauaaaguucuuguaaucacauuaagguaaugcuuucgguugguauuuuauuauuugaaggauuagccccuuuccuauuuuugaauucaauauucugcucuguguuuuauuaaacuuuuaggucccaauccccgggaauaccaacuaugccauucuuaggaaccugcagccagauacuccauacaccaucacagugguuccggucuauacagaaggugauggcgggcgcacaucagauacuggaaggacaugugaguaaaaagcagaauuggcuuuccauuguagacauugaucuccacuguaaagaacacauugagcaaugaagaaaauuagaaagaaagucagaaugagaagauuaaaaguaucaaaaugacccacagcucccuuuuugagcaucgaccuguugggucuugucauuggauuuuauagcuuagguugcugaaaccuguucacuuuaccacuugguugugauuuucucugguuugcugcuuuuggugcuauuugcuuuuaucgacuauuaauguagucaaaccaguuuaaaugcuuuugcuagucucucuggauauugcuuagccuuuugugcaugcuuaacacuuuaugacuuuuaaagcauacuuguggcugguugaagggcaucaagcauggguaguuuccuccaggguacaaucagggaucuagagagaugaugcuguugguuaagcuagaguuuuggguuaguaagcagauuuaaucuccuaauuuuauugauggaagauaauugagaacugacuugucucuucauuucaucuuuucuuuuaaucagagaagauauuccaagcuaguguugaauaaggcaggaaugaaugaaaaaaaugaaugauugaaagcagcugacagaggcaucaaugggaggagagguccuugguccugugaaggcucgauagaugucccaguguagaggaaucaagggugggaaggugggagaggguggguggguggaggaguacccucauagaagggaggaugggauaggggguuucugggaacaggguaaacggugaaaggagauaacauuugaaauguaaauaaagaaaauauccaauuuaaaagagaaaagaaaaagaaagcagcugacugaaucuauuucuuuccauugguuagaagacagaccauauauauauauauauauauauauauauauauauauauauauauauauauauauauauuagaaggcagaauauauguguguguguguauauauauauacacacacauauauauauuaaaaucucuccucuggccccacuacuuguacuggaaacucagcuacuucuguuuccuucuccuuauuccauguuccuuuauagccagcccaggccuguggcucaugcucauagucuuuuauugaaaacaacauugacugggcaaaggcuaacuuugucgaauuugcauuuggagaguuuucauguacuuuuguguguagauagaaguauaaaguggauaggauuuuauccuauuacagagaguguaacuugugaaaaagugaugaaaagcuugacacguauaaacagacaugagacaugggcauuggcuuuccuuuccucaguggugagaggacuggcaagaaacauccaaguguauaacccuacgcccaacagccuugauguucgcugggaccccgccccagggccagugcagcaguaccgcauuguguacuccccuguugcugguacaagacccucagaaucuguaaguaauuuugcugucuuagagcucagaaaagaauguugucaacucuguuguggcuucugccacagcagcuggcuagggaacaauaauggugucacugccucucauguagacuagguuuccugauuacuaugguugcauguuugaguaccauuuaggagcuuuuauaacccacccacauguuaguacauaauauuuaaaugauuguguuugugaguuaugacagauguaguaauuauaaguuugcuuaggaaagaacuuggggaaaaagugaauuagcuaugagacauacuguuucuagagcuuucaauaguagauacauugagaaacuacacagucuuugcugugaaaauauuuuaauuacacauuuauuuauuagcucuuacaaacuacagugucucuuuaguacucuucaguaucuuauccaagugcuaaccaggcuguuuaccaucuaaggucaggugcaaacagacauguuuggggugguauggucagagacuugcagcuagcuuccugauaaaucucagaucuguuuugugaguaggccaauaccguacaaaucugaaguuccuugguaugaauaauaauagcaucaaaaugcugaaagggaaagaauuuuauggacugacaagucuuugcaaaaguaagcaaugaugggcaaagauaagaaaaugauaagcaaugaauguauucuggaguagcauugauuuuaauguucuuuuauaugguauggcauaauuucuuucuuaaugacuuuacccuaauccaaauuaaugccuuaacaccaaauaucucugccacuagcaugggaucccuucucucaugcuuaugugacauuuagaaucuacucugagcaaauacacguacauauuccauuuaugagucuuuaugagaaauguaaaugggagaaaauugaagcaaauguguaagggggauuucugagaauaacugugucuaauaaugagcuagaggcagaucuugcagagaagcgcacuuggcuccugacaugccugggcgcagccuuuuacgauaaauacuauugugcugacuaaccgaggaccuggcaagcauuagcugucagcagaauuuggcacauuuuucuccccuucagauuguggugccagggaauacccgaacggugcaucuggagagguugauuccugacacacccuacucugugaauaucguggcucucuacucagauggagaggggaaucccagccccagccagggccgaacacgugagccaagcauccuauuuccacuuuaucucuugucacugagugaggggugggugguaggugguaggugagggacuccgaggacuugguacagaacaggguagugucugcauguaauccuucuugggauuucccacauucacauucuaggcucaggcuguguguccacagcuaucuuuugugcugaaugaauuucauuugaauguuaacaacaauaugaaccaaccacuacccccagagcucccagggucuaaaccaccaaccaaagaguacacauggagggacccauggauccagccacauauauagcagaggaugaucuuguuggacaucaaugggaggagaggcccuugguccugagaaggcucuaugccccaguguaggggaaugccagaacagggaagagggagugaguggguuggugagcagugugaggagggaugggaaagggaguuuucuuaggggaaaccaggaaaggggauaacauuugaaauguaaauuaaaaaaucuaaugagaacaaauaaaaagaguaaaaccuuaaaaucuggggucuaaauaaaagaguucuuuccucuuuguccccuucuuuuuuuaaugcaguguguuuuaucgcuaaacaggcacuggaaaugugaaggcuuagccucucuacuucaaguggagaugguuacagugguuaaaacaaucccuuucuuucccaggcugcauauuucagugcaaaccuagcucugucuuguugaaaguuuaguacauaaccauaucucugaaagggagcgugucaugcuguguggugucccaugaaaaccacagaagguaguguacagcgucacagggaguaagcaugaugaauggugacuucagcaccaguaagcaccuccuguaagcuggccugaaaaaugcuaucagguaagcagcaaaaccaacuguauuuuaucuaguuccaagaaguggaccaaggaacauacgggucuuuggggagacgaccaacagccucucuguagccugggaccaugcugaugggccaguucagcaauacaggaucaucuacucuccuacugucggcgauccaauugaugaauauguauguauacuacccacugauuggcauuuaaacaaucauuucaccugguaggagggugagauuaagcuucuuuuugagacgguuacuccugagcucuuggaucuuaugugacaggucucauguaguuuucucuaauguagggacaacaggaaaguuccugcuugaaacuuccauggugaaacagugauuuggggaucauuuccauuguaaggacugacugaaaaacuguccuagucuacauuucuaacuguugacucccaugaaaaggucuacuauaauaugccacacauuaauccauaacuaguguccaaacuaauauccagaugaugugacuauuccaaucuuacccuucuagaccaauuccccugcaugguuuccccuugguaucuuaguacuaguguccacuuucucuaaacucacaucuguuuucuguagucuuuugguuuagaauguacaaaccuccuguuaguugguucuagguucuauuucucccucccuucucuaucccuccuucuucuuucuuugauucuuucacuaagaauuaaacucaggacuugggguaugagaaacaaucucucugccauugacuuacauugagaaucucuucaaacucuuggcaguauaaauauugugucccccuggacacggguucaaguucuucaucucucucuccccucaauuccccaauacccccuuccccaaucccuucucccuuucuucuauuccuucuuccuuuuugugggacuggggacuaaccagggucuuguguguauacuugucaagcacucaaguuaaccccucacgcuucuuggaauuuccuuauaguugggaaaccacagucacugauauuuacugauugauuucugugaaaagcuccaagauuagcucaaauggugacuguaaagucguuagacuugugguuugcagccuuguugcuagcaguauccucuuagaaccuuucuccuuccacaugccuuuugcaugugaagaacuauucacucucuugauuuuggcacaacaaucuugaauugaaguucuguuuuauuaagaagaaacagguaauugucaauuagacuuuuuaagaagcaaaacaagauaaacaauuucaacuacucaugcuuaguauuuuuuucuuccaugcuggggaaaaaauguuccuaugcuuucugaaaauauugaaaacauaauuucuuuuagcaguucaguguuuguaguuaugggaguccaggccaggaggcuuagccacaguguuuguacaagacaagggagguugaaaacugcauggaucauucaucuuggaaaagggaguuuaauacauuuuccauuuccucuuuuucaaagaacacuuaauuaguaucaacuaaacuaauauucuuaaggguggaaaccugucaauuuuugcugacuaagggacaccuggguccauagcauguccuuuaccuggggaugugauguguuauggugacauccucagacacaguggcucagugauacuuucggaguguuguuuguguuacugucuucagagcuuguacuuuccuccagagaugcucagucauaugacugcauaguggcugaucugggauuucagccaauaucuguuaggccuucagcuauucuuccaagcuauguagaggcaggcuagauaauaugccuuuccuugagcauuuugaaacaaacguaugaagaaucuguuuuuaauuauggagccauaugaaaaccgcaugggcuucugaucuagguguccucuuguugaaaauaaauguuaaauugaacuuuccucacagaccacaguuccaggcagaagaaacaauguaauacugcagcccuugcaaccugacacuccauauaaaauuacugucauugcuauuuaugaggauggagaugguggucaccuaacuggaaacgggaggacuggucaguguugacuuauauauauauauauauuuuuuacucuuuuaaauucucauguuuuuaaugucacuacaccacuaaaacugagaacuacuaccuuuaccagcauugcucagauacuauguugauaacacaucauauucuacauuagacauugaauguuaagaugaugacacauagcauaauuuauuucuuaaccauuuaaagguauaauaaaaggagcaaaacggugauaggaaucugaauauuuuccauugcuucagauuauuuguucuuuuuaguguacuccaugagauguuacagugugcauggugacaagugaggcuguagcuguaagucaauguggugucagcuagacauccucucuuauccuugaaucuuaaugcagaaacacagaagcaaaaugauaggcacccuuucuaagacuguagcuuacaauuauugccucagauaaucgacagcgaauaaccaggguuugggcccacccuuugaucuguacugguggcaauuuuauuugguuuaaagauucucuaaccuguuuuucgccugacagccuuuaaaaauaugcuuaccuggaaggcucuuccagagcuuccaauacacuuggccugagauacggccuguggcuuuucugcuauacagaaaaggcuugagagcuacugguucccgcaaggcaaccugggcuccaguuguguaaauauggacaguguguuuucuuccuugauuuagaaaaucuacuggguuacuugguuuaugucucuuuaugcacucacuuguucaaagucuuuugggauuuacgugugcuugacaacaucagagaaguugagaaaggcaaccuugggaugcuucuaacagaaaagcugacuggaguggauccagcucgggguugcuagcuuggaaaucuguguuauuuauucauacuguagugacucuagcuguuucuccauuggcaaacucacuuucccacuuucucaaguuuaaaauauauuuugauaacuuuuggggggacuauggaguauuucaggauuuugugcuuacaaaaaugauacauaaaccuugauuucuguaggcagggcaaagccaugucuaguugccuucauggaaguaaguucucauguugcacuagucauuucuagaacgccauggguaacucaguagcuguggagaguaccaccuaacuacuacggauuuugcaaguuacauauuuugggagagauuauauguuuggggcaaaaccucugguagauugagaugcuaggcuguguggcagacagggugggauagggaaagaauauuaccuuagucauugucuugcuggucuauuguggaaacuauaucuuauuuauggaaugaggugcugaccagauaaucuguaauaugccuucuaguucuaauacuguucaacguacaauauucuaaaggagaucugagaucucucuuauugucuuuaauccugaucacacaucagcccuggaccuuguuauugaaucuucugaaaaccauccauuccagaauccguuugaauugcuuuuuugaaaaacuacuaaguuuucuuuggaacaugaaauggcuuuuaaauuauuuucuggauaagaaaauuucagucuauuaaaaaguuaaacugcucucacgggaauguccuaacaaguuagugaugugugugcauguuuccuugcagugggucugcuuccuccucagaacauacacaucuucgaugaaugguacacaagguuccgaguguccugggacccuucacccucaccaguucuuggauauaaaauuguguacaagccaguggguaaggaaacacaguuuucauaauaggaauauauuggaaaguuauguuguaacaaauacuaaaucuuaauuggguguuuauaccccaccuuugaucauuuaauucccagauaaaugacauacaacuuuuauaucuauaauaagccuuuaaucaacacuaaagcuaggcagauagcuauugucucugcuauuaugucuacuuccucaccaauaaccccaaguuauaacuugccaugcucugucugggcugcucuuaacuugaauuggccaacccucauggccauacuuuuaugacucaccuaacccauggcuucuuuucucuucucuucuuuccagcuucucuccucucuccccuuguggucucagaccccaagccugggaaaccaaacucugccuaucacucuucugcacagcuauaggcuguaagcaucuuuauuuaccaauuagggaugauuugggggacaaggcuacauagcaucauuugcguacaugaagauucuuucauuccugggacaaccaggccuuggggagcaguauuucacauuacaauagcaaaggaccaaaccucaccaaguuauuuguguaugauuauacauuaauauggauuaucccuaucccugucuagcuucaaaugaaugagacucaaacugauuuauuuuaggcucugcacaauuacugggugauuaccuccaaucuaauucucuaaaguuagucugaccacuucuccagcugcacuccccugaaguugcuguuuguaauuuucuguauuauuuaugcuucaguaaucuggcaucuuggagaggcauuucacucuggcaccugcugcuggccuauuaugacggagggaggcacaccucuugcucucucugucuucuccacguuccucucuaucuccuuuuuccuucucuucauugucccuaucugugauccccagcucaauaacucaaauucuaccucucucuauuaccccaguaauuggcuguugcaguuuuauuuaaccaauaguuuuaaacuggggagcaagauuuaucuagcaucacuuggucugugugaggaucuucucaucaggggcaaccagaucuugggaggcaggauuuagcauuugaggacauagcagugccagaucaacccccaagauacaaugguaucagaauauauuuccuacuacuggauucuccuauaaauacaucauguccuuuuauacuagagguacuauuuccagaaacagucuuuaagucaucagccuaaaauaucguuaucacucuggguguguaugagacucucacuaaauuuuacaguugaaaauguugaccuguggcuauucuccaauagaugguccucacacccuugagcauguagucagcacaaagugugcuuagugggugacuaaaucaaaaagaguacauuguuuggagaggguuggguaacaaaggaagauuugggaggaguugggggaagaguggaaaugaauaugaccaaaacacauugggagagauucuuaaagaauuaauagaaauauuauauaaaagaaaaguuucagcugguacacaaagugcacagauugaaguugcuuauauucuggcaucaucuuugccacgaugaccaugaaauuccucauuacacuaaaagguuuugugcaucuuaguuuguucauguuugcuuucaacuccucagugacauuuucagcuaaaccaacaucaccucgaaugaacaauuugauaaauuuuaucagugucaaaucuucuagggcaccuccuaugugcccuggaggacuaugaacaauacagaugaaggagaggaagcaggagaaagcaaaugugaaccucugccagcgaagcagagaaccugaagugugcaguggcuuuaauaaccgaggaucugcgguaaacagaaagugugggaugaauuccaggguugauggccuuagcuuaucacuacaauaauugcaaauguuaauugagucuguagucuguggaaagcaucaugcuggcaaaucagggcuuuaaaaagaaaugagagaauguguucaguaaaggaacauagaaacacgcugacguuaucucuaugcuguguugugcuuugcggaugggagagaaacuggugcuuacagauuucuggucaccacccacuguggcccaauaaaagagccugaaggaugauuggaauuaaugcacucauccucauagucaauuuucaagcuaauaucuuucauucugaacagaaacugagacuagugaguauauccuucuguguccuuuuguuguucugaaagguuccaaugagcccauggaagccuuuguuggagaagugacaucauacacuuuacacaaccucaaucccagcacuaccuaugacgucaguguuuaugcacaguaugacucuggacucagcguuccccucacagaucaaggcaccacaugugaguugugcaucacauugcgguuguaagaaaugcagugaaaguuuccaggcuauccucuuguaaucuuacucuuucucaugugcacguguauucugcagcaucggauagggaagugggucucagccuuccuaaugcugugaccuuuaauacagguccucaugucgugcugacccccauccauaaaauuacuucauugcaauucaugacuauaauuuuugcuacuguuauaaacuguaauguuaaugucugauaugaagggugucugaugugcagauuauaugauaugcaacuccugugaaagggucauucaaucucauauggguugagagccacagguugaagaccacugacauagauagaccauuuaguguccaguuaaacaaaacaacuauguacauaucuaaguaacuuaguagacuuauacauguauauaagaggaggaggugaucauucauucauucauucauucauucacaguccagucauuacuccacuccuagucugcccucccacaguuccucaucccauucuuccuccuccuggaggaagggauuuuuacuugauacagaauauuauauuuugauuuuuaaaauacuaaccuuauacaauaucauuuaacucauaguuaccuguguaaaauucuauugcaguuuuuuuuuagcuucuuguugcuuuacuauaaacuagagucauggugccacaugccuuuaaucccagcacuuaggaggcagaggcagguuauugcaguuauuuuuuuuuuuuugacauugaauguuaacauauauaccacuuacauucaucgauauaaucuaauagaaauacugaaucuguaauuugucauuuagauuuuguuuacccaacauuuuugacaaguuuuaauaggauucagcagcuaguauauuagaaauuuuucuuauuuuuuucuguaaaugacauucauaauuuugagggacuguauaauuucuuuuccuuggaaauuacugauggaaaccagcaugguggcacacaccuuuaauuccaguacuugggaggcagaggcagguggaucucugugagucugaggccagccuggucuacagagugaauuccaggacagccagugcuguauagggagaccuugucucaaggaaaacaagggaagaaaauaaaaucauagauggagaagcaggaugaguuugucuaugccacauuuucagacaugugugauguaaguuucccauaacaagauacuaugagauuucaagcauuuauuugacuuuucaucuacaaguguauacuugaacaucauauuauggugaaagcuaugcuuuucuucuuuacuauguauauagugaaucuguauuuuuuuucuuuccucuguaguguacuuaaaugugacagaucugaaaacuuaccagguuggaugggauacauucugugucaaguggucaccucaccgggcagccaccuccuacaggcuaaagcugaguccugcagaugguaugugcaaaagaaaacaaacugagccugcccuagccaaaucuuaaugggaagccaagccagauuccuuuuguuuauaagccauuauguaaacauguccuuccagauuguggaugauagcacuuguuuuuccucuugucacaaucaggaaccaggggacaagaaauaaccgugcgaggaucagagaccagucauugcuucacuggucucuccccggaggcugaguacggcguuacuguuuuugugcagacaccaaaucucgaggggccggguguccccaucaaagaacagaccaguaaguuuugaguuaucuggaguguagaacguuccaagugugggcagcauccgacucuucuccccugggguagcaguaauaggaugagcaggguguguggcuauuccgggaccuuuguuuguagugacuaucuuuaauggugguauuuuaaaauguuucaauguuuauucuuuuuuuucuuagauauuuucuuuauuuacauuucaaauguuauccccuuuccugguuuccccucugaaaaccccuuauccccucccccugcucaccaacccacccauuucugcuuccuggcccuggcauuccucuauacuggggcauagaaccuuuauaggaccaagggccucuccucccauugaugaccgacuacgccauccucugcuacauaugcagcuagagccaagagucccaccauguguuuucuuugguuggugguuuagucacagagagcucuggggguacuauuuaauucauacugauguuccuccuauggggcugcaaaccguuuccuucagcuccuuggguacuuucucuagcuccauuggagacccugugcuucauccaauggaggcugugagaaugcacuucuguauuugucaggcacggguagggccuuucaggagacagcuauaucaggcuccugucaauguuuauucuuauuuuauguauauugauauuuugccugcauauaugucugagaguauuggaucuccuagaacuggauuuacagacagguaaagaugccuugugggugcagggaauugaacccugauccucuagaagagcagccagugcuccuaaugacugagucaccucuccagccccuauugaugguauuuuaaaaauaggacugaagaagugagagaugacucugacgacgguaaaagggugaacauauuacugacauuuacuuguguggcuucucugaaggccccgaguucucccucugaaccugugcuuucugcagcauaauugaucugagaauugacugaguaugcacagucuagauagaaaggaaucuccuuuagucauugccagugggcuugaccucugcuuucuaagucuuaauuguuuuuaaggguuaaaaauccacauuucugggggcuaggggauguguacguuauauuuucuaauuguugcuuugaaauacuagcugugaaaccaacagaggcuccuacagaaccacccacgccuucuccuccucccacuauuccaccugcccgugaugguaaguaauguuaacauaaaaagguagaaucagccuguagggauccuagacuuacgccauaggcacacaaucuacagcugauucaaaaugucccgauauuauuucugcugaaagguuuuugcagaggaaacaaagaugagcaguuauuuguuccucuuuuuccuaggcacauuuuggggugaaucaaaucaguccuaauccaacccagaccucuagcugggacucuguuuccuuaguuuugcagcauaagaucuaacggggccuuccaucuucuccacagucacacuguggccucuuagcucugccgacugcuggcgucaacagacacugugaaccuuucuggcuauaucugaaaucuaaucacuuaggccauugacuuuggaauuccuggcuccugaacugagaagagacccagauuacacaaagcuaaaaauauuuccauucaucaaacucugagacacgauugucaguugcaguguacugguaaaaaacacaaggagcuuguuaaggcugcugucucagugauuugagggccuuuucucucuucucuucucuucucuucucuucucuucucuucucuucucuucucuucucuucucuucucuucucuucucuucucuuuucuucuccccuccccccuccccucuccucccccuccccccuccuuuccccucuccucuccucuccucuccucuccucuccucuccucuccucuccucuccucuccucuccucuccucuccucuccucuccuuuccuuuccuuuccuuuccuuuccuuuccuuuccuuuccuuuccuuuccuuuccuuuccuuuccuuuucuuucuccuccuccuccuccucuuuguguugcaucaagcccaguguaagcaaaauaaaaugguuuauucuguuuucacacuuugauuuuuagaaaacauuucaauuuucaaaguguuuuucuuucauaguauaaugauauagcugguuguaaucuuauuaaaagugcuguauaacuaaaauuaaaaauuuaaagaguauuauuuagagaauaaacuaagagcuuuauucaaauuaguuugcugaaagaaucauggcuuagaacauguuaaauuuuuuaaaaagcagccuuuauuuccucuugaagucucagguucauagcaacuugagcaggaagcacaguuaucaggggcccccacuccuacccuucucauuccuagcuagugcuugcucucauggccagauuggggcauccauggcagugcuugaagcuccauccacacaucgucaccacacacagcucagaauuuaucuuccaguuugcucuugaaguuauacuuguacaugcuaaguauuaaguuugaaugaacucagguuuucuaaacauugcccuagaaaguguucuuuuagguugcaaauccaaaaugagucaagucaaagauaguuaucuuuuuuucuucuuuccuuacauaugauucugaugguccaauuucaaagcaaauauuuuauuuguccuaaauauuugauaauuauauugcaaaucucccaaccugcugauggccuuccuuuaauuuucgauauugaugcuuuucaguugauucccuucauuuauuguuugagguagcuugaaggauuacauguagcaagaggcuaucacugaauaaugaauuuaaccaguguauucccagaacuaaagcugaggucacuuagaacaggccuuuucaacuuucuuguacauuugagccaucuggacaucuuacuauuucuuucuuuuuuuuuuuuuuuaugauaucaucuuauuuuuuuuuuccauuauuuauuagguauuuaacucauuuacauuuccaaugcuauaccaaacgucccccauauccacccacccccacuccccugcccacccacucccccuuuuuggcccugguguuccccuguacuggggcauauaaaguuugcaaguccaaugggccucucuuuccagugauggccgacuaggccaucuuuugauauauaugcagcuagagucaagagcuccgggguacugguuaguucauaauguuguuccaccuauaggguugcagaucccuuuagcuccuuggcuacuuucucuagcuccuccauugggagcccuaugauccauccauuagcugacugugagcauccacuucuguguuugcuaggccccggcauagucucacaagagacagcuacaucuggguccuuucaauaaaaucuugcuaguguaugcaauggugucagcguuuggaugcugauuaugggguggaucccuggauauggcagucucuacaugguccauccuuucaucucagcuccaaacuuuggcucuguaacuccuuccauggguguuuuguucccaaaucuaaggaggggcauaguguccacacuuuagucuucauucuucuugaguuucauguguuuaacaaauuauaucuuauaucuuggguauccuagguuuggggcuaauauccacuuaucagugaauacauauugugugaguuucuuugugaauguguuaccucacucaggaugaugcccuccagguccauccauuuggcuaggaacuucauaaauucauucuuuuuaauagcugaguaguacuccauuguguagauguaccacauuuucuguauccauuccucuguugaggggcaucuagguucuuuccagcuucuggcuauuauaaauaaggcugcuaugaacauaguggagcauguguccuucuuaccuguuggggcaucuucuggacaucuuacuauuucuaacucaggauccuggccugguugaggaggccacguugcuuccugauucaccauguagccauacugagaguaguaagguuuuagaugcuuuucaauuacagaaugucacaugaugagaaaauuaaggagauuuggguuuucuuucuuucuucuuuuuucaguaugcaaaggggccaaggcagauauuguguucuugacggaugccucuuggaguauuggagaugacaauuuuaacaaaguuguaaaauuuaucuuuaauacugugggggccuuugaugaagucaacccugcugggauucaggugagcauugcaucacuagugacuuuauuuuaucuuguccugcuauucuauuauuuguagugucuacuguuucuuuguaauuccuguuguuuguaauuccuauguuuuccuuuccacucccuauuaaaguagaaacucauuucgguagaaauucucuuuuugccuucacgguuugcuaugucuguuacaugugucuuugggaaguaauuugguacuggggauaaauaaguaguaaaauacauaauccuuuagcuuucuucucuguccagaugauguuccuguuggagaacuuaggacagucuaacucuaagauucuacuugaaacuuccaacaaagcgcauuccaugaaaggccauccaaaguucugcacauuaaauguguugucauaucaugcucuuaacaugagaauagcgguuggaaaggguguaugucuacacuguuauuacauuguauacauuaucccagccagaagcauauccauuaaugacccaaaggagaguuaguuuguuuuucuaagaugguaauuaccaauucuauuacuguggaaucacuuccaggauguuuucuuuuguacuugaguaggaguuuagagaaguuuauguuucuacaagaaacaucaaagaguaauuaaucauuuaauuguaaucugucacaaaacaaagagccuucuccacucuucccaggauacccaugaaaagaugaacauccacacuccacaguucucuaaagccuuguaggugauguuccaaacuccuuugagaaaggcagcaagcuauucuuggcuacuuuuuuuuuuaauuucuaaaaacaaucgcuauuacaguuuauuggguucacuagaucacaugauuaucaauccuuaaagcaauuuuacaagguaaauacuguuauccugaccuuguugauagggaaaccaacauccagaaaaguagggacugcccaguguuauacagcuauaguuagaacuaggacuugagcccagugaaucuugacuacauagcacuaaaucacacuuucauguaaaucauacuguuuugucaggaguaguaauuaugaugauacuaugacauuuuuauuuacgaugaauaaugaauuacauccaugaaaaggagguggcugagagccaacugcccaugagucaggaugguuuuguucuuguuucugacacuggcaucucaccauuaugcugguugacccaucucauuuuacauuuugaagaaaagcacauauaaauauuuuugguguuaauuauuuauuuuuauuuauuuauuuauuuauuuauuuauuuuuugguuuuuuuucaagacaggguuucucuguguagcccuggcuguucuggaacucacucuguagaccaggcuggccucgaacucagaaauuugccugccucugccucccaagugcugggauuaaaggugugcgccaccaugccugauuugguauuaauuuaaaugaugacaguuucacuggagauuagaaauuagaaaauguaaugagauuacaacagccaugguuacauuauuaggcauuaaaauaucuuguuacagccaagaucccacuuugccaucagaggaaccacuggaaaacugagauccaacuggaugucugacacuugccucuaaacuuauuuucuuucagguuucuuuugugcaguacagugaugaggucaagucugaauucaagcugaacacauacaacgauaaagcucuagcccucggagcccuccagaacauucgcuacagaggaggaaacacaagaacagguacccuguggcagcacuggugugggccuccuuuuuuuagaguaggcagguuggucuaauagucacaucucugucaccugggcauggucaagggauaguucucacugaagugacacuaaagugcucauaccacacucugcaggcaaggcccucacauuuaucaaggagaaggucuugaccugggagagcggcaugagaaagaaugucccgaaggugcugguuguggucacagauggccggucgcaggaugaggugaagaaggcagccuuugucauccagcagucagguaagcacaaacauggacuucaugguguauaagaauucaugcuuuaaguaugcaagaaugauaauaaaagagccaaauuuuuuucacuguacacuuuauaauuuccauuuaguuauggaauagacugcuaauuccugaaaaaugacacauacucuuugcaugagaugugagucagggcugucgccugacucuccccacagaggauggaagaguauagaaggcaaugauuauggaauacuauaauauacugccaggcuucuugcuauagcacaaugagucuugauucuaauaccugugcaaggaacaucauuggcuucuuucugccauagcucauccuugcagaugcagacugagugaagauggucaggaggcagucugcaaauaagaauuaugccagucucugggagauggugcuggggaugacuuugccaagcaggcauuguagaagccccuuaguaacaugggucuguugacuuauuguucagacuuauuagagaugaaagcaggcuuuucuaggacuuguauuaacaucaucucuccugccauuggcucaagcagggccuuaggugggcauaauuuagaaaguauucuauccaacgugugcucugcuguacucaaggguagaugacuuuguuaacuagaacaucagcucauauggaguuauguggcuguaauuguaaguuguacugagugugaagucauuucauuuucuuuuaucuuuaaauuuaaauuaucauauaagauaauaguuuuccuuaugaaauucucauacacaguuaauuuugauugcccacauccaacugacuucucucucccuuuucucauacuccauccccguuuguuuccuuccacgccugguauuccuccgucuacuuucauaucacgugugcucuguuacucucuccaugcccucccuuaaagcuucuuuucucuucuaauggguucuucucuaguuauuggccuccaucaacacucaguccccaugaguacacauggauacacauucagagagcauguagcacaucucauucugagccuugguuaccuuacuuaaugaaacaggugaacugaugauaaaaaugcaaugcacaugcaaacgcuuaugucuguaaauguccucagauagccuguuuguuaugaugucaaauagagcauuuugaauaagacuacuuacauuuacuuaaagagcagaauguuuguucucaguaagagcuguaggaucuauuuauuuuaaagguggucaaagcgcuugagcccaaguuugaugauuaaaaauaaaucaguuuuaagaauucauauuuaaaacguaaaaacagcuuuaaguuguuaacggaacuguugggcuuuugugugugaauuguggauuuguggaagacaauguauacugaacaguccuccuacuauuaaaagcuuuguguuuuaauuguugaggugucaguugagaagacccagugaauugaauuuuauaagucagaaagugggaugacacucuuggcuuauauucauuauagagaacacauucuucucuuagaggaguuugugucaaauaaaaggauuugcuguccaugcugaggaaauacaguaugauuuuugauguauuuccugguuuaugaugcuuucauuuuggguuuuauacauaacaauggacggaaagaggcuaugugauucccuugucaaugcccucggcaggguucaguguauucguuguugguguggcugauguggacuacaacgagcuugccaacauugccagcaagcccagcgagaggcauguauucaucguggaugacuuugaaucuuuugagaagauugaggacaaucugaucacauuuguuugugaaacugccacuucaaguaagucccgcucagcccagagccacggccucauugagaaaugacugcuuauaggcaguuauccauaccaugugggaucacgcccagggcacacauagauucugggaaaucucucaaaacugaugaaucauugcucuuuugagaucggccuaaacggguucuugccagaaguccauuuuuagcuuuaaagauguaauaaaccccauaugggaaaauaauuuuaaucucucccuuucuuaccagcacaaugucuacagcauuugaauuguauauuugagagaucuucagugaggugguuuccuuuuauaaucaacugguaucuuguuggcuuguaccccaagagaacaaugagaagacuggccuuuuacuuuuauuuauuugcuuucuuuuucuauagugcuagauauugaaccuaggaccuggcauaugccaggcugcuucucuaccacugacccauguccuuagccuaggcuugagacuuuuuuuuaauguuaagauuucaaauucagcuuugagcuacagaugcuaaacauagaucaaaugaauguccuucucuuaaaccaugagggacagcucuugugcuuuagauaauggagacacuauauguguauuauuuucagcaauuaaauacuauuuaaaaacucugcuuuuuacacaugcauugcuacuuucugugcaucuauguaagccauauugcuggcacauacuuaaagaauguugcauguuccagguugcccucucaucuaucuggauggcuacacaucaccagguaagacauuuguguagccuuuggcuaauuuauuucaagauauucacagcaauguaacugaaauguacucauuuaauauuuucuucuuugaugucaaggcuuuaagaugcuugaagcuuacaaccugacagaaaagaauuuugcuucuguccaaggagucucuuuggaauccggaucuuucccuagcuauucagccuacagacuucagaagaaugccuuuaucaaucagcccacagcguaagugugaaaauaggggggcuccccuuuucuuagaguagacaagaggcucuuagacuugcugcugauugcccagaaucuuggaacuuaacagucaccagaagacuccuuauggauaaucuaguuugcuuuccuaaagacagcuuaaauaucuuccuaggguuguguaacagcgugcauauagaacacugguacccauggcuuguuauuccaagauccaagccucucagucagcuaauggcacaguggauaauaggauagccuauugagcuguaggcuaggguuuucguuugcucucuucuucuaagggagguuguuaaaacaggaaggcagaucauuauuuugaacauuucggcccugugguguagaagaccuggguggagugagugagagaugagagcauacguucuaucucaugcuucagaccucagaaaaggaagggcugcagaguuacacuugcccaccaucagacaggcugagggucauuuauguuggccgauacuucagcagucuguuggguagcacuagauguauuuuauuccaugaaaguuugcaccuggguaugauaacaaaaaauguuucuuauucauuaaaaaugaaaaacuuuuuauguugaaaaguauguguuuggcaacuccaggggagaaaggacaugaaaaaacaaauuguccagaaaguuagaggagggucagaaaauaaugucugaaaauugaaauacacagagaaagccaguggaaaccuaauucuaaaccaaagcuaauuuguuuuaaggaggaguccauagcaugguuugacccauuauaaauuccuacaucuuuuaugcuuaguuacaaugguucaguaugcuagauuuucuaguggucaacauuagucaauauaauuuuuccagucaccucaagauaugguuuuaaaugauggcagccucuugucucuacagaagucacaaguuuugacuagaaggaaagaagaguaaauguaauuagaucuuuguuguuuuacugaggaaggaggaaaauaggcuaaaugagagagaugaggauaaaauagggagaaaaucaguauuuuuuaaaccagaacauuaaaagacagcucuuaaccacauaaaagaccucgugguagcuuucucagagcuuaugcccuggggagcaagagcguaucacaccaagcauguugaugauauggcaucaggacauacagccuccagagacauccugugucuucauuuuucccaggaguuccccuccaggccucuguccuaccuccagggagaaagcgucaugcaguguuauacagaaacacacuauuucuccuucaagcauucucccagaacagcaguucacacagugcuagaaggacacaagagauggaaauauuugucucaugucguuagagccaaaacucauuuuccucuaguugaaucacaucucuguuucguuucuaauuguuugcauauguacauggccuaaacauuucccauugguccucuuugggggaaucuguaaguuuauugaggugcuuuacuugauuucaagggaggaauuuagagguguaggaacuacugugaggccaagagagaaaugaaaauuuuaagccauuuuaucugcauuaucauaucccuaccacuggaaauuaaguauguauuaaaagacuuuaaucucuuaauauuauaucuacaguuauaguguuucuuacuuuaaaauuggugcuucugugugucuagaaaaaauugguuguggaucagaagauaaugauuauuugaaacuuuuccaaacuuguaacuugaucaaaucccaaguaaucgauuuguguuugauucuuugauguguuucauaagguuuucugcuucugcuaugaggcuagaugacuguaauuagguccuaacacuaccuauaaugauauuacuguguaaaaguucaaaauagucucugaugaauaaucccauugauugcuuauuuuguuuuauccaaaacagagaacugcauccaaauggacucccuccuucguacacgauuauauuauuauuuagacuucucccagaaacuccuagugaccccuuugcaauuuggcaaauuacagacagagacuacagaccacaaguuggagugauugcagaucguaaggagaccuuauuuuauuuuaaggcauacguauagcuuugaucauguuuuuccuuauaucuuuagaaaucuucugaaaauauauauauauauauauauauauauauauauauauacacacacacacacauguauuuacuugguacauguuuuaacuugaaguuuauuaaaauaacaugccaacaaauauucaaauugcaucuaauugcaauugaaacaauucuguugcuuuuuucucauuuauuuaguuuaaaaaauuaauuuacucauccuuugacaauuguacuguauuuaaucuuaguccuuuucaccuucaucaugcccucucaucucucuuuucuucccugcugaaaucuuucuucucccugcaaagcucccuuacucuuuugcuuuuuuuuuuuuuuggcaaagcacugaguuuaauggggguugcauacgggagaacgagugggaaguuauucauuggacucugggcaauguuuuagugguuacaccacugaagacaaugaugccuuccuccaucaccagccauuaaauggcggcaacaguuguucauggccucaugaguccuccucuauccauguugaaaagauaauggacucccgauccccaucuugugcaggcacugugcauguaaccaccacuaccaccacagugagcucaggagugcaauugccaugccauacuuaggggacacuuguuuuugcagcacaucucucuauacguuuguacuuagauuguuuuugccccgcuucuucagugcucccugagucuuggaagcagugaugcagauguuuugguuagggcugacugcuccagcgucacuuguucuugguacuuuagcuagguaugagauucagaguuaaccucugccugcagcaguaaggagcuccuuugacaaagacugaaagcagcgucaaauauggcuacggaccaauauuccgaagguagucggauagcauguucauuuauaaaagaauagaaguagacccuccucugacucuggccuauggcauccucagcucugggauccuuacguauucaguuccaggccugaaauccuucccaugcagugggccuuggauucaagcugaaagucacuguuuacuuugucuuaauugugccaccgcuauaccagugggcacaucuucccugguagauugaacuuuuuuuuuucaauuucuccaacaagaacuauuuguauacuuugaauaaaaagcauguuauguguauagaaguuuaacaaugaucuuaucuugauugcagcuuccagcaagacacuaucuuucuuuaauaaggauacaagaggggagguacaaacuguuacauuugacacagaugaagugaagacauuauuuuauggaagcuuucauaagguaaaaauguaagauuaucugggucuuauuuuuagaauaagaaugugaauugaaaccaaaacuuaauuauuuuauuguguuuaagcuaaauuagaauucuaguuaugccuuuuacuuuuauuuuaaauaauuugcuuaauucacaagauaaaauuugaauaaaacaguaaauuccgcuagcauuuugguauauuuucuaaaguuugaaacaaugguuauguauauauuuguauuuauguauauuuauauauguaaugaaacuugccugauuuucugcuuaccguuuuuuccauuuuaagauauauugguauuuauauguauguguguuugucuguguaaauuuaugcuguauaugugaggcugcauuuacagcccugaugagguguuagaucccucuggagcaggaguuacaggcaguuuuaugccaccugaccuggaagcugggaacucaaguccccuggaagaagagcaagugccguuaaccuuugacccaccucucuagucacucuauuuaccacuuuacugaaaacauuucugccauuuauuuuaaugaacuuaauaauuuaauggguuauauuuuaauuggucauauuaucauuuuauagagaacaaacauuuuaugugcuugccuauuaaaacguuacacgaugcaagcaaacuggagaauaagaauuuauuaauaagaauuaacaauaacugaaggaauaauuaagguagauauguaauagauuauuacaugaacacaaagucuaaaacacuauucuuuuaauacacaguuuucuaaauaaccauguuaaaccuguaauagauauuuaagaugguuucucauucuuggagaucgugaguuuuugucagugucuagaggauuauugaaacuuucgcguuucuaagggacaaucaauuggcaaaguccaguaucgaggcaggguauaucagaaacaaaaggaacaaucuaguuuaggaauacauuuuuaaugcugcuuuucacaugugagauugugcuaacaggaauacaaauuuuuaaauugauuauauauaacuucccuauguauggcaugguaaaagacaagccacacacacaaaaacacaccuuccuaguucaauaugauccccaagugaaacugaagagccuuucucuugcuuguguaggucagugcagccucuuccugcuuaaugcucuuggguaugcuuaauuuauuuccauaugcuuuccaguuuaugaauuagauucccuuuuccccucaguauauaaaaauuauuaguuccuugagaauuucucuuuucuuuuacugaaaauagaauuuucucauacacuuuauucugauuacaguuuccugucccccuccuccucccaacuccuccccaccuuccuucccaucuggauuaacaccauuucuauuuuuguugauagaaaacaauuaggcagcugggcagugguggugcaugccuuuaaucccagcacuugggaggcagaggcaggcggauuucugaguucgaggccagccuggucuacagagugaguucccggucagccagggcuauacagagaaacccugucucgaaaaaacaaaacaaaacaacaacaacaacaaaaaaaaauaaaaaugaaagaaagaaagaaagaaagaaagaaagaaagaaagaaagaaagaaagaaagaagacaauuaggcaucuaagaggaaaaagaaaaauaagauuaaaagcaaacagauuagaauaugacaaaacagcaaaacaaaacaaaaaagagccaaagaaaaagcauaagaaaugcauauagaugcagacacaugugcgugugugugugcgcacacacacauacacacacacacauacacacacacauacacacacacacacacacacacacacacacacacacacauacacacacauucacauaaccagagauuucauaaaaaacccaaacuggaagccauaauauauacacaaaggaucugaaagguagaaaaauaugcaacccaaaccaaaccaacaaaacaaaacccccaaaccucuuacuuagcauuaugggacacagcaccuucaaagaugccuuugaguucacuuucuguugcugagcuuggggguuauccuuaagacuggguuguuucccuaguaagacucuuggauacaacugaguuucuuuucaugugacuaucaauuggagauggcuucucaguuaggaaugguuguauguguucccuuuuucuuucaucccuaggaccccaccuagugcacagccauauaaccuguguauaugcuucuucuucuucuucuucuucuuuuuuuuuauuuguauuugugaguuguuauguaucccaacccuacuguguguagaagaccuugauuucuugauguccuccauucccucuggcuauaacucuuucugccuccucuuccacagaguuccuugagccucgaggggagugauuugcugaagacaucccaguuagggcugaguguuauaaggucucuuacuccacucauaaugacugugggucucuaucuguucucaucugcuguuggaggaagcuugcucugauaaggaaggcacagaucuauguguauagcagaaugucauuagaagucauuuuauugcuauauuacuuuagcagaguaguaguauuuuguuuuccuuuaagucaucuagcuuuagguucucaaucacccaagcagcguuggguaaggguucucucucauggaacagauguaaguugguuacuccaaaaaccauugugccacuacugcaccaguccaucuugaagccagaucauaauuauagguagaagggauugaagcuggguugguuuuuacuuuucuccucugguagugugcacaguaccuucuaguaccaagaaaacuuuuccauaaggcacuaggcagguaccagcuugauucaugcucaguuaguuuggaguugucuuuagcaauaggaccauguugucaguugugaagaaucaccaauauucuugacaauagccugaguuguuuggggguucccauaggaccccuuuggccaaccacuugauuagauauaacccauuaccaguacuggaagcuuuauuuggugauaaaagauauuucuucuguuauuugaugugccauuuugcuagaccuuacauaaguauauguuauagaaagcuucuacuguauuagguuucuguaugagcccucagauguccuuuuguuuaagcugucucuccccauauuuccucccucaucccuuuuucccuucuguuuaauccuccaauucaacccucuccuauccauccacaauagaauagguaguuauagauucuugauacggauggagaagggcuuuucuaaucuagcuuaaagagacaagaggcucucuuauggcuguggaagccaacagugauguagauggcaacacagccacagagagagaaaaaaaaaaccaauuccaagugcuguaguauagucuaucuugcuuaaaaauuugcagauuuuggugcaaugcaguaaauaaguuccuccuugggaaagcaaauuuuggggauaugauuggcuuuggcucauccuuauccaggaggagauguugauucuggcaacauucuuaggaacagccuuggcucauugauaaggcuuuuacaauuacaauugaauagcaagcugagaugaauuuacuuuucuuucacaguuacuggagaugcuaagaaucuaaucuccugaacaacuuguaaacauuuuguagcuauuuuaaaauucccaacuuucauggaaccauccauuuuauuuaagccaaaagaguaguacuuugagagaucuuuacugauaguaauuaauuauugcaaaugaagauaaauuuuucuuggcauuaccuuccuuguacuguuuguuuuucuagagaaguguucauauuuuucauauuucuuucuuuucauuggcucuuucuuuucccaaauucucucuguucacuuaucuuuaucuucuuuuuuauuaauaauuuuuuguuugacaauuuuauauauguuaaauuucauaugaacauauacauacauaugcuauguauaugcucauaugaaauuuaauacacauaugaaauuauauauauauaaauacauauauacucccuguuuuuucaguuucuuucucauuuuuacuuaaaaaaauuuuuuuuaaauguuauuuuuuuuauuagagauuuucuucauuuacauuucaaaugcuaucccuuuucuuauuuuccucuccgaaagucccuuauacccuaccccccacccccugccuugcuccccaacccacccacuccaguuuccuggcccgggcauuccccuguacuuaggcauuugagcuuugauuaguuuaaugcucaucagaguuuaauuugggccauuugcaugaccuuaaguuuggaacuaaccaucagacuggugguugccauuagaucaacaguaagugccaggugcugugaucuuguuccuuacucauaguugaaguuuaggaggggcuuacaucuuugggcgcagugccaguggacacacuguugugagugcaggauugccaugaccgugccccgcuuagcuuuuguagcucugcucuuuaucuccuggguuguacauucuuucugccucuucuuccauggggcucucugagcuuuaagggaguggugcaaaugucuuauuuagggcggagcccucaaucauccuuuguucucagcaucuuguucauucaccuucauucacuucgaagagaaacuuuuuugauuaagucagaggguaaccuuugucugugguaggcuguaccagaccauaaagaacuuuauuuucuucauacucuauuguuuucauuuccuuucuuuuuccuauucaacauacuuuacuauuuaauuuaauuuaauuuaauuugugcauaugcauauuuaccugugaguaugaguauugcaugcauggaaggugcucaaagaggccagaaaagggugucagauucuauugaacuagaauuacaggugguuguuagccaucauuuggguguccaggaaggaaauuagauccuuuagaaaagcagcaaguauucguaacaauugaguuaucucuccaguaacucucucuacccaauuauauaacuuaauccauaaggacauguggcugacugacuuauaacucuuauaaguuuucuucuugacaauuucauauauguauauaaugccaucugggucacucucaccucucacucucuuuucucccuccugcuccuaccaguccaaguccucuucacaaaucccuuucucacacucauguccuuguguuuuaucucgagaccaguugaguuaaaccagaaccguuucugugaccaugagcuucaaaguauccauuguggucuggaauacucacauguggcauauauugaagacaacuccugcccuacccccaagucuacaaguagccaguagcuuuuaagcaggguaggcucugguccugugaguccucccuauccaugcuugacugaagacaggccaaucuucuucaggcccaaugcaggcgaucauaauccugaauucuuuggccagugagcuacagaucaagaaucggcaaugaaauguaauuugcauaaguuuaaaaugcaguaagaggggugaagagauuagagcgaaauguauucucaggaugugcugucuuaugguucgcagugaaagaugaguguauuuugaaugauacaaauuaaaauccuuuugauuuugaaauaacccuggugaacauuuguuugugugguuguucauaagaaccaauaaauuucuuaaaauuauuuauuagauacuaaauauccugggaaugcuuaugcgauguucuugagaucagugcuaguugauuaucucacggauguuuaaacuuuauuuuuaguaagcuaugaaucacuuguauauaaaaacaugaaauuccuauuuaucacagauguuaugagccaguccuucggugauggcuccuuguaggaaaaaauauuuaguuuuaaaauaaaccuuuagaaauucuucccauucuaccugcuucagagcaguacuuccgcucuuuuucaucugucugucaaacuuuucacaguaaccaucaaguucuugcuuaaguauuugugcugagauagugggauccaugagucuaagugugaaggcaacacuuugucccaaucauucuuuuccuugcuucaauacaagcguuuugcugaauuucuguaccaauagauuuccuaauguccccauuuaauagcagaugcaauacaaucaauaggcguuuuuuuuuuuuuuuuucuuuaaaugaaucuugaguugugcugauuucuggguuuaccuauagaugaugugcuugcucuuacuauguuagagaaagccgaaagauacauagugaagagaugguggugaaugaaucagaauugaccuuuguggaagauaucuacagcuccuuuguauugaaugaaauauauuaguggucuacuaucgucuguuuagaucauuguuuuacaguuuacaaaauucuuucaugcacugcauccucucuguuugucucagugagaguacauaguggggaaauauggaauuuuacccauguacaugggugacagacucugaaaugcagucagugucuaguaaaguuucauaugacagcauugauuuuaaaaccuagguucuuggacuuuuuaacccaagacucuugacuugggauaaaaugguuuaagaaacaguuuuuguaaucaaucuggggcuggggaggggagguugggggaaaacugggaguagagggaagagaaacugcagucuugauguauuguaugagaguagaauaaguaaaaaagaaacaauuuauaaagaauugguauaaagcaaugcagaagucagcuuauuuuuuugagagaaauuuuauaaugaagauuacuuaucuuuuuagguccauauuguagugaccucaaagaguguuaagauuuauauugacugcuaugaaauuauagaaaaagacaucaaagaagcuggaaauauaacaacugauggcuacgaaauucuuggaaaacuucuuaaaggagagaggaagucagccacaguaaguaaagcgcugcgaggccuuugcugcuuagcgccucaugguaagguggacacgguguucucuaaaucagugaauuuuauuugcuuuuuuuuccccucagugaguuuuaauuuguuagugaguuugaaaguguggaaaguuacacucagaaaacgugcuacugagauaauaugauaacauaucuuuuuacuacugcagucacaauaagacauccaggcaccaagaaacaucauguaaucuuuucaaacaaggucaugcuggaaagaaacaagacagauaacugcuuacauacccagcaagaucacgauauuuuuuucccccaaaauaauuguuagccugaauuuguguauucccuuuuuagggguagggggaagaaagggcauugaguuugugaccauaguuuggaacuagucacugguaucuguuggacucaucagggguuacauaacugaagaacaugucuucccuucucccaacauuuaucaguagcuaguaguucaucagggagaggcagggccgcgugacucucuugcugaucccugauugauaagcaggccaguugcaaacagccauagucauggugacuugacugcuuuggcuguaugauacucaggggacauuuccuagcucuuaucccugucuuccaggucucacauucuuuccacccucucuucugcaauuuuuccugggccauggaggaggacauagaaggaggcccugggggaggggguggccuaaauguuccgcucaggacugagugcuccccaucacauauucugagcgccuucagcagccauguaucucugcauucacugccauucguugcaaagagaaacuucucugauuaaagcuggggauaguauuugucuauaaauauuuagaaggcagauuauuaccaugacaacuuaagaaccguauuaagcucaccccuagggcuuaaaaccuccucagucauggguuuuugacuagguuuacaguuugaauucccucuacugaagaaaguauuguaguuuguagaguugauagcuuuuggcuccaggaaagaagagaucaucagauuuuucaaagcauggcugcaucuagacaguauuuuuccuuuuaaauucuaaaaagacaggcauaugcuucacugaaauagcucauuugagggcuuuaaaauuuuuuagacuauuuugccaggcagugguggugcacaccguuaaucccagcacuuggaggcagaggcagaggcagaggcagaggcagaggcagaggcagaggcagaggcagaggcagaggcagaggcagaggcagaggcagaggcagaggcagaggcagaggcagaggcagagaggcagaggcagagaggcagaggcagagaggcagaggcagagaggcagaggcagagaggcagaggcagagaggcagaggcagaggcagaggcagaggcagaggcagaggcagaggcagaggcagaggcagaggcagaggcagaggcagaggcagaggcagaggcagaggcagaggcaggcagauuucugagucugaggccaggcuggccuacaaagugaguuccagggcagccaggucuacacacagaaaccccuccucaaaacaaaacaaaacaaaacaaaacaaaacaaaacaacccaacaaaacaaaacaaaauuauuagucuauuccuagauaauaauuucuaaagcaaauaucaucaaucauagaauaggguggcaguuucuuuaauguaacguuucuacaaagacacacuuuaaaagauugauuuaauuguggguaguauuuagauuaaucuaaagacagaaaggaauguucuuaaauaccucaaucaaacauuucuuuucagccuguggaucaggaauaggggcuggucaaugcaguuccucuuuccgucucuuugagacuuacaguuuuaaugauuuuccucaccacaugagcaucacaaugcucucaaaaguguaagcucuugagagacucuaccucaaauuggugauauuuacauguuuaaaccauuuuacacgcaaaagggaguggguugggguaggggguuuguggaagggagaccgggaagggggauaacaauugaaauguaaacaaauaaaaugauuacuaaauaaaaacaaaauguuuaaaccaucuuccuuagcugauguuucuguuggucauuugcaguuccaaauccagagcuuugacauugucugcagcccaguguggaccaguagagacagaugcugugauauucccucuagggugaguaagcccugcccuggcuuuaaacccccaagacagagcucuucucaugcaaauggccugagagaggaaauagcacucaagagcugcagauuggagcccagggacgugcaaugugugugugcucuucaguuaccacagcucaggccagggcucacgugaccuuuugcucgaaggauaggaauguacaagaccauaucuggaaauucucucaacaacagccaggaaaaucaugcugagucaaugugucugauaaaccuacuuacugcagaccucccacugcuuaacagccuuuuacuaaauaagcuaucacuuuucuggguuacuauggaucuuuugauggaaggaaugcauacauucauacauacauacauacaugcaugcauacauacaugugguguguagauaauaauuauaaaguucaguguuggugauuuuggcaagcacagcugcacacaucugccagauaaauguauacuauuaaauauuuagugaacauuuauuguaaaccaucaacucuucaauaugacaggguuguugcaguaaaaggugaguaucugugaaagccaguuagagaaauuaaaaauuagaugcauuggcuuuccgugagucuggacuucuccugugugggcuuaaccaaauacagacuggaaauauuaaagagacugaaucuacugaacuuauaagcauacuuuuugcucuacugcuuuccuaacugggauauuugucaaccucacacagacauuuuuacugcuaucacuuccuaaauagcauaauguaacagcuauuccuaacacauauuauacuaaguaauuagacaugaucugaagcaugcaggaggauauacuuaggcuacaugcaaaaccuagaguauuuuauaugagugacuuuaguaucuuuaggcuuugguguuuucuggaggucccggaacaaauacuucuaagauaaccuaaguaugaucuggguucuguugcagagcaggggccuugguaugcaaaccaagcacagguaaaggcauggggagugauggaggcgccaucaacuuucagugauaagagaguuaagcagaggccccaguggagcgagggagcaagcuguguggcugguagaggaagacacgcuaacuauaacucucacagugugcucuagcuaucugagacaugagacgguaaagcaggaccuggcccacagugagacacauacgcugguuuacagagcagaagaguuguggagacuauggaaagggcuuugcauuuuuuuuuccugaacaaaauaggaguugagguuuuuuuuuuuaaagauacgcaucauuuucuauaacagggaaucaagaaaacugggcuaaauuaccagggcuucugcuaaucuuauuaacauuacuuuguuauguguggguugcucaagcauagcacaaaggagcugagcaaauucuaacguuagacucuuucuaagcuaugauuaacuagcaguuacuuguuccaguugggaagcagauucucauguguguagguagggcuggugggugagaugucacccucugugucucacugaguuuauauguaaaugaucauuucaaaauuucagagagaugaagcaaaaugcccugcccuuccgaaugcuugcacguguacccaggacagcguuggaccuccaggcccuccgggcccugcaguaaggaaacacacauaguugcuuauugcuguuuuguuuugaaaguuguuuuggaaggggggaaucaccuguuugucaguauggcggccauaaaaugcuuuuuauccauuucaguguuuucaaugcuggaguaugcuaaacuuccagccaucuuuauaauguauauucauaauauauuuugagaucugaaaugaaguaaaucaagaagaaaauuagggagcugguaagaugaaucaguggguaaagguguuuaccgccuaaccgaaugacgugugucuuauccuuaacauccacaagguagaaugaaagggcuaacucaugcacauuguccucuggauuucacaauguguccccccaacaaauaaauuaguaaaugugaucacaauuucauuucaaaaacaagagaguucuauucuagugcucagaccauuucucuagcuacucagguauuggcucucuucaagacuuuuucucuuaaaaacacaaguuuggguuuccaucuguaaauauaagcacuuggaaguguacuauauuuccuuaaaguuucuuguaugaauaaccaugguuuggaaggcugaccaagaacaacuuacguagaacuuagaacauauguaccugacauagcaggcacaccucauggugugaacauguuaagaugacaaauauauggucaugguauaagcucugggagcaaguacuagaguguggacuaauuugaaugcugaggcuaugacuagauacuaugugauggggaugagagacuaagaaaaaugcaaagugaaacauugaagacugcaguuacccuagagugcauugguccaucaguguguaucuuuuuggauuaggccugauuuguaauacccgacuugagcccuacuguggaauacaagugauugcuuuaaccucauuggcuuuuuaagaaaauaaauuauugauauaggagcaacucagauacugagaacaccagucuguaugauacugggguuauagaaaauaacuugauuuuagguuaauuacaaagcaccuuuuauauauggauuuaaaaugucccuggaauuaguaucaaaaaucugagauucaccuggaauaugucuuggaucugauagacauuucucuguuuuuuucucuaguauugagguaccauuuucugaugucacuaucauuuuuuuuuuuuuuuuuugguuuuauuuguuguuccuugaauucuuguuuguaagcacacgcucugagguccugagacauuugaguaguuuccuugcagaauauaauucauauaauccucaaaugcacuuuucuuuuuauucaagugcugugaauauaacaagaagaaacauagaaugugcaguuuucaaauucucuuugccuguguguuuauaugauacaaauuuauuucuuagccaugcuggggcucaaaccugagcuuuguccaugcuaggcaaggguuugccauagagcugcauccuggccauaacaugauaacuuuccuuuaauauuuugcaaguaucuguguaaguauugaccguuuagcgagcauauuacuucuugaaacacuguuuuuuauguaucaauuucugaauuccuuaugcuuacaccaaaauguguucuuuuuauguguuuuagggaggaccuggcgcaaaaggucccagaggugaaagaggcaucaauggggcaguuguaaguacauuuuaaugcuccaaggagucauggauaucaaguuguuuaaauccccuuggagguggucuuugaccuugggccacuuacuuuugguuuaguaacaucaagucacaucacaguucuuggcuucagacauuaugaacaaggaguguagauucaacauaguggaaauuugaacucaugggaauaugugaauacagauauagcacauauuauauaaugguuuuuacuuuaaaaagaccaccuuuaaaaggacauuuguugaaauguagguuuuguugugaauucauggcaccacuuccugaagguguaguaaagggaaugaaaggguguggccucaauagaguuuuauacacguauguauuuuaaacuguuggugaagacuaaguaaucaugccgucaggcuaugacgagagguuucugacccuucuuacuguucuuaaagguucuuacaucaaccuuuucaucuuucacuuuucucauauauuuuaggggcccccagguccccguggagauacuggcccuccaggcccucaagguccuccaggcccccagggacccaauggacucuccauuccgggcgaacagguaaacauaaaagcuuucuauaguaaaugaaaauguuggguuaacaauguauuuaaauggaacacauuuuuucuuccuuuccuuguuuugucgugucuccccucagcaauuuuugguauaagguuuuggaccuagagccucacagaugcuaugcaagcucucuaccguugagcuaacgccccgaccuguuauaagcuucuuauuuugagacaggguuuugagcuuacucuguggucaguucaggacuugaacuugugauucuccuaucucagucuuuugagcagcugggaugccaggccugagccacucggacugguuuacgugcaguauuuucuauguuguucugagugcaaauguuuucuaggagaaugcaaggcuagcuacucagcuggugucaucugaugaauauuauuuuagauguguaaaucagacaugcaaucaguaacuaugaaaaauuguucuauuuauuuggucucucagaaacuuccugaaaguaauguauaugucacuuuuguuaaacuauguucuuuuaauguagauauauugucccaagucuguauaacagcaucauaacauuaaguagaaaguacaaaaugacauuugcuggauagaaagugaguguuaaugaaggggaggguucauucauguuccuuuaaaauagacuuacgugcuugucucugaaucccuacaucauaccuauaaaaugauaaaaaugcauaagugacucaauuccuucuuuuaaacuuaauuuccauaauaccugagaaccaucuucucacugcccacucuagggucgccagggaaugaaaggugaugcaggagagccaggccuuccgggacggacagugaguucucaaaauuaccucuucuuaccuguaaugcucuguugacaaaguugucuuuugaguguuacaaauuuguuugagaggggagguggaguuuguuggguggggagaagcagggaggagcuggagaaaaggcaaaucaugaucagaauauauuauaugaaaauuaauuaauuaaaaagaagcaaaccaagauuaaauagugaaggguggcucacgugugugcuucucuggacuugaauuucauacucuguucuuacuuuucaaggguauacuguuuaauucuaauaccuccuagcugaccaaugucuauaugccuggcccuguguuuggccauagucuucuguuucuuuuuagagcccucaaacuuuguuugaagacauuuugaagaacacuaagaauaauuuuuuucuuuuacauaaacaguguauuacugcacacuaauugcuugcucccuucuguguagggaaccccaggauuaccuggcccaccaggaccaaugggaccaccaggagacagaguaaguuuugggccaugaauauguuuuaauuacagacccccccaauccuguuugcaugauuggagagguggagcucauauaucuugugagagguuucaaagaugguauugguggaccauccagcaucagcaaucacuggcaaggaggugucacucaguaggagcaauacuucaccaagguaacccagaauagugugugacaugcucccgaggguuguuucugugcuuuuucugacacuuggaagaaacacacaagucaaagagcaagucauagacuccaaugaggaguuuggagacucaagugacauauuggcacuucagcaucuuuugacaaugcugaauuugggcaguauuguucaauuuuuacuguauaaugaagagcaacagugagaauacaaaugaacuccagccuuuccaauaagaaaacaaaggugacuacagccacugagaaaguggcagugagcugauuugcugucaagggcucgcugugcacaucacaacccaucccagugugugcuucagaugguaaugguggggcccaguguguguuucagauggugauggugcggucuugagguuggcaaucaggaagccaauacugucaccauugcaccgagaagggugagggguuaggaagaucugcacauuucccccuccaacccaugaaacuccaacccauguccaacauuguggacagaccacucuuaucucuugggaugaaaaugaggcaacgauuuaagaaccaauucccacguuucuuccauggcccuacucaugugccgauggcuuagugagcugccucugaggcuaaaagcaggcacagugagcagggaggacauacacuguuucacacagugagagaagcugucgguauggggauuuuggcuaacaaaaauaagaaauaaauaagaaaguggcaggaaguaagagagggaagcaggaggaaggugaggaagaggacccuggugagucagguucugcagguauaguggggaccacagaagaaccccauguacuuguaucuaauuuauaugaaguggucccuagucucuucugacaccgugauugauucgggugguuauaguaacgacuguugcaggcuugcagucagaagugaagcuaagagguaaagcauggugacugcagguggcuugagauagcccauuuaaggacaucaaauuaaaucccccucaucccaauuuagguauguuccuucaaagaaacagguggccaggaaguucuaagcaugacuagaucauuaaaagucugauccucccuacaaggggagagagagagagagagagcgagcgagagagagugcugugguagcacuuggaucuguuuggauggaagaccaggccuaucagagcuacuggaacacuuugguuucuuaaguggcucucagaaguaauguugguuuuguaucagauggacuccaagccugguauuuguuaagcggacauaacuucuucagaaagcaaacugaaaguuuaucccuuuaaguuucugaaaagauuuguuuugggggauaugggaguauuucuaaaacucccuuaaaagaaaacuaaguuucugcuauugugaaguaagcagaaauacagaggcugaauaauuauggacaacauaauucuuccaugguuugauuuuuucaaaaccaagcuggcccagaacucacagcaauccuccugucucagccucccaaaugcuagaauugcaggcgcggagucaccauugccugguacugaucauuuuuauucucuguggaaaaugggacaaaaaucacuucugacugaggaaugcagcaagcauaaacagcaaacugacucagaaguccucggcuggguuucagagaucugguguugcgaaugaacacuaacuagguagcagggugacucacuccagacagaggucauuuggcacuguacagagggaaagagcaaaccaguguggacacaggagccaaagggcagcccugcagggagaugcgccugcccuuuccuugcugcucacacugacauagcucggcccugucaugaagggagaacauuuaacucuggcugagagaauagaagacuuccuuuccuuuuugaguguagggcagcuaaggcaguuugaguuucugaggguggcuucaaucagcagaggcagucucccuucaucucuuuuuguacuuuuaaaaucuuagaauuucuuaaaaucuuucuuuuaaaaucuuaaaauuuuagaaucugccuucuuugaaaaauauuaguuuggcauuugaacuaauuuugcuuguaguauacaaaugaaugagcauaggaacuaauuacucaguaaaaguauaauguaaauugaaaugaggguuuuuuuuuuuuugucguuguuauuguuguuauuuuggaaugcuggucuucauacugaaagcuuagcuaccaaacaccaccauguacucagcccuucuuaugacccuaucacccuuagugaucuauuuagccucauuccacaugcuuguuuccuuccuaaccuguacuuucauucuuacaacaggguuucacuggaaaagauggugcaauggggcccagaggucccccggggccaccgguaagagcugagaggguuacacugcccugaccacggucuccagccuccuuuuccuuuccucccauuuugaguuuccccccucugugcuauggggaauauugauccagaagccauuuguuuuugauuuaugagucaaaauguucuagagaaaacagaugugucaaaauacagaugcuuuuucaaguucuguuucagaaaaaucucagacugaccugggcacugucugguuggucucuugauuuuucucuucagugagauauuagacucaguuccucaguggucaccuccugaaucugagcucugugacauuuaaauguuaaggacaauauuaaugagcaaccacuggucauucugaggagguagguuuuaucuacaucuuaaacaaaggguggucuuaugccuuguguagauuaagcugaagauagauucugaaauuuuuuucaaguagaacaaucuauaggugauguuacaaugagauagaaacacuggcuaugccccccugucugcauggcaggauugaaagauuccagaacauauguuuauuugauuuuacuauuuauauuuaauacauguguuuucauguaagaacaguuuaaauaaauaauaagccuaacuauuuacuacagagcucaacuuugcauacauuuagggaaauauuuuauaaaaucuaugauucuauuuaauagaagugguaggcuuuagaacaugauguauuggauaucauauuauaaauagcccaguagauauagagcagaaaugcuugcaauuagacuuaaaagcaacagggagagauucuugugguuuuggugggaugaggagugcugacuggagggagagacuuggagccucgggaaugucccugaggaguaaggauuucuagacucuucuauggucucuggaagagaggcuaaaggaggauaaacucagccaccuucuuaaucccccacuagucaacauuuccaccccugucuuuuggaggauuuauuuaguuauuuauuuauuuucagaaauaaacuaaaaaauuaggaguuuuuauucuguaaauaugccuuugcaacaaauguacugagauuuuagucuaugaauugugaaucugguuauagguaugcauguauuuuucuguuggucucaagauacauuucagacagaaaucccaagauuucuccccucauguuaccuuaaaacguggcuuuccucuuccuuacuguguaauggcauccugcuucuuuuaaacgguuuuaagucuggcugcaauucuucaguuacuguggcuaggauuuuuuccuugucauaaccuuggcuuucuuggucugugguuguagggaagcccaggcucuccaggagucacagggccaagugggaaaccaggaaaaccuggagaccauggcagaccuguaaguaguuuugcaugucgacugauuccauucuccuguggauguggacaaaugagaaucccaaggcuugggcauauuuagauuaucucagccauaaauauguaggagcagcugcugaaaccacgauaaacccauagauuugacucgggaacgguucugaagacuuuucuucccccugcugggcugcuauaauauccugggaugaaaauugugguccuugguuucuuuaaaaggaggaagggauugugagccaagacacauuuuucugcacuguauaaacacucuaagcuucagagcugggucagcaaaaucauucucuuuuuuaauuuauaaaugguaugcuguuuaagacauaaaaauacaugaucagagugcagggcgccuucauucucaauggaggaauguuaacccuuugauacccacuacccagauauaccauuuucuuuucuugcuccauaacugaggauucuggagcaucagaccagucuuaaaaguguuuauuggggcuuagggagauggcuuagaggguaaaaaugcuagccauccaagcaugaggaucuaaguuugaguuuccaggauacuuacaaaaccugcacauguagcaggaguaucugcccucucaguguuccugcagagagaugggaggaagaaaugggagggucccuggaagcucuuagguaagguaucuggcauccauaguggacaaacagcaaagagaccgugucucaaaucauguggaaguuaaggaugaacacccaaggccuccacauguaugcuguggaacacgucugcauauguaugugcaaaugcucucaccacacacgugcaugugcauaaaaaauucuuuauuagacugaggguguagcucagugcuggggugucagcuuagccugugcagggccauugguucaacacuuagcacaaacaaauacaucagaggccaaacuuaagcugguuauuuuacuuuuucuagugugacccuuucucaguuuauaccugguuuagcucucucucucucuccuccucacucuuuugguuaggaauaagaauugcaauaguaccacaccuagcaugcacuuucaaauuaguauguuucgauugaauuuggaguuucuaacauauccacaaguauuugaaauggccauugggcuucacacccuucuuguuuuacuuuguauuagaugaggcuagaugaggcuaacuuagacaagcagagggccagaacauccuacugcuuuuagcugagaugugauugcuagugacugggaguaaaaaugcuucuacaagaucacagacaugaugacagggaaguuauuucugugaauuuuugacaauauuguugucuaaacaagacaauaccaugugaugugccaacauguauugggggauuucacaaggccucaccccuaaaugaagaucuauaggcagucaauggcuauaggcagucaaguggucacucuaaaacaugcacauaugagaaacauuaaaugaacucauguguguguguauguguacgaguguguguauaaguguguauuuauguguguguguaugaguguguguuuguaugaguaugugugcuugugugcguuuauguguauaaguguguguguguauuugugugugugugugugugugugugugaguaauagagaaggaguaauaauugagaaggaguagugguauacaugagaggaguuguggggagauaaugaucaaaaugcaguacccaugugucaauuucucaaaaagcuuaaacaauuuagaguaggaacaaauugaaaauuuaagucagaaacauuucagaggagcaagaaauaaaaaauaauaacuguaguuucauaaaguuccauauucaauauuagcagucccacaaaaaauuaauucuuuuuguaaugaggaagccaagcacaaguuuuucuuacaauaacuauaauucacuguacgucauucaugucucagggcaaacaagugagaaaaucuacuuuuucuuuaaaauucccauucuggcaucuguaucaagaauaggcuaucaagagcaaaagcaggaaggagggaggucaguuaagaggauaucggaaucauuacacuaagccgggauuagaacucauuaguuuccauggaaacaguacaaguugaguuggcuggaauagcaucccacuaucaaauuuguuaaugacuuggauguuccuucugcaaugguaguuugcaguuugaaagaaauacuacgagaagauaggaaguucgggcccuccaaggaucuuucuuggacagggaugggcuucugauggagugugauaaagauuaugugguuguuuggaugugagaucaauuaagagacaaaaacaucuguuuucuuuucuauccaauguacaaaaacuaauuggaggaagaaugagcuccacauuuauccagggagcugacaggaaguccuuuacugguucuucuaggaagugaguggaugucaggcuuuuguguauuucacaauaggcaacugagcuaaguaaccaugguaacuuaaauugcuaguucaagugcaguuugaguucaagcgcacguugcaguugcaagucuacguggugaacggcacauagcuuuuguaacuguuguucuaaaacucacgucugagcaaggcuuuggaaggccccaguuggugggagauuagguuauuuuuauaguaaaggaaaauguuaguggugugguuuuaaugugaugcaccacauugcugguuuaucagacgacagacucugcccucauaucaucguggcuguccauuuuagaucagagguucucagcuuauggguccuuacccccuugcacaucaaagaacaaggaagggguugcauaucagauauccugcauagcagauguuuacacuaugauuaaaacaguaucaaaauuauaguuaugaagaugcaacaaaauaauuuuaugguuugggugucacuaaaacaugagcuacuguauuaaaaggucacagcauuaggaagguugagaacaacuauuuuagaucaucucuugcuguuucuaaaauauaacauaucuguguuucagggucaaucuggcuuaaaaggagaaaaaggugauaggguauguauuucuuaaaauuagacuucauuuucuuucaaguguuuaaacacuuaacucugaaguuauagaaauaauauuuuaaugauuauuuuuaaaauuaauuaaccagggagacaucgcuucccagaacaugaugcgagcgguugcaagacaagucugcgaacaacugaucagugguaauuagcucuucaccauuugaacaacggcuaaagagaaaauacaggaaauugagucacagaguugauuggaaauguuucacacuaguacagcgccaugccugaagauggagcgcaagcuagccuugaaacucagggcucguccucugaaguuucauuagugcuucucacagcacaguccugaggaacacagcccacaaauuucuuaauuuguuuguaagaaaagagagguccgugaucauguucuaaauccagugaaucacugggcuuggaaacgaagcccccaaaauaauaacuuuugagugacuuccucugacacacagaaaggcaauguauuucaaagaguuaccaccuucugauaagucuuacuuauuuguaccaaagcuuguggcuugaggccagcauuuuggaugacugcugaucaagggucacuuucuacuggguggcugaugcaucucauuuuuaaugagggaacuuauuagagcacaagagcuaggugcuaagagaaaacagcuccccuaugugccgccucccuuccuggguuucuuucuaacaacucuuucucucuauaggccagaugagcagauucaaucagaugcugaaucagauuccaaaugauuaccacucaagucgaaaccagccuggcccaccagggccuccagggcccccuggcagugcuggagccagaggagaaccagggccugggggucgaccaggauucccuggcacaccugggaugcaaggacccccuggugaacgaggucggccuuuaugacuuuuuauagcgauaaaggaagggcuugugugugugugugugugugugugugugugugugugugugugugugugagggauuggggcagguugaaagcauuuagaaggcagaauuugacauaccacuucacuguuauuuggacaguccagaagagcaguuugggagccaccuuuccuguuuaguaacuggaagugcgcagacaucuguaaucccagcaauaggagugugagaaaauggaccccguagucagcagaucucacuggagauauuucuauccauugauuuuucuuguggcucuggugggaaguagugucuuggcagaaggaaucaggcaccagucuuacuaagggcuguggcuguggcaagaacugagcagcaaccaagggcacuugguccaaauuccuucuauuccuucauucaggacuggcccugcuucuuggauauuuguuucacuuuaauuucaugguagauaaaugaaauucaaaggggcaaaaaaagaaaaaugggauuucucuacuuccagauguuuuaggaugcuuacuuuaagaguuauauaacccgacuaucuaauggugugacugccgugcccacacagcuccuaaagucuaccugaagggccuucacuaagauuucugguuuuaauuacuauuugacaauauauuaggcauauuuguauccuucaaauaauuucccucugacuuucagccagauuugcuucuuggcuaugaaucuggaauuacacaaaugucuagaaagaauuuggcuuaaggagugaacuucugggaaaaauuagguucuguuuucacuaaggaaaugacuuacuugaauuauuauuuaagaugaaaaaacauguuuccagauaaaauuuucccaugcuuucauuuuccuucccuuuuaaauuucuauugauugauuuauugauugauugauuggcuucuugcagguuugccuggagagaaaggugaaagggguacugggucucaaggaccccgaggaccgccugggcccccagguagguuuguuaagacaucagacuaggaaagcauguaaaaaaggcaacuucaugguaucagcuuuguaccaacauggugggauuuuuagcaaaaaaguugaguuuggauguagccuugugaaagucucacucuaccaggccgcugugguauaagaagggggugaaugcgucugacauugaggaguacauguuuuauucgggacucuccgugguauuuguuugcuuguuuuguuuuguuuacuuuguucucuccaauuacuauuguguguaguauucuucaauaugggguuauuagagugagaacaauuuaaagacuugacacaaauuuucauugacagcauuucuccaacaagcuauaaggaaacaguagcugucugaguuguuuuaugcauuguuuugacuagguucaaaaugauccuucucuuuuuuauuuaaaguuaagaaauccuuuauucuaucuaucuaucuaucuaucuaucuaucuaucuaucuaucuaucuaucuaucuaucuauaucaucuauauuucaucuaaucuaucuaucauuuaucuaucaucuaucuaucuaucuaucuaucuaucuaucuaucuaucuaucuaucuaucuaucuaucuugucugugugugcauguguguguguaugugugguacacauguccauggugugcauguugaggucagagaacaauuugugggaguugguucuuuucuuccacuuuguggguccugggaacuuaacucugauugucaggcuuggcagcaagcaccuuuacuuuccaagccaucuugcugcuccauguuuuucuucuuuuucugaaguuucuguaucuuuacacuuaaugcaagcccuguggcgaaaucuuuacauuuaugucaaucauaugaagcaccacuuuacccaugaguauuggaaucugccucagguguuuuugacaagaaauggaaauauauuauuauuauuauuauuauuauuauuauuauuuugcuucacacuagguccacaaggcgaaucccgaacggguccaccagggucuacagguucaagaggcccuccuggucccccuggucguccaggaaacucagguauccgaggcccuccagguccuccuggauauugugauucaucccagugugccagcaucccguacaaugggcaaggcuauccagguauguugcugccaucauaaggacuccaguuucccagaaauaaagagcccuaggauugaaggcaggucgagauagggaucucguggagaugccaacauuuucgguucuguauuuugaguaugcgacagucuucuaaagcacaaaacacuuuccauaauuaggauuuaagugaccauuuuccccuccuguauuucuggauuugccaaaccacaccauuaacuucucuacaacucuuuggggaguuaaaugaaugcuaccaauucauuagguuucuuuuuuuuuuuucuuuccuuucuuuuuauuuauuauuuuuaccuaaaggaacagagagacuaaaaaaaugaaauaguguuauagaaugcugaaaauauauaugaaaauuauuucugcaauccaaucuacauauaauagcaaacaaaaugcagacaagugaaagaauucacugucaugcgccagccguagaauugcugcuuaucaaaucuguagcuuaauauuuuuauagggcuguuagugaaauucuaguguugcacaguuguagacugcagacgcaucucaugccugaccuugggggaugugagaacugggguguauacuggucuggauagaaagacucucauguuaugaucaaugguuaguuuuucauuagugcauccucaugcaucuugcaaguuuaaaaaaugauacugcuguuugauaugguuugcuacuagcaaguagugcaugaguaguuggauauaucaauaucuauauaucuauauauuuaugugcauaacuauaugugaucaaaaguaguaaugaauccaaaugcauaaucccauguaaucuauuugcaagacuauaauuuaauuauuuguaaagcaaauuuaaauuaucccugccuuauggcauuugugaacugaaaauauauggauauauaaauauacauacuuuaacauuuacauagauggauguguauauauauauauauauauuugcauaguaauucaacuuuuaaaaacuaucaucuuugaccuguuucagguuccggcuaacaaauuuucuaagucuccagugcugcuuacaguuugaaauacaugagaauccuguuucugagauguuugcgcacgugcuuauuagaaaaugagucuguauggaaaucucgcggcagauaugguuaacgaacugggucggcaucauacaggaggguggagacuccauacuaacuugaaugacacaagggcagugguguccgccugaugcuuuucagcaguaacguagaacaccaucuuuuaaaaaguucaaacauagccaggaggagcccugguugugaaggaggcgccuaauaagcuacuaaccaacagagucaugccauguugagacagacaauuaaccugguugaagagaaauguccuauguaaauaauaaacuaauugucgcuuguacacgaucugaaugugauccuguauacuaaaauuucguaacaacucaacaacccgcuucugcaccaaagccugcuggcugcuugcucucugcagugauaacagagaauggaucugauccccucuugcuuguuagcagugugucugaguucagggcaugugacuucucaguacucucuguguguauuuuuauuuggguuucuuaacugcaauuuuucaaaccaaaguuuaaaaucaacaucccuuccuuuuuggcuauagucacagguguuccugcccacuggcuguaacucugcaugagacauagccauaggggacaccguggaguguacaaaaccuggcgacaucuccuuucaccccgaguucagucucuaggcuccaauacuuuucaugaccucagcucuccaaguuaucuguugaccugauaaguuugaagucaugaacaguuauuuagggauuugccaaaaauccuaccuagguauuguguuuacaauucuuuggcccaauuucugauccuucccagguuuugugcaaugauuguguuuacugcuggaucuuugagucccccacuccccuguccagcacuccuuauuuggucaccaaauucacucugcacacgugcacauggaaauaauuggaacaccgcaaugcaaugcaucuauuuaugguugugagauuaaggguggagugcccucaccuccagugaugaguuaacuuuugcugugcguguauaccuuccaagucaugccauaacuguaauguugaaucggacagagccuuaugugcccgaggguggggccuaccugccugaacgagagcccuucaucgugccuguggagccagagaggacagcagaauaugaggaugacuacggugcagaugagccugaccagcagcacccugaucacaugcguuggcggcgagcccugcgcccaggcccugggcagugaaccugaaaucacggguucacugaggugggaggugcugggauucucaaucacaggucagacagagcagcaguguacgucauuucugugauguuuucucugcgucgcuucacccacaagugcuccgaucugacuguagagaaucuuguuucugcaggcagccuagcuggcaacagucuguagacauccaugccuuugcaguucaaaugguuacaacacaagcucuucacagaagcugcauggagagaacgcguccagggugggcugcggcagccaagcuucuagguuacccagcaagcccuggaaaccagagcagcugucuauucagaaagggccuuuaucuuucuuagaacaaaugcaguucaauugcaucccauuuccagucauuccacucuuaaaaccaaaaaggaggggaacaccagcucacugcagcaguucucccuucuuuccuuccuucuguuacgcuuuagggcacagaaugcucuuuagucuuuuaacaaccacagaccuuaagccucguagccgaaguuauuguaucaacuggauacuguuccauaucgcuuuuagacgucuuuguuuugacacacuaacauuuaugccaaauugcagauuauucugcagaaauggaauugcauguuuguguuguauauuuagaaugaacuuuuuuuuuuuuuuuuugcaaaacauguuucuuaguuaucaaagcaguuggaaauguuugcaagacuaugaacauagaauugcugcuuuuauauuuuaacugcagauugugaauuucacugccuuauauuauuuauuucugaaacaaaagaggcauuuuucaauaaaacuacugaaaauuugaccugg

SEQ ID NO: 5216 - RNA, 5019 nt, Mus musculus
aggauagcuucggagguccggaggcuagacgggccgcugcgagaagucgcucuggcucgccuuccgcucucuauggucgggagcgcgagccccuccucuucccggaacgagcccucuugcucgacgcgcgcgcagcgcuaggagggaguuccguuuccggucugguggcuuucgauuuuuggcguucaguagucgcgguugguggguaacaaccgagccaagauguugcggaaucugcugguagguagcuuuggggguuuggcugguacuggagugucggggcggagggucaggcauccugacagaaaggcgugcuggaaauguggcagaagacagcagccggagucaccuuggccgcgcguccuuuucccugaccuuccguccacucgccccuggcuguuucuggguagucguagagggaagagcaggaucgcauuugguucuuggucacuacagcuuaccguugcuuauggcuaugacuguagcucugacguaggcuccaguggggggaucuuggacaccuggaaaaccuagguggaagguggcuuuuuguugucauuuuguuuuguaucauagugaaaagauaaaauuuuaccugauucaaagaaguaagccaaagaacuaaauuguacaguuuuaguugggauuuaauggguuucaugauugaaguguaaugacgauucagaauuaccuuuaacacuuggugaauauuucuccaaaauuuaaaaagguguguuuugauuuuauuuuguaaucguuuaacacaauuaagacuuaacaccaauuacauuuuucuuagauguccaggaguguucuagcaugugcccuccacugcaaaguaauuuuucagugccuuggcuauccuggaacuaaaucuguagacuagcauggccucugccucccuagugcugcgauuaaagucuugagccuccacuacccugccaggaauagauuuuugacauaggcaaauauuaaaugaaaauguuagaacuuauaagaugucuauaucauuuauuuuucuguauaucagcauguuuuguucuauaaaauacuacugauuaauuucaggcacagguuauauauaggucaugguuucugaagacuaugauauguaacaugaagcacagagcagagaauagacaacauguagaaaaucuggaugcuagucuuggauaguacugacaaguucgauaaugcuuuaaaucucagcuuccuuucagugugaaggguuggaaguugccuuuacagguuucuuuggacucuuaggucuuguucgaugcaugugaauuuucuguuucaggcccuucgucagauugcccagaggaccaucagcaccacuucacgaaggcauuuugaaaacaagguuccagagaaacaaaagcuguuucagguacugaaguguucuaugugauuguuaauuguaacagagcuggcacgguagaguaaguccagaggaucugcuucuuagaggcucucaagguuuuuuuuuuuuuuuuuuuuuuuuuuuuaucguaaggaggauuauuugcugugucuaagaggugcucagggaggugggaaaaaugcagaagccagugaauugugugugugauuugaugaauugguaaucuuugggggaauaauugcauaaaccauaaaaaagaguccagaaacaaaaaauaagcaggaauuguuacaggguguagcauaccugcagggaagaguacaguaaauaauuuuaaguggggaaggcuucuaaggaaacaucaaaagacaccccccccccccaggagaacaaccaagaucuaaaaauacacgcuuuauugcugaaggagaagaaacagaugugcagcuuagguaugguugugucacugguacucaaagaauugcagauuuguaagaaauguaugaucucacuauagcugucagggcgcgagaugaagauuucuguggaauguggcaggcauugcaguucugacugacacuuaguuagccuuguauucugcuccugcccuaacuccugcauccuagcuaguggauuggaagcugcagagguuuggagaaugccauuucauggggacagaauaugauuucucuggcuaucgagauggaggaccacugcuggccccaugcacugguggaacagaaguucugccaugugcucuugccuucaaagcuaugaagccccuuucuggacacaaauuuuuuauauaccagcuugaccgugucagugucaccaagagaugguugugacccugucauuaucuuuucgguuuuguagauuuaaggcuauucugcccugacuuuaaauguucuuagaaucaaaaaaacaaacaaacaaaaaaaccaaaacuguagcuucucuggcaguuauuggagcagucuuuucagagcaaacagaaaugagugguaaccucacuccuugccauauaaguagaaauauuuaaaauagaauguuugccagguaugggagaaagauagcaucagucacaggcuuuuuacaagcugagcaguguaugcauuagagacagaaguuuagcugguacuggaaauacuguaaacaagucuauuaguuaagaagccuucucucagauacuuguguagacucugugcaugagcauaaggaacuugaaaaaggauuuuaacccaaccuauaaauuauuggaggguugaguaauguaguucagacauucuuuuuuucccgauagaauauuauguacucauugaagagagaauuaaaacagaguauaaaugucuaacaucauuacauagcacagugccguuuuguauauuaguacauauaagguaaaagaauugguaaauaauaagcauuaacaguagagauguaugccauaacuguuuugggugguaugucuugaagagaggcccugcagauuggaacaguuuuauugugcuguauaauuuuucccuaugcaaaauuucaaguaguaaaguauuauauaugcuacauaaaaacaagauucuuaaguggauauaagaugauagacuaguagccuggcgugguggcucacaccuuuaauucuaguacucaggaggcagaagcaggcgaauuucugaguuugaggccagccuggucuacaaagugaguuccaggacagccagggcuacgcagagaaacccugucucgaaaaacaaaacaaacaaaaaagaugauagacuaguguuauaagucagagcccccggccccauuugguaaggggaaaaaaaucuuccuggagauugacuggccaguaucuuauauuuacauuguugaauucaaggaauauauuuuauugcucugguuuguccucaaaaacaccucauuaggucucaaauuagcuugaaaacgaugcugucuuuuacaaguuuguaaauuuaaaguagugguagagaaaggauaaaaguuguaagccuuuuaaauucugugaguaucuguagcuguuggcuuuauaugaauaauuaauauccugacuuuuaacuggaagcaggugauacauguaucaaugucugguuuuuguuuuuuguuuuuuuuuaaccaggaggauaaugggaugccaguucaucugaaaggcggggcaucugaugcccuccucuacagagccacaauggcucugacgcuuggugguaagacaucuuuugaggguuuacaagucaagaguagcugugacaguuuucuugcuuuugaugugguguguuuauugcagucugucugcacaccaucucuauguagcucagaugagcagucaggagggcagcuaaaacacacugcuugaccuucaaguaggucuggcaaggcagguuugugguuaacagagcuaguuuucuauaugucacuagugcuucucaacacccuuccacacacauaccccaaauauucacacucuaauaggggguuaaaaaagauuguacucuuuauuauauugagggcuuuguuguuauccuuauauugaaggauaucuacacuuuuaaaauagaaaugaugaaaguagacuaauuuaaauauuuuuuagcauuuaucaagacacuuuuauguuugaucaccgauguguaugugugcucccacuagaaaucaaacccacgaacugaacuuaggcauuagaugcaaacagacuaccauugccauauucccagaacuuaggcauuagaugcaaacacucuaccuuugcgggauucccagccauugagcuucacagcaguuuugccuuucacauuugagcuaggcuuuaauugaaauaaauaaguguauguucugaaaccagaaaucuuaguaagccuuuucuugguguguuucucaggcacagccuaugccaucuaucuguuagcuauggcugcauuucccaagaagcagaacuaaugucgucaucccagucuucacgugguucaguuucaucaacgcucgauggaccaggaaucugaugaguaacugagcucuucuuuggggaucaauauuuauugauguguauuaacugcugccaauaaagcaauccuuaaccauuuugugucucccuuuucacuugagaauaaauuccugguaauaccauuuugugucagcaguuggcaaaucuuagauaagaaaaaaauuuaaaaguuguuuguccacaaguuuaucuaaagcaccauugucaugguaauguguauucacuuuuagcagcuagggauauuuagcugucuucuuuaggugucuucaacaccgccugagcuugaccauugagaggauguugcuuugcugucuguccccugccuuaggggccugguugaagugcugggcacugcucaaguggagguggguccugcuggcucacuccauuuucugugcugaaguauugccugaguucugucucagaauuaggguuuauuaggcugcaaaaccaccugagugcuuuuucuacauucagaauggguuuuuaaugauuuuacucuaauccuuaacauaaagcuuaaaauccuuaauuuauaaaaguuaugggggacuuuaggaaaucaaauauuuuuuccuuuugcaagguauauccuggcaaucucugagaagacuggagacua

SEQ ID NO: 5217 - RNA, 3405 nt, Mus musculus
uuuuaauuuuuuaauuguaugaauauuguauucagauguaaaaagaauauugcacaagccuuuuauauuucauugucauuuuuuucauaccccggugagauuuccauaaauaauuugauuuuaaaaguaacagagaaugucuuaacuguaauguaaucacuuauaaagagcugaaaagagggcauuacacucguauaaaagacaagcacauaaaaccaugcgguuucaguguaaaauaauaaacuuauauauuuaauaaagcugaagggaggcaaauucagaaugauaggaaaauagaguauuucuaaaagcuuuccaaaauauauucuugcuuuugacaacucuaaaaccuugaagaauucuaagacugacuuaucacauuauacauuuaauauuuuggauaaaugaauaccuuguacucuuuuguuuaaaaauuagauuaaaaauucaaauuuucacugguaaagugacaaaaucuguuggaugauaaggugacauacccacaaaugacaugagccacaaacaaacaaaagagcagaaaaugcuuuuaucccaccauggcauacauaaacauaccuguccaaaauguaugcaacuauuacauuuuccacaaagaacacaguuauuaguuaugaaauaacuacugaaaacucagaaacaaguacuaauggucauaaacuucuaacuuuuauaauuucuuacaguuauuuuuauucuucuuccucuuugcccucuacuuggucuuuuuaguauuggucuagcagcagagauaggauggccugagccucaggcaccaacucaugaguuuuaaguuucauuuuguacuucugcuauuuuuagauguauggcugaaacaauaccugaacauauucaacuuccaccauauuuuucuucuguuuuccagaaaaucucaacagugguauuggauaaaaccaucacaugccuacuaaaccauuuacucucaccuuaccucugaguuuuacaagcuccaaguuauuuuagcagcaucuauguuguuguuagugcuuaaacuagauauuccacaccgugauuucuuagagguuguuuuaagacucaaugaauuuguuuuauguacaaucugggcaagaauauccugcugauacucucuauccagucucuucaucaagcucaacacuuuaugaacacuugaagaaaggcagaugauaccacagaaaccaagaucaaauaagcaaaaagaguuaucaagaggaaagauguagucauuacugugauucaugcuuguaauucuaacacucgggugacuggggcaggaacaucauaggugugaaccauccuuagcuacauaauguguuugaggacagccugggcuagcuagugaaacccugucucagaaaacacauguagaggcuggggauuguauugcacauuuuuauuuccuaacacucaggaaacagagagacaggaucucugugaguuuuggacaaccagagcuacauaagaagacccugucuuaaaaacaaaacggaacaacugcagaucaaacagaacaauggauugggucaacugugccuugaacuagaaaugcugauugcaguucagaaaauaccuaaauaauuccauccacagauuagucucauccagauugauggagauguauuuacaguaaaagaaucaagguuacacaauguuuccagguuagcgccagaacuaccugugauggcaacuuuuacaacgcaacaagguugcuaagaugugacugugaucuugccuuguuucacaacagucucuuguuucaaauuuaauguguuccuuuuacuuauaugucacucaagaaauuggugaugagguaggcaggaaaaucagcaucuacccagaugacugguuacaacauaaucuucacugucuugacaaauacuaaaguucuuuacaacucaggagggaaagaaacccagaagauccguauccacagcuuagcagucuuguaaguuaaagcaaauaauuaagcuccaguaacuguaccaccuaagucagcagaaaaauacuaaauaaaauaaaagcuguuuugugauugaaaaaucauuauauuuuaacauuuugagaaagcaaaucuuaacccuuuuaaaaaucuuaacacacacacacacacacacacacacacacacacacacacacagagucuagacuucugugucagugaucaaaaccacaaagguuaugugagacuuccacuaucauuaaaguuugggcaagucuaacaugacauuuauuuuacuuuaaacaaaugcaagauuuuuuuuuagaaaauauuuaauuuaugguauguauugaauaugauuugucaguuccacagaauauauuaaaaacccucuagguuacaugaggguuuagcauugugcuuccuauuccagagacucuguaaacgccccucugcagcugauaaggguacagcuuguggacagaggugagccuccagcacauggcuuucgugacuugacuuaccucuuaacauucagaagaugccuuggcucuuuaaucacacuagaguagcaagguaaaugacuucuucauuuagaaaccgagugucagcgcuuauccuuauaguuauguuuaaagaucuuauaagaacuacacucucgucaacgggauuuuuuaaacuagaguuccaaguagacgucauauuuuuacauaaauucaacagcagcucugacaaugaggcgaauagcaaaugguggacuuuuaauucuuuaaaauauaaauauauuuuagcuggguuugguggcacaugccuuuagucuuaacacaugugagaggcacagacaggaucccugggacuucaaggccagccuggucuacaaaaccaguuuuaggcuagcuagagauacauagcaagagccuguaccaagaugacgacugggguggggguggggggaggaagggggaggaggaggaggaagaggaggaggaggggaaggaaaaaggaguaguaguaguuguuuuuucuaccuacaaguuguuuugaaaaaccuaucaaaauuggagugaagugauuauauaccuuugggucucccuacuuuuuuuuuaaguggacauuauuuaggucgguuuuuauuugaaagcuuucacgggggcacuaauaugugggaaauacagggacaucaaagucacuauuauguuuuguacacagaguuaaacaaugcagauagaaauaaaauugacugucagucaaagcuguuuguuucucacucagaacaccaaaggagacaguuacauguugguuuuaaguacuuaaacuccuaagucaggacaguguuuuccguguugggccgcgaucagaaccauagcaccguucaagccguggaacucccaggaucuccuguuccucgguuuuaccuuuuaacguuguccagggaaaucgagugcugu

SEQ ID NO: 5218 - RNA, 2144 nt, Mus musculus
uguagguccacacccuguacuuccucucuuucaucaggguugccauuccugaguuuuugagcuguagguuuuuuucuuuauuuccaucucaucuauucccuccccaccgccccguauuuuguuuuuauuuuugucuuuguaagguuucuggaauaucauugcguuuguugauuuuugaauaggcugcagguaaucaguuguagcauaaacacaugaguaaaacaaguguucuguaagacagcgucucuguucuguccagcugugcuguuaguccuuccuuugcugugccacaugcacgcuucgccuguaacaugcuauaauccgcacuuuucccaccagcucagucacacuccacauagaaagaggaaccacaucagaagggugcacugucuucugcgugcuucuaucacaguccuuuaaaucuguauaugaauuuacaguuucagauuguguucaauuugaccgugccuuguagaauguucaggaacuuuccuggcauagaucaugagaagaaauauuuaaccauggugagggaaaugguagaacacauuuaaguucaauguauagguuacccauaugauaaaaaauggcuucaacauuauuuuaagacgauacugauuuacauauagacaauauguuuuuguggagauauuauugauguauaauucuuucuaauuauauguauuauguugcuguggauuccuuguacccauaguuggcugcaagggucuaaacuuaguuucaucuucaggaaaccauuuagggcuauaccuguugguaaaaaucuuuauaguuuaaccaguaacugaaaugacaccaaagucugguggcauuuuacauugcauggcauuucuauguugaugacugucauguuugauuuacaggaacaagaacuguaucagaaagagggccuggguguuaaugaaguccauuacguggacaaucaggacugcauagguauggguacugguguucugccuuugggaaauaugggggagaugauggccgcacuugcugggaacaccacuguguucagugauuuagacaguuaucggacuugggacuguggcguuggagauggggucuuuuguaguacacccugccaguuauuugucuucacaaggcaucauucucagcuagguugaaggguuuucuaaaagcucugauuauuaugauacauauucuacuacucugaaggcuacuuggugacccauguaaaggggaagcaccaggauucagggaauaagcagauagcugugucgucuguuaggacaaagugcacaguguggugagguuugccagggccucuugguucuguucucuucuguggauggcaauaucucucacugacugcaaguugacuuuagaaguuucacauuaaagcuagauaacaccaugaaacugcagaacagggccucugcuuuucuuugaguuuaucaauaaagaaaugucauccauugcccuccagcucacucuuggucuaacuaacuaauuaauuaaucaaucaauuaauuuguauggauguuuuaucugcaugugugucuccgaaccacauuuaugccuaguguccacagaagucagaagaaggcaucugaucugggacuggaauuacagacaguuguaagcugcugugugggugcugggaaucgaaccccaguccuuuuagcuaucaagccaucucuccaucucccaccuucugucuuucuuuucuugcccaucccaucucuaaaguuaaguguuggguaagucugggaauugaaaguccaauugauaauccagccacaauaaccauauugucuagauuuuugacagugcaguguagaguagcagccugugccaguguagcagccugugucaguguuacagccugugucaguguuacagccugugucaguguuacagccugugucaguguuaaagccugugucaguauagccuuucuaagucuucccuguucuacccugcucugcucagcauccuuuuagccaccacaucucuucucaccucugugaauuggccgugggguugucaaucugccaggaacuucuccccuucuguugauccauuuucccacuucugucuuaugcuaguucagcauguucauugucauucaucaccaacguucagagaagugucacauucug

SEQ ID NO: 5219 - RNA, 2982 nt, Mus musculus
guuucuccgaccaaauuuaaauaaauaaaugaagacugaaggaugccaaaguguuuaaaacuuaagcuguaacacagaguucuccccagagcauagaguauuaauugucaaguucaaguacugccaggcuguauguagaggugucucaggccucagacaacaucuacaagugcuacuggcuuagagggcaacaacauccaugauacaaaacggggcagggauacccauccaucaccaauguuaaaaaguugcaaccuuuugugugaauggcugcuggaggaucugugcugagcccggacuuugaguggaggaagcuaaguuccucggguauggaagcuuuacaguaguuugcguuguucacauuccagagugcucucucagagaagcuaggcuucugccggggccucugaggauccauugcccuugcccagaagagagagccuugcuuccacccaguaacagggaaagaagauuugaccuaccugugaaaagacccaacuugguccccaaaggucgcuuaggcgaccccacugccauugacaagucaaccugcgcacuuaaagcguaucaguuuguggaacgcuuguuugaaguccucauuggacaugguguagaugaugggguugaugagggaguuaagauagccuaaccaauugaagaagucaaaaauggccaugugaaaccagcaggcauccuuacagauaggcaucaccagggagaugaugaagaagggcagccaacacacaauaaaugcuccuaaaaugaucccuagggucuugguggcuuugcgcucccuagcggccaugaguuucuucuuuuccagcagggcgucugagacucgcacuuugacuugguucacguacacaggagacccggacucacugggcacguccggagcccgggaguuaauggaggugaccgaggauguggaucccggggagucuguuaucaacugggcucgggucaagcgcuugccggucuuguugggugucuguuucaaaauccgagagcgggcuuccacauagaugcggccauagagggcgaugaggagcaggguggguaaauagaaagcgcccaccguggaguagaccguguagaggacguggucgguguucacaaagcaguccagcaucuccuccucugcuuuggcuugacgccagaagaaggguggcaacgaaauagagauggagaagacccacaccagcacgaucaugauggccgcccuuuugggaguccuuuuagcagaauacuccaccgcaucggugauggcccaguagcgguccagggcgaugacacagagaugcaugauggaagcagugcaacaggugauauccgacgacagccagaagucgcagaccaccuggccuaguguccagcguccagugaccguguacauggugcugaugggcaucaccaggauggacacgagcaggucagugacugccagagaggcgaucagguaguuagccgggguguguagcuuccggguccgauacaccguagcgauuacaaaggcguuggagagcgugguggccaaggugaugagcgccaacaaagcaaccagcaggacuuuccagggcagggcgauggaguccugguaaauguagccgucggcgcugcaguugugggagagguuggugagagguaccccugucugggaggcggcgggaggcggcggggcgcacugaauacccugcuccuccauagcucuccucguccuggcugcggagcgcagcucuugaacauggagcggaccagggaaagaacagaggacgggaggaucauggagacuauaggcuugucuccuuuggcuagccaguuccgugggcuccucaguaacuccuccgccuguguucucagcccaaaggagaggucacaggcgcggccaccaagccugcgggcgcguccccugcacuuccagugcgccaggcgcugcugccgcgucugcuagcuccucuccacuccccgucuucgcccgggugaauaaagcacuggcccacccaguccagcuucucucagguucccuggaggcaaacaguggagaaggacuaaguaucgcuuguagaggggucucggggucuagugggaccucuuaccccaauugcucaggucucagcuucuccuaacccgggcgcuccggaaucugcagacuccgcccgaaggaguuugcuggcugugcagaccgaagcuugcaggccagugcagaguccugggcuugcauccccaccccaugcccccuacaagcccggagcuccgccacuuucuuuggccgccgccugacuuggggauugugaagucugcgagccagccgcgcggcgccagcagccugggcgccgcacucccucccuuuucacacgcuggccacaccagcgagcugccccguggagacccggccaccagaggggagacucuggggcccgagcugcggcaguucgagccgcccugcagcugucaccaccuccaggguuccagcagcgccgcugggagccaugccgcggggcacaaggggcuggggcaccuggagccgcacaccgggagggggcaggugucugggggagcgggaggaagucggugugcgccagcccgggagcggggugugagccucagagccgguggggcuccuuuuauauuaucuggguccagccugguccggcugugcaacucgugcagugcggcgagagcagacggcggcugcaaagcaccuucccuucugcucuuuccccccucccucccucucucccucccucccucccuccuucuuuuccucccgcccagauccagucccugcuacagaaucucccgcaggguccuaccgcccucucucgcaguuuucuucaccuugucccuucucccgacccugaaacuuggagucgccuuucaagcagggaauggguaaugggacguccuguucuagccucugagagcuuugagucuuugcgcuccgcagucaacccacgucuuuagucgcugccacagacuuag

SEQ ID NO: 5220 - RNA, 1171 nt, Mus musculus
aguccuugaaguuucuuuuuuuuuuuuuuuucuuuuccuguuguauuuugcucaagauacuuccccccaaauuaauugagaaccaugauguugagaccucaaaacagggcgacugagcacagagggacagggaggaaaggacugcaacuugcucccagggacuggagaaaauuaaaaaauaaaaagaaaauaaaaaagaagguuggaauccaucagucuucugugcuaaucauccucgccuucguccuccucuccuuccuccccuucauccucaucgucaucuucuucaccuucauccucaucuccuucuucaucaauaucuuccagccccuccuccucuucgucgucgucaucaucaucuucugccucuccuucuucaucauccaugucgggaaccagguaguacugcaagggauuuggccagaugucaucuuugaugaccucuccuaacucaucagcaccugcgucagaauggucaguaaaccagguaaagaagcucucuggcucuucgugcugccucuuccugcuggccuuauuuugcguuugacuugagcguuuugucaaauccuuuccagauuuccauuugauuucgguggacuuugaagacgggucaccacucucguucagaugaaauucuuuggagagaacuuuauuuucaaaguaaggauuuucaucaaaauaaaaaucuauucuguaaccugauuuaaugucuucaaauucugucacuucaacucuggucaaauaaugcagagccuccucguccuccuccccaagcagugcagacacuuguggaugguugacaaauguuguuacccaaaaauuugggauuuuggcgaucaauucugaccucuucugaaaaaaugguuggcggaguuuguuauauuuuuguucuacuuucaaaauuuccucacuggcuuguucauuaagucugucuauuucauuuuguacuucaucaauauguucaauugcuucuugcuguucuuuuucucccuucggcaggccgggagaggccgacuuguccuccagcuucggggcagcagccggucuggguuucuugggcugaggcaggaucgcagacugccgcuucggggccauggcgcgagggagaugaccgggagacagagcccagugcccugauguucacagcaggaagaaacucacaggaacuccu

SEQ ID NO: 5221 - RNA, 37704 nt, Mus musculus
ggggaaauuucaaacguguuuccggagagggguuggggugcugcuguuugggcugcagcuuggcuuucagaggugggugcaucagagcgggcauggcagagaggcugcggccggcgggaggcugcugggugacgaggguggcggcgagcgagcuggcgcuugagcccccggccaggcgggcggguacggccuguagguccugggcugcuggugggggagcagggcccagaagcgggugcgccgugcgggucaggacugauuguguaacucucaagaccugcccccguggguggcugugagcugggaggagguggggaaccccuugcuccccuccuuugggcccauuuuuauuguuaacacuccgcgguggcucugagcuuuaguuacugcguuguggagaauggcagacagagugacagaaagccugcagacugugggcuauuaaccaacacauucaugcagauaaccggagcgccugggcuccaguacugugacaaguaccucgaugcuugcauuagaaggauaaaagcacaaaucagggcuuugucugggacaaacuucugaaagucgcuuaucuguagaaggaugcagaaugcgcgcaaugucaauauuuacucuggcaggguaggcgaccaaagggacaacuuauugucauuaccaaacggauuccuuacguuccguaggugaaagaaagacauucagugaaaugaaguuuucaaaggcgucagcuggacguggugguguaucuauguacagcuagugcuugggagauguaaggagauaagcugcagaaucagagagagcaaggccauccuaggcuacuuaacacccuuacucaaaacacaaaagcgucaugagagcauuaucuuccagguucacacaguguaaccucaaugcuguuucauacugggaagaauagauguuuuugguucguugaaacuuuguucugguaaauuacaagcuauguccuuguggguuuuguugcucugguuugauuuaguugccacuaacacuuaccucauaacaguuacauuuagauagauauguuuacaaaacuaauguucuaucuuauuuauuccaaagacgaguuacaauuuagaaauggaggcugaagaguuaauuggcagcagugugacgauugauuccaucaugagcaaaaugagagauauuaaaaauaagauaaaugaagacuguacugaugagcuaagcuugucuaaaaucugugccgaucacacgggugaguuuuuucuuugcuuaaaaaagcaaacaaaaaccuaaaaaaaaaaaaaaaaaaaccguugagagccuccgaguugaaggugagcaguguuaaccaccuuguguggccuaaugaaguuguuucuguuuuucucaguaagugaugguuauccguuaaauuguacuucauacuuuaacuucuuuuguuuggaaacauuacaaguguuuuuugcuggagggaaacaggcaggcagauagauacaccaaacuugggaaucugaggcagaaagcucucaaguuuguagccaguguggaaaacauaguaagacccuaucucaaaagcucaaaacaacaaaaaagaauccuucuugagugugcucacagguaguucucucaacucuuuuguuacugccugcuaccuuuguuggcuacuuugccugcugcugugagcgcgcgcguacacacacacacacacacacacacacacacacacacacacacacacaggguuuuugguuuugacuguuuuugccacaaacugaggaagccucaccaaucuuccugaaguuaauuucuuguacucacguauucuuuuuauuuugcgugugaauguuuuaucucuguguguuuauauauguaccacuuucaugcuugcucuccuuggaggucagaagagagcacaggaauuccccuggaacuggagcuauggaugguugugagccaucauguaggcgcugagaauggaaccuggguccucugcaagagcauaaaagugccccacacugcugagaccccucuccaguccucugaaguuauauuuaaucuuaacacggaacacugaagugaaguaucugccuauuagucuuguagcugucuuaccucuguucuggcuacaggucugugagucccaaauagguguucauuuucaccucucuggucuuuguaaacgucucuucauggccuucccugauaaacuuguuugagaaaguuaccuccugagaugggggugugucucccaucuucuuuuccuguauuguuugcacagccccgguucacuuccugcauuuguguaucuguucuugaucuguccaagaaguggaaaugacuagaauguccuuuccaugaggucagcuaccugucuguuauagccagugcuuggguuggcgcccgauaugaaguuguugaauaccgaaugagcgaaaagccccacaguguaacacacuaguuuugucuuucuuaggucucaagugguugaugucauuuaaaugguggauauuugccagcuaaaaacagaugcucuguguuucaucucuuuaaacuggauuaaaaccccacuagcuacaugaaucaggguaaaauugaccaucagugccugaaugcuuaaugaaguuuaauucaaaagcaaaugugcaauaaacccaagguguuucugccugugcuugcccaugcugcauugcucagcugcucaguagccuugguuccaagcacacaguguggguacuuugcgcugugcacagugucccauggcucagugccgguaagccuugcuuagaucugagaugauuguacauuauaaaccgucacaucuuuauuguaggcacagagguucuuucuuucacagaaaugcaguaauuuaaugaugaaaaaaaaaagacuuuuuaaaaagcauuuuccuaccuuuauuccuacguguaucagauuauuuuaucuuuggaauguaauauguuagaaugauugauuuugaaaauuguaggcuugcugacuugaauuucauuaaauauuguuaacuuaauuuauuccugggaugagaauagaauuuccaggcguuucuaaaguugccauacacauauuuccuccauuuguacaaucaccuguacccucagcaucgcugguacuagacucaaaauacugacuaagucugaaggacacuaaagaugcgcugugcccugcaaacuccagauauuucaccaaaaacaaucaacauccaucucauuaguauacgugcuugcuuuuauccuuaauaaauaguaaaauuauauguguaacaacgaauuauuuuaaaauaaguugauuugugauccugucaguaaaaguucaaucuuuuauaccuauuuuauacaccuguaguccugguaguugcuucaaaacuuccucagguaaaaaggucucacaggugggagaacucugguuacuagugggccugguuccuagaggccuccaaaucacaaguggcaagauauauuuuuuagguauuucacaaacuaacuuguuaggaaauuaguagaaauaaaacuggaaaaucaguugguggggugcacaccauugauccuagcacucaggaggcagggccagguggauuucugaguucaaggccagccuggucuacagagugaguucuaggccagccagggaugcauagagaaacccugucucaaaaacaaaaacaacaggaaaaaaaaaaucaaccaaaacaaaacugagaaaacuacauugguaguauccagccagcuuacuuuuagagugagcaauagaaugucaggaaugagcugcucugcgagaaagcaggaaaggugacuuuguuuucuaaaggaguaauagcuucuucaggaaauuagaauuuaaaauaccuuucuaauaaaaguaauuaauaaacuaauaaaagauauccuaaguagggggcugguguucaaauuccuuucuuuuuuuuuuuuuuuaaaagugcacuuauuuagugcugacuaagugaaaauuauguuugcaggacuuagcccacugugugcacauuaagcaaagguagaggguuagcgggucaagaucacacuuagcuaaguauugaguugaaggccacccuggguuacuugacccuguuauaaaaaaguaaaacaaaaucaucugaaguguauucuuuucuguugugguuuugguuuguuuguuugcuuugagacagggucucuauguagccccagcuguccuggcacugccauguagaccaggcugauuucaaagucacagagauucaccugccucuguccccccagugcugggauuaaaggugugcaacaccauaccuagcuugaaguuuauucucgcuuuugcuauguaugauggaauuucacagcaagaaagcugacacccacaagaaacccuguagguuuugaaggcacggauuggugagaccaggaaauuagcaagguauuuaagagaacuguagcuaacuuggaaaaagcacuuggaaagguaacuugucuauuucucaguugugauuuuuuuuuucuccuuauucuuauaacuuagaaacuguuaaccaaauuaugaggguugggaacaccccagagaacugguugaauuucuugcugaaacuagagaaaaacagcucaccucuaaaugacgaucuuuuaaauaagcugauuggucgguauagucaagcgauugaaguacuuccuccagauaaauacggccagaaugagagcuuugcucgaauacaagugagacuugcugaacuaaaagcguaaguauuagugaaccacacauaaccaacuauauauguacuauauuacagagaaacaggguaaaaacagguaauuuauauuuuuuaaacuaguacuuuuauuuuuaagguaaauuuucuuucuguggacauagaucccucagaguuacaguuuggacauuuccaaaaaugguacacaacuuuaaucuaguuuuuuauuuucacauuaaaaaaaaaaaagaauagucuaucucuuuaaaaagagaaguuaucaaguguacuuguuauaaaaccuuuugauuuuauaaacgugagucuaaucuuuuguugcaguauucaagagccugaugaugcccgugacuacuuccagauggccagggaaaacugcaagaaguuugcuuuugugcacguaucuuuugcacaguuugaacugucucaagguaaucugaagaugucacauuuacauuuuaagugcacauucgacuguaacaauauugaaucauagauuugacgugaaauauuaaagcaaaaauauuacaguugaugaggugagagcaugggacaggagugauccauagcguaaguccaggguauucucuggacuguccuuacacucacgcggaaugcucugugggaggaaggacaaacauugaauuuguguccuucacucaggauacaucagaaggaugcuuuuuuucuccuuugauuauuuguagaauaaaauauaagauauuuuagcuggcacugagauaaucuugucuaggcuguggcuucauagugcugaguguguuuaauaaugcuguaacagugagccacuguauuccaauacaccacugcaagggcagucugccuugcucaugccaucuuuugaguuagggccagaacaucuguuuuuuuuuuuuccccugagacacuuuuacccuggcuagcccuuugguugguuuccccgccacuucuccccucccuccauuuuccuggggaucuuuagcuauacccucagaguagccucuggccaagccuuuuauuccucugcuuauuugugcuggcauucugguuucacgcacuaaccaguugagcguugccacugccagcagcgucccucugguaguaagguuugugcagugcaagcugcuccucaggguugagguagggaaaauguugugugacacagacaugguuggagaguccugaguuuaccuaugggauuccuaaauucuaguaauuuaaauauguggucaacuguguacauguaaagcaugcauuucccucccagaaaaauugauucuuucuugcuucuuauggucaggccuuuaugacccuauggcuuuuaaugguaaguguaauuauuaaaucauagaacaaauaaguugagcugacuauaaaaacaacuaaauaccugaacuuuggcaauagccgccagaucaaaauugugauuguuuugagcaggaggauggguagacuaccaggagauaacgcagcuucuugaggcugugcacugacugcugugugcauuuagagggcaagggcaucccagaguuuuuaucagauucacuaauggauuuuugaccugaguuaaaaagaccuccaauugcuggugcuucuuuaagucacuaugcucaguaaacaugggauuuaaucauuaccauauaaucuuuaaaauuuguaaauggugaguagcuagagguugucucauaguaacaucauuuuuaguuuuuaaaguuuuucuuaugggcauguauuggauguugaguauaucuccugcaccucaacucuuucaacccucccuuccccucuuuaaucaucuugguugugauuuuguguuacuguauaaaauauaggaccauaaaagaggagaaaaaaaagauauuuaucuaaguuggcuuacucugcuuaauaugacugucucuaguuguauccauguuccggcaaagaucauaacuuuauucuuuauggcugaaaauaauuucacugugcguauguaccacauuuuugucauccauuucucuguuacaugucuguauuggcuucacaguuuagcuguugcaaguagcuucuucuuuuguguguaugaauauuuugccugcauguauguacuuaaacuauguacauaccuggcacccacauagucagaagcagguauuggccucuggaguugguaaaugguggugagcugccaugugguuguugugaaccaagccuggucgucuacaagaacagcaaaugcucuuaaacaugagccguaucuccagcucuguguauagugcugcaguacacacugaugugaaguaucucugugaugaguugaauuguagucuuuugaccaaauaaauauccaggagagguugaagcaggacaucucuuagaucuguuucugguguuuugagaaaccuugguacugauuuccacagaggcuggacuaauuuacauuuucauuagugaugcauaagaauucccuuuuguccacauuuaugguuuguuuuugauauuuauuuucuaaugagucccauuaugacuggaguaagauggauuuuuuuuuucuuuuucuuuuuuuuuuuuugagacaggguuucucuguauagcccuagcuguccuggaacucacuuuguagaccaggcuggccucgaacucagaaaucagccugccucugccucccgagugcugggauuaaaggcgugcgccaccacacccagcaagauggagucuugauauaguuugauuugcauuuuccuuuggcuagucaaguuaacauuuuucauguauuuauuggccacuuguauucuuccuuuaugacuguguuuuuguuagcuuacuuauugauugauucaguuguuuucuuguugcuuaguuuuugaaguucuuuauauauguuagauacuaggccucuauuagaugcauaacuguccaagaacacccaugucucugcuugauuaacuauuuucauuguuguacagaagcuuucaaaugucacuugccaguuggggucucauuuucugagcauguaggguucuauucagagagucuuuuccugugguuaggucuugaaguguuuccuauaugauguucuuuauacccuaagugccauauacauagcaugauagcccauaacaggauuccauaacuguugcuagcauccuguguacuacaugaugugcacauugaauauuuaccaacuacuggagaucaaguuuguauuugaaaggaaauuugguaaugucugugguugaauaagcuuucuugguaguuuuauauuuuggcagugguauagacuaguuuaacagcagaugguagcccuuuaaucuuuuuuuuaaauccuuuuccuagaagaguuuuuagcaaauuuucagucuugaugacugaauguuacuaugaauaguauguuauaacaaaugcuugcuuuaauaaggagaguacccaagaugcuucugauuccuguaguguguguguguguguguguguguguguguguguaugcacacgcuaauuuauuaaacuucuaaaugguuuucagugaugagcaggaauugguauagaggaguuaacuguaugugugauaagugagaaacuuuauuugcuuaugcaauaaugcgaguaagucugaucuuuccacuagguccuaaugaguaaauaacaagcugagacuagugggcagaggaugcugcgucaauaacaguuaucuuuccucucuuaggcaaucuuaaaaaaagugagcagcuucuucauaaagcuguagagacuggggcggugccgcugcagaugcuggagacggccaugcguaacuuacaccuccagaaaaagcagcugcuuccggaggaggacaagaagagugugucagguggcuguccaagggcacugggcuuugcuggagcgguaaaauucagacugagguuacuuuaaaggaaaaaaaaaguauguagguauaggccuaaaaaccuaaaguuaaguuguagguguauaggagguaagcuguucagaaacaaaaugcuuacugcgcuaaccuuguguugguaacuccuuaaaaaugacucagucaaaguaaagagguagccuuuugcuguuagugagggauagacuuuuacgcugggacaaggcuuuauguguggagaauauuuaaagggacaguuggaaagaaguguauugaugcuagacauugucccgcucccaugucuuuuaaaacauuccuauuugugagauuccucuuuuuuguaaauuuaaucauaguuguaacauuuuuccagcaucgacaguacuaagugcccaagagccguucuccagcucacuuggaaauguacagaaucggagcaucagcugugaguccagaggacaggcuggggcagccaggguuuuauauggguaagaaagugcauucagcucucuacacgauugucuuugguauuuucacacuaguguaauaacuacauguagcaguaaaaugaagauauauuauuaauaguauucucugaagaaaaccacagcagcuuucuuucucuuuagagagaacuugccuccacaagaugccgaagugaggcaucaaaaccccuucaagcagacucacgcagcuaaacgggugagucgcuugaguccuuccaaggaaggugacggcagggaauucuuccugugucccaguugguaacguaaucuuucaaaucguuucuagucaugccccuuuggaagagucccagucaaucuucuaaacagcccagauuucuaugugaagacagauagcucagcugugacacaguuaacaacaagguauguuugaguuuggguuucugaaacuuguuuguauauaaggacuguugucagaauaucuugcuuuuuuuacuaagcaauaguaauaggauugguuaguuuugcuugguaguucuguggacugagccuagggcaaguccucugccacugacguauauccaugucccugucgucacuguaugagaccagauuucacuaauucuccuaggcuagccuuaagcucuguacccuagccguacguacccugccuccugcacuuacagcugcuggugcucgcaggcuuggcauaaguaaauuucuaugguaugagaaguuacuggguuucuuuuugguuugguuuuuugagauuauguucuucugagauggcugguaauccuccugcuucugucucuuugaugcuggaauuacgaauauguaccaccacacccggcuaacguaaauuucugaaugcuaucaggaacaaauugaauagaaggaaaucacuucaguuuucucucauuaagaguauugaagcuacuauuaaguaaggagauauaguggaaaguuaccaagugaacaugauguguagaagcuaugaagagugaaacuugugucauuugagcauuucuuaguaauauauccaguguagugcuuauuauagugugugaggaucuuuauagcagggauggaaggagacgugaaaacaaacucuguuuuaauucacuucaggugcuggccugcucuuagugggaaugaugauucauucauacauuguugcagagcucagggcuccaagaagugggauagaggccgggagcaaagcucuaguagaguauauaccaaacaugugaagugcccugggcucaauccccaagcaccaaaaaaggaaaaaaaaaaaaaacguuaauuggcugccgaaugagguggugcaggguggcugagccaggaaaaucuuuuaaaucaaggguuugcugagaucaccuuggccuuguaguaagcagacucuguaucuuaaauauguguguguguuuauauguguuauguuuauaucugauauauauguauguguguuuauagauaaguucaguaacgaaggaucauucucauccgauauauucccuuacucccaauuuaaaugucuacucccaaauaagaaacagaaaugugcuugaugugguggcauaugcuaauaagauugaaaaacaaauuaguuuaguuggugccuucagaaauugaaguccuguucuauuuaggcuucgaauacauauugaugguuaagaggauauuugcauuuaaguuacguauuccuguucucugggaccuucaugucaaauacuuaguugaagccuacuggagauuuuuauccuacucuuaaaacguauuguuuuaagcccucccaccccucaagguucacugagccgggcucuugaugcuuuuuaugacagacuguaugcugagcuguaaggugcacauggcaguucauugcguguucuuauccuucaucuugugcagccugaaauguaguuucaucugcauacuuuuccuuucccacaugcuuaucuuagcuccagcuguaacuuguuagguaaugaagacacuggcaaucaucuaucucuugaucaguuugucauugcucaguaccuaauuuuuaagcauagucaccuuugcauucgaauuaugucacuuuuaaagugaugcuuccaauccaaaguguauaugaacuaguuauguguauugaauuugaaacaauuugauguuaacuguggaaaucuuucugucucguggacaauagaaaggggucaggaccagaccgagacgcgauucugcccggcuccagaccacguggcagugauuccuaugaacugagagguuuaaagguauugcgacuguaaaugggugugaagcaaagcuuccugcuuuagaacucacugaggcuucuuagagaaaagacauaguguuuaucugucuccaaaguauuggugaagucaccauaaguucgagaccaccacugagagguggcacagauguccuggacucucaaagauuaagguguuagagcaaggacuagaagaaacaugaggcacauuaguugggcauguguuuaaauggguuaguaggcugggaucugagagucagaugggagcugugccccagguuuuguuuguugguuuacagacaggauuuugaccaaguguuuuuaacccagagcaucuguuagugcagaggugggagcauaaguauuaaagcuaaucugcugugccccugccuuugucagcuuuacacaggacaugacuaguuccagauguaggaguuuguagggauucuaauauucuugguauacuuggcuuaaaucccugcauugugugaauuuucaacauuacagccuuucaugaucuaugcuuuaaaauaauuuucucuucuuuuagggaaugcuacuuaauugugucaaaaaauuauaucucaauuuauaauaacuacugccuugagguuauauaaacaccaacuuuuacuaaugcuauuauuuuggugauauaguacagucaggacaggggauuuggcucagugguagagcacaaacuaucauaugugaggcucugagaucaauucccaguacugcaaaauucauaaacauauacuaacuaaaauauagaaucauguaaacaagauacuuauagcuauuacuuaucgucaggcuuauucuauauuggauccaaauuuucuaacacuuucuuuuuugagugaaguauacuguagcaacuaaguaauauuaaaauguccacuuaaagcaaguuugucaaauuaaugguuauaaccuuuccugauguugugaucaguaacuuaggauguuaauauuuucugggaguuugugagucuacaaauacaagagauaguuuugcaagcaaucuuuucacauagauaaaacuguauuauauugaacaguuaagaccaauuaguacuacugcuauuuaucguacauuaucuuauuugaaaucuuucuaugcuuuuuuguauagcccauucaaacuaucuauuugaaagacucuuugguguccaaugaaaagaguucugaacuuaugucugauuuaauagccuugaagaguaaaacagauucaagucuaacaaaauuggaagguacguguucgcguagucaaccugauuaaauucacugggccguugacaaaggaaggauaugaaagucagagggggcuugggaauacaaaggguuucuguggaggaggagggagcgauaagagaagauaaccauggcauggaaaggccucaaguucauucuguauguuugaaacuaucaaagaauaacacacacggacacacuggggagauggcucuguggguaaagugcuugccauuguacgugaggaccccaauucaaaucuaccacauaaagcugaacucgguagucaggucuagaacccccacacuccugugguaagauggcaggggcaggagacucccccgaagcucacaggccuucucuucugaugcacacagccugucuagaacuggugccugagguuuuucucugacuucucauguuuacacaaaugugcauacauaucauacacaauccauauagcuuaagacaacagauaaugaccuaauauugauauaaaaucuuccuuuguuuuccauuuuacuuuuuuuacggaaugagugaaaaguauugacuccuauaggagaggaagccacuuuccaaaagggcacauaaaaagacgagggacaauaagugggacugaguuacuuuucuuaguugguuugacagcuauugucacugaagaacaaaaaaguaauuuuuauaucacaguccacucucauuuucauuuuaaaucaaauguugguuuuucacuauauagguacuauaauaaauguucuaggaauccaauaauuuuaggaacagggucccaagauugcaaaucacuucuggguuguacauagaauagauaagaccuaaugugggauacaguguaaggauuguuaagagagauacaagcaacaugcucugagaauuuaggagaaggagaauuuuacgaaccucauuuggauuagaaaaaguauggaaaaacauuugaaagagaagaaauuugaaaacccuaggcuucagcuggagggaauagcuuaggcuaaagaauaaaugcuaagccaggauguuccgaggggcuggaaggcagcugcugcaccagugggaagugagugacagugagugacaugccuacacuuccuauuguuguagaccugaaaguaagcaugcuuucaggggagcgcuggggugugcgccucugucugaggagacuggggagccaaggaggcuggcucugauguuuaucugcugcuuccaggauucuaccccgggaagcccggugccugggaaagcccauggcucaagcagugcuucuuccguagaagucuccagccuuucccuugacacugauggcgaacagauuccuaaucuugguacuuuuggaagcugcuuuucaugucuucuugucaucuuuugauaucauuaggaaaagucaccuuuaucaaauauuaauguuugucaccuguuaaaauagcuaauuugaugaaauagaauucugaauuucuguggauucugacuuccuacucuuugccuuuauacuuucugcuauuuuagacaagguuuaugggaguacccuaaacauauuuacagauuguagggaaccauuuuuuaucuucauuuuuagguucaauuuugcuugaacuugguaugaacacaaauauauaauaagauaaggugucaagacuuugaacugccauaaagauucuagguucuauguaucaguuuucauucauuggaaaauugaaguuggguugggaagcaguugagccuauaaagacauccgagacaaacugucaucuucagccuuccagcccacuaacuuggcauguguucagucacuuacuagaccaagaauccuguucucuagagcucuuguguauguugugguagaucuaguuaaggauagcuaauauuuuugcuguugugauaaugaaggguacccuuugcuguauauaauuuuacucuucaacuuuauugcuaguauauaaauuugauuuauuuauuuauuuuacuuagauauauugacauugcuaaauucagugaacaauucuaaugauuucuuuauucuuuaggccuauuuugugugugugaugguuuuguuuauucuuuuuagagacaaggucuaauuucagacugccuucaaacucaaaaguucuccugccucagccuguuaagggcuggaauuacaggcauguucuacagugcccaauuugugaguguuguuaggccacaaucauguuuggaaauaguauguccuuauucuuaaggauccuuuccauuucguuguugugcagcuucuaagaggucacgguuaggauuucuaagagugaugggaggcgaacuugaugccucacaauuuuaaggugacauuuuuauuauccuaacucuuggaaugauagcugauuuuuauuacuuuuuuuuuaaaucuaauucuguaauguuucuuuuuggccuagauuauucauauuuuuuguauaccugugugguugguugagcauugaauuuuaugagaaguccuuuuguugcugagcuacucauguuucuuucuuuuuuuuuaaauuuucuuuguuugcauuucaaauguuauccccuuuccuaguuuccccuccaaaaauccccccccuucccccccccccccccccccgcuccccaacccacccacuccugcuuccuggcccuggcauucccccacacuagggcauagagccuucacaggaccaagggccuuuccucccauugaugaccaacuaggccauccucugcuacauuugcagcuggagccaugagucucucuguguguuuucuuugguuggugguuuagucccagggagcucuggggguacugguuaguucauaguuguuccuccuauggggcugcaaaccccuagcaacgugcacugauuuuucagauguuuagcagacagcauuuaggggugaaucauauuuggauguaauuuauuaggucuuuuaucaguuaauauuuuuuauuuauuaaaaaccagaucuacuucagucuagaauggucucuagugaaacuuuuuaaacuauuuaggaaaguuagugucuugcauuuuguaagccugacuucuuccuuccucgacuuuuuaauaacuuauguuauuuucagaguaaaaaugaagcauaguuuauacaacauuccuguugcuuaagcguacuugucuaugugagguuuaguuuguuuugaggugaggucuugcuauacugcccaagcugguuucagaauccuugguucaagugauccuauccuaccuuugagacuauagauggaugccacaccuguucuuaauuauuaucaucgucaaauguuaauuuuuaaugauuacaaaauuucagaaacuaagccagagauugcagaaagaaggcccaugcaguggcagucuaccagaaagcccgaguguguguuccagaacccugcugccuuugcaccccugcggcacguuccagaugucaccccgaaggcugacaaagaggugaugcucuguucacuuaaacuacauuacugucuuuaguaacaugugucucagguuugauguguguguuggguauuucauuuugaagugcugaggcgaugagagauuagugugguaguugauuuacaagauuucuuucuuucuuuuuuuuuuuuuuuucccagaauaccgugaucaguaguagcuguaggaugcuaagagcacaugucaggauaaauucuguuucaucaguacuuauagacugccauaguuuugggguuuuuugucuuuuuugucuuauguguggguaugugccugugcauguaggcgccuauggaggccagaggcguugggcuucuagagcuacaguuacagugguugagagcugcccaguauggaggaugggcaucaaacucaaaucaccugcaagaguaauacaguuuuguuuuguuuuuuaacccgugagcucuuucucuagcccuacaauagauuuauaguuuagagaacugaauacauauauccauaauacuaauuuggaaaggaauauuauucauaguagaauguuuguaacuguggcaaaaguaauaucuauauuaugugguacaucuuuguaaugaagucuuacuaaucaaagaaauuuugguacacacuccaaccuaaaugagccuuaaaauuguuaaguauaacaacuguaucgcacagccaggcagugguggcgcaugccuuuaaucccagcacucgggaggcaaaggcaggcggauuucagaguucaaggccagccuggucuauggagugaguuccaggacagccagggcuacacagagaaacccugucucaaaaaaccaaaaaaaaaaaaaaaacccauaucacaggaggccacugguucuaugagcuaaugugagaugcucugaauagacaaaaccauagaaauaaaaguuauguucauaguugguggaaauagauaauauaagaaacgaggagcgaguuacagguaugggguuuuuugcuuggggauugaaaauauucuaaauucaguaaauaaacugaaaacuugaaaaguauccuuagacacagcaaggaaggagagccaguuucuugugacccugcugacugaguagccuucuuaaagggaguucauuuugucacacgccucacuuuacagcugugaguuccccauuucuguguuaggcugcuucuuccucacuucugacaaaguccuacucuugggucucugcccucucagugccgccaugcucuuacuuacugcggucauagaugaaaauccuggugacuccacauuguuccuuaaaaaauacucugggccagacaugguggugcacaccuugggagguggaggcaggcugaucaaacucagguucucaaauguauuuaacaaaacaagacccagcaucuuccuuguaucagaaccaucauguguuaaauuuuuauaaaauguucaggaguuugcaaugugcuaucuacggagaugcacuucagucuggggacaguuugaguagacuuuguuagcacuaaguauggaauaaaagaacagugccaaaauuuaacugaauguugggcuggggaagaaagcuuaguaaaaugcugcacaagcgugaggaccugaguuugauaaugagcaucaguguaaaaagcaggguuaggggcaugugcuuguaaucuuaaccaagaacagggggauagaggccguagauccguagggcucacuguucugccagcccaaccuagcauaaucuaugaugcucagguccaacauagggacuuucucaaaacacaauacccuaaguugaccucugggcucuacccuuacaugugcacaugugaauggauacgggugugcacacauacaaacacacacaguuuuagucugcuuuucuggugcuuuaaauaugcuuggcucauguuacucuuaagagguguggccugguuggaguggguguggcuuuauuggaggaagugugucacuguuagggugggcuuugagguccuaugcucaagcuccacccaaugugaaagagaccuuccuccggcugccugcagaagggaaucuccuuguugguuuugguucaagauguagacucuugacuccuccagcaccaagucugccugcaugaugccacacuucccaccaugacgauaauggacucaaccucugaaacuguaacugcagccccaccuaaauguucuuuauaagagucauggugccucuucacagcaauggaaacccaaacuaggacagcuuugcuuuucauauuuuauuauuucaaagguuauauuuguuaaacugguaaugucuaguucucuaagucauggaauuuuaaauuuucuuuuagcagaaguguaccgcuguugaguaacuugccuuuucuguuucaaagcagucaccaccaauaucaguuccuaaauggcuugauccaaagucugcuugugagacaccuaguagcagcuccuuggaugauuacaugaaaugguaauuaccuuuugcccugagcucagaaugcaaggugguaaauagaaaugagauaagcuuccagaccaagcugcauuggguugaaccuaaucucuuauuuaaugucuuggaaauuacuuucuuucucagcaucaguuuuuggcaucuggaaaguccaaaggggaaagcaaauuaugauuacaucuguauuaucuucauguguaauucuguuuuuaagaacuguuguaaaaguacucugucauauuauacucuuauagcuuggaaaucuaaguaugcaguuuaucucuugcuuguuaacgugugugucucugauugagaaacauuuuaaaggaaauuuagcauucuuagaauggaacaggauagauagauauuuccauguaugaagugguaauuggaaugguggccucugaguaagaucagauguauaauucacauaguuuggaaaguauucaaagauacagcaauaaggacaggaaugagaggugugugaagaaaguggaugaucagugcugauaaaaaggaaacauaaaagauauugcaaaagaaaaugagugauauuucaaagaaaagaauauauaauaaccuucaaccauuggcucuauuuuuaauguuuuaagggauaacauaacuccaugaugccuuuggcuuuuuauuuugagaaugucauuuuuuacccuaauuaaaacuauccuauuuauaaccagugucuuaucuacuuaaugcaauguuauuauuucgucaucuuauuacauguaguuauuucaaagaaugauugcuagcuaaauuaauaaugcauuucuuaagauauuuauguguguguucuguauacugacuuauauaugcagaugcaugugccugcagaccagaggggucuguuacuguccaccugauucccuuuagacagaaucucucacagaaucuugagcuagacuuggcagcuagcaaaccuuaguagugcuugggccucugacugcaccagguuacaggccugcacauagccaugccuacguuuuacauggguguugggcauucugacuccagucuuuaugcuugcgcaauaggugcucuuacccacagagcagucuuucuagccccagauuaaaguuuuuguuguuguuauuguugguuuuuuuucauuuuguuuuguuuuugccaacuacugcuaacaauguugaagauacauuagcaaucaaaggaaacaaaguaugaaugugugcugagcagacacaaacuggaagaucaaacuccucugcugacaugauuggcucuuaguuauuucuagcagacugccauagaacauuauuguuuaaaaacaauucuaaaaaucuguggucaguuauaagcugaccuuuguuuuggcuaaacuguuauaaaauuccccuuacuccauacuuuuaauuucaucuuauuuuauuaacaaggauuucuuguuuggagacaaaaaaugauuucacaacaauuuuccccaaauuaaccaccuggucaugauacgagucaaacacauaaauaucagcucuuaaaaguuaaugugggaguuuuagaucuaugugaucuuuuuacagugcaugaagacuuacaauuugccuuaauuuuuaaauauauuaaagaaaauuaaaaucuuuucuaguuuuaagacuccaguuguaaagaaugacuuuccaccugccuguccaucaucaacaccuuacagccagcuugcccgccuccagcagcaacagcagcagggacucagcacuccucuucaaagcuugcagguucgaugcaugugcuucaugguaccguaguuaaggugcagucgguuucauagauuuugcuuucacaguaucaaguugucagggaaggucuucagcagcugucccuuagggaagcuaagggacauuuugauaagggcgugucuuccaugugcucucagugaguaggcucaagaguccaguuugaauaguuuaauacgucucuuauccugaagcuuacuuucuccuugugagcagcgccauuuccuuuguuaauucauuuggaaaaguggaucuucuggguagaggagcaguaugagguacucagaguguauuaucauuucuguaaaccaacaaacauuuugcuaacaugugaauuaccauuugacaaaauccuaggcaccagcugacugaaaucauuguauaacagucuugaacacagugugaacaugggucugucuggugggcagaccucauggacauggacauaauuccuggcuucacucucagcagcugugugaucuuuggcaaguuacaagaacucuuuguacccauuucaucaugcuuaaaauggagaaauaacacuaccaacugcuagaauccuugugaagguuauguuaguuauaucuguaacucuuaaagcagagcaugacacuuaaaaguugauaaauguuaagugcuguuguuauuuaaaugaaauaacaaaagaacgaucaccuguuaagaccaggugaugaacaauaauuggcagaaagugaaagaguagucacauaaccugggagggaggaacuaggggguuguuacugugaaaugguauagaguuucaguauuugauggcaaagcauacugaagauggaccguggugaugauuccacagugaccaguguaccuaauaacacagaacuguacuugaaaaugcuuaaaaaagcuaagucuggguuauguauauuuugccauuauauaaaaagaugagcaaaagauuaccugacaauaguuuaugugaugcuaacuuugcaggcuuggaauuauauaagaagguacaaagugaaaggaaaaagcccggcaugguagcacacagcccuugggagacaggcaggaggagacccuuucuccaaagggagagaguaauguugguucaagaucuguuuauuggccuuuuagugcuaauagguccuguucugguuaaaaucuagaaggcaauacagaagugacuggaaaggggacuuaaaaugcucuggaggaggccacugucaggagagacuucaaaaguagucagguguggccuagagcuggggaggggucagugcucaagacgucacugggcuuucggaaguucugugugggauagagaagcauaguaaaaugaucuaauuaauuaguaguuuggaaggcccuggugaggagguggauggggugaggagucucguggagggaacuaaugccacacugguauggaaguagaauucccuggugauacuguguucugaaaaguggucacagcagggguaaggaugucaaagggauuauuccccaagaaaugcuguuuaaggaagaacaaagagaacacaugguugacaacucugacuuaggucaacucucaaggauaaggacuuuagaauccaucugucuguuucuauagaagauuacaugaaagauucugucauuuuggauucaaaacaugacucaguuaaagugaaguuuauucagauuuugauugaauuuaguuaacuagcuaaucaaagccucuucauuucagcuuuacuaucugaaauaaggccguuuagcauaccauuucuuuuaaagucuauaaacaaggcaagaccauccagcuauaagaaggaagagaaggacaacugaugcucaccagguugaugggggcaguggacuucucugagggcagaagugaaggacaggcaaugaugaaauaugcauugucuaacugaccagagcucacugugccucggcacagugcucuuauguaauguuaaauggggguggggguaaagaaaugacaguggauguggaggugggaguaaagagaugcaaggaagacagauagaaagaaagaugaaauggguaacucaugaguuugcccauugaauacuaagugacauucuuaaauuuucuacucagaugaaguaaaaaucaguucaucaggagaccuuugagaaauuugucucugaauuuagcuaacauauuucucuuacuccucauuuauguuuuguugguggugguuuuuguuuguugguugguugguuuguuggauuuuuuguuuaguugguuuuuuuuuuuuuuuuggagaaucuuuuguauccuagcuggccaaaauugggaguguuucaccauaccuaauguaaacuaguuuguuagccauguuguuugaacuuauauuuacauaucuuaauuguuuagauuucagguucuucaucaauaaaugaaugcauuucaguuaacggaagaauuuauuccauauuaaagcagauaggcaguggagguuccaguaaggugaguaucaaaugaauagauauccugccuuuuagaguaggggggcucuuuuaucuucuagaagcccauguugcccuggagccagaaaagcugccucauauccucccuuccuuccccuaaagucacuuaccuuccauagacugaccacuggcucucagcuaaugcccuccuccuguguccucugcuuucagaucccuucugggucacguuaacaugguuuucagugccuuaguagccacuguauugucacagagagacugagaaaagugaacugaggacauagcaugauguuagauauuaagcagcauuauggccuuccuuuucccuauagauuaauuucauuuuucucuauagcugaaugaaaucacauuauagauacauauuuuccauuauccacucaucuguugaggaacauuuagggugguuucauuucuuguuguugugaauagaauggcaaaaaauguggauguccacgugucuguguuguaguaugaguccuacgaaugauauagcugggccaucuuaagaaagcuccauucugacuuucauaauggccguaccaguuuacagcagcugugaauaaggguucaucuuucaccacauccucaccagcaguguuguccaauuuuuuugauaauaucuauucugacuggguugagguaguaugucagaguagcuuauguauuucuuggggcuuugaucacacaugaaaauagccuuuggccauuuguauuucuuugaaauuuuuucuuuacuuuuuuauuuuguacauaaugagcuuuugccugucuguaugccucugccagccuacacuuggcugaaacuagaguuacagacaguuguuaaccaccaugugggugcuaggaauuggcccugaauccucugaaagagcaguguucuaggcugagcccugcagcccucuuucuucuuuugagaacugucuauuucauuagccuguuugucgauuagaaguuuugucuuaucuuauuuugcauuucucuauacuuccgacuaugagugcccucuuugaaguauagguagcuaauauuucccacucauucuguugucuguuuauaguuucuuuugcucaccgggaccuuuugauuucauguagucccauguauugaucuguggggcuauuuccuaugcuuuggcucagaaagugcuugccuauaccucuaucuuaaaguauauuccauuuuuuuccucuggcaaauucaguguuuuaaguuuuaaauuaaggucuuuguucuacauugaauugccuuuguacaggaugagagaaaggcucaccccaaugcuagcuguuagguggguuguccugucuuuguacugcaugcuuuugagaucuuugucagauacgagagagcacuggauuuguuguuuuguuucucggucuucguucuguuccuuuggucugucuguuuuuaugucaguaccuggcugucuucaucauuauguccuucuagucaaguuugacuaauguaaacucaaauauuguaauaucuccaaagguauucucucuuucuuaggauugcucuguuauuccauaugaauucccaugggguuugcuuguuuguuuuccuaguacugugaggaauguccuuggaauuuugauggauaucuuaaaucuguaaacuaauuuugguggucuggccauuuucaugauacuaaccuugacuaugacaugucguggagcauccucuaugccucuucuguuuggauaucuacuucuuucuccagcuuuggaacauuuccugcuauaauuuuauuuguccauuuuccaauuuagcacauaucuuuuuauuuuuuuccuauucuaugaauucuuggguuuggcuucuugaauguaucccagaauuuuuggacguauugccugugugcauuaaauguauuuucuuuauguauguggaguauguuguggucuuagcuuuguuuuccaucccuaaaacuuguucuucugccuagucuuguuuaguaaugaugcuuuuuggcguacuuuuucauuugacugaccauucauucccauccuuuauuugguuucuuuuuauucagcacauggugauuuuuuucuuccaugauuuuuacuuucuccuccaauuuaccauuuuguucacuuuggcgauugucuucuuggggucuuggauugaguuccuuaguccugcauacauuuguuugagucuuuuaucuguucauuaauucauuuuaaaaguagggcuuugaauuguuuuucuucugggacugcuuggagcccugauuucaguucuuauuccuugacugaggaggagagcauuaugagagcuaucucugaaccacacuugucaccucucuccagucacuucugccuguguugcuaacccacagagcuacccuccaagucguucaggcuuccagagguuuguuaaaugugguucugugcuuugacuuuuuguuucuuaguagacaacugguuuguuuuacuguaguucucauugaugaccacacacagacacaugcacacuugccuuauucucucacacucagacuuucuccaucuuccuggugucccuggugucagguaccuugccuuaggacucuggauuugaccgcuaacucaagccuuccuuugcuguucucccaguguuguggagugaaugcuguuaaaugguuaaaguuucugaacugguguuuccaguucaacccucugguuuccaaaccaacuuuccaaacuugagugcucagcgucucucuugguuagcagguguuuaaggcaauguguaagcgcgugcucccuguccaguugcaguguauagcaacuucgcucuuacaguuccuuggcuauaaaccuacugacugcuuguuuucauacauacauucaggcaacaagacuugcuguuacuaccuuucgagcaguuucaaaauccuuuuuuuuuuuuaauuaaugucacuuuaucugaagcagcuauuaucuuaccugguuuaugacaauaaauaauaagcucacucagccauuguacuucugucuaguuuguaucuuucccucuucacuccuuuccucccucccuuccuuccauaguguuuugcuuuauaacucggcuggccuugaauuugcagcaguuucccugccucacagccucucaaaugcugggguuacagguuguauccccaucccaucucucuccagauagcuuugcuaaaguacacccaaaaacugcagugccuacccucuagucaccagaguucucuuuucucccaucuucacuguaguguguucucucucucucucucucucucccccccccucccccuccccucccccuccccuccccccucuccuccucucuccccuccccuccccuccccuccucucuccccuccucucccuuccccuccccuccucuccuuuccccuccccuccucucccucucuuucucucucugucucccccccccccucgaaggccucaaccucacagagaucuuucugcuucugccucucuccugagugcugagauuaaaggugugugcagccaugccuagcuguguguggcuuuccuguuaccacauucuguggauagcuuaucuguuguuugugccccaccuuguacuuaauaucaagaugagauguuuggcuguucggugauacuagcucuggugacuaaaacugaauaggaccuuuauuccuuugcugaguguuccuccuuggcuaucaggcuguuuuauguuauggugauacaugaacagagauaaagggcuuauuuuaaguuuuacuguaauucucuaagccagcuagcuguaauuagacuugcuucuggcuauuuuauuaacuuauagcaaguaauuggaaagcaucccaucagacccauuuguauaauuccugcacacaguacgcugaggcgggaugauugccugggcuacauacaugcacuguauaggcugcugcuauggcuuuggugcagggcccuggcuuuaaucucuuaacauaaaaaccauaagcaaaagacaaaauagguaggaguguauauuuccacauggagcaugucuucccauaaauauuuuccuuuucacgcuccccuuauuagauuuucaguuaugagcauaaggaagaaggugggguaagagugauugaacaagagugacagggaagaggauucgugcaggggagggaagugcaugcauguucuaggcacugagugaugggugugcuggaagcuguaaacugcgugggggccucuuccucagugcuuuaagaaauugauucauaggaacaucauugcuccugccaaccuaacucaacugugacuugcgcugcuuuccacaaaugaauguagugauggcuuacaauuacugugauuuuuaaaaauauucccuaucagagaaaugaauugguugauaguaggcacaaugaaaaggugggaguugguggggagaggggucuaggaagugaacugucaaaucacagccuuagucauccuuaucgucuucgaaugucuuuuccuugauguuuucucccuggauaagaaaggcaucccuagaauuuuguggauauagcaacaucauauuuaaguugguuuucuuagacacugauguagaaaaccuuugaauuauuugaauguccauuguuauaggggcuggaaauggauacuuagcuucucauguugguauuucuuuaggaauauccucagccugagacuguuaguguuaaauggaaagguacugcuccaguuuucagagggagacauguccuaagcucuuucuccacuuuuuauguagguguuucagguauugaaugagaaaaaacagauaaacgcuaucaaauaugugaaccuagaagacgccgauagccaaacuauugagagcuaccgcaacgagauagcguuuuugaacaaacuacagcaacacagugauaagaucauccgccucuaugauuaguaugaauucauuuuuauuuuaaaaauaaaaguuuguucuugccauaauucuuaggcaaagaguaaauccuuaaugacauaaugugggcauuuauuguuuuguugugucuguuuaucuuuaauugcagugaaaucaccgagcaguacaucuacaugguaauggaauguggaaacauugaccuaaauaguuggcuuaaaaagaaaaaauccaucaauccaugggaacgcaagagcuacuggaaaaacauguuggaggcaguacacauaauccaucagcaugguauuuucauaucucuucauacacguaaaguuaaaauaguuguuaauugugccauuuuagaaacauacccuuaacuggaaguucauuagaggugaaggcacucuuaagagugguuauacacaggcuacagaacacaaacaagcacaggauguagaacagaaauggccacauguacaauguaaacuuacccuccucugguaccuggggauuccuaucuucaaguccugaggauuuggacauccuacagauaggaggagaauggccaguuuuucagucuccaaaggauuuucucuuuggagcccggugugagaguuggucuguucuugcuguuuucuguuucauuauuuguuuguucuuguucucuccaguuuccucugccuuucccuugucuuuuaaacagauguguucaaucucaugcgcuuccucugcuucuccuuuuagaagcaguaacuaagcagaggauaggacucuuugggggugagggaggccuugcgaucuuauugucugacaguucuugguggugcuuuccuggccugugcauggcagugugcagcacacacugacaggcuaggccuggaauccugaacaguucacuucaacucaaaucacauugaguguccucacccugaaaaugaugaugauaaugggacuuauuugcuaugcauugcuauagaaugguaccuggcccacaacauuugcuaagaaaguguagaauguauaauaacuaaauauuaauguguugccuaauugaaaggauaagccugaccuaaagauuaugaaaugcuuuuuuguccccuggccauagaauguuuuucuucauauaacagacggauuuuauuuugaagguauuguucauagugaucugaagccugcuaacuuugugauaguggauggaaugcuaaagcuaauugauuuugggauugcaaaccaaaugcagccagacacaacaagcauuguuaaagauucucagguaggaguuuugcugucuugguuguauuuuaguguuuugaaccaggguuuugcaucaggguuuugcauaaccuagaaugcucuugacuuugaucaguggccuucagcuccugauccugcugccugugcaucccaggugugggcuuauaggugucagccccgacacccgacuucagguaggauuuuaaugauggcugguuacuacaaggcuuaguucauuuuuaucuguuaaauauguugccaauauuauauuuuuaccaaccauguuauuccaaaaauuugaagucuuuuuaaagaauagaaacuauguuuauaaaagaccauggucaaagccauggucaauuugauuuauaaaagcaguucaagaucagacaaguauauuuaugaauuuuggaugauuuucucauagcugaggcagggcagagaguaauugcaccuucauguucuccacuguccuguuucuuuuucuuacugcuuaaauuugggagaaaguuuuaagagagccuuauugggaauacugaagcguuccacucagcuacgcguuaaaaaggaaauauuuuacuuacuguuuggggggcggugugcggauuccagauguaagugugccauuguggagguguggggauggcuucgguaaaccacuucucuccuacugugggcccugggagccaaagucagauugugugugcagcaagcucuacagcccagcugugcuuuguaguaacauuugcugugguaaaucucaugaagcugaaguagugaggggaaaacagagcugaaaggugaugucgacugcaccucgcaggcuguguccagggauggagauaaaucagaagauaaauuaccaugcacguagaaagucauucuucuugacagccauucauuguuuuuuguuucagaaguacagaugaugaacagugaguguagaugagacugaaguuuucuauggcaaggucuuagcaggccgacauuuuguuaccuuagaacuaaaggauuuugcguauuaucuccaugcccagcuagagaagcucuucucugauauagguuuccaacccaucuugaucugcacauggagccgaagaauauugggagauaaagcuagcugguuccuuuuauucauguauuaauuuguugcuugguuuauugagggaagaauauguugaauuuauuggaacaugaaagugaaugaaaggccaaguucagaauccgccuacgcaguuguaaagacuuaguacuuaguacuuaguacuuagcacuagcucuccagcacagcugcagacagcacagugcucccugugcuccagacggagcccguucauucucagcccagcucaucugauuguaccugggaugggauaguacauacauucuuauauuguuagcaguuauuugaauuuuucaagucugucauuuaaaucauuaguuauucaaauuuccaagaaucugacauuuacauauuuacaaaucuagaaagauauucucauugauuucuuugugauuugcaaauagguuggcacaguuaacuauauggccccagaagcaaucagagacaugucuucuucaagagaaaauucgaaaaucaggaccaagguaccgggaagagcgcuccccuggcaccagugagcuccugugaauugucaugggguucugucaccauucuuuuaccuuguuuucucuuuauucuauuauuuuaugugugcauggauguuauuuuagucucagcgagugcugcuugcuucccugaugucccuuaucaggggcccaguuucuuuucgggguguggggugugucaagcucccaggcuaaucuuucuuucacugcugcaguguuugaaagcucacagaggacuggguuccagcagccuucaugucaugcauaacccuacuucuuaagcagugaggaaccugugugucuccccucugaggcggacuuguugaauaauguguauuuuagaagaaaacaaggaguaacagagaaaggaaucucucagcucagcaugcagcucacugaugaacaacuucacuuuuuuuucccuagaaacugcgguuucuggcaguuuuucaaauaacuuacauuaauauuuguguggcguuguccauaucuaugucugucugaguguguaugauguguguauuuguguguacacauuuauguucucaguggcgcagucuuuguguugcuguuugcugcuguguaugcuaggcuuggggcuuuccucugccuucucccacugucuuuuccuggguugccaugucugacuuuacccugguuucugaggauucagucggguccucacacuucauggcaagugcuuuacccaccgaaccaucuccccggcccagugugcauaaagccuugcagaguaguuuaucuuagaaagcuguuuucauaauugucuuuuucugauuuauacuugcugccuuuugguuagguuuucuuuagacuuaagguuuuguugaacuuaaaaacagauguuuauuucauucacaaauucuauuucccuuugcuuucaguuuauacuuuuguguuuguuagguauuaguuuucauguauacucugguuuuuguuguuguugagaggaucuaacuuuggagccuuggcugaccugggacuuguugcaguucuugugccuugagucaccacugacaguaccagaacugaaccuggggcacuuguguuugccucuugagcugucucccuuuaugugcccugguuacuuuuucucccaucuuaaacucaauuauaauugauuuuaguggauguggugguggcugccugcucuggcuuccggaagugaagcuggagggucaagaguucagugacuccaauugcuuaauacagccuugcuuuuuaaaagauaacauuuuuacugagucuuccacuaguaguuacagguuuuaugauaguauuuuuuuaaugccuauuaauugcuaaguuuuguaauuucauuuuauuguuuguuugguuuuuuguccuuuuuuuuuuuuuuuuuuuacuuuuaaggucuugaaucauacguagagauuagagauuauaauuuuuucaguuuucaacucagugauuuaauaugcaaugacaaacuuccccucccuauucuuccccuccuuccuucuuccuccuuccuccuuccuccuucccccuucucauuuuuugagacauagucucauuaucccuugccuuagcuuucaaaugcugggaucucagaugugugcuacaauaccuggcucaguuuucaaugguacauaacauuucaaaaauucaucccugaagcucaagagauggcucaguggucaagagcaacuuuugcucuugcagaggacucaaauucaguucccagcacucaaguuggguagcucacaacugcauguguauccaguucagggaaucuagugcccucuucuggggcaacuguguacaugugcacacccaugcacacauacauucccuccaucccccuuuuuuuuuauaguuuacucuuuuucuuaguugguaacauuguuuaucacaguacaaauaauuuucucuucugucuuauguuuuguucucuuuuuguaauauugagcaguaguuuguucuuccuuugguuuaaauaaauaaauaaauaaauaaaggucaggcuuuuguguguccauuucuuuuucuaacccccaacuuuuucuucacuaacuuucuaugacaguugguuuagcuuuucucuuugaggaaaauaucuguuucuguuuguuuuuccuucucugucuuccuguugcugugauuacuccugauguggcuuuaacccaguuaacauuggacaacguuggauucaggggaagugagugaucuguauuggugcuuacucaaacuccuguggacugaagagauggcucagcagcugggaguauuugcuguaguuucacauaaauaaacaaauacauaaccuacaaagaaaaauaagcucuucucucugguuaucuguaacuaauuccauuuaauacccauaacaauauuccguguuuuguuuuugcuuuggagucgggguuuagagucgggguuuggugugugcugggcaagugguucugguucuguaguuugugcucuagagagugggguuguacaauuuaagcaaccuuugaaaaauauagacauguuaugaauucagauacaaagguauugcaaccuaaucauucugggacaaacaaguaaauucagauuuguggauauguuauuucaguauuguguuuucacuggaugccaggaauuuaauacuuuauuuccuauaaaauaauuugagguuuucaaggguuucaaguucuucucuauaaagggaucaaauguaaugaaaauugggaaaagauguuuugucauguaagcauaaucuuauacuuuuauaucuauugagguuuucauuauuauuauauaguuaggguuacagucauauaauauuuuuauguuacccuuuguauuaaacuaaagcaacuuuucuuuuccuacguagguaagucccagaagugaugucugguccuuggggugcauuuuguacuacaugacuuaugggaggacgccauuucagcacaucaucaaucaggucucuaaacugcacgccauaaucaacccugcucaugagauugaauuucccgagauuucggaaaaagaucuucgagacguguuaaagguaacauagcacuauguggguauagaaaaauaaugucucauaauuuuauguuuguuugaaagaaguaguugaaguguuuggaauuauucaacuauccugaauguaacugaucuagugaaaggacuugcugguagaaguuauuuuuaaagccugcuuauugugaaaggugucuuuuuaaauuuaauggacacuuaggaauuucuaaaaggugacuuggagaaaacuuguuaccgaugucugagcaggaugucuggaguaggguguauaguaugauguuaucuagaaaaccacuuuguuagcaucacguauaaaaacgugcucuuuauuuuguuuuguuuuuguuuguuuguuuuuagugcuguuuagugaggaacccuaaagagaggauaucuaucccugagcuucucacacauccguauguucaaauucagccccauccagguacugcuuccucaaagguugcuacugucuucuagguuacagcaugcaugaauaguguguuaacuauagaaaaccaaaaucuaaauggccacucucauggccuguuugcuagauaauaaaguuaauaauauugccucuuuuaacuuuguuauuuaauauuaccuauugaauauagcagauugcaauaacuuacaagaaugccagcuaguguacaauauguuaaguacaauauauauuuucuguugcuauuguuuuggcgugggguaggggcagagucuuacuacuauagcugaggcugaccuugaauucaugaucccuuuuccucaccuccagaauguggguugguuuuuuuuuauuuguuuguuuugauuuuugagacaggaucuugccucaaacucagaccaauacucccaccucagccucuugagggcaggaauuacgggcauguaccugaccggaauggguuuuuaaaugaguuucucuuauuaauacagcauuuuauucauuauauuccuuuuauaggcagccaaauggcuaggggagccacugaugaaaugaaauauguguugggucaacuuguuggucugaauucuccuaacuccaucuugaaaacugcaaaagugagugcauguacauuacuuccagcuguuuuaauguaaugcagugaguuaggccuuaaaggaacuguagccagaaggagaacuggccuccugcucacagcugugguaaaauacauugcugcaauuacuuaacugaguguucuuuaaacaccuuucugauuugugguguuauuguucuuaggcuuuuagcuggaauaaauaaaaauuaacuuuuaaaaugucucgacaacauucuuuagaaaucguuucuucuagucaauucugaauacagccuuugggaaaugacaauauuugucacaugccauaccuucuguagcaauugguauauuucucaaugcacaucucacaccagccagcuuccggguauguucugucucuucauuugagugcccucuaugaacaaaacacugcuaagcacaauagaaguacugguguaaagagagguuucaccauuuauaaaacauuaucugcucuauaagaugacgaaucugacuucuagaaccauucggaaccuagcauccuucuugaugucuaaagaagccuuuaaauucuucaaaucaugaaaauuuguucuauuuauuuucuuuuuuuaucagugcuguauuuuucaaucuauauuuuuucagcaagcagacaugcuuuacaaaauauaaucuacaauuuccuucucucccccaaagaaguauaucaguauauuuuuuuaagucaucaaaauaauuuauaauaguuaaaugccucuuaaauaugcauaucuucugaagcuaaaaguaauaggcacucaaccaauuuuuaaaaucuauuuggaacauuaaccguaguagagguagaaagaaaccccuuaggaaguccuccuugaaaggaaauuuuaaaaaguuccagauuagacagaacccauuccaucuccaaggaagaauaugcaguguaacucuggcuucguagaaugaauuggguaaaguacuuucuguuucuauuuuguggaguaguuugaagaguauugguaguaggucuucuuugaaugucugaugauagaauucugcacucaguccaucugguccugggcuuuuuuugguugggagacuuuuaaugacgacuucuauuucuuuagggguuaugggacuguuuagaugguuuaucuaauccugauuugacuuuguuauuuuguauuuaucaagaaaauugucaauuucauccagauuuuccaguuuuguugaauauagguuuuuguaguaggaucuggugauuuuuuaaauuuccucaguuucugguuuuaaucuccuuuuucauuucugauuuuguuaauuuggauacuaucucucugcccucuggcuagucuggcuaaggguuuaucuaucuucugauuuucucaaaggaccagcuccugguuuuguugauucuuuguauaguucuuuuuguuucuacuugguugauuucagacccaaguuuauuuccuuccaucuacuccucuuggguguauuugcuucuuuuuguucuugagcuuucaggggugcugucaagcugcuaguguaugcucucuucaguuucuuuugggaggcacucagagcuauguuuuccucauagcacugcuuccauuguaucccauaaguuuggguagguugugccuucauuuucauuaaauucuaaaaagccuuuacuuucuuucuuugguucuuccuugaccaaguuaucauugaguaggguguuguucagcuuccauguguaugugggcuuucuguuguuuuuguugcuauugaagaccacccuuaguccauugugauaugauagggugcaugggaauauuccaauuuuguaucuguugaggccuguuuuggaaccaauuauauggucaacuuggagaagguacuaugagguacugagaagguauauucuuuuguuuuaggaugaaauguucuauagauaucuguuaaguccauuugguccauaauuucuguuaauuacaaugugucuguuuaguuuuuguuuccaugaucuguccauugaugagagugggguguugacagucucuuuuuaauacauaguuuucaguaauucagugaaccccuguaucuauggauuccauaucuggagucaaucaacugcaaaucaaaagcauucugaaaaauaauuuaugaguacugggcauauaccuacuuuauuguuauuaauccauaaaaauauagucaaacaaucaucacauuuacauuguauuaguuauuuuaaguauaaauuaaaauauucagcaagauguauauacauaugugcaaguaguaugcccauucuguuagggacuggagcgucugucagguaggaauccuguuaaccagcucuucaaagauaacacuagggucaagggaacauaauuagacuuauuuacauaguaauuuucaugucuucuauucauuaguguaaauagcuucugagaguauauauuguuuccucgucauauuugauauguugauauauauauacauauauauauccccacuuauguauauauaugaauuuuuuaguaaguuauuuuaaagaaaaguaagugggcuugcagugggcuugaaggucugugugugcuaugcugauugugcuauaguauaauucucuuguggaaagguugagcugcauuucuuuauauuuagaauauaucaccaucuucacuaauaauacacugaacuaaaaaguugaaaaaacagguuuguguuuuuaauuucagacuuuguaugaacguuauaauuguggugaaggucaagauucuucgucauccaagacuuuugacaaaaagagagaaagaaagugaugcacagcuacguacaaaccaagaacacuagauuguuuccucugccauacucuugaaucucugaggaaaucuaccaguuggaaacaaccucaccuggauuuuaucaguuaaaaaaacaaacaaacaaaacuucaguagauuauccucaaaaggaagcuguaaaguuaaccacucauagcacuguguauauuaaauuauagaguugugcuuuucuuuuaugcuuuucuguaaaucugcuaauguuuuacguuuagaacagugaaugauagcuggaauguugaagagcucuguaaauaaagcgucaccacaguuccagaacugua

SEQ ID NO: 5222 - RNA, 6912 nt, Mus musculus
cggaagcgcggagaagcccgguauaaaaaaaguacugaagacauuuccccccgcacaacugcuaaagcuccagagacgcgagugugcgcgguggcaucggcggcgucgagagccgccaccuccgagaccaccgcagcgggggcgcgggcggggcgcgggcaaggggcgggaacgcucagggcgcggcgggggucggcgcggagaagucgcgggccgcugccgggagcgcacucgcagcuccugcgaaguguguccgccucgcgguuccucgcucgccugcgcuccuagaaggggcggccgccuccaggugacacagacgggacucucgcuugugcuuuccagaugcaucagagauacuuuuggugcggggcugcucugcggggcgcggcgcgcggcugggcauuggggucggugaggguugggggaggagggcuacuaugggcgucacgaucggggaggggaagcccaggccccucggcgggaccccuguccccucacccgcacaccucucugccgcuccccuaaauccacucuuuccucuuaggacugaccaaggccaaguggcuuucggagggcacuacauggccgagggcgaaggguacuuugccauggcagaggacgagcugaccggcggcccuuacaucccccuggguggugacuucggcggcggcggcagcagcuucggcgaccgcugcucggacuauugcgaaagccccacggcgcacugcaaugugcugaacugggagcaagugcagcgguuggacggcauucugagcgagaccaucccgauccacgggcgcggcaacuuccccacgcucgagcugcagccaagccugauugugaagguggugaggaggcgccuggaagagaagggcauagguguccgcgacgugcgccucaacggcucagccgccagucacguccugcaccaggacaguggccuaggcuacaaggaccuggaccucaucuucugcgcugaccugcguggggaagaggaguuucagacugugaaggacgucguucuggauugccuguuagacuucuugcccgaaggggugaacaaggagaagaucacaccgcucacucucaagguaaagccaccugaugggcuugggcagagcagggguggggagaaagcaagcccagcuugccuugacugccgucaguauggccauagugaguucguuuauuuauuuuuuuauuauuuuuuuuucacgagcgcacuaaugcgcgugagugguguggaguguuuuaguuuccugggagauccagcgccacaacucugugcuuccuccucugcguuuccuucucuuccuucucucuaugguuuaacucuugacuuuccuugcuggacucuuguccagaguauaacgugauugguggaaggauggaaugauguaaauaauuuuuuugagucaucuuguaaucuagacuuugggaaaaauagcagccugaagcagaacugagucaaugguuuuuauuauauuggaaaaugugaaucgauccauacuccacugacuucggcguuuaagauauuugaugcuuuucccuguuaauucacagagucgaggguguaauagugugccccuccccuucgguuuagguggcguuuuguauaauuaauuaaaguugucugaaggcaauuuaguuccucuuuggcuguaacuguagagugucgcuggagggacacacucgacugauaagauugauugccuaagggggaggagaacggggugguuggagaccaggcugagagaggccaacucacgacacugucugucucucuguggauacugggugaauauugugcccauuagaccaucuucaaaaaauaacauuugaacucagacaugacaauagaacgucuuaguaugcugcugugucugccaaaagccucaaacuauuacuucuagucucuuucccagacggcaaaacuacucguuaaauguauuuuuuccccuguuuuccgaagaccguuuaagcucguagguaguguuuugcugaaacuuaacaaaacaaacaggaaggagcaaaauaauucucagcaaagcagcugagacacauuuauuguuccuuuaccagcuuuguucauuuccuuguuucuuuuacaucguaggaggcuuaugugcagaaaaugguuaaagugugcaaugauucugaccgguggagccuuauaucccugucaaacaacaguggcaaaaauguggagcugaaguuuguggauucccugcggaggcaguuugaauucaguguagauucuuuucaaaucaaauuagacucucuucuccucuuuuacgaguguucagagaacccgaugacugagacauuucaccccaccaucaucggugagagugucuauggugauuuccacgaagccuuugaucaccuuugcaacaagaucauugccaccaggaacccagaggaaauaagagggggaggccugcuuaaguacugcaaucucuuagugcggggcuucaggccugccuccgaggagaucaagacccuccagagguacauguguucccgguuuuuuauugacuucucagacaucggagagcagcagagaaagcuggaguccuacuugcagaaccacuucgugggcuuggaagaccgcaaguaugacuaucucaugacccuucauggagugguaaacgagaguacggugugccugaugggacaugaaaggaggcagacuuuaaaccuuaucaccaugcuggcaauccgggugcuagcugaccaaaaugucauuccuaauguggcuaaugucacuugcuauuaccagccggcccccuauguugcagaugcuaacuuuagcaauuacuacauugcacaaguucagcccguguucacaugccagcagcagacauacucuacuugguuacccugcaacuaagaauguuuaaaaaaugucccauggggaagccauuucaaguaagacaggggggaaaaaaagaaagaaagagagaaagaaaaaaaaagaaaggaagaaaaauuaugacacaacaccaaaaagggaagugacccaguccuaauuagggauguguuuagugcacggaggacuugcuccugauuuuaaaguuggcaaugcuuuuggaucuuuccaucaguacaggagcaggaucucaacugucacccucccuagccacccaccucaccuauggucucuacccaauuggaugguaucuugaaacaaacgaggccuguugguaaaaagcagccagauucucccaaaauaacaagagaauuuuaaaaaaggaaaaaaaaaaaggcuugauuuugacaauauggguuugcaguagcuacucccauagcucugccauagggaagagaaugguggacaaacuuuucagauggcauucacaaaugggaaaccacagaggaggaaagccuugccuaucacacgaggaggucagaaaguaacaggggaaagcagggcuacuauacuagaagguauuaccgucuguuuugaagcaagugcucucuuuggaaugauccuguuuuccucagagaaacagcucaauccaaaccaacaguccaaaccgaccaacagucagucgaugcuguccucguaacaaacagcagaacuuaaggaugacacgacccguuaauuccagcuucgugcguagcuugcguuuuuuuuaauuauuauuauuauuuuaaaugugaagacgcaagcaaaaaacagcuguagccaagaaaacaugcucaaggaccaaagauuuaacagauaaaaauucccaagcagaagagauagaauaggauauauaaagaguuacuauauuuguuacacaccaauacacaucaaagugccuguugcuuucagaagauuugaaguggaaaagguuauuuuaugguuuaauaauuauuuuauuuuaucagggacucaagaaaaaaaaauaaaacaacauauaagcuugugaaugguggaggaaaugcccuauuuuuuuuuuuuuuuuuggcaaauaccuauauaaaguugauauuguuuggugugauguuaucauagguacguauauauuguuuguguguauacacacacacauauaugugauauguauguauguauauauacacacacuacuuugucuaugaucuaaaauaauguaucaaauaggaaaaauuuaaauauagugcuuuuuauguuuuugguaggaucuuagaagacaugggcaaacugcaaugaugacuuaaaacccauaaaaaaauaagacaaguggagguaaaugaguaauauauuuguaggaaaagcagagauuacacauuuauagugaguuuuuucuuauuuucagugagccagagaacuucacaaauggaagaauauuugguagcauacuuuuuaauugacuuacuugacauuuugagagucugaaccccucccccuuaaauaaauggaaucacauaccuucaaggcuuagaacuuguggaucauggaccagagauaggauaacuaaauccauaaacugcggaaaaaaaauucuggaaccugaacacuacuuccuaauauuuaaaugaaaauacaaaugagugcauucuacauuuuggaccacuagaauuuaauaaaugugaaaugaccauuuuuaaagaguauuugcacaauuacauaaaguuuauauauaggauaucuauauuauauauacauauauauacauuuuauaaauuuauccgauaugaaauauguuugaucugguugucacacugcauagaaauauguaguacugcaccuuaaauuaaaucacguuguauucgcucaaacccagcuuuaguuuucucucccaggagaccauuuguguaccuuugugucgugaacugauauuuucauguucagcgacagcuaaacuuaacuccugucccagcucuguagaccuugaucucugaaaaauaacauuucaaaaaaaugaaacaaaugcauuaaaaaccuucccuuauuguugugaaacaaucacacaguccccuggaaccuuagugaaugacugcuagguauggucauuccuuugcagagccagucagugacagagaugcuagggugaauguaacucucucaccuuggcaaugaaugauguuaucucagcaucucucagcuucugcuggacagauuaguccagguucaucugucuggaccacccuucugugcaucuguaucugaagccuuaacagcaaccagauuggcucugauuggacagcuucccugagaauccucacuaagcugccacagcccccaacacugccacucucuuuuauaaggaacugaucuuacucccauggugguccaguuuuccccuucacugcccugcauuugaaaaaucauacacaaagucccaggaaaccuuguucagcuugcagcugaagucuggaacucaccuaucagaaaccacaguccagcccacuuagcucuccugcaaguuccccuggacugcuggggcgggggacagaggcuuuucuggugaccugguuucugcucaugcuaacucugcaaauaugaguuguccacuguuuugaaaagucuggagaucuugggcucugccauaguagcagccugcuguuaacugacagcacagguuuuuguuugaaggggccuuauuagaaaauaauguuuaucauuuacuuucucaaguauuuucuauuccuugcuugcuuacuuagcugcaagcuaagucaaaagaacuuagucaaaagaaccagcacgcaacauucagauagaacaggcuguguucaaggcaacuuuuggcauuuacuuuaacccuuauauaauuuauuucuauuuugugcauacuauaguccugugcauauguaguugaacaugcaagggaauaugugucucucuuuguggauguguggccuaaaauucugaaugucagagcaaaggacagcucucucugcaucuaaucagugcccacgguuuguuugcucuuguguuugucuggccuaguguacuguuacuuugaaacagggagaagucuugccuucugaagguucuucucacguguccagucuggcaugucagagaacacuuagccugugacuguguccuuuuacaaaguuuacuucaucugcaguaaauucaacugccucaagaacucuuacagggggauggacuuuccaaaguugaacggagcgcuugcgcucuuugguauaguuaggcuguuuugaccuggguccaaaaaagcacaaggaugggcagaauacucaauccaaucaggaagugaaaugaaaagugaacauacuguuuuugccaccccuucuguuugcugucguugguugcuuuacugugcauauccuuguuuuaaugcaaugcuuguuaaauaaauauugugaacuauuuuguaaaugaaauguauuauguuaaaagcugucagcagcugucaaaaauaagcuuuuguugugaaagaaaaauguguguuagauaaaaacaaaacaaaacaaaaaaagucaaaaauauccuguuuucauauauagcaccuauuugaauauacucuuucuuuaauauuucuuuuagcaucaccauuucagugcuguggagggaucuccgugucacguguugucaugguaauggcuugcuaagaaaucagugauaaccguacaaagugggcggugcugaggggcuuggggauccuugcugcaaagcuuugcagaauguaagaggcucuguuuacccuuggcccucccucccaccucccuacaaccauugccugcucugaguuguccuaugacagcaagaugcacccugggucacucuuggaacguuuugacaauugugugucacaggcaguaaaaagaguugauagaaaauggacucuucaaaacugacauguucgcagcagugcuagagggaacagauugugaauuuuguuuacagcauccaauauuuggauuuuuguuuuuguaaauaaaaagaaguuauuuuuuucuauugau

SEQ ID NO: 5223 - RNA, 2704 nt, Mus musculus
ugguucuagggauugaaaucaagauucuuacaagcuagacaagauuuuuacuaccuaaguuuacccucagcccuggauuuuuauaguuugaaacuuaaaugguuauuuuuuugaaaucuaucaauauaauuauaccugaacaagcaagguacuacaaauaaauaaauaaauacaagaaaaagaagaaaagccuuugcuuauuuaccugugugucuacucaggugucucaccugcuuacccgagggugugugguucaggccaccacuccagcccaugaccaccaucagaaggugcccauuccccagauauagcagccuuguccuuggacuacucagaugaacgccgagucccccaaaugaaaguguuagauuugucaccuauggcagauaguuucaggacaccacacuugaagucuuacaugcgaaauuccuuuuuaguucaauccuguuucuagaauuacuauugaauugacauucuuaguuaaguauggaagucuuccucuuuucucuucuggauugcuaauggaucaguaguauuacugcaggagauuuguggggagugucuaguuggauauuuucaaaaagaucuguguucucuaacuuacugucaacguguggguauuuaacuuuguggaguuauggccaccguaagagccugaguugauaaccagcuuugauuuccuaggcaggggucgcaugaccguuugaagacaguuuaagcaggagugggauggagaggccagugacagcucuguuggguagaguccagauaugcauaagacauucccucauggaggaaagucaucugggccagacugucaagcuucuuaccauugugagacccuggauauuucagauuuaaaaaucaccaguuuuuaaagaaugguuguuuuauauauugcuuauuauugcuaaaauuuugaugaucuggguuuuauauaauguuacuuugguuuagaauguuaguuuuuauguuacuaaaauuuggugguaauugaaaaaaaacuuaguuuauuacuuauuacguaccaggaaagucugauuuguuuuuuucucuguuuauaagaagacaucuaguguguuuaucaucuauuaaaagaaaacuccaucauuaacaacuugcacugcugauguccggaaguggcugcaucacuguguucugagauuugugacuugucaugagugaugacaugagacguuagcaguugcuaaggcaguagcagugaggaggguguacuuguaucuuagagaaaccugcacuagauuuuaaauauguagucaacuacagucuuacuugucauuuuaaauagauacaggcaaaauaucugaaaggaaggacuaucauuggaguagcagcgggcagguuucauacggugcuguggacucgagaagccguuuacacacugggacugaaugguggacaguuggguaagaaauauuucauggcaauauucaaaugcuacaguaugaucuuagaauagguaugugacgguuugcuuacuuguguaaauuuuuaggucacuuacuggaucccaauggugaaaagugugucacaaccccucgccaagucucugcccuucaucacaaggauaucgcugugucuuugguagcugcaagugauggugccacagucugugucaccacaaggggagacauuuacuuacuugcagacuaucagugcaagaagauggcaacuaaguaugugcauuucuggaaccugucacuauaaaaaauaagaauucaucucucuagcugcuuaucaacugauagcugugugcugggcuccgugagaagacagaaucgaagggaaaacuaagaaugguuuucuuuaauuuuugguuuuggacaaggauccaauggacauauaaaaguuuuguuugcaaauuguaaaauaauauuuuugagucauauuuaacauaauaugucccacaaaguuuaguuuccuuuuuaauguaugugggucacauaauuaggcuaacccucauucuugguuuauaacaugaucacuauuucaaauauagguuuugauaucuuauauccuaguuauuaaaaaaagaucagcaucauaaacacucuaccaggcuuacucuuuacaucucacugcugcuacuuguccuugucccguguagugcguuguguuuagcaugccguaguaacgugcaggagacuagcuguuacuuggcauaucaaagaauacagaaucaaauuuaggcauggguccacaugccaacuguagcucucugacuuguacuuacacacaaacucaggauuucacuuccgauuuuauuuagaaugauguaacguauagguguuuaaagauaauggggagguaaucuuguguuucugauacauucagucccuaguaguugauuaauuuguaucugauuugacagcauuguauuguuuuagguccuucuaaaguaauuaucuuuuguaguaaaucuuuuucuuuucaggcugauauuucagaguguugagcaauguuucuuucuauuauauucauuagaguagauaguacaagcauggaaauauccuugaaaggauaacuuagcucuuggaaacaguggcuaauuuacaaggcaauuagggauuuaaauguggaugcagcagacauguucuugcuggugugugaaggcgauggugaugucaucacauuguuaacuaugaaagcuugcuuagaucugaacacaaccaacagcagcaua

SEQ ID NO: 5224 - RNA, 24492 nt, Mus musculus
cggcuggcgggcgaaggcgcccgccgggagcacggucaucugguugccgguaaggaaaagguugcgcacguaaggcgguagauccgccggcaccuccagcagguugcgguucacgcacuuaaccgugcgcgccgccucggagcacucgcacgccgcggggcaucucucggcuggcggaggcugcgcagaccccgaggccaggaaggcugccggggagguggaagacgaggguaccgaagagcugggggccgacgcggagacccaacccagcagcacuagcgccagccuugccaaccucagccguccguccccggcggaggggccccgggagcccgccccaggcaucgcggcucgcgguuccccggagcugggacagcgcccgcuccgaagacucgaccgccugggcccggcgggcgcgagccggccgcaagcgucgacggcaaacuuuccucgcgugggagcagaggaggggacgccaaaagcuggaacuuggcuaaccccgagccaccgggcgucccccucccggagcggcaccccgcccuucccuccagugaguacgcacggcgggucgggacacgggccuuggcgcuccuccucccgccgcagcugggguggguggcaccuccucaacuccuuuguuggcgccucucucagggcaggaucggaugagcgaccugggacaagcgggagagaagcgugaggaggagugacggccgcagcuccccgaguacgaaccaaguaguccccacacuagcaacccggcccaagcuucugugugcguccuuccucccuagugggacgcgguccccacucccaggcgcuaagccuaccucuuccgggcccacaccaucaggacccgggccaccucccgccuggcuccugcccggauugcccuccucccgccuagaacuucacgcagaccccgcgguguccagcgagcaaacuucuccuuuuuccggaucccagcuccuaccgccccggccgaccaccugccuuccgggguccccgcccccgccgcuccucccccucccaccuugggaugagagcgaaguuucggguuacgggacucuuaagagcuuuuuuuuuuuuuugguaccuccuuggauuagugugaaaaggggagcagagccguacagcugucgccuacucucgacuccccaguuccuggccacccagcuccccgaucccgagaggauccagacaucuccagaaaaacggagggaacccgccaacaaagcggccgugggaccgugggcgguguggcagccaggacccccccccccccggcucucuucacgcccuaguauagaaaggaacccuggucccgccuccaggcuccaaaccuggccgcucgguccccacugcucaccuccgcaccccgcgccugcaaagccaacuccgagggccacccgaguccacgcgccuucccagcuccugcugcgggcgccgacucuccucucaaccccagccccuggcccaaccuccacggcugggaaaaaccaagccggggggcgggggagggccagggcugcaggagagaucgccgccgcgcuggccaccucugcugccccagguaggggcuucagggagggauacgaggggcaaccuaggcugggcgacuccccuaggcggagauaaaugagcaacgcaucccgagaaggugagggauuccccuucuguucccccuccccggcauccuuuggugguuccguauuuugcauagcguauuuaccucggacagaaacaaaaccgcugguggaccucuuggaauucacgcugcuucuggcaccgcuggcagugaggagagggauuuaagcgugagcaaagcagcaguagaagaaggagcugcacagguuacauccgccgcggcaaacgccuggguugugagggagauucagaaagucuccucucucguggcucgguuuggcuggcaacuucaguuuaugagguaguuaguuaaugccuuccuaccugugccgcccccgcacgucuaggguaguuaucaaacuuguaaagacagucaacuuuaaagugggggaggguuacuggaaaggacacucauucuugauucauuaugggugguuuuuuccccccuccucucaaaauuaaaaccagagggaagaaaauugcagcuaaaacaccccagaaacaaaagcaaauugcaaagacgugagucacccggaaagcucccuacaccagaugcggugcguugugucagcacaagucacuuacgcagggagcgcucgcggcgggaggugggcgggcugaccugggaaagaaguuugucccaaagucugucucccagggggcgcuggcaggcgccggaugauggauuagggaaacgacuggaaugcuuauaggaccaaugucauuaagucuggagagaguuggagucccgaacgcccucucauugcucucucaaaaagucuuaucugcuuuuccucagucaaauuuuccccaaguuaaaaggugugggugauuacagacuauuucauuuuagagagagaaacgauaggagagauaaggcugggaaaaagaagacccaguauaauaaaaguaucaaguuaaggaagccggggauuguuccccacaacaugcaucaugacuguggcgguccaauucugagucuauggcuguuucuuucuguggaaagauaguccacagaaacaccagccaaaauggcccaggaaaaaaagcugcagagccuggagacugcagagauuugugcaaaaagacaguuucauuaauuugcaucuucagcacauuuaucuaaaucccuuucucuuauuuuuaaaaguguuuugcaguauaaaugugaaaagcuuugaggggaaaaaaaaaccgacucagaagcugaagucauauguauggcaaucaugacgaugguuauguaaacccauacacgugcuaaaacucguaagacuguacgccgaaaagggcaauuuuacugccuacguuuguaguaaaguaaauggcacgggaagaauuuuucugaucuucugguguggucuuaaaugguucugucaaaagagcaagugcucuugugaccuagcuuuuuagcauuaaaaaaaaaaaaaaaaaaaaaaaaguauucucaucucaucucaacauauaccucagaggcaagauacacuguagcauugggacgaucguccugaauccuuccuguucagcuugccaaacaagcaagcaaacaaacaaacaaaaaagacuaugagcuagugugaucuggggucaaauguuuucuacuugccuagucaugccacuuaauaacaauuacccaauuuuacucugcauaucacaaccaagauaaaucuucucaccagauuuacccaugagaaagcaggcaugcugguauagaacaaugucaaguggaagguggagauggaaccaggacaaacuuaccugcuuuucaugucuucccauuccaugucuaggccagaugaagagauuugugcaaagucucaaucuuuggauauauucagccuucagccaaaggguggugaugaaugcauccaauacacacacacacacacacacaaagauguuacagacuuaguuaaaacaugagauucuuauuuuguaacccaauuguaugguuuucccaugugaacuuuaugcugacagcaucaccauccaggcaggccugagggagccaaauaagcaacacaccugagugucuuucagcuucccucugcaguucacagcuacuuagaacuagaagcagaggcauuuauagcuccaacacuuacacagggaccgcuguucugauacuaaaucuguaaaauggagccacaaguacaauucaaaagaucuccacgagaauugagauggcacuuaucaauaccaucuguugucauucucucucuaauuaaucucccuccaguuaucaauuauaauuuauuuccauaaccauguuagugauagcaguacaggguaagcaaaggucuccauaaagcagaauauuuaagaaaugaaaguacaacacacaguguuagcuuuaauuucaguuaaacacucaacagugugguguuacccacaaguucacuugggucuucccgcuuuaauuaaccuaaucuagacaaccccucucagagcuggacagagucuuguuuuucuaguugauucuagauuccuguuaaguggauauuaaucaucacaucuccacccuuugacacccaaacacauuacuucuaaaccugagccuucuuccacuuagcugcauuggcacacagguaccccauaaugcagaaacagauuccauccaacuucaaaaggcuguauagucuuuuaacaaucccagcucuguuuaaaauucucaagccugagaucucauuugagauucauccuuuuugcucacucccucucucuguagaucugcauaaaagaacugagcagcagacacaccacagcuggagaauaggcugucuuggaauucugccugccaaauaaauugguucaugacuuaauucaccacugcacaaggucuuagggaacgugcagaauuugacgggauucuuggccagaauguaacaaaaaaaaugccucuagcccagccuuuguuuccuucugaaaccucugugugccaaaccucuaagccugcuugucuucuaagucccugccggaacagaccauugagcuaugccuucaguauuugagggcuugucuagcccaaaguuucaaauucuugagcauuccuuuuguaaaccaguuccaaagacuugaggaccaagggagcugguuuauuauagcggugaucucucacccaguucucaguuacucuuucuguugcugugauaaaauucuguaacaaacacaguuugaaggagagaggauuuguuuuagcuaacaguccaagagugcagccagguguguggggggaggaggagucuuggcagaggaagauuaaggcaggugcacaaauuguguuuacagucagggagcacagagccauaaaugcucagguuuagcuugcuuucuccuuuuuauucuuccagacccuaccgcauggauuggugccauccucuuccaaauccuuccuggguaugcgcaaaggcuugucuccugggugauuucagauccugcuaagguggcaauauuagccaucacauacugcaaauacuuugcugagcuaucucuccaaccucuuacuuugcauauauauuuaauucuauuucuucuacgauagacucguguguauauaucauaugcaucacuuacaauuuuucuuaauuuaagaauauauuuuauaaaaaagaguuaaaaaauauauuuuaugucuguauauaugcuauuuguguaugugcguguguguguguguguguguguguguguguguguuuguaggggugcauucaugugcagacagauauucauucacaggggugugaguauauauguggaauguggagugcuguucaucacacagucucacccuggccuggaagugaccaagucggcuggucugucaggccaacaaacucuaguaaucuaggucucuguacugcuagugcaaggauugcaaacccuuauugaauaaugugagaacugaaauauucucaccagcaaacuuaccuguaugcuugaaaggcaauaaucacuuuaccagcugagccaccugcccaucuugcuuucuuccuuaggacuguacaauauuucauacuguggacuacuaugcuauacuuguuuuugucauuaagaaacaaagucuuaaguaaauaucuaagagagagagagagagacaaacagacagacagacaaagucuuacugugaagcccuggcuggccagaaaccccguguaaaccaggcugacuuuauuauccuccugccucugccucccaagggcuugauugcaggcaugugccaccaugcguggcuuacacuacagauuuuuaacagcaugauugcaacauggauaacuacuuuuaaagacguuucccacaagugagaaaaccuuaccaggaucaguucuauuuugauuguuuuaggcauuuaauuauacuaaauuaucauacuuacuuuacucuugacagcuugaaaauuuuuugugcauaaugcuauuuacaugcucugaagcaggacagaggguuucagaguacaucuucaaaaguggaagaucucacucaaugcccuugcaaaaucaauuuaauauauuucccaaggucauguuauagccucuaguaaaauuacccuacaauaacauuuauguagaagauuauuacuucaggagucauuuuucuucuaauaacccaaaggaaagucacuuaaaaagauauuacugaaauauugauguaaaucuuggagcuucagggaaauuaaggaaggaaggaaggaaggaaggaaggaaggaaggaagagugauacuaacaaccuuaagugauacccagcagagagaagccuggagguucaacaagccaaacaccaaggcucuuuaaaauuaguuuacuuuuggucuucgccuaaaaucagcaaaggaauugaugaagggaacacucuccaguuugaaaaaaugucuaacaaagucaaguguugaauaccaaccaaaucuguuacagaaccauuaacuaacacuuagaaaggcaaaggccacuugcacacaagaaguaaaaagagaaaggugaagagaggguggaagaaaaacuuuuaaagauuguucauggaggcucgagugauaucucagcaauuaauggaggauggagggaugucuccaugauuaagagcacuggcugcucuuccagaggacucauguucaguccuuagcacucacuuggcagcucaccaccagcuguaacucuagucccaggguauuuaacacccccuucugagguccacagauacugcacacauguagugcacagauauacuuguaggcaaaacauauuuacaugagucuuaaaugcaauaaauaaauaaauaaauaaaauuacucacagaagaauauucuugugagcugauuucaaauuguuuuaugaaggaugaaauguggucuccuuuuuugauuuaaguaaaauauaagcuagagaaugggucaaagaagacaaauuuaucuucaauagucaguaaaaaguaguguuggagcuauuaaaaaauauaauaaagaugucuucaagcucauugaaaauggaacacauauuaaagaagcagcuaaaaggaugugucaggcuggagugaaugaguaaguuggauaggugcuucuuuauggggcgagaaaauagugggaagcaaaugaaaacaguucaaugcacagaucuucgagaagcuaacacagucacucaauguuaguucaacaaauucuuuaagaccucaccuuuugccugccacucaugugguccuuaggauacaaaacccuacccucaguuaacucauuuggguggaagagcagacuaccagucagaacaacugguacgaagcugacgugaggauucacuagguccuguggcuugcggugcgcuuuaacguaucaguuagaacuugcucaaaagaguugaaacguucaguucuggaugcugugugaggaagaguacagaagauauaggagggagauguucagauccaauuugcaaugggucaaaucaagccagaugugggaacaugccugugauuucagcacuugguaaguaggaauagagaugucaagaugucaaggccuuccugaguuacagagcaaguuugaggucagccucggcuacaucagaccccgacucaaacucugcuccuuuccagcaggaaauuaaauauggcuguccugcaaaggguugauuuauccuguagugcuggggggaauggcauaagauuuugacuggcaaugacauggucacaugaacagggaauuuucagcagauaaaucuaaggguagagagaggaauuuggagacccaagugagagaggagauuaacaacaacaaaaaccuuaaaauagagcugagguaaaagacugggcugguguguggaggagcagaugaacccggugcuuguggaaaacagagaggugcugccaccaccgggcauuucagagauuucuggagcauuuucugguugucaacaguaauugggagcuucuggcauuuagugggaagaggccaaggauauuagaaaucccauaauuagacagcaacucccuacaaugaagaauuguucggucuugaaugacuuucaaauauguguucuuguagauuaaccucugaagcuuagccuagagucggauccauuucccacucagucgacaacaaacgcguauggcaucauuugagcacagcaaauuuucaggaagaaagcuuuguuguucuccaggagaacagaggcuguuuagucuggaacuugaccaaaacuaccguggagagccaggccgcucgcucaguugacggugccagcacagcucaucuguguccaucccucuugucuggcguuggaguuguuugccagugugauggcucuuaaugugacguguaggcuauguuaggacguugguuucuauuggacugaggucaggaacuccuacggaacaguuaggaggaggauugaaggaacugaaggggauggcaaccacauaggaagcccaacagugucaacuaaccuggaccccuaggagcucccagagacugucaccaaccaaagagcauacaugggcuggucugaggccuuggcacauauguaucagaggacugccuugucuggcucaggaugcaccuaauccuuagagacuugauacucuacggaaggggaaugccggggucaggggggguacacccucucagaggcaaaggagaggaagaggggcaacacuugggauguaaauaaauaaaauaauuaauuaaaauaaaagaaguugguuucugcauucacccauauagugaggcgaggucccuuaaaucauagcuuauuuguaaguggguggagauuuauuucuauuuccuuaaacucugauaagcucaugcccaauauuggauugaaaauuauaucuauuauauauaaguuauauauauauacacacacacauacauauauauugucauauauguuaauaguuuagugagaagguacauuuuuauuuacuacacgugacuuuguaugguauucauuguaaaaaaaaaagaaagaaaagaaaagaaacacugauuucagaaaauuugaaaacaacguguacagaugucuaagaguuagacugcaacucugaacaauuuauucccuguggaugugagaauauagacaggcuuaauuuugaaauaggcuauuauaggggauaucuauauuuuaaaugaugcauaguacgaagucuaacagcucuagacugaagagccaggcucgugugugaggaagccgaaaagaggaggggaaacaguggaguucccuguuugaggaagaaccugcuuugccugcuuaaacuuacugucuuguaaaagcaagucauggcaaaugcuuaaguaauguugccucaugucuacuuauuuaaaaauaauuguggugcuuuuguuuacugggugaaugccugccacugccugagagggccagucagaggacaccuagcaggaguuacuuaauaucuuauacuacauggauccuggggauugaacucaggucaugagacuuggcaccaaucccccuuuaccugcagaaccguuuugcuggcccuuauauucauacccaguuuuuaaugcaaguugauucugcuuugaagacaguaccgaggagccuccauuuguuuaguucuugaccaagaugggggucaaaccgaacaagaauccaacccaguguuaggaaggaguauugccauuguaaugaccauacaaauucaguuucuuucaacccuaucuaauacagacgacaaagacuuauuaaugugcuuuuuuuuguaguacccucacuuuaaccuuccaaaaagaacuaccucaaaggcagcaauuuucucauucuggcucacuggcggggucuaguauguguccaucagagauuucagggcauauuuaauguauucugcaaaucugauuccacaagcugaaguacaugaauaugauggcccugggguugucugaagugcucagaucugacauauugagaauuuuaucugauuuaguuugggucuuccauauaacagccaaaggaccauguauuuuggaauagaaauuuaucauauguucauggcagugaaagaaaaggcucagggcuauuaacgagggagcgugaggucaaucuagggucaagccacagggcugcacagugugacuuaugcugaggaaaaucaggugcacuacagaguagguugcauuuacugaacuccaaucauagcugcuggagggacccaugaccccagaaggcuuuggccaagagcuauugaugcagugauauuuacuaagaagccuguauugccgugguguggaaccaaugaggcccagacacugaacaguccacgcucauuccagggcagggcuccauauauagacagugaccggaaagcuguaaugcagucugccugagugugagcaccacaugacccuacaacucuguccaauucuucagacacugaaaggcuucucaccaucugcaaccauaggcacgaggcauagucaugccaaaauucauccaugaugcccaagcuuggugguaaugaauucuaaacuuucacugaagaguccugggcuguaucuuaggagcagaaagugccuagcauaguaagagacccugauuugacacacaaaaagcaccaaaaugcaggcauauucuucuauuguuuuguuuuaaauuugagguuugugcuuauuguuagaagaaucggugcuuuuuuuuuuuuuuuuuuuuuuuuuuuuuuuuuuuucuggccaaauaguauuacccagcagaaauaugggaccuucucuuugaccucuugauggauucuuccagccuggaacuaucacauacagggcagggguaaacauuuacauuugaauuucuguaugaacaaacauuuuuauguauccuggacaaauacugagggauugaaaggagucuucagcagauucauuuuuaccuuguucaaaauuaccugacugacuaauguguucuuacccauuuugcaugaccacaaauggaaaauaggagaugucacggcucaaguccuccccaccuuggauaggguugacauuuucaagucuggugugcaugacauggguguuacacacaugaacucacagcaucugugguuaccugcauacaaccaagauaauuaaaaguccaguaugaauggggaagggacccccaaagcuccacuuccagcugaggagcugcugguaguugauggcuguugaaggagagucaccuuccucagugggaguagccacggguaaguuaccaugccccaguagguaacuccucacccaugcacauauggcugacacuaauucaauguacuggguuuuauuuuuuuuaaagacauaaaaucaggagggaaauauauugcugaguagggucuggacaagcugcaggaagcagaaaauaggccugggcaugaccaagagacauuguaugcccgcaagauauuauuuuauguuuguguacauuguugcucucuucagacacacccaccagaagagggcaucagaacccauuacagaugguugugauucacugugugguugcugggaauugaacucaagaccucuggaagagcagucagugcucuuaacuucugagccaucucacuccaaccccugacauuuucuaagaauaaauacaaaacauuuuuaaaauaaagauaggugguuuugagagcucacucaggcuuuauuauucauuacagugcuaagccauuuuauuucauuaugcagccgauagacuuuuguuuugcuugugaaggguuuuuuucccccugaaagaaagaaaauacuggaacaaaacggcaaaagaugaacagauggguucaaauaagaaaauagaaauggccuuugauauuaaaagauugucagucuuacuuguagcaagaauuguagaaaucagagucaugcaaagauaauauauucauagggaaaguagcaaaaacauuuuuaaaaugauaagaguuccaacauugguagcagggacauaaauugucacagucaaucaucucuaagcaggguuuuggcagucacuaucaaaauuagaagugcucauaucauauucuuuaaucaagaguuucgcuagcgaggauuuaugcuuuggauaugugacacgcgugggagaugacauauguacucagucacuguugcagcacuugugauuguagaaggauggauauauccugagaguggggggccuugaguaaagcacggggccuguuugugccggauggcaucggcagccccacccauucagaccuuccuuaggggcagccuuuucccaugucaacagacaaugcccucuucacuacacccagcuauggcccgcugugccuucacuucagagugugauuugcguagauguauaggugugauucaggcagcuucuuuaaaugauuugcuaggauuggguuggcucacucuugugcuuaucuguugccaggagaauaacacauucaacuaucucacuggucuugggaaggaaguaaaggaaaaaaaaaaaucugucuuucagguaaguugguucagcucagcucagccuacgguagagcucagcagucauucugcaguagcaccagcagguuuguguccagguuaagaguuugcugaucuaagccaacucauaucguucaguucucagccagaccauagacacacugcucuguccuacgccacugaguuccuaggugguuuagugcacagaagacauuguuaauccacucuauaauagaugccaccuaccccaaagaguuauuggaguaaugggaaagucucugagaauuauuguuaaacuaaauaugugcaaugcucuguuacuguugaaaagcagucugcacacacccauaaaaaacaaacgcaugcacaugagcagacacacacacacacacacacacacacacacacacacacacaccuaauacaagucuguugccaacaguugaaagaaaagagugaaaagaggcuuuuuacugaaugcccuccaauuguuuuaguuacuuucuuucuuuuauaaagagacagcuauguuacccagguuagccuugaacuccuagaccccaaugauauuucugccucagccuucugaguagcuaggacuaguacaccccagucccuuaugacgcauuaagauuaucaauuguuucuguguaucagauaauuuuuuuaauuaauuguuuuucaaaauggaggcuauggauaguacauaaugaaaucuaacagaaugggggaagaacacaccaucacuuggguauucuucuccagugaagagcuauuccaugcuccagaagacccagaaggcuucuucacuuuucucugaaaccaggugucuucaggcuuuaucuagauauagaacucugaauuuaucacugugccuauaacuagaaaauaaauguaaauaguucuaaaaauaacaaccuuaacugcccuguuuagaugaugggcaagugaauggaugagguacuucaagacagaagauucauaaaugagcauauuagacgcaugccaucgggcaucacgaaucagcaagacguacagugagcuaucauaaacagaguuuagaaccugcagaggccagcuguucucggcacacuuccucauccuccgucucuuacauucuguuuccugaucugagguguuugcucaguccugaggguuggguugaggugggcauggauagaguuguccuauuuagagaugagcacuuucuucucagugcuuugcagaguucagucugcauuaaccacauccugcugccauaagcaucuccucugacaaaugaugcaagcagugcaacacuaugggaauagacaucaauguuuagaacacagugugacaaagugaccuucuaggaaaacaguaucaauaugacugugacgucccgugguuuuugaacaaguuuagaguugcaggcaugaaguccccccccuguggagcaggucucacuuccagucaagagaggaauugguuucucccauaaacagucaugccacuaucacacaaguggguguauguugccugguaguuugguauugcaacaugcaggguccagugagggauuaaaaaacacugaugcucuuuccaugucuucgaagaauuguguugggauuuugauggggauugcauugaaucuguagauugcuuuuguuaggauggccauuuuuacuauguuaauucugccaauccaugagcaugggagaucuuccaucuucuuagauauucuucaauuucuuucuugagagacuuaaaguuauugucauacagaucuuucacuuguuugguuagaguuacccccaagauauuuuauauuauuuguggcuguugugaagggaguuguuucccuaauuucuuucucagccugacucucauuuguauaaaggaagguuacugauuuauuugaguuaauuuuauauccagccacuuugcugaaguuguuuaucagcuggagaaguucucugguggaauuuuaggggucacuuauauauagcaucugcaaauagugauaccuuuauuucuucuuugccaguuuguagccccuugaucuccuuuuguugucuuauuguucuagcuagcacuuagaguacuauauugauuagauauggggagaaugggcauccuugccauguaccugauuucagugggauugcuucaaguaugucuccauuuaaauugauauugggcuguugguuugcuguauauugcuuuuauuauguuuagguauaggccuugaauuccugauuucuccaauuccuuugacaugaagggguuuuguauuuugucagaugcuuuuuuuuuuccaucuaaggagaugaucaugaucauuuuuuuccuuugaguuuguuuauauaguggauugcauuaauggauuuucauauauugauccaaccuugcauuccugggaugaagccuacuugaucauggugaaugaugguuuugauguguucuuggauucuguuuacaagaauuuuauugaguauuuuugcaaggauauucauaagcaagauuugucugaaguucucuuuuuugguuaaguccuuaugugguuuagguaucagaguauuuguggcuucauagaaugaauuagguaacguuccuucuguuucuauuuuauagaauaguuugagaaauauugguauuaugucucuuugaagaucugguagaauucugcauuaaauccaucuagcucugggcuuuuuugguugggagauuuuaaaugacuuacacuauuuccuugugugauaugggccuguuuagauaguucaccugcucuugauuuaacuucaguaugugguaacugucuagaaaaccauccauuucaucuaaauuuuuccagucuaggcuuuuguaguaagaucugaugauuuuugaauucccucaguuucuauugcuaugucucccuuuucauuucugguuuuacuaauuuggauacugccucugggcccuuuaguuuguuuggcuagggguuuaucugucuuguugauucucucaaagagccagcuuuuggguuuguugauccuuuguauuguucuguuuguuucuauuugguucauuuugucccugaguuugacuaguuccucucuucuacuccucuuagguguguucgcuucuuuuuguucuagagcucucaggagugcuguuaaguugcuaguauaauaucucuccaguuucuuuaccagggcucguaaugcuaugaauuuuccucuuaguacugcuuucauugugucccauacguuuggauauguugugucaacauuuucauugaguuccaggaagucuuuaauuucuuucuuuauuuuuucccugaccaaguuaucauugaguagagaguuguucaauuuccauguauaugugagcuuucugguuuuuuuuauugaaggcugucuguguguagaaaaauagaaaauagacccauauuugucaccuugcacaaagcucaaguccaaguggaucaaggaccucaacauaaaaccagauauacugaaucuaauagaagaaaaggugggaaagagccuugaacucacugauacaggggaaaauuuccuaaacagaacuccaguggcucacgcuguaagaucaagaauugauuaaugagaccuuaugaaacagaaaagcuucuguaaggcaaaggacauagucaauaagacaaaucggcaaccuacagauugggaaaaaaucuuuacuaaucccacauccgauagaggacuaauguccaaaauauauaaagaacucaagaaccuaaccaccaaaaccccaaacaacccaaucaaaaaaugggguauagaacuaaacagagaauucacaacagaggaauuuccaaugacugagaaucaacuaaagaaauguuaaaacuccuuagugaucagagaaauucaaaucaaaaugacucugagaucccacuuuacaccaaucagaauggcuaagaucaaaaccucaggcgacaguacauguuggugaggauguggagaaagagaaacacuccuccauugcuggugggauugcaaacugguacaaccagucaaucuggagguuucucagaaaauuggaaauagaucugccugaauacccagcaauaucacucagguauauacccaaaagaugcccuaccaggccacaagggcacauguugcacuaugucaauagcacccuuguuugugauagccagaagcuagaaacaacccagauguuccaggacagaagaauggauacagaaaacaugguucauuuacacaguggaauacuaaucagcuauuaagaacgaggaaauccugaguuuugcaggcaaauggauggaacuauaaaguaucauccuuagcgagguaacucagacccaaaaggacaugcaugguauguacucacuaauaauuugauauuagccaaaaaauaaagaaaguaccagaauacucaagagucuacagaacucaaaaagguaaacaagcuaaagggcccaaaugaggaugccucaaucccacuugggaggaagaaaaaagcaaucccauggggggggggaggguagggggggucggaacaggacagaggcaccugagcaggagaagggaugagggggagggaaacaugaucucaucuuggguuagagaaaggacugaagcccugaaggccagaagaaaagaauggaaacaggcaaccucaggacauaguaacauaguaggugggugaaggagaaccuccagaauguaccagagaccugggcagucucuguguguugacuguaucuuauuuucuuaagcacuuauauuuuugugauuuuguucuuacauuuguccaguuuuguuagaaaacucucuuacuauugaggucguuucuuucuuuuuauuccuuaauuuuuguugguguauucucuugcucuuuuauccuccucucuagauauauuuucugcauuccuuuucuuuacccuuucuuuaguuuaacccuuugucugcucucuuuugcccccuucacuuacuuacuaucuucacauuuacucuggguaauguuuaucuucguggcauagucuaccuuaguucugccacuuucuguuucuggccauuagugaugucuaaagcaacuuuaacugauuuagaagguauuucucuauugugugcuuuguuacuauugcaaaaguuguuuucucuucaugguacuguauauugagcccucaaagguaagcuacccaauaagaagaaaaaaaauuaaaacuaauaaaaccauuacacccaaaccaagauauauacaaacuagaacagagagaggagauacauauaaaagcaagauaacuuuaccagaagaucauaaaugcucagcuacuggguuuaagcguggugaacugugggaugaugacuucaaaaaguuaaauaauaaaagugaucaaugaucuaaaaggguguacacgguggggagaagaugaauuaaaucuacgaccuggagaagaaaguaggcaacgcagaaaaaagucagcaagguggcagaaacguucaguaaggaaagugagauuguggaggauacccaaaaggauauagaaaucucaguuaauaaaauaaaaaaaaaacaguaggaaucauuaaagauggacuuaacuggggccaggaaagauagaucaaugguuaauaucaauugcugauauugcgaaugaccuggguuuuguuccuggcaccugugugguggaucauaaccaucuguaacugcagguccaggggaucugaugcccuguucugggcaccagguaccaugaagugcaccuauaugcaugcaugcauacauggaaaauacucauuaacauaaaauaacauaaaucuuuuuaaaaaagaaguccaaucaagcauagagugucaggaccagagaacagcaucaaggaaguacuacauucaaacaucaaagaggaaagacgggaagaccaugacuguaagauucaagaacacugagauacauccauaagaccagaccacaagauagaaacagaaacugagcuacaugcaaacgacauggagaauuuuaauaauggaguuauaucauaaaguuucucacauauagagaaagaaagggacacccaaggaaagacagaaucccaaguggauaugagcagagaagagcuucuauaauacauauuguagucaagauaguauaguuagugugcuaucucauaaaguagauuucaagucaaaauuagaauaaaaagccaacugcagacuaauaagcagaacaguucaucaagaucuaacaugggagacuaauaaaacaacugaucaagauauaguguaauuauauguggaucaaacagcagggcuuccaauuucauuaaacaaauaccaauaaacauaaaaagucaaguaagcccagguacaaagauaguggguuauuuuaauauccugcucucaucaauagauagguuguccaaacuaaaaaucaucaaagaaauaccagaguuaaacaacaagauagauguaauggacuuaauauaauaaaaaauuauauucaacauguuuagaauauauauuccacucagcagcuuauggaacauucucucaaagagaauacuuccuaggccaucaaauaaaucuuaucagauauaaaaguaaugaaauaauuuccuguacuuuauuagaccauggugggggggaggggguggggcucaaaucaauugcaagagaaacuacacaaauaaacaaagacuacaaaaugaccagugggugauugaauaaaucguaggggaaauauaaaauuuccuagaaugaaaugaaaauaaaaacacaacuuagcagaacauuugggauacagcaagaauagcucugaaagccacggcuacgcugacguuacaagucaaagaucacaagcaaauaacuuaaugauacaccucagcucuuagaaagucaagaauaccacaaaccccaacgcaauaggugguaaaacaaaacaaaacaaaaaauuaagaaaauuuaaucuaauggaaguuuuuuuuuuuuuuuuuuuaaaaacacacaaaaucaauuaaacaaagacuuccaugagaaaauguaaacaauauguagaugauaccaaguucugcugccacccagaacugcagucuggccccuuucuacuauggcuauagucgccucuaugccuccguggcugaauggggaggcacuucacacaguugauauccuugaguagggaaugucuucagcugcauuuuccauucauucucgccucugaacugaauccacauuuacccauuuacgagcuggaaccuuuggugggcggggcaucuuuaacucuaaggcgucguccuuacugugccagggcgauguuugagacuuuucuuaguugcgccggucucuuuaacagcuacagguccuuugugucugugccuuugcugucugcgacuguaaacucauuccugggcuuugcuucauccaacuggguacuuugcaugcacuugugcuuugaauugugaucguugaaccucaguaagcagcccaaaugcugacugugccccaacuuaagguuucugucagaagacgucuuguuacucuugaauuuacccucauucaaacuaucaggauauggaaaggaaacugccaaaaacuggaauuuuugccagacuguaacacaaauggccucuuauccuauugucaaugguguucuucucugaagccucacgggcacucgccuuuagcccucauuucugucagcacucuggucuucagaauggucucccacggaaugacucauuagggcucccguagcuuguggcuccaaacucuuccacauucuuccuccaaacaaguuccagagacccacaagucacguggucggguuaaucucgacgacggcccuacuuacucaguaucgguuuucugccuuaguugcuuuuucuuauugguaaaaugcuggacacaagcaacgaaaaauaaaacgcuuguuuuucucgugauuuccuccauacacauagcccauaauaacugggaaggugugguggcgagagaagaucaggugcugagggagcauucagcaaaugcugcuguuucuuuuguuuuguguuucggauucauucuccgaccccaaccgguggaauggcacuccucacuuuugggguggauuuuccucaguuaaauucgaaugcccccuagacagacccggaauugugucuccuauaugucucuaaauuccauugacgauuaagauuuaccaucacugugugugugugugugugugugugugugugugugcgcgcgcgcgcgcaugugacuguguguugugcuuacaugcacacauguguuuagcuaaugaaugcagaaagggagccaugaauagagaagaaacaaucuuuaagaaaugguagaaggggaaaagaugaauaacacacauaugggaauacauaagaagugaaaggaauagaccguucuuuuuagagggaggaaaggacccagcaagacgguaaaaggguaaaaaauaggaaagcauaaagguuguguguguguuugguaacacaaaugccauaaugaaacccauuacuugguguacugacuuuaaaaauaauuuuuucuaaaagagaaccgguggugaagccuagcuggagagaguguuuguugaucagcauccaugaagcucuggguucaguccgcagcaccaugguuaccagaugugcuguuguauccccguaacagcgcagguggaagcagaaggagcagaaguuccagcucaccuucggcuacgagaugacuuugagaugaccuggagaaagacccugucuugaaacaaucccagaaagaagagcaggcugagccauugucaagccagcucaucagacagaucacuggaagaaaaaguaagaaagagccugccuuaggcugcagagauggcuugcugguugagagcacuucuugcucuuccaggagacaaggguucaguuuccaguacccacauaaagcagcccauaagugcccgacacaccagcucaaggggauccacuuguucugccccccuccaccagcugcacucacauguccauauccccacacaggcacaaacgcacagagagaauuaaaaauaaacaugagaagagaagagccagccugaucucagaacaaauccccgagagucccuucaaacgccaccucugcacagauucaauuccaucagauaaauacacuaaaugugauuaugaaaguauuaaagugcauuuaacuugcuuuugcuuuuuacuuugcaaaaaugcaauuugacaaaacacaauguuacagucuauucucaggcaagaaccaauaagaacguuaagauacuuaacaaagcaguguaaagaagcaggaugggaucaacgaucuauugagcuuagaaaaugauagagaugcugacuuaauuccauaccacauguguagaguuccccaaauuaauagguauaacacaacaaacuacaaauauguaguuguucuuucuucucauuuuguuugguacaccuaaaacuaaaauguaauaguuguaauggcauauuauugucuuaguaauauaucuagaugccauauguguaaguauacuauauaaaaacaauguuucugugucuuauuauaauuaaguuuguauaaauuuaaaggagauucuaggaagauauaucacugagaaaccauuaagaaaauaaacuuuuaaauggcaaaaagguagugucaugucugcacguugguacaugcagggaagugcaggucucaggcuggccagugauuuuuaauuccccuugagcuggagucacaaaugauuaugagccacacaagugugggugcugagaacugaacucagguccucugaaagaacagcaagugcucuuagccacugagccaucucuccagacccugguacauuuucugagauugacuauauucuagccaucaaaaagcaaaucucaauaaauuuaaagagacaaaauuuguggaaaauauuucucuaaucaaaaggaauagaaauuaauaacaaaauuagaauauucacaaauguguggauuaaacacaacugacacauaaucggugugucgguggagaaauuaaaauagcacaaaguacuuuaggacaaaggaaaaauaaaggcacacuauauacaaauuuguuauuuuaucuagcuaagacaguaauugaugggaaauguuuauauuuuuuaaaaaaggaaaaccuucuucaaugacggcauaacgguaccuuuaagacauuguaaaagaagaacaaauuaagcuaaaagcgaauauaaagaggaaauaaauauuuggcacagaguaguaaaauuagaaaaaaaaaaauguugcagucaggauggccaagcagucaagacuccauguucacaauguaaaaauaauaagaaaaaaaaaggucaacaaaaugaaaguugguuaugcacaaauuacuaauauaaggcacaaggaaacaaaagacauugccaucagccauauaaauacaaaggaggguaauaaugaaugcuauggauugcuguguuccaaaaaaaccacaccaguugggugagaauucaaauuucugaagacaggagcugcuggagcugacucugaguagagccucugaguagacuuauaagggagagugagcuguuagcauuucagaaaccuccuaaggaagaaaagccaacugccggugauuucaccagcgaaugucucacuuacagcaugauuaguucccgaucccaaacuuuuucaaaaacuagaagaggaagagaacauauugugacucacucgcugaugccaguguuucuuuaauaacagaaccugacaagacgccgcaagaaaaggaaaccacagagcgcgaccacguaugauuguagauguaacauccuuccgcuaaauuaaaccuaaucaaacccagagacaagcaaaaaugacuguaauccaugacuacgcaggauucacaucuaggaauacaaggaugcuuaaaugaaaagaaauugacuguggcaauacaaauuaccaauggaaacaaaagaaaacaaacaaacagacagaaacaaaauauggccauaccaucugaugugguagaguauuuagcaauauucaccauccagucugauaaaagaaaacacccugccuaauauaaaugaaagaagucccuauucugguuaagaguaccagaaaccaaacuaauaccacaaagagcacaccuacaauggcauguaauggcaggagauaugauuuccuguuauacugaugaugcacaggggagaauaugcugcagccuuaaacauucauaaaaugaagaguuauauuuuuaauuucuugugauuuuuuuauauaauaaaaagucacauugucagagaauagaguuggucugucuccuccugccuagucugacugccucauguucuugccugauugucuuauguggcaugcccaauacaaucuugaaaaaaagcuagguaagagcagacauccuuguuuugguauuuacuaucaugugaaaccauucugucuuuaagcauuaaauguuaucuuagcuguggaguuuuacuucuugcugcuauuacuguuuuuuuauaucucaauuuaauagaauuucauugacacacucuccccaguuggcuauuugauaaucuguugagguccuucagugggaaaagaauagugcuuucauuuacaagggcuguggugauuauauaugacagaaggauggaaggagggaauggaagauggaagggaaggagagaaggagggaaagagaagaaaacuggacacccuuauuacauucauacaaaaauccucuuaacuccaauagauccuacacugaguauaagcuacuagucuugagaaaaaacagaacuaaauuuuuaugauccucgauuaugacaagcauuuguucacacaacacuaaaaauauaagcaagaguaaaauacauccauugcauuuuauugaaacuaaaacuuauuuaugcuccacagauugcuauagaggugaugagaugauuauuuuaaugggga

SEQ ID NO: 5225 - RNA, 4678 nt, Mus musculus
cauaaacugaaguugccagccaaaccgagccacgagagaggagacuuucugaaucucccucacaacccaggcguuugccgcggcggauguaaccugugcagcuccuucuucuacugcugcuuugcucacgcuuaaaucccucuccucacugccagcggugccagaagcagcgugaauuccaagagguccaccagcgguuuuguuucuguccgagguaaauacgcuaugcaaaauacggaaccaccaaaggaugccggggagggggaacagaaggggaaucccucaccuucucgggaugcguugcucauuuaucuccgccuaggggagucgcccagccuagguugccccucguaucccucccugaagccccuaccuggggcagcagagguggccagcgcggcggcgaucucuccugcagcccuggcccucccccgccccccggcuugguuuuucccagccguggagguugggccaggggcugggguugagaggagagucggcgcccgcagcaggagcugggaaggcgcguggacucggguggcccucggaguuggcuuugcaggcgcggggugcggaggugagcaguggggaccgagcggccagguuuggagccuggaggcgggaccaggguuccuuucuauacuagggcgugaagagagccggggggggggggguccuggcugccacaccgcccacggucccacggccgcuuuguuggcggguucccuccguuuuucuggagaugucuggauccucucgggaucggggagcuggguggccaggaacuggggagucgagaguaggcgacagcuguacggcucugcuccccuuuucacacuaauccaaggagguaccaaaaaaaaaaaaaagcucuuaagagucccguaacccgaaacuucgcucucaucccaaggugggagggggaggagcggcgggggcggggaccccggaaggcagguggucggccggggcgguaggagcugggauccggaaaaaggagaaguuugcucgcuggacaccgcggggucugcgugaaguucuaggcgggaggagggcaauccgggcaggagccaggcgggagguggcccggguccugauggugugggcccggaagagguaggcuuagcgccugggaguggggaccgcgucccacuagggaggaaggacgcacacagaagcuugggccggguugcuaguguggggacuacuugguucguacucggggagcugcggccgucacuccuccucacgcuucucucccgcuugucccaggucgcucauccgauccugcccugagagaggcgccaacaaaggaguugaggaggugccacccaccccagcugcggcgggaggaggagcgccaaggcccgugucccgacccgccgugcguacucacuggagggaagggcggggugccgcuccgggagggggacgcccgguggcucgggguuagccaaguuccagcuuuuggcguccccuccucugcucccacgcgaggaaaguuugccgucgacgcuugcggccggcucgcgcccgccgggcccaggcggucgagucuucggagcgggcgcugucccagcuccggggaaccgcgagccgcgaugccuggggcgggcucccggggccccuccgccggggacggacggcugagguuggcaaggcuggcgcuagugcugcuggguugggucuccgcgucggcccccagcucuucgguacccucgucuuccaccuccccggcagccuuccuggccucggggucugcgcagccuccgccagccgagagaugccccgcggcgugcgagugcuccgaggcggcgcgcacgguuaagugcgugaaccgcaaccugcuggaggugccggcggaucuaccgccuuacgugcgcaaccuuuuccuuaccggcaaccagaugaccgugcucccggcgggcgccuucgcccgccagccgccgcucgccgaccuggaggcgcucaaccucagcggcaaccaccugaaggaagugugugcaggugccuucgagcaucugccgggucugcgccggcuugaccucagccacaacccucucaccaaccucagcgccuucgccuuugcgggcagcaacgccagcgucucggcccccagcccccuggaggagcugauccugaaucacaucgugcccccugaggaucagaggcagaacgggagcuucgaggguaugguggccuucgaaggcaugguggcagcagcucugcgcucaggccuugcacuccgaggucuuacacgccuggagcuagccagcaaucacuuucuuuuccugccucgggacuuacuagcccaacugccgagucucagauaccuggaccucaggaacaauucccuggugagccugaccuacgcauccuuccgcaaccugacacaccucgaaagccuccacuuggaggacaaugcccucaagguccuucacaacuccaccuuggcugaguggcacggccuggcucaugucaagguguuccuggacaacaaucccuggguuugcgacugcuacauggcugacaugguggcuuggcuuaaagagacagagguggugccagauaaagccaggcuuaccugcgcauucccggagaaaaugaggaaucguggccucuuagaccucaacagcucugaccuggacugugacgcuguccuuccccaaucccugcagacuuccuaugucuuccuagguauuguuuuagcucugauaggcgcuauuuuccuccucguuuuguauuugaaccguaaaggcauaaaaaaguggaugcauaacaucagagaugccugcagggaucacauggaaggguaucauuacagauacgaaaucaaugcggaccccagauuaacaaaucuuaguuccaacucggaugucugagaaaccggacccgucaaggaggacucugcaugagguguagacuuaaggguuuuuuuuuccccuuuacuaggcuugcuccacuuccacacuucaccguagacacuauugacuuugauccuuguuauguaaaaucccgguguguucuguuaauguaaggacaugaacaacugcacauguuuauuuucccuauuccuuucgguacuccucgaugccugcggagggauuguuuuuuuuuuuuuuuccucucucucaagucgcagcauggacuuggauuaguucaguucaagguguagcacagauaacauucaacggaagcugccucaguuuuuuuuuuuuuuugagaaaaguacuuuauucauaaauaugaguuucauccucaccuaccuaaaugauggaggaaauauugcauccccaaacugccugcagaccguagcaagcucuuacauagaacuuuguagugcauaagagcaccugcauccaagagcaugcguacauuuuacuguucugcauauuaaaaagaaaaaguugcaacuucagauaacuucuuugacaaacuaaauuacuuuuugauugcaguuuauaggaaacugaccugagauuuuucgguguuuuuuuuuuuuuuuuuuuguuuguuuugguuuuuuguuuuguuuuguuuuuuaaauaaacugcauugagauccaacaaacuggauuguuauaaaaaaaaucaauaaaagaaucuuaaaagaagcauguuguguuuaacuuugguauuuugaaaggaggauuaagggcaaugguauugaauagucuggauucaaauaauacuggaguuauuaguuagcagagcugagaaucagccuggagcagugccuucauauaaauagacuggagagaauucugaaaugauggauucuuuuagggcuuaaguggaauuaagguuauuuauagggucauaguauuagagguccccaaguuaacgguguucauuauguguuauuuaaaagagcauugggagguugguaauagugaagaguccuuuaugguaaacaugucacagcugccacuuugucuagacuaauuuaguugcugagacagaaucauuagccaaacugaaugaaguugcuccauggaauuugagagccaagugugagucaugugguggcaauaaaugugugaaaauaaaguaucuuaaaauauuuugaaguaaaaaaaaucuuaaaagacaaauuaagaacaguauuuucagagaucauaaauuguaguucagagagccucgagaaucugcuuuuaaauuuucaaaguggaacauuguguuucuuggaguuauuaugauuguguuuaaggaaauaaccaaagauacauccuuguaucuagagacaaauauuauaaguaguuauuagauucuuauguucaguauuuaagaauuugagggcuuuuuaaagaaggccccucagcucugagcaccauguaaguaaauguauauaccuccauaaggaauaaaucauacuuagguauaaauuaaagcaauuucucauuaacauucuugucauccgauacucuugucucgucucuaucccgccaccccucugccaucaugugccacuuacagugaacaggaagugucguuaaccugucuccaggccaucgauugaaggaacugagguucaacuuuuacuucagauaggaggucacuugcgucaauaaauguuaagacccguuuucaugcuaagugauucaugucuacauuugcuuuacaugugaaauaaaacuuacgauuugcuguuuuuauaaauaaaguggcucagguuauga

SEQ ID NO: 5226 - RNA, 4678 nt, Mus musculus
ucauaaccugagccacuuuauuuauaaaaacagcaaaucguaaguuuuauuucacauguaaagcaaauguagacaugaaucacuuagcaugaaaacgggucuuaacauuuauugacgcaagugaccuccuaucugaaguaaaaguugaaccucaguuccuucaaucgauggccuggagacagguuaacgacacuuccuguucacuguaaguggcacaugauggcagagggguggcgggauagagacgagacaagaguaucggaugacaagaauguuaaugagaaauugcuuuaauuuauaccuaaguaugauuuauuccuuauggagguauauacauuuacuuacauggugcucagagcugaggggccuucuuuaaaaagcccucaaauucuuaaauacugaacauaagaaucuaauaacuacuuauaauauuugucucuagauacaaggauguaucuuugguuauuuccuuaaacacaaucauaauaacuccaagaaacacaauguuccacuuugaaaauuuaaaagcagauucucgaggcucucugaacuacaauuuaugaucucugaaaauacuguucuuaauuugucuuuuaagauuuuuuuuacuucaaaauauuuuaagauacuuuauuuucacacauuuauugccaccacaugacucacacuuggcucucaaauuccauggagcaacuucauucaguuuggcuaaugauucugucucagcaacuaaauuagucuagacaaaguggcagcugugacauguuuaccauaaaggacucuucacuauuaccaaccucccaaugcucuuuuaaauaacacauaaugaacaccguuaacuuggggaccucuaauacuaugacccuauaaauaaccuuaauuccacuuaagcccuaaaagaauccaucauuucagaauucucuccagucuauuuauaugaaggcacugcuccaggcugauucucagcucugcuaacuaauaacuccaguauuauuugaauccagacuauucaauaccauugcccuuaauccuccuuucaaaauaccaaaguuaaacacaacaugcuucuuuuaagauucuuuuauugauuuuuuuuauaacaauccaguuuguuggaucucaaugcaguuuauuuaaaaaacaaaacaaaacaaaaaaccaaaacaaacaaaaaaaaaaaaaaaaaaacaccgaaaaaucucaggucaguuuccuauaaacugcaaucaaaaaguaauuuaguuugucaaagaaguuaucugaaguugcaacuuuuucuuuuuaauaugcagaacaguaaaauguacgcaugcucuuggaugcaggugcucuuaugcacuacaaaguucuauguaagagcuugcuacggucugcaggcaguuuggggaugcaauauuuccuccaucauuuagguaggugaggaugaaacucauauuuaugaauaaaguacuuuucucaaaaaaaaaaaaaaacugaggcagcuuccguugaauguuaucugugcuacaccuugaacugaacuaauccaaguccaugcugcgacuugagagagaggaaaaaaaaaaaaaaacaaucccuccgcaggcaucgaggaguaccgaaaggaauagggaaaauaaacaugugcaguuguucauguccuuacauuaacagaacacaccgggauuuuacauaacaaggaucaaagucaauagugucuacggugaaguguggaaguggagcaagccuaguaaaggggaaaaaaaaacccuuaagucuacaccucaugcagaguccuccuugacggguccgguuucucagacauccgaguuggaacuaagauuuguuaaucugggguccgcauugauuucguaucuguaaugauacccuuccaugugaucccugcaggcaucucugauguuaugcauccacuuuuuuaugccuuuacgguucaaauacaaaacgaggaggaaaauagcgccuaucagagcuaaaacaauaccuaggaagacauaggaagucugcagggauuggggaaggacagcgucacaguccaggucagagcuguugaggucuaagaggccacgauuccucauuuucuccgggaaugcgcagguaagccuggcuuuaucuggcaccaccucugucucuuuaagccaagccaccaugucagccauguagcagucgcaaacccagggauuguuguccaggaacaccuugacaugagccaggccgugccacucagccaagguggaguugugaaggaccuugagggcauuguccuccaaguggaggcuuucgaggugugucagguugcggaaggaugcguaggucaggcucaccagggaauuguuccugagguccagguaucugagacucggcaguugggcuaguaagucccgaggcaggaaaagaaagugauugcuggcuagcuccaggcguguaagaccucggagugcaaggccugagcgcagagcugcugccaccaugccuucgaaggccaccauacccucgaagcucccguucugccucugauccucagggggcacgaugugauucaggaucagcuccuccagggggcugggggccgagacgcuggcguugcugcccgcaaaggcgaaggcgcugagguuggugagaggguuguggcugaggucaagccggcgcagacccggcagaugcucgaaggcaccugcacacacuuccuucaggugguugccgcugagguugagcgccuccaggucggcgagcggcggcuggcgggcgaaggcgcccgccgggagcacggucaucugguugccgguaaggaaaagguugcgcacguaaggcgguagauccgccggcaccuccagcagguugcgguucacgcacuuaaccgugcgcgccgccucggagcacucgcacgccgcggggcaucucucggcuggcggaggcugcgcagaccccgaggccaggaaggcugccggggagguggaagacgaggguaccgaagagcugggggccgacgcggagacccaacccagcagcacuagcgccagccuugccaaccucagccguccguccccggcggaggggccccgggagcccgccccaggcaucgcggcucgcgguuccccggagcugggacagcgcccgcuccgaagacucgaccgccugggcccggcgggcgcgagccggccgcaagcgucgacggcaaacuuuccucgcgugggagcagaggaggggacgccaaaagcuggaacuuggcuaaccccgagccaccgggcgucccccucccggagcggcaccccgcccuucccuccagugaguacgcacggcgggucgggacacgggccuuggcgcuccuccucccgccgcagcugggguggguggcaccuccucaacuccuuuguuggcgccucucucagggcaggaucggaugagcgaccugggacaagcgggagagaagcgugaggaggagugacggccgcagcuccccgaguacgaaccaaguaguccccacacuagcaacccggcccaagcuucugugugcguccuuccucccuagugggacgcgguccccacucccaggcgcuaagccuaccucuuccgggcccacaccaucaggacccgggccaccucccgccuggcuccugcccggauugcccuccucccgccuagaacuucacgcagaccccgcgguguccagcgagcaaacuucuccuuuuuccggaucccagcuccuaccgccccggccgaccaccugccuuccgggguccccgcccccgccgcuccucccccucccaccuugggaugagagcgaaguuucggguuacgggacucuuaagagcuuuuuuuuuuuuuugguaccuccuuggauuagugugaaaaggggagcagagccguacagcugucgccuacucucgacuccccaguuccuggccacccagcuccccgaucccgagaggauccagacaucuccagaaaaacggagggaacccgccaacaaagcggccgugggaccgugggcgguguggcagccaggacccccccccccccggcucucuucacgcccuaguauagaaaggaacccuggucccgccuccaggcuccaaaccuggccgcucgguccccacugcucaccuccgcaccccgcgccugcaaagccaacuccgagggccacccgaguccacgcgccuucccagcuccugcugcgggcgccgacucuccucucaaccccagccccuggcccaaccuccacggcugggaaaaaccaagccggggggcgggggagggccagggcugcaggagagaucgccgccgcgcuggccaccucugcugccccagguaggggcuucagggagggauacgaggggcaaccuaggcugggcgacuccccuaggcggagauaaaugagcaacgcaucccgagaaggugagggauuccccuucuguucccccuccccggcauccuuuggugguuccguauuuugcauagcguauuuaccucggacagaaacaaaaccgcugguggaccucuuggaauucacgcugcuucuggcaccgcuggcagugaggagagggauuuaagcgugagcaaagcagcaguagaagaaggagcugcacagguuacauccgccgcggcaaacgccuggguugugagggagauucagaaagucuccucucucguggcucgguuuggcuggcaacuucaguuuaug

SEQ ID NO: 5227 - RNA, 2044 nt, Mus musculus
guuugaagaucuugagccauaguggcuauggauuccagaagauugaaucuccgaguuuaaggaacacaccuuuaaucugggcuacaccuuucaucugggauuaaaggugugguggaacacaccuuuaaucugggcuacaccuucugcuggagacaauauaaggacauuggaagaagggagucuagcucuugcucuugcuccuucgccugcuugcugcgugagacugaguaacugcuagauccuuggacuuccauucacagcugcgacugaacaauuguugggaauugggcugccaacuguaagucaucaauaaauuccuuuacuaucuagagacuauccauaaguucugugacucuagagaacccugacuaauacagguaugaacacaguucugugggagaaagcaauuguacaugggaaagaggaaaggcuauaggaagauggguuuagacagggcuuucagguaauggugcuucaucauaggauaagaagaggccugugauggguaagaaaggucuuaggacagucuuagaggagaugcgauguggaugaagugugguugaaaaguaaaugaggcucugcuauagcugaaguacugaguacaguuucauagaugagguggcugcaaagaacagcaaguuaucauuuccagcuauggaugcugacagucagaacucacaguggcagagagcugaguucuuacaagaacucauuucugauucauagguuucugacuucugguuguguccucauagugguggggccagugagggagggagagugcuaggggcauuucuaaugaggaagcaaaccccaucucucagacuaccaccuucugcuccauugucucccaacagccucccugaugucaucccagagggcauagaauuuuaauauauucaugauggaaugggcccauacauccaguccauuacaggaccccugaaagcaggcugaagcauggacggaaccuugcagacaauaagaaaccaugaaaauuguauuagccugauucaugaucagaucucuaguaugauaaauguugcucucuggcauuugcagaauccacucaggggcuauagggagaaaaguauucccauuugccaauaguugcuugcacaaauaguucuccccaaggguaaaaacugacugaguuguaguuccuaggcuugaccaagaggauagggcaagacccacagaguuggcuggggaacaaaaugcacacucagaggcuucugucuggguauucgaggaugccaugugauucuguuaccuggauaccgguuuccaggggagugauguccaggaagaugggggcaguaauacgcuugguauuucagccaguuguauuugaagaaaagauaauacacacauaugacgcucuccaguaaucugggaagcagggacagagcuccacugugucaccccuucucugaccucuccucugaagaggugcucuuaggucaccucugaaagguuauagcuaacggcguggcuaagaccucauacagaacucagccacagauuagcucugcugcucucuagcucuguugucuucggaagccucauuuuucuucauguauaaaagagggcaagagggguggugagcuccuucagagguaaagguaguugcugcuaggucucaggaccugagaacucuaagcccaucugguagaaggaaaggacagauucccagcaaguuguccacucaccccaacacucacuguggcacgcacauccccucgaauaaacaaauagauguaaaaaaaaaauaaagcaaaacaagaugugauaggaagagcauauucaauugaaagcuguuucucaaaauuaccauguuauaccugcaaguaagaucacuaaccacucacaaacucaccugggaaauuccugucucuugcuaauuugcagaauuaucuccucccuucagcccaacccauccauccauggaauuaaucccugccacucauccguacuucugacacagguccugaaauccuacuuccucuggacacaaagagccacgguuugaacagggaauuac

SEQ ID NO: 5228 - RNA, 4098 nt, Mus musculus
acguaauagagcagccuguaaguagucaugaugcuuucuaaggauuagugacgugauacaaauacauaggcuucucacaaucuccccagaaggagugagaguagaaaggaagacaagagaagcgcucguacgugagcccggcuuuaugcucacaggagaagucaucacccaggugagugucacagagcaaggcgagaagcccgacucgcaugcagugauggaaccccgugugcuaguagucaguguaaauagucuaagcuccacaaaaggcaacuucagcacaugcccgugcuucacaucacugggaaagauaaacaaaauuccaaacagcagcaggcuuccaagggcaggggcacaccugcagcugcucccaaaggagggccaaaccagggcuaggaagaaauacaguaacucagaggcagggaccacuacccuuguaggcagaugcuauugauauuguuaaggaucagccucccucaagaguacagugaggagaccggauggcccuguacacaucgucaucaucacaggcugguuagaguuugaguauuucacaauacccaaacaauaucccauuauuccugaaauuucaguaguagcaauaaaggcagauaaguugaacagugagcuaaacaaugcuaaauauguugugucccuaacaugcaggaaauugauguuagguccgguucuuccucccagccccaugcucccagaaauacgacucagacuccaaauacauuuacaaauaccuuggccuaauggcuaagcuuuacuuugacuagaucauaaccuagauaacccauuuauuuuaacugacauucugccacaugccugguuaccugugcucagguaccaugccuccaucuccucacuucuccaacagaucuucccgugcauggcucuaagccagaauucauuuuccucccagaugucccaccuuccauucccugucugaaccauaggccaucaguuuuuuaauugacaggugaugcauccauacgauacacaagcuauucucucuacagggaauuagcugucuugaauaagccaaaguggaaaagagacaagguaauucuucauggagaaacagacugguaaauacucagcuaaugccacauucacccacugaacgacaaaggaccaauccaaaaguagaguacuaggcuuagaauauagaguccacugcugugcuaccaugaaugugcccaguuuugucugaccuuggaagcuuggcaucaggcuagguuaauucuuaggugaggagggaauaucaccacaagcuacagccuugaagccuaguggaauugccacccuugggguuuagaaauuuuuuggucccuugugacccaugaacagaaauuuuauauucuguaucuuagacuuguaauaucaagggaccaaaaaaaaugucuucuaguucuauaggucuguagauggagaugacuuuccccaagacucacuaacaucuggcuuagauggcuaaaauaaugacaauaugcagcuuggaguugauacuguaauggauugcaacgcuagcauuuugaaauaacuuuauuuuacauggaggaugagcuaggccaaggaagacagggaagaaaggcugcuggcucucaauauguccauaucuugucucuggaaacuaguucuguguuaccuuucaugacaaaggggacuuuggcagaugagaucaggaagagaccugacaugaguuauccucgguaauccaauguaaccaccagagucuuggcaaggaggacacagggccgucagaggcagaaagcaaaagaagagcucacagugacaugaggucacgauccacagauugagccaccuguagaaacugaugaaggcaagaaaauagauuuuuccagagccuccuauguuagcuuucucugaaagaaauuaaugaaaaguguauuugggcucaugguuucagagaccucaaauccauggucauuuggugcauccuuucugggccaguggaaguacagcaugacugcaagaguguauagagaaggagacugcucaccucauggugaccagggcacagaagggucagcaacgagacccagcuucccaaagcaugccaacaacuagguucucugccucuauguuucugucacuucuguuaguccauuaaacuaggaacccauuaacuaauccauaaugagcucagagcccuuuagauccaaucauggauuagauucuucugggauucuugccaccuauggucuuugcuaugcuggggaccaaguccccaacccaggagcccugggaggauauggcacauccaaaccagaacuuuucuagauggaacacagccaaguuaauacuuuguuuuuagcuaucugggaaugguuuuagacuuguguacuaggaugauaagaaguucauguuguuuaaagacauauaacagcaugaaaaauuaacagcaauggaaaauuaacucagaaccaacaucccugugaugcaccuguagccugcuggacuggcugaacagaaguucuuggucuugcucagaaaucuugugucugcuggaagcauuuaggggacugagagagccuagccucuucacuuguaagagguuguaaaguauucgguuuuucaugauccuuaacauucaguacuuaaaauugugauaacucagggacuuucuucuguuuaggacuccaggucuucuucuagcuaauuaacuucacaauauggugucucuugaauaguuuucaugaauaauuaagaaguaguucacgauguguauuuauauauaguugaaagaauuacgcuaauacucgggcagauuaguaagaucaauauuguugcauuggguaaaaauauacaugaaggaagcaugucucuaucuguaagaacucaaaguggcuuuaaugauacuauaguaacuaguucauguucugcucuacuacuucauguuacucucuuaaagaaucauacuuccuuuugaagacauuaugggaaagggauuuccuuggguggacuuguucccaaacgaaucgccuguguggcucugagacgccgucagcacacacacucucucagaaaucagggagauauuuaggcacagcauaggauagcuuuuuagaggaauggaaacuugccugugugaaaaucaaagcagagaaaauuccugugcgaucaaaugcauuuauuaugcaacuuaagcaagacaaagggugaacaaauucguaaaguagaugccacccaucgauuagcagcugcucaugcauacaacucucugugugcaaggcugaguucuuuccgacaccagcaaaggguugcuuccuccacgaaaugaacaucauguugcucaaauuaucaucgcaauccugaacaucugcuacuguggcacaaacaacccacugacccucucagcuccaagccaggcagccgacacccacacaucugccacgcagaccauggcaaggagcgucuuguucugaagccaaagaguucagaagcgcgagcacaggaugcaaacucggagacaccgagaagggacccacaucaggcagaugacaaucugcccuagcaguuuuugagagcacggaugcuugugaaacaguuuaggcugguacucacuggagucaaagcugccccaguuuaaagccgggguggguggaguucaucacauaaacugcugcggcaaaacucgcagagacacuguccacagugcaugugaggcuccugugcuccugguaaagguuucccuagcuaaagugagacucugugaagggcugagcaaagggaggguaccaagcccuggagaaccugcccugaaagccagggugccauguucuauuaucuacuguuuauguguuucuuagcaugucuuaaacgcuaagucugaaagccacaaaaauucuagagcugggauaggucaucuacuccagacaggccaccuuacauguaaaaccauggcaguccagagagguaaagcaacuuguuacaggcagagaauggugggaaagggcuagaucagacugcaguaaccuaacccucacccaggagggggcucaauugcauauauguggcuaauuguuucaauaaagaagccuuaauacugucaaugcauuuuuuuaaucc

SEQ ID NO: 5229 - RNA, 5283 nt, Mus musculus
uuuagacuagggaauauugauuguaguagaaaaaguuguagaacugaccuaaagaccucuacaaacaaugacacuuggaaggcaaacuaguuaccagcagcccauuccugcuuguacauuugcaucauguaaaugauuauacuucgguucacacagauaaaguggcuacacuuuucauuagggacuucuacacuacaggucacuacaggccaucuuaaaucaguaacaggagugagggaacacaaugccccugaauuaaagaaguuaacaggcaccaucuggggaaugugaacaaugccacaugauagcucuuccacucucuacugaaaugcugagacuuaugauuggaauuugcguggaacugcacuuggcucucuacacugcagugcuuaguacacaauccaaaaaguucugaugugccccacacuuacagcauuaauuuaaaaggaagccuguaaugauauuugcacucagaaaacuuguccuguuaaggagcaacuuucuuugcaagaguacuaaguggcugcaguuucuggauuauguuuuuaauauuucaaaaaauuaaauaguucaaauuaugaucucgagguggaugagaaauuauuauucauuuaaguuauagggaagacacauaaagucauacuguaagauaauaauguugaaaaaaacuaucuugccuacaaauuuucaucuuauuuggcucugguuguuauuucaagucaaauguccaucauaagaauuauuuugcuucuggaagaacaacuuuccuaauucauaugaacugaucauaauggcacaauguucuucauuauaguccaggcugacaaauccaaaggugcaggaaagaaccggacaaugauccugaaguaaagucgaucauaaauguugauucauauaaaccagauuucucaccucuuuaauuuuucauaauuauaccaguacauugcugagaaaggcacaucucuaauaguaggagcccagcccuuccaaagagaaauccaaccaucuucagacagucucaugcucacaaauugauauaauuccuuguaagaaaacuucuuagacuaacugcaccuuaguucugaucaauucuaauggacuuaucacuguuaccgcaccaaaucuggcgacaaccccagcaacuauugguauucgaguuucauuuucuccuaauuuggcuuucagaaaagcacuuaacuguucauagcagguaaaauaaauaacuguggcaggaauugccaucacuagaguaggagggaggccgcuccacagggauuuuaugcccucauuucgaagaauuuuuaaaaaggcauccaaugucccacggaaguuuccuggcuucuuauaccaugcuuucuugcucuccucuucacagacacacaugugauccaugaguccauuacuguauaaaaaacacuuuccuuuggggaauggguuguucugggccuggagucgaauuuuaacaacauccaggggugucaccauuagugaugucaguacagcuccaguacaggaggcaaucauuugcugaagaggagucacugggauuguugguucaggcuccauacuuuuuaacugguggcgaggcgacugcaaaggcccgggucccagccaaccuagcaggugaugugggccgcgaggugaagccucugaggcuaaccgcguccaccgcccaggcugcccuacacucucaagucugcagagcggagccggaacucgaggaggacacgagagagcaccuuccucuuugugauuuacaucuauuucauacuuacacgggucgggggauauguuugcugcaaaaugcuuuauuuaguuaacuaaacccucaccuuacuaguauggaguuggacuagcauucuuccaugucguagguaaggaacagguaauuuuugggaccuaaaauucaugaccucucuuagguccuccauaaaaaguggugcaaucacaaucugacuccuaaacugagggcuuaacuuggcuuguuuggugcuggcaacuuacuauauaauggucuucagccagggcguggacaugagaccaacuagacugucagcgagcacaaggaaugggcuggaccacucuuaccguugagccccaaacucaucaagcaauauucuuauccauucugacucgcacucugcuuccucagaggucuggguaaagagauguaacaguucagauuagaaaaaugcacucuacuauaaauaaagucauuuucuggucuguacacaaucucuuagauagaucaaguuugggauccagcuagaaauuugguuuggggauguacaaaguugagagacucacacaaccuugggagcuccagucggguuuuugggggucaagucauugcccuucccuaccugauuccuuagcaccauuaaauguucugaccugagcuucugaccuugaguccuuaaauuaccauauucccugcuccucaccuggaauggaagcagucuccacuggaauagaaauacagcaucugggggccagcagagcaauucuaccucagucuuuacaucuguuuggccugcuagcaucuaccuagcauguuccuacacacacaaaaaauggcggguacagauuaaauuucaaucaaucaacuaaucuacuugucaaggcagauccauucuggaagcaauacaaaaauacauuugcaagggcuagaaaguugacucagagguuaagagcacugauuauucuuccagaugacaugaguuugauucccaacaaccauauggcagcucacaacuguaauucuaggcccagaggauccaacacucuuuucuugucuccauggacacuaugcacauacgagauacaaauacauaauacauguauacagacacauaaacauacauacauacauacauacaugaaagcaaaacacucauacacauaaaaugaaaauaaauaaaaauuggaaaauauauuugcaaaccaacagauuggcaacugcaaaugaaucaagcaacaaaaucugugaggcuagauuaggaaaguccaucucggcugcggagaggguucuucacuugaucuuagccaaaaggccgagaagcgauguggagaguguucuugcuaggcaugucuagaaugcucaccacaauaaaaaagaaaaaaagaaaaaagaaagcaaaguucuguuucccuuccuaucauuugaugaguuaugagagagccuagaaaacaacaacgguucuauuuugugucacacacacacacgcacaaauguaaucaaaacucuacguguacagaauucaagucauaagugggacugauagcauaauguagucacguugaacuccagcuuggacaguccaugucucgugagucaugagucccaugaugauaacugauuccaggaagcaguguaucagucuagacaccucacucuuuuuuuuuuguuguuguuguuguuguuguuguuguuguuuuuuggagggggggguuucaagacaggguuucucuguauagcccuagcuguccuggaacucacucuguagaccaggcuggccuugaacucagaaauccgccugccucugccccccaagugcugggauuaaaggcgugugccaccaccacccagcuagacaccucacucuuuuagugcuugcccaacgaucucccucuuagcaacugcccuucugaaaucuacgagaacuacggucucccuguccuccuagguugcuuuucccagcagcauccugcucuuugccacucgguagccucuaagggugaaaaacaagacaaaauguucucaagucuucacacaagggaaccaaccaggauuuucccacaucuaggagauguauaagagcauuggaagcacaagcgcgggcugggauuugaauccccagaguguaaaaagcugguuauggccacaugugugacuguggugggcagagacgggaggauuguuggcugccagccuagcuccaggaacaaugacagaccuugucucaagggaacaaggaggaaagauugagacuagccugggguauguaaugaguucuaauccagacaaguauauaugccaaaccuuaucugaagaaaaaagaaaagaaagaauuaaagacaguaauaaaacauuuuuaaaaagcuacacagagggaggaaaguggagcagggagggaggaaacgagaaaauaacuaagaaucuucucuuacaugcuggaggauuugucaaguuggaagacagaguucauuauggaagucuucaaacuggaaagaaacaaaugagagaaaaaaaaaagaagcaggagacaguaaauuacugagacugcuaccguuuccacagugcccagggccagucauggcucagcagguagacauacucaacacacaagccugacaaacugaggccagcccccagaucccacaugguggaaaaugaggaucaacuuccaaaguuguccacugccuccacauaugcacaugggauuguacacauguucauacacacacacacacaaacaaacacacacaugcacauaugcacacguaggcacacacacaucccacaguaauaauaaacaaaaauuaaagcauauaauaauucuagcucaucuaauagguauucuugacuuugcuggagcacacaggaagaaaggugagacauuuuuucaggaaauagaccaucugaagcuaagaaugagcagaaauuauagucuacaauagugucaauccagaaggcaguaacauucuccucagggugucccccuguggcuaugcagaggguguuuuaguuuucuugucuauuuuucuaacagaaaauaaauuugaggcugggguguagcuaaguugguugagagcuugucuggcauaccuguucugccuccagcacuucauaaacugggugguggguacaaaccuguaacuccaguucuccuggggugaaagcaugagggucaggauugaucaccuuccacuacauaguaaguuuuagacuagccugugcuacuugaacccuuaucuagacaagccaggagauggggggaggaaugccacaaagauagaaccuuuuaguguguaccaguuuuggugcagcaucucgugcuggcuguuuugaaauccuuccaaauccuugccucugccaucagucuguuccuugugcccgugaccuacccuuauccacuagcccacuuuaggacauucggguuguuuccagacuuugacaauuaugaauaagagugucuaugcauacuugaguccaguuucuucucuuucauguagaugaacaggucaaggauuuuaacuucaugagaaauugcccaaaccauu

SEQ ID NO: 5230 - RNA, 2308 nt, Mus musculus
auauuugcaauugaauguuuuuuauuucaauacuccccauuuuauuucaaucacugccagaauaaggaaauagcucauaaugaugaacugcagcuuuauagucaggauugcauucagucuguacagcugugucugucaaucagcucaccuaugaccuucacagaagagaacacugucgaauggauugucaaaacaauccauuuacauacagcccacaaaaaaaaaaaaguacaggaaucaacucugcaggccacaccagaugcuguccugauagggacagcuagagacauguagauagaccccaucucaaacaucccaguacuaagacugcauuuuuuugucuaugcuuuuucuggauggucacaucuaguuuucauucgcacgucuugugucacuggcucuaaaauauaaaaauaagaacacaggcauuauguuacugccaacauuaaagaagaacacaauaguccuuugcaaugguccaucucagaagccagauccguaaguaugguuuuucaacaggaauucagguucgggauaggaucaucauagacuagaccaacgacaguaagcucagcagaaaacaaaacagagcaccacucacaugcacuccugcugcaggaucuucacaggcggacuggcaucucucgcaaguucuugugucacuggcccuaaaauauaaaaacaaaaacacaggcauuacgucauugccaacauuaaagaagaacacaauaguccuuugcaaugguccaucucagaagccagauccguaauuaugguuuuucaacaggaauucagguucgggauaggaucaucauagacuagaccaacgacaguaagcucagcagaaaacaaaacagagcaccacucacaugcacuucugcuguaggaucuucacacgcaggcuggcaucucacuggucagcauucacuacagaaagagguaccaugacaugcuaugaguaagaacugcauuaacaagacuaccacuuaaacacaauggucuucucucagaagcugcauuuaucuucaggucaucaucuucgggauguauuucaucacuguucugacccgguaugucucacaacuguuuguacaaucaauuuguacaccaugcauucacaacagucacuccaaauugcaaaggccagaguaguuuggccaggacuacuucacaauacauuuccaggaacccggauucuuacuucacaacgguauguuugcaugcuuacaagggaaaaaaucuaggcuucaauacacacccuuuaaaacggucauguuuuaagcauguuucuuucauuuaucaauucucucagaugcuuugggcuccccuccaucuaauauaaugaaaaaucaaaaaacaaaauuuaagcaucacacaucacuuccuauugcacuauaacaauauucuuaaaauauagaagcugcaucgccuuuaccuugguuucuucuuguagcugcuuugaagacgcgaagaacaauggcgccauuguccuugugaacgugcauauaauaggaugucucuuucggugacucuaguaccuucggaacagcacaaaaggcugcaaacccugcuguaaaaaccuacccacgcggggacucaggaacuagaacgcaugcggccuucagucaggccgcuuaguacgaaucucacuggggcccagacuccaaucccgaaauaucauuagcugcugcgcacuucuccgaggaaguuuacaccaguacccuaaguucaagucucagaagccuccaaauccucguugcaccccuauauuucacuuggucauccgacuguaacucacucaccgacaagacaaagaauaucuuaggcuccgucguaaaagaacgagcccgguucaccgcagcuccuuuuauagucuccuuugugcgagaucgaggcugccccucccucugucacugauuggacgcgagaguacgugggggcguggcuuuucaugaagcaacgcgugggagcgcgcgccuuggaccucuuuuuuuuuuuacaggccauuccggggcguggugcgcgccgcccgcccgccgccgcgugcaucuccguugcugcgcgcgcucccgcuggcucgccgccaccggucucuuccgagucuggcgggguggcucagcucgacguggcgugggaguggcgccagaauucaaacgaacugccgcaguuggaggcgaggucaccgccugcuucgagccuagucgacacggacggucggcggcagggaguggccuugacuucgccgcgcaggcagcuuugagcgccgcugguggagaagcuugguugcuacgguggccagcgcugcgcu

SEQ ID NO: 5231 - RNA, 37367 nt, Mus musculus
auccaucuccagaaagggccugccauauguuauaaaagcgggcccaaaaucuaucaguaaggagccaacugacugaaagggagaggaaggcacuuggugguaaaggagaauguuuuauccauugaccaggaggaaccaagagccuuccgguaugauguauacgcaugucuggcuugcuuugcccuucugaagcuucucgagcccuguacuccacaauuagaugaauaucgaguccuggaguauaguugacagccuuuguuagacccucugcagaagcauggcgaccuuuuguggucugagagagaggguaagcacacugggcuacgugcacaguccccagcuaucaagcaggaagggucaaggacgccacaccaugcuguuaucugccaacacaggacgggagucugcucagaugccuaaguggccugugcaccucugcagguuuacagaggcaggggauuuggagucccgccccuuaagcuccgagggugaugggcguggccggggcggugcuugccaggaauggcggcggucacgguaaacagugccaagcggggccugcgggccgagcugaagcagcgcuugagggccuugagcgcggaggaacggcugcgccagucucuccuccucacgcagaagguacgagaagacugccgggaguuaaacuccgggaagggugggcucgcgagucugcgcaggcgcaccuccccgggggcgcgugcgcgucguccggggagcgcgcuccgcaggcaagggcggcucucgcugguccuggagcuugugagggagcgagcugagcuuccgggcagguuuggucauucacagagcuauuuuguuauugcuaggaaaggcauuguagccauuaggagcuguagagacugucgaaucacucuccgguuuaauugaaauccauucgcauguguugaacaccuaguaaaccuuuuuuuuuuuuuuuuuuuuuuuuuuuuuuuaugaguuggguaauacagaugacaaacaugauugucgccccuaagggaucagggauguagcagaggaaggagacaaaaggaaccauuguagggcuggggauauggcucagugauacaacuguucaaaaaugcgcuguauuuuauuuguccauacuuagaacauacauggaauuugggucuguuuuucuaggaguuuuaaaucgccuguaccuuuauuuuggcaaaacucgacugugaguuuuaucuaaggggagauaacuguugaugcugugacuuagcugcguucacugcacagcauuacaccuuggguugcugcuucugaguugggguuguuucugguccuuauuuucuuguuuugucucuuuucuuacuuaguuuuccucagcuuccuuaagaguauauccucaacggaauuauuuuaaagaaaauaccuauacgauuggcacuauuuguaguugaaauguauucguguuuugcuugcacguauguaaguccauugugugugugugccuggugucuuagguuagaagugggugccagauccuuuggaacuagacagaguucaggaagguuguaagucccuuugugggugcuggaaauugaacccagguugucugcaagagcagcaagugaucuuaaacugcggagccaucucucuagucacaacuuuuaaauauauuguauauuaaaauaucuucaacuccaauuugguccauauuaaucaaauuuuaauuacuuuauugucauucugcucaauaccuauggguuccaaucuagagaccaauguuuucauuuaugcauuauaucuugugguuuaguuauuguucuauugcugugaagagacaccaugaccauagcaacuuauaaaaggaagcauuucauuugggcuugcuuacagguucagaaggcugcucugugaucaucuuggugggaagcuuggaagcaggcaggcaggcaggcaggcaggcauggugccgagcgcuuacaucuuauccacaagguggagguagugagaguccugggucugccauaggcugugggcuuuuggaaucucaaagcucacuuugaugguuucugugaccacagagguaagaagagugucuucagcaugaagcaagaaggaagucugacucaacaugauuugguaccugggguugguucaaacuucuagagucuuacacuuauuuuaggcauauuuaaacauagcacauuuugggagaaaaaucuccucauuauaauuaacuuaauucaaauucaaaagaguuucuaaauaauuauggcuugagccauacaagggacaugagucuucucccguagagaugaauucuauagauugacuacauguaacaaguuaagggucucgguguagucuccaucauauagauagugccaaggucaccagguuauuaaccaccucugcucucauuuguaaaguacacaugccaucucccauaaagaugggcucuacugacugagaaacaaugcucaagauagaggucuagggaggauaacugagacaaacauaagaaucuuaggagccaugcagacaguucagaggucaccaggcuguuagcuaaauucauuccccaccuucuggguguaaaacagguaauauaucuuucccuuugaagaaacaaaugugugaaccuaucauguucauugucauucaaacuguuacaucuugauuaccgguuuuccuuuguaucuuucagaaauucuuuuucauuagauaauaaaaacucuagauuaaucuuuugugucucuuaacuacuuuucuuauuuuuuuucuuaaucuuucucccucauagggccuccuagauuguuuucauuuggcuaaucacaguuuuaaugucuaaugaguauuccuuaggucucuuacugauuccuuucccuagcagucuauuaauguuuuauagauucaguuauuguuuucaguuugucugugaagacuaauuagaauuuaaaaaucauccccaucuuuugaauuaccuguuugucacuaaaucauuuuucaauucuauuuuuuuuauguuuaaaaaauccuucuauuuuguauuuuguuuguuuuuucaaaauaguugaaaauccuugauuggcuaugcauauuucugucuuuuggggguagugagccucaacugaggaccuuguacaugauaguggaugaaaccccuggcccuuggcauucauaaauauggauuuaugaaugaaaguguauuagcuacaagcuuuccucuguuuuugcagauacuguuuggaauucuaagggaagaauggagucugcccaccuccuguguccauguuuuaauggugcugugucuauaaauacuggcucaucuucccucugucuuauaggaaucauugucuucauccucccuuccuaacagauagcauaaaaaugagcuggaggaagaaaggcaaaugcauaugcauaaucucacaccgauuuuagcugugugucuuauuguuuauuuagcucuugcuuuucuacacucugcuguaaagagacuaagaaaaagacuuucuuauauaguaagcggugugaaaagccucaggccugcuccaaauccggguuuccauuugcuucauuucugccagcagcuucugacagcuucgcagggaggaauuccuucccuagccucgcuuugcuaugcuuugcuuaacuuccgucuccccuugguauuagauguaacuuugcuuucuuccccuaagucuuucugucagccauauuuguaagcugccauugcguuauccuucuuuccuuagcuugaaggacaggggggacagaaaagcaguggacacagaaagggaguaaggggccggcuucugagucuggguaagugcuuaggacuucaugagcacaacuuagcucccacugucugaugagcgauuccacucaauguggauucuugcaccaggagcccuuugcccccauuuuaaugaacuccgugagcaccuaauugaauggaaugacacugguugagcuaagaaacuuuuaccagcauguucucugugagagcuuguggacagauucagaaucuguccuuuaggauacauaggcagugacugacccgggacucaccauauagacugaaguguugaugugcgucccuacagauguagcaaagguucugcagagcccaguaagguuaggucucagugggacuuaaauggggaaaaucaaugggagaaauguccaaugauccaaggacuggaaauuuugugagaucccaacuuaauagaaaaaaacaacccccaaaaccucgagugagucccugagguguacugucaggaacuggaaacuggguucuuaucugggaucugaagauagacagcuuuucauuccaugacuucuuaaggaauuuccauagggucaagcauaggcauaguggagagaugaaggagucaaguaugcaaaucuugagucuugaaauaaaaaccagguaucagggugcagugucagcucaccgcaucacuccuugaaagaggcggagacaaaagggaggaauugguaagagaaguuacuaguuuaugaagaauauagucuuaaaaauuaaaacugccaucauuucccacuuaggugauugcccacaaucaguaucagaauuccaaaagaauuuccaucuuucugagcaugcaagaugaaguugagacggaaguaaucaucaaggacauuuucaaacaaggcaaaaucugcuucaucccucaguaccaauuccagagcaaucacauggacauggugagguuaacgucaccugaagaaauugcuuuacuucccaagacaucuuggaauauucaucagccuggugagggagauguucgggaggaggccuuauccacugguaaggcaucuuuucuuacauccaaacacuuaccuuggugcacccucuuuccucugaucuuggaagcuagcauggucauacuuggcuagcuugggagaacugauaucuuuguauguuuugaugguuucacuggauuuguuuuucuucucauaaaaaucuuuucucccuuuuuguguauuuugugagacagggugucacuauguaggcaagacuggcuucaaacucucaaaguccuaccuccccagugcugugcuccugggccuacaccaccucuccggcuucuaccagauaucuuuaucuauuuuuuggucagaucuauuguaugccuaggaagcuaaggcccaguuccuagaaggacucacccugaagcugggaagacagaaauuucauguuaauaaaaguaucucaacuuguacucuacauuaaauauaagcaucaaauuaaaaaagacauucaaucaguucagggguuggucuugcaaaugugcaccccuuacaugggcuucuucaucaccauccucuucucuccauccauaccauguuuguggcagcaguuguggcuuuugcuccugugauacaacccaaguugcaguggaguagaguaugaggcuuuagagucuuucagcugugguaugaggcaccgaaccugccccccccccccacuguuguuugcagaaaagucugcugagcaggcaugcuuaucgaacucagugugcaguuuuccuugcaucagcaguuuagaaaguggcaaguucagugcuaaagccuaaaucaagccucaccguguuggaggugagccagugggagcgcagaucaucucugcugcagccuuugcugucuacucgucuuccugguuugccuuuguuaucucaccuuagaaaagggugaacuuguagccagaguugcaguuacagauucucaaguaaaaauuucuuguaagguauucuugucuuagguuuacaggauacuaaaccagcugguaagugaaaauagagggucugucucuuuacugaauuuauccuuaaaaugagggcggcuuagacaauugauuagccgggaguuuuuccauugauaauguguaaucugguucaaccacuaucaacuuggcauaagcacaaggggauaauauugguccagaaacugaagacuacacagacaaggcagcuccaguuucucuggauuagugucuuuagaagucagucuaucuuuguugagacucuuuuucugucgauguugguuuuguguucacuguggcucauggcagcuuggacuuauaauacccuuagagcuagaauucccagcagaaaagagcaagucugguuuucuaauagucccaauaaaauucugguccuaacucuuuuugcuugaaguggucaucccugagugaaucacuguggauagacacaaaauuaguuuauuggcucaagccuggguuguauacaaccguuccugacuguuuucugugacuggggcaaaggaccuguagccaccucuucagcccuccucaaccacuguuucuuuaguaagacugugugguuccuguagaauuauagcagaguaggcauggguuuaucaccaucucgcacaaagucuuuauauauauauauuuaaugaaaacuuuauuauagagagcuugcaaauaaaaaaugccacagaaucaugauaugcaugagagcaggccaaagaaaauauaauugugucacaaauuugaaagugguuuguuuguuuguuuguuuguuuguuuguuuugguugagaugggaucucaguacaaagccaggcuggucuugaucucacaauccauaagucucagccuccaaggcuucuagaccuacauagccaucuggcugguaaauaguuauuaagaacuuaguucagugguucucaaucuuccuaaugcugugugacccucuaauacaguuccucaugucgaggugagccauaaaaguauuuuguuucuacuacuucauaacuguaauuuggcuacuguucugaauuguagcaugauaucuaauaugcaggauaucugguagggaacccauguagaagggucauucagcccccacagugauggggaagucacugagugucugugagaagugugauggagaccugcuucccacagggguagaguuaacuaccugugguucucauagaggugggcuucugcuagcacuacacaggcccucuccuaugagcugccccguucagcuuugcauuaaacaucaagauguuccaccauuccuugauuucacauucauaaauuuauucuuuuuauauauuucuguuuguagcuagcauguacccauaaaauuauccuugucucucuuuuuuaaccauccaauuauuagguauuacuggauauuucuuugguauauauuugugugcagugcaugugugugcucuauguaugugugugcacagcuguauguagaagccaaaggaggguguugggugcccugcucuaucacccucuaccuuauggcuuugaacaagggucucacacugaguccagagcuaggcuggcagugacaaagccccaauguauccuucucuuucuuccacauuaugaugcuggguuacaggcacaacugcaccuggagugaaccucaugcuuaagccgcaagccuucguagccauucagauauuuccccaaucccgcuuuguacaauuuuuaucaccugcuucugaucccagugaccuuuuguccccaguugacuggucacacugacuauuccccuagaaugacuuucaaacuguuuccugaucauauugguuucccucagaugccuuuuuauacagcucacccaucuguuagauuuuuuuccuggauacuauaaugaucucugucucuggccaacaguacuuccugcugaucuguuguggacaaaagcuggacuuuggcuaacucuaaaguccaggccacugaaugagccacuguuuccccuugcuuucugcuucucgccaguguggcuccucuccuucucccaaagugcucagcuggaggauagcauuucgucacuguuguuggugagggauucaggacugaucucuauaguuuccuccuuucuaacuaugaccucuguuccugaacucuugugaauuccagauaucucaccuggagguggagcuuaugaagccuaccccuagacuauugucgagauacagugagaugaugucaguugcucugugaaagugcccuugcuucugugccuucuauuuugcuagaguuguguuauaauguacacagccuucugugaaaaugaggcuugcuguuuucuaggcuggaaugugucauguguuucuucaggcuagaauauuguaguccaggcucugagaucccuggcccucaaauuguaagcuggguucaauuacuuacgaauuuggaaaaugacuaaaaagcugaaaggccccaagaguugggacuaauaaagccguuuuguagugagaacaaaguaggaugauauacaguuaaauacuacacaguguguugucaggaggaaucaguagaacguugucaucaucauugaguacugaauauuuucccuggcugcucccaacacccuagucuuuuucucugugauucuuaaguccuuggcacuuagcauuaauccccacguuuuauuaauucuucuucggagcauauuucuuuuuguucuaauagacuuugucucuauagggcaagauuuuugucuaagauacuguaucccugguaccuccuaucauuugguucauagucuguauagucauccaagcaggaaggaagacaggcuaaggagagagacaaggugccuuuuccuucaguuaucagauuauugaagcaaugguccuaaggaacuuuuucaaaaaucccaugccaagagauggaaaaagcugaaggcuggugccucccaggagaggaauuugucucccaaggagagauuucacacaauucugauaccuuuccagacuaccuugcaggagaaacuggagugggaacagugauggacaaugaccacccagggagugggacugcuuauuuacauacaaagcuugccugcuauugaaaugcaaaccuuggagcuggcaggauggcucaguagguaaagguuccuccucaccaggcugaggacuugacuuggauccuggaacccaaaugggaggagaaaaccgacuccagcaacuugacuugagauuuccuacauguuuaguaacaugugauuccuuccccaguaacuaacagaauaaccaaccaaaugaguaaauagaggcauacucaaagagugaacaucauggccagaccagcagaggauuggguggggcggcguucguugcaccucuuuauugauuccuccuuccaguauggccacaguggauuaaucuccucucucuguuuuguacuguugucuguguaauugaccuuuugagggcaguggcugagccuggcuuguuuugcuugccagggucuaugcucugacccuaauaacuuucgcaacauguugauucaaacuggaaaguucucaaaguaaaucugaauuuauuauaaguucagacaauacuaauauagaugaauagaugaucaguccuuuauacaugaagaacaccugaauuaaaaacuuacaaagaauacauggggauuauuuuauagaugcugugauuuuuuuuuauuauuuauaucauauguaaaaugucaacauuaucucugauuuggucagggccuuccugcaugaugguccugggauuuucagucucucggggcugguuuugggaaagucauugaguuaagagaaucaugggaugcugccuggcugcugauguugccacacuugcaguggaggcugaggauuggcuuggaggccuuguguauuugugauggguauuguguuaaagguugguaagaagcagaauuugcaguuuuguuaauggaguauuuaggaucaaaagcuugguuucuagaagcacaacaagccaggcuugcccccuccccccauccccaguuccuucaugggaaaagcagaaaagagguuccucgccaacuggcaccaggcuuuaaccuuucccuccuugcagcaugauauuacuaggaaauucuaauucccugucaguaagugcuucuguauccuaauagccacuggaugaucacaacugucucgcuuuagacugugccacuccugcgagauggcagaucuugaccuacugcaccaugguucuuucugugcccugggguacauugagaucauuguuaugccucagaucagaugaaguuaauacuuuugcuauaucuccucuuuuguaugcugaacaaauguguuaauuauuagacugaagccagggauguccauaguccuggggaccaggccauacugucucagcuacuugcagaaacucagggacaccgccacgcagaugacugccgcauacucaggagaacucuugguuuugguuuaguuuauauuaagcagugacucagggacacugccacacagaugacugucacaugcucaggagagaacacuugguuuugguuuaguuuauacuaagcaaagaagagaguugcuaaagauccggcacgauuugcuguuuucagugugauuuguagcagcacugcucuuacaggaaguguuuuagcaaaccuuuaaccacaucuccuucacacaacagaaacauuguugauuuuacugaaguuuugacauggcuuguuuuagcuaaaaguaaaucaaggcuguugucauugucauaugugcacauuuaucuauuuugauggcucuuggaguagcuuccuucuuuggauuauagagaaaauucccuccauguaggaauugcagaaagcagaacaauuucuuaccaucuuuauacagucucucccuuauuccgaugaguuagcuguagcccagagaggucaagugacuuuuuggaggacacacaggcaguuaacgagagggggaggccauccaguucucuaguuuuccacucuagugccauccccagccccuuugucuugaggucucguagcccaggcuggccuagagcucacuguguagccgaggaugacuuugguggcuacucuccagacacguggugguaucugccaccuugcccaguuuaugcacugcuggagauggaacuggagcuuaccauacucaaaaaggagacaaagguauguaugagguagauaaggcacagccugaaagcuaccguuucacagaaaguauacaaaccgagaacagagcacagucaacagaccacugugguauuauugagugaagugggcaaugagcuaugagaugcaguggaaagugaaauguaucuugugauuaccugucccauuauuucgggcuaagcagugaaguucacuuggugaaauuuagaauuaucagaguauaguggcucagcuagcccggaccauuuaccaaaacucuggcaugaagccauuuaucguauuauauagggcagaguuuuguaacuucaauccaugacucauuaauggcuuuguuugauuuugagacagaauuucauguagcccaggcuggccuuacuugcuacuucacugaaugugaugacuuugaacuuuuuaacuugcuugcaccuuucagaugcugaggccacaaugcaugccacuguccccauguguuuagugcuggagaucaaccuggggcacugugugugcuugguaagcauuauaccaacagcuuccucaucagucaccacacugguuuguuuugagacagagucuuccuagguugcccagaguguccuuacauuuacgaugcuuuauccccagucuuuggaguugggguaccaggaugugcaguucuauaccuggcaucagugggcuuuaauuuccuuaagaaguauuaaaaaccaaaccagaaagaaauugggaggaaauguuuauuuaggugugcugaucaugaaauggaucugauauuuuucuuccaguaaguucuaaaacacuguaaagcuauuggcuuagaugucuuucucaaaagggcauucauuaucuggugaccuuacaaagcaauaagaccaacagguacauuuucuuaaccagguacauuugcuaauuuugauggagaccuagcaaaacaaacacacaaacagaaacucacaugacuuuuuauauacagcaacacagucaccgugaaauacaugguugaaaauaaaagcaauucauggaccauaaggauacuaauuucaaggaaaaccaaaaaauauuuaaauagaagugauuuuguaucugugcagggucaggucucaccccugccaggggucucagccuucucugcaguuccacuaaugcagguguuugggaacuacuggucguguaaacaucgaggcauacaaagugagggaguuugugugugucaacucucuuaaugccccuguugauuuuuaaauucugucuaaaagaaauuuaguguuuucuuuuggaguuguuuguuuguuuguuuguuuguuuuuguuuuguuuuguuuuuuugagacaggguuucucuguguagcccuggcuguccuggaacucacucuauagaccaggcuggccuugaacucagaaauccgccugccugccucuuccucccgagugcuguuucuuaaagaauguaauauagcuuauaauauagcucagucuguuucagaucuguguuuacuaaauuccaauaaaauacaggggguuugcuucuguaugagucccucucccuuuuguaucauauaaauuauguuucuauauacuaugcauccagcagugcaguauaauuauugcuuuagauauuuauauguuuuaggaaagaguuaagagaggaaaggaaacuggguugaugggacaugccugcaacugccuguuuuucuagcauucuggaaacuacggcaggaguauccucgugaguuuguggccagccugaguuacauagugagacuguaugucuccucugaaacaacacacacacacaaauucuuucuuugaauacauagaugaagaaauagaaaggcuaagguggacagauuuagaaggauuucauguuuauauuuucuaacuuuuagauacuuuucaguuucuuuuuuuuauuuucauuuuauuuacuuuaguggguuguuuuguuuuuaagguggagucucuuauacuccaugcuggccuggaauuaccaaguagcuaaagauggccuugaccuugugaacuccugauucuuuauuucugacccuagcaaguacuuugauuuuagguaucuacaacuauuccuuguuuaugcuauacuggggaucgaacucaggucuucaaggcaugcuaggcaagcccuugucuaacuggaucccagcucaauacuuuuuuuuuaaaaaaggcuauuaguuguuauaauaaaguacuaaccauauaugauauuuauugaaugaccucucugguagacucacaguuagguuuuauuccuaaaauaguauaauaggcaaguaaccuaguccagugaugugaacucuaaagaguuuugagacaucugugcuucguucaguagauuuauuuucuuaacuuccugcaguggucagugugcugacaggcuaaggaugcagagggccagggguccagugaggaggugggauggggaguaucgguguuaacaagggugauugguugaggaggaaaaggcugcucaaggacuggcugggugaaauauuuagguucuaaacacucagagcuagggccagggagcuacgaaaaacuucuccuguggacagagauguggaagggcacagagggaauuccaguauuucuuucccuccccagagaccuucguuucccuuuccauuccucucuccuacuaucugccuuccccuugucucccccaacuuuuuccuucaucuucuuauugucuacccuuuuccuacucuguuuuuuguuuuuugguuuuuugguuuuucaagacaggguuucucuguauagcccuggcuguccuggaacucacucuguagaccaggcuggccucgaacucagaaauccgccugccucugccucccgagugcugggauuaaaggcgugugccaccaugcccuuccuacucuguuuuaaucaugcaagcagucaauauuguuuagcuugcuauuacacuguaacaucuuucugauuccuuauuccuuuauuuucauuccucccuguauauuaguacaaauauaaaaauaguuaauauuuuaauauaaauguuuuggacucauuguuaucuguuuuaucuuaaugguauuaaaugcuucauugguccaagcaauauuuaaaguuauuaaauguuauuaaacauccuaaccauuuucuuaucuguugcccucgggaagcaguucccaaccugugggucacgacuucuuuggggauuaaaugacucuuucacaggggccaccuaagaccacugcaaaacacagauguuuacauuauaauucauaacaguagcaaaauuacaguuaugaaguuacaacaaaaaauaauuuuaugacuaugggucaucacaacaugagcaaauguauuaaagggucacaacauuaagaagguugaacacaaauacuuuagaacuuuuggaauuuauuaaaacuuucuuuguagguuaauauauuugauuauuacaguuuuguugguaaugacauuuuauucuaacaggaacagaaaucuugugaaauccaguuugaaagaggagggggcauauuuauuaccuauuuuuaugcaugagaguauaggcuaccauuuuauuggcauuucuuuucuacuugugaaauggcuucugcagaucuugccaucacaucugagguaagcaagaagggaaaugauggcagugguugaauguuagcuguccgcacugcaaguaacuucuggaaacucuuaccucucauuggcuuuaaugguaacaaaacuuauauauaagggaaaucuggaauuuuccuuuucuuauuuauaucuaugcagauucuaggguggugcugggccaguguagggugggucaguuccuguuagaguucuguagacuugcaaaauacucugggguuuuuuuuuuuuguuguuguuuuuugcuuuguuuguugcuuguugucuaagggacaaagcaagcucuguugcuguauauucagcugaauuuccuuccugggcuuguaagugacgucaccuaaucgggcagcagccacaggaggaagaagacaaagcucuguucuggcuccgucuguggcuccgucucagggcucuccccuccacugacgucaggaugcuugacuucgucaguggaaauagggacaggauggacaacucgaaacagaguuggaauuuauuaagaaaaaaauuuaauauacauuuaaacacuaguggugaaagagugguguggagcgggagaaggggagagagagacagacagagacagauuugcuuaggacaaugacaguguauacccaaguguagccaugggcaucccaauggagaguugccccuaaaugucucagcauagcugugugaacauucugguggauuugaaauuuacauuuuucugggucuggagaacugguuuggcaguuaagagaagguaauauuauuguagaagaucugagcucaguuuccaguaccugcaucaggcagcucuggcuccagaggaucugacuuccucuuccggccuaccuggcaucuguauucaugugcacaugccuauacauaacuaaaaauaauaaaauaauuuuuuacauuuucaauuuuuaaagaguuuuaaagaguuacuaagaauguuuugguauauuuguucuucugucagaaacuuuuuuauuuuuauuguaaagaugguauaucgaauaggauuacuggguaauaagauaaaaacagguccaaagagucaacagaauucuuagcauaguaucuuccaugaguccaugugccucucaccuuacucugcacaguuccuuuaguguauuguuaagugauuuuagccagcuuauacuuguuaauacuaaaggugggcuuuuccuucuuauauaguauguauauacuucuuauguaauguauacacacacacauauauucagggagacagagagaaacagagagagacagagggaauauuagguuuuuuuguuuauuuguuuguuuuacuagauagcucugauuaguuugggagucaccauucuuuuuacccuaggcuccccagagcugugauuaaacacaugccaccauagcugauuacuccauuauauaauaaaguguuauuuccccuauuguauagagaaacauaccagcauagucucaaguuuuuaaauagaauaggaaucucugaaggaauuucagaauuauuaucauuguacauuauuucuuaaauuucauggaagcaaacauugaugcuuugguuuuauuaaaaauguuuauccuugauuaacaguuuucaaaaggaggugugcaaacuggauuucucgaggcuguguuggaugaauugcauaccuuucuccaagcccagcagagucaguguuucgcagauguacagacuaaagcagugccuucguccacagucuucacauguguguguuccuuagucauuuaaucacugaaguggggucagcuggagaccacccaagucagguuuuuaccuggagguaagggaaugggccucugugggaaacgauucaucaacgucacacagugaacggugaagcuaagccaaguguuuuuguuucuaagacucuccauuuucagaacugauuaaaaauagguacccaaaucauggagaucaaaaaaggauaauccagaguagaugccccacuuauggaggaaaaagaggcaaaugcuguuccauuuguuugggugugcagacagcaguucagucaugaugaauaagaugcuaccaguaucugaaagcagcuagcuggagaagggguugcuacaugggaaagugaccuuugaaaaccauucugugcuugcuuugaccauagagcucaugugacaccagugccaguacuugugugacaccugaaugauucccacauucuguccacucauagccuuauccagugcauuggagcaaaaucauacaaaccauuuaguucuuucuucuuuuugagaggcacuuaucacuguccccaaacauauggcaaucuccccaaaucugugcuuuuguuuauuuuauuuugaagcacaggccauugcagucccucuuccagaccccuguaaguucuguuauuccagcacccacuuccuuaaugucauuuuccuggacuuaagcacuugucagugggguaccaugaucuccuuucuguuuauugccuuggcacauguacuacuccaucuauuacgguuuagguguuccuuacacucaacuucuugggugugguuuuagcuaagcaaguuguuaguacuuuguuggcaaauaccugucccauguucuuauaguuccuuggaugaggcuagcauauuuauagaauuauuaauaaugacuaguuauugacuugauuguauugaauuucugauaaauaaaaaagcuuugugaauuuuuuucuccuucccuucuugucagcugcuuuuaugguguauuaaggguuucgagaugaaaguuuuuuauccaccagaagaaggcguauugaaacagauagcaaggcuagcuggagugaaaauaacacacaugaaucgugggaaaggaugauagagaccuaggugauacuaugucaaagcacugacuuccuuuuucuuggauuuacagcaauuggaguugugauggcacauagcucaugucaguaagcucugaggccuccuauacaugcaagagaagggcaagcaggagaaacagacugugaguuuaguugcauuggcuuaccuagagagacugcccagcuuucaagugucaaacaucuggguaaaagaagugguggaagccaucgagccguuucuugcucaacucugaagcuggggaacugggcagcacuguaacugauuagaauaaggacuuugugagcuccuuguguacaacguagauagauagagagagcugcaaaggcacccuuacuuacccugcaccuacgagagaugcucuucauuacucuauagcagagcuucucaaccauccuaugcugagucccucugauacaguuccucaugcugugcugacaccaaccauagauuauuuucauugcuccuucgaaacugcaauuuugcuacuguuaugagucauaauauuaauaucuguuuuccaauggccugagguaacccuugugaaagggucauuccauucaucccaaaggguugccacccauggguugagaaccacugcucuagaguaaggcacauuuuaauugauucauuccugaugccuguggcugaugcuggugguuuuacacgggccagggaaccacucacucugccagagccccaguucuucucuuccucuccuaucauaguuguuucucguuauuauuguagagaagcauguaguauaaagugcacauuuaccuuucugaaacacccaguccagcagugcuaagaacauucugcugugcaacagcucucuuaagauuuccauuuggggaccugaaacugugcacugagagaugacacucuugccccagccccaggcaaccacaguucuucuuuccuuucugcacuugaucuuagccaaaaggcugagaagugaucuuuccuuucugaauuugacugcguuacauaugcguaagugggguugcgcagaacuuaucuuucugugguucucugcuuauuucucgauuaugucacacagaaaaaguuaaccuuaaaguuguaagaaucuuuaacuuagauuugaaauacaucugagaaauugaaguuuucuuucucucuuuuucucucccuuccuuuuucuuucuuucccucuuucccucuuucucucuuucuauccuucccuuccucccuuccuuucuucuuucuuuccuuuuauuuuuuuaacguuacauaaccagaggagacucaaguuagagaaaaagcauaggaaaaucuuucacuucuucccacuuuuauuuuccuguuuggacaauaaaauacaugaauaucauucauuugacuaugaaugguagugugucucccccaaacucagugccaaaauaacacaaaggaaugccauuuggauuaagauaauaccaucucugaacuuuuuuuuguacugaaaauaauuugaucuuccccuuccuuaauauucuuuuuaaaucuucuaagauaggaugaacugaaggauugauuuuccucuguccuuaagcccuaagggagauguccaaggcaagggcuggcacucuucacugugaaagagcagguaguaaggaucugggccuuaguggcugauaugcauguucagggacugguuguuccauuuuaguggccaaaguaagguguggcuggguuccagugaaucuuuauaaucauauuugguggggaggcuguggguucaaaccgguguaguugaagaaucugaggccuuggagauggcucagugggaaagagugcuugccucccaagccucagguauagccaaguauaacuucccagcacccaagaaaaaagccaggcaugccauuccagugcugugggaauguggagaccagaggaucccucgugcuugacucuaccucagaagaaucaagcagagagugagagaacauuagauguccuucucgggcauacccuuaggugcacaaaaugugccugaaggggugcauacgcauauacauuacaugcauacauacauacauacauacauacauacauacguauaugcauuuacuaaaagaaaauagcuguacacuguuuuuuccccacacccacacagaauugguucaccucuucccacuuuggcucuuggcaaccagcuauguaucuuucauauauaguuacgauugcuguucagaggcauagagagauggucaugcugucuaaucaaauaauguuggauuauuguuacuuguuaucuuaauaucauaucauauuuucagauaauguguuaaccaagauauaauuacauuuuuaagugcuuaagaaaauaacaugcuuugaaguuuuguccuaagacuagaauuuuagagcauucaaacacacacauauauuacaugcaagcacacuauacauacauacauacauacauacauacauacauacacacacacacacagacauuuacuaaaaggaaauacgugugcucuguuuuguguuaacuuuccuugggaaggugugaaacagcaauaacuuaacccagauguagccguaacaauaaauccacccuagaccaucaugguaaacccaugaguuuguuuauaggaacguggguaagggguuacuuucagaagaguggguagcccccaaacgcaacagcugcaucacugcgaaguccuaccccaucacagaagauggugugcagacucugucacagaguuccauuuucaguuaaccuccccucuuguuauauacugcagcaucuccugagagcacucacaaccgauuugugggaaggaguaauggccggaaucccagaugaggauccuguagucuuccuucuacuccuucuaugagggaaggggggaauagcucuguuaccauuaccguaaacuugcuuucauuacauuauuguucuuauuuugcuaccauggcuaugggucaaagucaucucuacuccauuacaccauugggacagucauuuuuguccagauaaaucuaacaaaaacucaguauuuuuugaucauaaagaugagacauaaaguaaaaacuaaaaacaacccaucuccaugcccagaacuaacuacuaauacucaccauguucaaacauugcuggauauguuuguuagcguuuacuggacucaguccuuuucacuuaacaauugcuauaagcccauaaagggugacacauuacagacuaaagggugagcuggaggguuaacacuuuguacuuuagugcagugcccccacuccugcccagcagccguuccagcugccauccugcuggcaccauagacauacucucccuacucccacagccuaagauguuggauggccaguguucccuagcaguuacuacuuacaaguugccaguccuuuuacuggccccuuucaugaguuucuuuucucaguuugugugccaucugugcacacuguggcccaagccugacuaguauagaugcuguauuccaugugacuuagcuugcuuccauggcagauuuaguauauauucuuugucugccuuauccuccagcaagaggcucucauccuucccagcccuggagucucgacaucacuggcuauaugacuuugucaaauuacauucugucuuugaaucuugauuuucccauuuggagaaagcagaugauagugugucuuguggggugugugggcaggugauguaaggaugugucugugaagugggcaguauaacuaacagugagcaucaaguaucagugccauugguccugauuuccuuauagaaacuucucagaggauccucuguacaaggaaaggugcuuuguagccacagugcuuucccaucacaucuuucuagagccaccauuucagagagccugcauggcucacgcucugcuccuggcuggagcaucucuuguagauggcuccugucuguacauuucuagcagacagcagguggugguagagagcuaggcuugcucuuggaugggguuugugcaaaagucuaaauaacucuuuuaagaaaaaaagaaucaagagucaacaaagaauaggcauuuuuucauauccauaaguguaagagaauccuucguuuauugaacacuuuauuaaguuuugacauucuuuccuuauguauuuacuuagucacuuuguaaaguugguauuugucccgucuuaagaagaagcuggguuucaaggagagcuucaguuacuuagaaguuucuaacaacccuugguuguuguggggucuacacagugaucuguauggaggccagugcacgugacugguugcuagucuccuaugcucuugcauucacacagaagguugauauuuaagagaauuucacauuucuggcucuguguuccaugugauaaauauucacaaggagugaugugaagguguacgguccccuuuucacgcaggcccuucuguuccccaguucuucaucucagaggcuguuacuuuucuauguauccuuccuggggcagacucacaggaaggcacaggcauuacagagagaaggggacuguuuucacaggccaucuuagguugacuuuuggccuugggaauuuuuaggcugcuaugcuaggguagaagcuguugugcagaaacacucgcacuuauaccauaugcacuucaaguuucuucuguguuucagcucugcccagaagacucuaaauccuugucuccauugacugcagaagaagguuagggcacagagagacaucaggguuuacaugagagaagugauuuggcagaaacacagaaauucuuccccuguaagagacauguaacagacaaaugcacaaaagugggugaaggcagaugcuggcuggccugaagucauggucgccauuucuaccacuauacauauauggcccugaucuaauuauuucuucagggauacaaaacccugaaaaucucauggaucccaguccaugacuguaacuacuuccuucguuuaaacacaauguucaugggauuaaauaaagccuugcauucauaauguacuuaggcuuucauggaaggcauagauagacucucaugcugugauccacaugacauuagcagaauguccccuuauacccaggaguacauuuuaccugguguuguaugguuggccuagugcccuggugaugaauguugauucuguauuuugauacaaguuuuggugcccgugucaaagcaagaauguuaacaaugucaaagugagcagucaggggccauccugucuucagauguauaugauucuacacuaagauucccaaaggcugguacauguugagacagagugaaaaugccuuugagauguaaauauuuuuaauuaccugcucucauuaggugauuuaguugauuaguucuuccuggguuuauggguuucucuuucucuuaauuuguauugcauuuguguguguguguguguguguguguguguguguguguguguguguguuguauggagucagagaacaauuuuggggagagucaguucucuuccuaccauguggcuugauggcaagcaccuaaaccaucuugcuagaccagaaaaauuuuuuucaaaaccauuuauaccugaaaucauuaguggacugugucuuauugcaacccauaauugguuuuguuuauuaucucauguguguuucauuguuuuccccuugaggagcaagcauccuaugucagucugcucuagcacagccaguaugaguucaaaguuucuguugauuucugaguuuaucacaagagcugucaugagguacuggcacugugucuuguuugggauuuccaauucuuuguguccugaaagcaugguugauggacaugucugagucucugcagucacuuguaugacuucaagaguaggcauacagccguuaaguugacauuucauguuacuacauuagggacacuugccaucauaauguguuuguuuuuaggugaaggugguuuugauugauguuucauaguugauaugugauagugcuaagaguucaaccugguagccugucuagaagccugcacagcccaucucucaguaaaaugguggggacugagugaaguucuucuacaaagauccucacuuguaucaagaauucuacaaaguuuagaguuuaugucauuguggagaguugguaugcugcagauuuauaacucaauuaguauugcccagugaaauccuuuuguaacaauguauuaacaaacuacaagcuugcaccaacccaaaggcuaggagugucaccagauaccaccugaagccuauuccuaauuccccagguuuucugucacuggccaaucugaugcucccaccauguauuuggaaaaugccuugacuuaugaccuucuuuuguucucuaauuaauaaauucuccacaaaacucuuaccuccauacaccugaacauggcguuuggcauagcuugacuccacauuccuggcucaggaucacugauacuuggcuuuggaguaauuuaucccuuauuccuuuugaggggagagcuguguuuucgcauuugucauggcucuaacauaguugucccguggcugcuucucccauccuuuugcacagccacacuugaacccauuagcagugaagaccgcuuagauguugaaucuugaccucccucuuugaacugugugacucuaaagaauccuuugagcucucugaauugcuuuuccagugugaagagcagucugcacccuccuccugccugccuauagauguagcaauuuucuucaccacuuuuauuccuaggggagaggagagugcugggcauugguggacauuacuccaauguuagcuccugaacccugcucuucuugacccugcucuguaguucagagucaggugucuccuauaguaaucaaagcaggugacuacauggauauggucaggagccacaggcugucauuagguccuucacucucauccuuccauuuagagagagcugagcuauaaggaauccuaaaagaaaggaaggauucccacugcuuauuggacuccagggcaagagcugcuuacugcauagugauuugacaaaagaacugcauggcagcuuaaguaaggcucguuauaugaccauugcuauaucagaugagguggccuugggauuggaacacagauacccaggcagacagucacaagugggcuugugagacauggauccaucgauguaacugaugccacaggaauacaacggaaaggauguggaggauaaugaccuggagacuaggggagguuuugcauagacaaguaaagacaucuuggauguuaucauuaaaggugauaugcuuacuaaaugcacuuuuuggauuuuuuucuuuucuuuugcuugcuugcuugcuuccuuccuuccuuccuuccuuccuuccuuccuccuuccuuccuuccuuucuuuuguaauuguugguguuuuuugagacagguucucauguaacccuggauggccuugaacucuauauagccaauaaugacuuugcauuccugauucuccugcuaaaauuacaggccgggauuacauauaugguuuaccaugucuguuuucaggcagugcugaagauuaaacauaggacuuuucacaguccguaaacguucuguaccugagcuguauucccaguccuguuaaaugcuuuugaacaagggagagccaggaagaagccugcauuuuaggaagugggauaaucagcugaacuuucuggaggaaugguacaagcagaaccacaagaugagaauccuggcccuagugcagagaggugacugcacuaagucauauuuucgaaucuccuaaaggagaguguauagaagauaagaucaagaacugcaagauaaagagaauuaaagggaggaaaagaauccuaagaauggugccuguugaacccagagcaggggcuguguguauuucuugggcuccaucacucauucucagggucagugcagagacaguccaguggcugaacaggcucuauccuggagaccucugucccuggagucuguguucaggguguugucagagacaucgcuguuaucauaaugaaaaugauguucccagcggugagcuagauccucagaacuauggugaauagaagcaugcauaaaguccccuuuugucuucucuaaaagccuauuuccuaggguuccuuuuguuggugaagaguccacagcucugcuugcucccauccccugugugucccuacagcucugcuugcucccauccccugugugucccuacagcucugcuugcucccauccccugugugucccuacagcucugcuugcucccauccccugugugucccuacagcucugcuugcucccauccccugugugucccuacagcucugcuugcucccauccccugugugucccuacagcucugcuugcucccauccccugugugucccuacagcucagcuugcucccauccccugugugucccuacagcucugcuugcucccaucuacugugugucccuuacuguaacaguuaccuucuugccaucucuaagggauguuguucuuacccuguccaccuuugaccucuguucuuauuucagaaacuccuucuauaucacaugacaggauggcaacuguagccucuggaucaagucugguccucuaccuauuuuaguaagugagcauagcuaguuauucauauauauguaguauugcuuauggcuguuuucacaguacaaaacugaccuaugguucacagugucucauagccugaauuauuuaccccuuggcuuuuuauaggaaaaaaaagucaacacaccuaacucuggcucuucaccugcgcuuuccuaguuuucuugcucuuggcugaagccugaggcaggaggaguacaugcaucagucagcucuaagggaagacuuaaguaagaagcucugcucaauuucacugggaguucuagaggaacuucauuccuuucuccaccaguucaagaaauagugccucauauuucuuaauucaaaggagaaauucucauaauaaaugcaauuauccaaacuuugucucuguaacuccuuccaugagugauuguuuccaauucuaagaaugagcaaaguguccacacuuuggucuucguucuucuucaguuucauauguuuuacauauuguaccuuauaucucgcuauacuaaguuucuggguuaauauccacuuaucagugaguacauuucauuugaguucuuuugugauuggguuaccucacucaggaugaugcccuccagguccaaccauuugccuaggaauuucgugaauucauucuuuuuaauagcugaguaguacuccauuguguaaauguaccacauuuuuuguauccauuccucuguugagggacaucuggguucuuuccagcuucuggcuauuauaaauaaggcugcuaugaacauaguggagcauguguccuucuuaccaguugggacaucuucuggauauaugcccaggagagguauugcuggauccuccgguaguacuauguccaauuuucggaggaaccgccagacugauuuccagagugguuguacaagcuugcaaucccaccaacaauguagaaguguuccucuuucuccacauccucgccagcaucugcugucaccugaauuuuugaucuuagccauuuugacuggagcugagacaaaaggaugguccaucuagagacugccauauccaggguuccaucccauaauuagccuccaagcgaugacaccacugcauacacuagcaagccuuuguugcaaggacggugauauagcugucccuugugagacuaggccggggccuagcaaacacagaaguggaugcucacagucaacuauuggauggaucacagggcccccaauggaggagcuagagaaaguauccaaggaacuaaagagaucugcaacccuaucggaggaacaacauuaugaacuaaccaguaccccagagcucuugacucuagcugcauauguaucaaaagaugaccuacucggccaucacuggaaagagaggcccauuggucaggcaaacguuauaugccccaguacaagggaaugccagggccaaaaaaugggaauggguggguaggggaguggugggggggacuuuugggauagcauuggaaauguaauugaagaaaauacguaauaaaaaaaagaaaaaaaagaaauaaaugcaauuaucuuggacuguacuuagcaguagagcucauaagcaugaucugauuuaaugugacagcaggcgaacaagcagauuugcaggugguaaugucgaaagcacagacuggaaggcuacucacccuugaucccacagcuaggaaauagcaugguccuugccccuuaccagcugccuucagaggaggcuguucuuucagagcaauaccaaauaaggggaagaagaaagacugugaacaaauguaugguauaagacuggugcaguuuuccaaaggguagcuuugcaguuucgaaugcaagagaaauguggaacuacaccuuccccaggaagaacaaauaaacaauaaaguguggcugugcagaagaacugacugacccgcagagaccucugccugaaggucuuguugccauccugaugaguggagcucguuagcucucugguuacauuucauuccagccaggcuugggagacaagaguggaaggguuaacugaaaucaggauuauggugggcacugugcuaaugucuucuguuaaugagccuuugcugauuguaaaucauguaggaagaauaugggugaagaaggaaggcuuuucuguucuuccuacugaacuucgcuuuugugguucauuagggugugucuaggggucaugcucuaguauauguggcaugggaagcuuguugagcccacaccugauuuacuugucccacugauuucuucacuggggaaaggugacauucagaaguacuguuauggaaaugucaagagucccagauagguaaguagguaggguagguaagguugugcauguguaugugcguguaugugguguguguguguguguguguguguguguguguguguguguguguguguguguauguguguguguguguacucacgcauguaucaggcagcagaagagaagagaaaggaagaaaagaugguggcaagccacagaaagaacuucaggggcaacagcagaugggggaagccaguaaggaaugcaguauacauucagaaaagcacuaagaucuaaacagcagaagugggaaaauaccagaaaggacuuucaaaguccuagguacuggaacuggggccacagucaagugcacaaauaguagaagggauuuggguggaagcaguucuaugggcauggacucaaaggccugagucccagguagaaugccaggaccucugcagggcaguuucaggucccugaguuacccaauggccagaaggccauucucacuucugcuuaauagcuagagaauuucacguuuaacuaguggccaugugaggauauauuuacucauaaugucacuucuuuaauccaaauauauauauauaccuuagaguuauugaagucggaggugccaugccaggauugaucugucugaagauaauguacucauuuuugggggucuuugugcucuagcaaucuauuaaaauucaagcaugaaggauggcuuggaaaaaauuauggccugcaaggaaaauugcuguccagccgagucgacagagacauauacacucagcucuacaagacagacucuagggagaagcagaccaagcccagggaggaguaggagcagcagcaaacuugaucccagcgugagggcugagaauggcuuuccuugacuguuucucucucuggucucuuccuccaccagcaggaaugugauggcuccagaauucugccuuuuuucuguaugagucggcgcuggugaauaucccagcuguucuguugccguaccuuuuuguugcuuugcuuguauaguuuguuuuuuauuauguuagcuaguaacccauaugagauguucccucuuaaaaguuuaggucuagaguauacuuauuuuggccauaaacacaguguccuacagacugcuggagcuuguccaucuugcuuggaugagacgcugugcuuaucuaauaguaucuuccccuggucccugacaacuggcauucuacuuccuguuuauaaaaguuuuacucuucuagauaccuaguauaaguggaguuauacaguguguguguguuuauaugauuguuuuuccaucuagcacagugucuucuugguucauccauauccacuauuauaaaauugucuucaauuuucuggcagauuaauaccuuaccauaugcaugugccaugguuuugguuauuuguuuguuuugaucaguuguuacucugguggacauuucggcuguucuaccuuugggcuauuggguacacuucaacaugaagauggaaguguaaagaucugcugagauccugauuucaguguuuuuggauaaacaccuaggagcaagguuucuagaucuuaugguaguuccacuauuaauuuuuugagaauuccauguaccuucguccuggcauuuguucuuccacugcuggagaaaagugcacaccugucaucucuuauuccuugccccggucuuucugccccauacgaaacugccgcuugccccuucccugcgcacuauccugcuacccuucuuuuggcuuccaggauguaacuugacucuugacacguucuuaaaaagcccaugucaagucaaaauacccgaugaccaggacuucucacccagcuaaauuuacuuauucucuacuggagucucuagagccuuugcuucuguagcuuugggacaguugauagagaugucaucuuagccugauguuacauguuauuuuaaaugaacugucaucucuugaaggcaaggacucuguguccucucugaagauuuuacaaaacaccuauucacauguggagaggcagaaaucauaggacauauauguguuacagguuuagaaggcaggaacuuuaaguuaguugcucuucaaagguaaagaagacccuuggcagcaagguccaaaugcacaggacacuguccauuccuauagagauaaauuaauggggcggggauagaaaggaaagaucaaugacaucacuuucuuaauuguuuugagcaagcaggccuuggaauaggcaggcaggcuuagcggguugggucugacugcaccugagcucuucagugugggaagucagcaggcaaggugaacauguacguggcaggaacaggaaaugggguucaccucauaggaggucaucagcugcuugaugccagcacuauucuaucagaacauccuacuucuagcauccugagcugagagcccuuggcuuccagccauggucugccaugcuagcagugcugucagugugcucaccccacaccuaagcuuuaagucugagccuacccuugccugucagugggagggaauggaagaggagugggccuuguggacugcaugauacucuuaacagcuguggaauagcuccauccuuucugucuucccuggccuucucacaucccuccaucugucaugaucccaggguacuggcucccgaaccagagagguguggagaaucagcuacaugcuagaguuaaaggaaggucugaggucugcccacagcguccucucacugauguggacaaggcuaagaaccugccauuucuauagaggcacaccaaaggacugcagaaggauggaugcaggacuaacaacguugcugaagaauuauuuccuuugucuaacuuguuuuuuuuuucaugauuacacaaggauuauauauauauacucuuuuuaaaaaugggaaaaugauugauguuaauagaaauaacaugcuauccugaagcagucaugaaguaaccauugaugcuccaaguacauuucuguuuuccacagguggacuugaccucaucuuccuuccuggccucggguuugacaaagauggcaaccggcuggggcgggguaagggguacuaugacaccuaccugaagcgcuguguacagcaucaggaagugaagcccuacaccauggcuuuggcuuuuaaagagcagaucuguccccagaucccaguggaugagcaugacaugaagguagaugaaguccuuuaugaagauuccccagcauccuaaguuacacaacgacggcuacacuuacugcucugucccgguguaaagaacauauguauauuuuucucuugucaaaaugaaucaaaauggcacauuaaagugaauauggguugugauuuuaaguguaaaaauaaaauaauauaaaauccuauuuagaaaucaauagaaauuauuagaauauuaaugcaaauggagguggaaaccgcaugguuuucagcuuagcuuucuggugucaagaugguaaguugaccuuucugucuuuuaguuuagaugaaauauuuauaaguauuagagaaacagaaauugggugugaauggaggcacgauuuuuuuuuuccauuuuuuauuagguauuuaacucauuuacauuuccaaugcuauaccaaaagucccccauauccacccacccccacuccccugcccacccacucccccuuuuuggcccugguauuccccuguacuggggcauauaaaguuugcaaguccaaugggccucucuuuccagugauggccgacuaggccaucuuuugauauauaugcagcuagagucaagagcuccgggguacugguuagcucauaauguuguuccaccuauaggguugcagaucccuuuagcuccuuggcuacuuucucuagcuccuccauugggagcccuaugauccauccauuagcugacugugagcauccacuucuguguuugcugggccccggcauagucucacaagagacagcuacaucugcguccuuucaauaaaaucuugcuaguguaugcaauggugucagcguuuggaugcugauuaugggguggaucccuggauauggcagucucuacaugguccauccuuucaucucagcuccaaacuccgucucuguaacuccuuccauggguguuuuguucccaaaucuaaggaggggcauaguguccacacuucagucuucauucuccuugaguuucauguguuuagcaaauuauaucuuauauccuggguauccuagguuuggggcuaauauccacuuaucagugaauacauauugugugaguuucuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuagguucuuuccagcuucuggcuauuauaaauaaggcugcuaugaacauaguggagcauguguccuucuuaccuguuggggcaucuucuggauauaagaggcacgauuucuuaauaugcagucauaggccugauugcucuggcauauggagacucaguuguuauuaauugguuuggcaguacuugguauggauaaaauauuccccaagaauauuauuauaccaccuaaucauggcuucauuuacucaccuugaagucuugugugugacacuuuguagcuucauguggugaauggaugggaaucuuuugugguuugcauacuuugauccagugauuggucucuggcccugaggacuuauauaagaaagcauuucugugaauucguggguuccauuuggaaauggaagcugccacggaccggacauugccagauggucucacagcuagggagagguacuuuuguugaggggaaagauuugguuaucacaagacacucaggggucuuccuggacaugucugcuugcuugguuccaccugcagccugucacuagcuccugcuggcauugccucugggaugcggucuacaucugcucucuccuuccugucuuccugcuccuaauuucuucaacucucagcauuucucagcucaauaggcaggcuuugugcuuagcuucuuuugccuccaauucauuucagggaugaucugauaaggcauaaaucuaguguggacaauccacaucaaagucuuuuggagacauuuucacaaguagaugccuuccacugugggagaaaucccuuguaaggccccccuuccucuaccaucucuucccucuccccucuaugucuuucuaugagugcugcaagcaccucaggcccucugcccagugcaagccuguuuuccugcaucucaaugcuggcuucuuuuguccugggaacugcugggcaucuucagggcucuguccuugcuuuguuucuccaggaggucuuccuuggcuccccuccugccaacucuagauccucuuucuucucuuucuguggccauugccuauuuaucacauuguccuauggagcaguuacuaauguccaugucugucccuucacgaggcucuaaguucuucuugucuucaguagaugacugauaguguuugguaacauuuuuuaaaguguaaacagaauauguguacaauuacuucacuuuaaacacagaucuaauguuuuuuacauaaaaauauacaguuugauauuuugugcacaaagguaaaaaaauauauuuuuuaaaaugucaauucaggcuaagaguugaucuguacaauuuagaauaugcaaagagaaaugaaaaagaaauggaauuacuacaagcuaugaugccauuaguauacugguuaaucuuauucagaguuacuucaccggcagggauaagguaaguguuacuauaacuggcaugacuguuggugugaaauaguuacauccuaacauuacagggcucuuguaggucgagaaagcuuugcuuucucaaccuauguuauucuuguauuaaaagagagcauguaagagccagguguaguuagaauagacaaaugacuugccagaaauugcugggcauucaagauucagaacaaucacaagccauaugaucucucccuguagugguuaaucuuguaaaccugacaggauucagaacuaccacagaaacaugucccuggguguguuuaugagggugcuuccuggaagguuuaaucaaacaggaagacguacccaauaugugguaacucugucucguggggugggauccuggaccaaaugagaagggaaaaaugaguugcauacuaaugaucauugcucucugcuuccugacugugggugccucuggaugcucugauggauuguauauuggcaaaauaaauacuuccuauaguuguuucuuaucagauauuuugguaauaaugagcauaucaccugacacacaccccuaaaaugacagccauuucugugugaccaagcuugcaccguggaauuccugugaagguacugggaggucgacacucccucccccgugaugcaggguacgaugacacuguagguagauuagguauguagauuaggacaucuaugacccggggaaugagcagcacaggguaggacaucauggauuaggauuugaaucugcagugcucccacagguucauguucugaaugguucccucugggauggcauuguuugccuauggaggcagagccuagcuggcagaaguaggccauuggagguagaucugcccugguuccuuucugacuuucugcuuccuaaucugcugugaugaagcccccuccugcugugaguaacacuucuauagcaugucuaccuugccuucaugagcuggaacccucugaaacugugagcccaaccaagccauuccucucuucuuuucuuuuuggcggauacucugucacagcaaugcgaaaguauccaaguuuacacuuucagaaugaagagagucucagaaggagccaccuauauagaggagaacuaguaaucagguacuaaccgaacccacuaaccagggaggaaccagggcuggaaaccaugagaaccacaaagaggugcaugauacguauuuuauagaacuguguuuaauugaacuagaaccauaugaaguuguagucagugguuaagaauaacucauauuuaaucucaauguuuuccugccuaaagaacugguuaaauauacugagacauggguagcuucaugcagaaacaguuccuggccccagauuuuaaaauuuuguauguauacggggguagagugggggaugagggcauguauguguuucuuguagagacuucugauuuccagcugcuuacauuguauuuaauagguauauguuuaagucuuccuccagccuauagcucuuaaaaguacauucucugagaaguuuauaaucauuucaagacccaguccagaccccaccagaaaauaauaauuccugaugagggaauggaccugcuucaaugcugcccuguguccauugggaggguacagaggggaaagggaaaggaggcauguugaaguuaaauuacuaugucagaaagaaaacugacucuccuucccacauuagcccccaacugcccauagcuccucaaugauggguagaggcucaccaaucgcuucuccaugcuagaaugcugacuggcuucaucuggugaaauugcccacagcugcucugaguacaugagugcagcuguccugucauccagaaggcacuguuugcucugggccccuccggcuucuggcucuuaaaucuuucuucucuuuugcaguggugucugggccuugggaggaggugagauauagaaacaugcugagcaacccauuggcauucauucucccuacuuugaacaguugugacugacuguauuaaucaucaucuacagcaucaacuucucugaugaggucugggcuguauguguaccauacauauguguguguuuaccauauguguguggaugugcauguguguguuguuuacuauauaugugugugugaucuguacaugcaugagcacauaugccugcagacccagaccccaaaagagggcaucacauccucuggaguuggcuuuauaugugguuuugaaguugugagccucauugaacuuggcuccucuagaagagcaagacaggcugcuaaauuguugagccaucucccuggcuuugaauuuuuaagacacuacauucuacuguguagaaacucucuauaacagaccagauggccacucauuucuuauagucuuccuaucuaugcagauguucacaccacaacaagcuuuuuaaacuauaggaguugcauaacugaguguagggaucacaacacacacacaaacacacacacacaaauuagcaaagguuaaaguguuuugaauguacaaggacugaaaguugauucaaaaucaaauguauuuuuggauccaagccuuuucuggcagugcuugcccauguuguauaucacaggacaccuaugacuacuucuccuccucuuccuccucuaucuccuacuccucuuccuucuccaucuucucugccucuuccuucuccuuuuuggcagggucucacuauggagcccaggcuggccuagaacucacuguguagaccaggcuggccuugaacuuucacagaaccacgugcuucuaccugcuggaauuaaaugugaaccauccacauuguuaauaacuaagaucacagauuauugaaaaguuuuaaaaaguauuaaacuaaguuagaaaaaacaugcuuccuauuguacuuguguaaauaugaaaguguaugcgcgucacauggguuuuuuaauucaauuacacaauauaaagucauggcaaaaaggcauuuucauuacacccuguugcuccucccuuccuucuucccuccuucucuuccuuucucuuccuuacuucuuuaccucgcuccucuuuucccuucccuccucuccuuuccuucuucuaccugucauggaucaagcucaaggccucaugaaugcuaggccaggauucuauuuaggaaccacaccuucagucacaacacuucuuuggaaaguagguuucaucucugucuuugauggcacauggccauuuaucuga

SEQ ID NO: 5232 - RNA, 5164 nt, Mus musculus
cugguccucuaccuauuuuaguaagugagcauagcuaguuauucauauauauguaguauugcuuaaggcugucuucacaguacaaaacugaccuaugguucacagugucucauagccuaaauuauuugccccuuggcucuuuauaggaaaaaaaagucaacacaccuaacucuggcucuucaccuacgcuuuccuaguuuucuugcucucuuggcugaagccugaggcaggaggaauacaugcaucagucagcucuaagggaagacuuaaguaagaagcucugcucaauuucacugggaguucuagaggaacuucauuccuuucuccaccaguucaagaaauagugccucauauuucuuaauucaaaggagaaauucucauaauacaugcaauuauccaaacuuugucucuguaacuccuuccaugggugauuguuuccaauucuaagaaugagcaaaguguccacacuuugaucuucguucuucuucaguuucauauguuuuacauauuguaccuuauaucucgcuauacuaaguuucuggguuaauauccacuuaucagugaguacauuucauuugaguucuuuugugauuggguuaccucacucaggaugaugcccuccagguccaaccauuugccuaggaauuucgugaauucauucuuuuuaauagcugaguaguacuccauuguguaaauguaccacauuuuuuguauccauuccucuguugagggacaucuggguucuuuccagcuucuggcuauuauaaauaaggcugcuaugaacauaguggagcauguguccuucuuaccaguugggacaucuucuggauauaugcccaggagagguauugcuggauccuccgguaguacuauguccaauuuucggaggaaccgccagacugauuuccagagugguuguacaagcuugcaaucccaccaacaauguagaaguguuccucuuucuccacauccucgccagcaucugcugucaccugaauuuuugaucuuagccauuuugacuggagcugagacaaaaggaugguccaucuagagacugccauauccaggguuccaucccauaauuagccuccaagcgaugacaccacugcauacacuagcaagccuuuguugcaaggacggugauauagcugucccuugugagacuaggccggggccuagcaaacacagaaguggaugcucacagucaacuauuggauggaucacagggcccccaauggaggagcuagagaaaguauccaaggaacuaaagagaucugcaacccuaucggaggaacaacauuaugaacuaaccaguaccccagagcucuugacucuagcugcauauguaucaaaagaugaccuacucggccaucacuggaaagagaggcccauuggucaggcaaacguuauaugccccaguacaagggaaugccagggccaaaaaaugggaauggguggguaggggaguggugggggggacuuuugggauagcauuggaaauguaauugaagaaaauacguaauaaaaaaaagaaaaaaaagaaauaaaugcaauuaucuuggacuguacuuagcaguagagcucauaagcaugaucugauuuaauguuugugacagcaggcgaacaagcagauuugcaggugguaaugucgaaagcacagacuggaaggcuacucacccuugaucccacagcuaggaaauagcaugguccuugccccuuaccagcugccuucagaggaggcugcucuuucagagcaauaccaaauaaggggaagaagaaagacugugaacaaauguaggguauaaggcuggugcaguucuccaaaaguuagcuuugcaguuucgaaugcaagagaacugugaaauacaccuuccccaggaagaacaaauaaacaauaaaguguggcugugcagaagaacuggcuaacacccagagaccucugccugaaggucuuguugccauccugaugaguggagcucauuagcucuccugguuacauuucauuccagccaggcuugggagacaagaguggaaggguuaacuggaaucaggauuauggugggcacuaugcuaaugucuucuguuaaugagccuuugcugauuguaaaucauguaggaagaauaugggugaagaaggaaggcuuuucuguucuuccuacugaacuucgcuuuugugguucauuagggugugucuaggggucaugcucuaguauauguggcaugggaaacuuguugagcccacaccugauuuacuugucccacugauuucuucacuggggaaaggugacauucagaaguacuguuauggaaaugucaagagucccagauagguaaguagguaggguagguaagguugugcauauguaugugcguguauguagugugugugugugugugugugugugugugugugugugugugcucacgcauguaucaggcagcagaagagaagagaaaggaagaaaagaugguggcaagccacagaaagaauuucaggggcaacagcagaugggugaagccaguaaggaaugcaguauacauucagaaaagcacuaagaucuaaacagcagaagugggaaaauaccagaaaggacuuucaaaguccuaaguacuggaacuggggccacagucaagugcacaaauaguagaagggauuuggguggaagcaguucuaugggcagggacucaaaggccugagucccagguagaaugccaggaccucuacagggcaguuucaggucccugaguuacccaauagcagaaaggccauucucacuucugcuuaauagcuagagaauuucacguuuaacuaguggccaugcgaggauagauuuacucauaaugucacuucuuuaauccaaauauauauauaccuuagaguuauugaagucggaggugccaugccaggauugaucugucugaagauaauguacucauuuuucggggucuuugugcucuagcaaucuauuaaaauucaagcaugaaggauggcuuggaaaaaauuauggccugcaaggaaaauugcuuuccagccaagucgacagagacauauacacucagcucuacaagacagacucuagggagaagcagaccaagccauguccacuauuauaaaauuuucuucaauuuuguggcagauuaauaccuuaccauaugcaugugccaugguuuugguuauuuguuuguuuugaucaguuguuacucugguggacauuucggcuguucuaccuuugggcuauuggguacacuucaacaugaagauggaaguguaaagaucugcugagauccugauuucaguguuuuuggguaaacaccuacgaguaagguuucuagaucguaugguaguuccacuauuaauuuuuugagaacuccauguaccuuuguccuggcauuuguucuuccacuucuggagaaaagugcacaucuaucaucucuuauuccuugccccggucuuucugccucauaugagacugccgcuugccccuucccugcgcacuauccugcuacccuucuuuuggcuuccaggauguaacuugacucuugacucauucuuaaaaagcccaugucaagacaaaauaccccaugaccaggacuucucacccagcuaaauuuacuuauucucuacuggagucucuagagccuuugcuucuguagcuuugggacaguugauagagaugucaucuuagccugauguuacauguuauuuuaaaugaacugucaucucuugaaggcaaggacucuguguccucucugaagauuuuacaaaacaccuauucacauguggagaggcagaaaucauaggacauauauguguuacagguuuagaagacaggaacuuuaaguuaguugcucuggauagguaaagaagacccuuggcagcaagguccaaaugcacaggacacuguccauuccuauagagauaaauuaauggggcagggauagaaaggaaagaucaaugacuucaccuucuuaauuguuuugagcaagcaggccuuggaauaggcaggcaggcuuagcggguugggucugacugcaccugagcuccucagugugggaagucagcaggcaaggugaacauguacguggcaggaacaggaaaugggguucaccucauaggaagucaucagcugcuugaugccagcacuauucuaucagaacauccuacuucuagcauccugagcugagagcccuuggcuuccagccauggucugccaugcuagcagugcugucagugugcucaccccacaccuaagcuuuaagucugagccuacccuugccugucagugggagggaauggaagaggagugggccuuguggacugcaugauacucuuaacagcuguggaauagcuccauccuuucugucuucccuggccuucucacaucccuccaucugucaugaucccaggguacuggcucccgaaccagagagguguggagaaucagcuacaugcuagaguuaaaggaaggucugaggucugcccacagcguccucucacugauguggacaaggcuaagaaccugccauuucuauagaggcacaccaaaggacugcggaaggauggaugcaggacuaacaacauugcugaagaauuauuuccuuuguauaacuuguuuuuuuuuuucaugauuacacaaggauuguauauauauauauacucuuuuaaaaaaugggaaaaugauugaugucaauagaaauaacaugcuauccugaagcagucaugaaguaaccauugaugcuccaaguacauuucuguuuuccacagguggacuugaccucaucuuccuuccuggccucggguuugacaaagauggcaaccggcuggggcgggguaagggguacuaugacaccuaccugaagcgcuguguacagcaucaggaagugaagcccuacaccauggcuuuggcuuuuaaagagcagaucuguccccagaucccaguggaugagcaugacaugaagguagaugaaguccuuuaugaagauucccagcauucuaaguuacaccacaacggcuacacuuacugcucugucccgguguaaagaacauauguauauuuuucucuugucaaaaugaaucaaaauggcacauuaaagugaauauggguugugauuuuaaguguaaaaauaaaauaauauaaaauccuauuuagaaaucaauagaaau

SEQ ID NO: 5233 - RNA, 5870 nt, Mus musculus
ugcggcugcgcgcggaguggccgccacccggaaccgcugugcugagcucgcgccacgucucuucagggggccccuccccucucccugcugucccugcugucgcugcgcgggagccuagagaggacuaggcccggagcaucaugguccacgaggcuccgcacgcuucauccuuccagaugcugcuacagcugcugcuucugcuccugcuccgggccgagccacugcggagcgcugagcucaccuucgagcugccggacaacgccaagcagugcuuccacgaagagguggagcagggcgugaaguucucucuggauuaccaggugcggcccuagccgcgucucacuggggcuacuggugcgccgccauccggagcggccaagauuagccaccaaaggcugagggggucggggauaacaaccccagaccgguugacuucucccugagaagaaacguuuguaucugccagagcccucccgaagugggccaggggcacuggggaguuaggcaggcuacaggugagcgcucaggauggggggccuguuaccgcccccugucgcccccugcagaauugaccagaaugaccucucccagguaccuccaggaacaucaguauuaauuagcuggacacccacuggguggcagucugacccaacugucacuuugggcugggugucuugcuggugcugaagucagcugcauccuuuacagcuggaguuuggggugacauaguuggagugaugaaggguuuuuuuuuuuugaaaggaggguucagugcagacuucgaacccugccaguguauacuuaaggacagucacacacacucccuccccagugguguggcuauguggcuugccucucugcuuaccauauggcucaacaaaguuagguccugcacuuuggucuccauggacagaucucauagcuaacaguugcuuugguaaaggcucuauccccuaggguuaaugaguaggcauagggucagagggaugaaugaccaccauaaagcaagaccucuagaaaugaggugacacaggcaccccaguuguguacaaugaguaagcccuucuaugguagacgcucugaagguugcuucugcugacaauuccauguaugguggagucacugaugagacugcucucacaucuauggacgacauacagugugugugugugugugugugugugugugugccugccucagcacaggcagccuaagaauaagaacaauauucuuggcugggcagugguggcgcaggacuuuaaucccagcacuugggaggcagaggcugguggaucucugaguucgaggucagccugguuuacagaguuccaggacagccaggacuauacagggaaacccugucucgaagaaacaaaacaaaacaaaacaaaacaaacaagaacaacaacaacaaccgccccccccaccccagcauucuugauguggcuagugaggcuccagaagccguugaggguaggcaugccccaucaguggggggaaaucuauaaccaccaaagagacaagccucugagaauguaaagggcuuucuagauuagauugcagugggaagagccacccuaagugggaguaccaucauucaccaggcugaauaaaaaggaggaaaccagcugaaugcuaucguucauuucucugcuuccugacucuggauaccaugugauuagccccuaccccuaccccuggaagccuucauguuccagauaccaugccuucucccugaugaacuaugcccucaaauuuauuugcaagucaaauaaauuugaauuuauuugcaagucaaauaaauuuggauuuuuuuccuugaauugcuucugucaaauguuuuguaguaauacuaagaaaaacaccgagugcaguggucacugccucuuaacugcguaggcucagcaggaugggaagcuacauggagucuguguuggaaaauggugaggguuaaauuacagaaugcuuagcgggguccccguuauggucagcauuucaaagaauugcuugccuccccaucacugcacccuuuuugugguugucagguuaucacuggaggccacuacgauguggacugcuauguggaagaccccaggggcaacgucaucuacagggagaccaagaagcaguaugacagcuucacguacaagacagaggccaagggcgucuaccgguuuugcuucaguaaugaguucuccaccuucucucauaagaccgucuacuuugacuuccaagugggugacgagccccccauucucccagacauggggaacagggucacggcucucacucaggugagugugcaugaccgugacaggacuaggggaacccucccacucucaucauguuucugcuuuuuuuguccuuguccuagcugaugaaccagaaucacccucuagcuguaaaagacuccauaccacuucuggucuccuguuucuagccagagcccucucauagcuaacacuuuuccucuccacccuuccaacucucuuucucgggcguggcacgucuuccaaaauucugacauguaccugucugcugugucauaugcucagauggugaagaacaauguccugcuucaggaguguguuggugagggucagaccagcugcugccauaacaaacucauaugucagggccuagcacacuggguagugcacugcucucaggguaguuuggaaaagguuggauggugacuugggaauccaggcucucucucucucucucucucucucucucucucucugugugugugugugugugugcuuguuuuuaauucucacuuccucuucauauucucuuuuucucccucccuucccuuuccacuuucccuuucuuguuaucucccuaucucucccucuuucccuuccuuucuauucuuucucuuuuucuuuuuuucugaacuugggaccuugcuuagcacauacucuacuacagaacuuuguccugagccucaaggcucuuucucgccauccuucuccuuucccucgggcuucagcguucucugucccuggauaccaaaagaggcagaaaugagaaaggcacagcugucccuucaaagccuuggccuguaguaauacacauagcauguccacucaugucccuuuggugaccacuuguguaguaagucagcacagggcggcuacuaaguacaaucgcuggacaacaaauccccacuguggaagagaaguugcagcaauuauggaggauggauaguuuccauugacuuccauggcucucaagauuguugacuaaccucagccuccaucuggaguucuucuuucuguucucccucccuccuacauauaggcugggcuucccaagggccaagccucugguaucuaucuaccucuauauucuugauaccuugguguaggaggugugacaccaaauacuugucuuaugacugaucaccauggccugaggaaccuguaagacaggaauaaccaucuuauuucuugaccaaagccagaaugucucaaaucucuaaggaggccaguuuuuccuccugugugcucucugaggagaccauauguccuauuucucuguggcucaugcccaguuuccuaccaucucugggagguuagggaauggaguuucauugcccaguacaauaucuaguauguccauuuggcuguuuagauagaaguuagaagauccagcugaagggaucuucaguucuguuggucauugaugaaaccauggaaguuuaaggaaucccucuuguaccagugggagaaagugagagagaaaaagguucaugcauuagagcaacagagaaugucuugcuuggaguuucaguuccagugugagucuguuguggugaggaggacagguggcauuuguaaauuuccucuuucaccaguccauuuuacuccguaucguaugguucucuuuuuacccaaugccugcuuucccacauccccugaaguaacuaacugaaauguugugguaacaagcuuugugguagacuaguaccaauggagaccccaguggauggggagguagcauccacugaagauaagggaguguucuucagugugugucacuguuggugacuuacugcuuuggguaggguuuaugccauguguccuaaucaugggcugugguugauauaugucccccuagccccagggguuggacuaguguuaagcuagggccaaggguuggaggaauucccacucuguggauccagugaccacuaaguuuccaagugugcugggacagaaaugaacuuagagaauggauuucuaacuuggagaaccaaaggagccauucccuggugcuuaaaaacaaaguaccuguggauuuauauacuugaaagcauguguguuuguacauguauguacauacacauaugcacguacacagccugugacugaacacacaccacacacguaugugucuuuauccaccuuuccuucuaaugauuuccuuuguucuugaguucucugacuuuaaacuaccccaagcccacucccauccagcauaggggcuuucuuaguggggaucuucuucugccagugcggugucaacuguagggcucucuggaaguagaaugugaggagcagcaaucccaugugaacaucuguguguaugugcaugauuguauguucacacguguuguguuuauacaugaaacuguagacaucugcuauacaguagaagucuggcauaaucaagucuaguucacacagcuuguuaguuaguuggguaccucaagccguucaucuagccucuuugagcucaauuucuuuaucaguaggauaaguaagcuaugaucugguuguccuugacuggagguagugauccagucugucagggcaucgagaggauuaaagaagauacacagacuauggcuugcacacauaggcugauucuguuacuuauuaaacuugugugauugaauaaguugcucucuuugagcccccccucaccccagguuaucuguacaauugugaaaccacauaaagugcuuaacacagaccccucagaggugccaggaauuugcaguaaaccuuggcugcuggauuaugcccugccugacuuaggguuagcaacugacuacuguuuucuuccugccuagauggaaucugccuguguaacuauucacgaggcucugaagacugugaucgacucccagacacacuaucgacugcgggaggcucaggaccgagcccgagcugaagaccuuaauagucgaguguccuacuggucuguaggcgagacuauugcccuguuuguggucagcuucagccaggugcuacugcugaaaagcuucuuuacagaaaagcgaccuguuaacagagcgguccacuccuagccucgaagucccucccacagucccucaccccucccgggucucagguuccuacagggcugguggugugacacagagaagagggagagcagcagggagaccaaaggcgcacauaucugaucuuugcacuccaacaacggaagcucacagagccccgguaaucugauuguauuguguguguaacauuggccaaaaguguuuacaggucaaccuaggguuuggucacuacgggaggccagugaucuagcauccaaucuguaggagaacuccaagugccuggaccuccagggcaguuuaggguucugccacuacuccaugagacauuggucauuaggugguugugucuucuuccaucuugagaaagggacccugaguucuugccuucccuucguggaccucucuauuccugaggaaagcuggucuaaucuggaaacaguagggucagacauacaaccaggacccaaguagagagugagugagugcccuuggugaucuaugucuccuggaggcagaacugugcuaauaaaaaccaagacugagcauucuggag

SEQ ID NO: 5234 - RNA, 3344 nt, Mus musculus
gguucagaacuuagccuuuguauacacagcaccagaugaauccccaacacaucccccuuuugccuaaauggaaagcuucuuucuucuacacuaauaaaugacauauaacaaauaugaaacaacuaugaaaacuauuaaguaggaauuacauuuacaauguccagucugucugguaaguuuuugguaaaguauucuaaaaucuauccuaucuugguaaguuuugaauucuguaccuaaauaauuuucuauauaacuuggauaugccuauguaccuguauauaacuaacauauauuauauaacuauauagcuaauaacuuguacuacuaauuaaaauauagguuauuaauaacuaauaacccauauaaccaacaacuuguauuacuaaccuaaaaacaucuucuuagaucuaaaaacauccuuuugaauccuagacaacauaagcuuaacugugagacuacagcuaucuagucuucaaccccaucagcgacuugagaaggaaucaauauuaccugaggaugcaggaaguucaggcaagcagcuuccaaaacuauagaaaugacagagaaaguuggcugccugaacagucccccagaauuucucuaaaacaguggagcaucaucuucagcccucuggcccagaauaucuggcagaccuuucugugaagcaagaacuaugaaggacuugccuaccuuguccuugcaaagcucagcagucaacuuuccuguguccaguuuggaaagcauuuugucugaaguugagguaagggcacuuucuugcccagggacuagcuugcuacauaugaagcaaacucuauauggagguucuuugauguccgucauuccagcacacauggaauggcagugcugccgggaagcagaccugucucgucaaaaaaaaaaaaaaaaaaaggcuuuaauuucauaaaauauuuuaaauguuacauucuguagaucuuugauauuucugaagaccaucuauaauauaucugaauuguuuauuucuagcuauuuacuaucugcucagucuaggaaacauauauuuauaauuaacuaaacuaauuucuaacaugaccaugaguuugguugucuggugauaauuugcauuucuuuuuuuuuaagauuuauuuauuuauuuauuauauguauguacauuguaacugucuucagacacuccagaagagggcaucagauuuuuguuacggaugguugugagacaccauaugguugcugggauuugaacucaggaccuuuggaagaacagucgguacucuuaacugcugagccaucucaccagccccaauuugcauuucuuaauuaucauaaauaguugguaauaucagguaucauggacuagaacuuaacauuacauuuuuaaaugaguuacauagguacaauacuauaauauguuguagcaaaauauuaauauauucucauuuguaucaauauacaagccucuauaccaauguuacauuauuggcuauaaagcuuuuuuuguuuaaaaggagauucagccgggcaugguggcacacaccuuuaaucccagcacuugggaggcagaggcaggcggauuucugaguucgaggccagccuggucuacaaagugaguuccaggacagccagggcuauacagagaaacccugucucaaaaagacaaaaaaaaaaaaacaaaacaaaaaggagauucaauaaucuauccccuuuucuauuauuccuuuaauauuccuauaucccccuuuuucuuuucaaccccucucucccuacauaagaaggagucaguagagcauagguucuuaaucccagguucaugguuuugugccccacguugggugacagauauaaaaguaacuuuuauucaccugaaguaauugucauuucccaggguuacugccuucauuugcuaaccuaggccuaguccuggaauugucuggccuggguacaaucuaaucuaggccuagaauauucucagccucugagacuuacugcugaauaagcuuacuccuuccuaguucuuucugaucucugacugacuagcuguucuggauaaaauuucucaccaagcugacugauucaaucugguuucucucuuggcuucugaauugcucucuugaucucaaacuaacuuuggcaauguuugaaggucuggguacugcugccugucuaaccagccauuuuaugcuguuauuaauguuacaaggaaacuuucucauauacucuaacuacuguuaauaggaaacuuucuuguacccggguugauugaauauucuguuaucuucugugcuuugauggucuuggaaaccaaucacaauagaagucagaacugcguugcauaguuagccacaauaagcuuggagaugaaacaauuaaugugugucuuuugugugugugucugugugugugugucugugugugucugugugugugagacugugggucucugugugugucuuuguauaugcuuguguauguauuuguguguguguguguuugaucuaugugugugucuguguaugugugugcaugugugaugugugucugugugugugucuguguauguaugugcaugugugucuguguaugugucucuuuuguguguguauauguguguguauggguguuuguggccuagagaugacucuguuuccuuacugaagcacugcuaaaacuucugagcagcuucauaacuuuucucauguuuaccagacuaagcuccaugacaacagucauuguuucauucacugguguauucuaaguaccuaaaacaaugccgguuuuauaguauguauuuaagagauauuuucaauacauagauagacauugcgugauugacauuccaucaugggugucuacccuuacuccuccuccuaaggugauuacuuugguuguuuuccaucucuugcugugacuguacacuucacaugaguucauauguaggauggaauguuugaucuagaaucgcuaguaagaguaugugcauuuuugguuuaguguuuugagacagaauuucauguaaaccaaguauggugguuugaauaggaauggccaccauagccccugaguguuugaaugguugguccauagaaaguggcacuauuaggaggugcggccuuuuuggaguauguguggccuuguuggaggaagucugucacugugaaggagggcuuugaggucucauauaugcucaagcucuguccaguguggaacacagucuccuucugcugccuguggaucagauauagaccucucagcaccauauuggccuguacgcugccaugcuucgcaucaggaugauaauagacuaggccucugaaacuguaagccagccccuauuaaacguuaucuuuaua

SEQ ID NO: 5235 - RNA, 68781 nt, Mus musculus
ccugcggagggcgcggcgcggggaggugggcgcugcggcggcggcccggaggagcgcggggcgggagcgcgggcgcgggcgccggcggcaggccaugccgggggccggggacggcguggaggagagcugcagugguggugagggagcgguaccgggaacaggcucggaggcuggggcgguggcgggacgggagcccucgcggcugugcggcuaccugcagaagcugucgggcaagggcccguugcgcggcuaccgcagccgcugguucguguuugacucgcgccgcugcuaccucuacuacuucaagaguccccaggacgcucugccgcucggccaccuggacaucgccgacgccugcuucagcuaccagggccgcgaugaggcugcggagcccggagcagauccgcccacacacuuccaggugcacagcgccggugcagucaccgugcucaaggugggacgaucgcgccccggugcccacucgugucccgucagcagauuucccccuccaccuuccuuccuugucccaaaggccuccuccuguccugcccaagccucucuuugccacugccuacucugauuccuuccucauucuuaucuuuuuuugcccuuuaccugugcuuggacuaugaggcugagucaggguuggggguuacacagcuaaucuuuugacacuuugacccauuaucucccgauacgccuuuccucgcuucccuccuguguccacgcucaccauuccuuggaugcugugggagacccucccacaguugcaggcuuccacccuccaucccugccuaauuuauaacuccuccugugaccuuggguccucugaaagaccccucugugcuucagcugccugcucuguaaaguggggacaacaguauugggauuaagugguuuccacucucaaguguuuaguaaauaugguacauugagugcuauagccagaggcaagugauaccagggccccgggaacuaauuugccacagcccccucuagagaggucgggguacuccagcagugcccacucuugcuucuuggaaaaggugggagggguugcuucagcuuaugggaggcuuccuuaggcuuccccagagagauuugaguauuggaggcuuggcaauggucaccagucccggggcagcauuucccuguugcugagaguucuaaaggccaggaccuugacaucuccuaggaaugguccuguuuggagcacccaagggccuggaccccuggccuagggcugggcugccucucacucugggccuugcuccccgcuugguucccugagucuccacccuccuuuuucuggcuucucuuccgucuugcaagcugggcuuucuccagagccacagggcugggcuugaagcagcagcccucucaaagcuggccaaguggagaguggccuugugagcaugcaacuguuccugagcucugcagaccgugcagcagcuggagcuguucccugaagcccuuucucagagcuuugucgacucagcagagucugacugggggaacagggguggaggggggggggaugcugugauguucccccccacuagcagaugcauaaaauguuucucuaaaggaagccaagcaggccugcaguucaacuugagguaacucagugucuguguaaacuugggacuggcucccagagcguccacagggagcuuugucagaggcagaugcuugcccucuguguacauguggacccuggugaauuuccgguggaauugccugugaaaaaaagaaaacugagcuuccuguuucagauucucucagauagcuuuagaacucucucccuaccaggucuuucauuuuuuaaaagcaucuaagcagcggcagcaucugccuaagugaaguuacagugcuuaauggacggcuuuggaccuggauagauuugaacuugcagccugagucaucaaccauguggauuggacacauuuuaucacuucucugucuaguuccugcuuuggucuaauaggaauuucaccccucccccgcccccacccacccaccccccccuccccccgcccuguggauggcagcaagggcucuaggaaacauuacggaaaaaggcuggcacguuguaagcacuaccuggcagacaucuaaaacagcaggcacugucuuugaccgaauaugugguauagucuguugaauuaaauauuaauuggggacuacuuaacaauagucauucuggucauauaacagaauguuauggguaauaaacaggaaaucagaguuguaugugucagucugucugucacaaauguaaaacugagcaaggaauaaguuacagaaaugauaccuuuuauguaaggauuaagaaguuuauaugcaguaucaaccuuaaggaucuaugcugugcccugcagggaguugggaagcuacgucauagagacaagcccugguuucagggugguagauaacucugauaggaagauaggauuauggaaggggauggauauucuagggcuucuacucuggcucugcaaggcauuucaccugagacugggucauagcugcaccaggguugauuguguuuuacaacguauccuuccauagcccuggucagccuugcacucagaguuucagugccucugccuccugagagcaaagauuuaaacuuuuuuuauuuuacauauaugaguauauguauauguccugguuccugcacaggccagagaagaaaccugaaaacuggaguuaauuacaguugugagcugcagugugggugcugggaauugaaccugggcccucuguaaaagcaggugcucuuaagcuauuacacuucuggccccugauacuguuuuguuuugccuuuuuaagaggaggagggggacacguucucauggguuacugacccaccugauuuucauucagauuuucacaggcuucaugaauauucaugcagaccuuuuuuuuuaaacuuucuuuuauuuuaugccuacauuuaugaaagugugccgugccugugugugugugcugugccuguggagaccagaagacuuaaucagaucuggaagcagaguuacugacaguggugaaauaccagggaauugcuaggaacugaacccugguccucuacgagcgcagcaagugcucuuaaccccugagccguuucuccagcccucaugcaagacgguuuccuauggaaaguuagaguguuggucugacagagguggugggaaugggaaaaggcagggcuuuccugaagagaagggcaucugagauucaggggccagagucaggguggcuuuguucucuaaguggauuuuacgagacugggaagaacugcuuaagaggaccuacauuugauccccagcacccaagugaaagcugggcauggcaucaauguaccuauaacccugcuggagagaaacagggucccuggagcugccuggcuaaccagucuagucaacugagggcucuagacacagcaagagacccuaucucaaaacauccaacauuaauuaaucucucucucucucucucucauaagcauagggacaggcacauacauacauacaugcauacauauacacacaaggagaacuucaggacacaguaguuccuccugagcugcuagaguaaaaaauguacauuggaaaagcgggaaaggaccggucauccuccuucucaugugaucugauucccgugagcauggaagcuuaacacaaaggccaggagagaccgcgguuuccaaagagccggugagggcuuaucccugcuccaguucgagucugcauauaacugcaggcgccauuucuucuggaaaggaugaguuaaaaagagaagaaaagcagugauuugcuuauuacguaucaucauguguuucuuauuuuaagcaucuugcagccuucuccggagaagcuguggcuucauugggcuuuuucaaaaugccugacugcuuaagucuuaaugaaagcugagacuggaauuucuugguaaacuccucuauucuuaaagucagggaucugguccagagcccuauuuuacagaugcaggaaaggaggccugagaaggggcuaggaucugccugagaucacaaggcuagacucaggccaucugaaagcagagucucuggcaacggggaguguucaagucccauuaucugcuuuggcaaaucuucucuccagacuuuggguucugucuuguuuuggacuagguaaagucuaguggcuuucugccuucacucagucccuuguaaugcagcgaguaccuagaaccuuguccugucugguucugcuagcuggaggcauuuuagcuuuaauguagaagcuacugcaaaggccuagaagaggcaggugcuuccuguggaguguaugcagggugcuagaggcuucuuuuccaacuuuccugggaccagaggcauaccgauauuucuagauuugaacugguauugggaguuaagaaagcaugugacugaaugugggcaaaauuaggacguccuugcccuagcugaucucugcaguccuuggagcaggauauaucaucauaguggccacaaaagaguuuccuccguguucucccuuucuuguaagcauuuggugcucacguggacauguguguguugccuguccguuuccgaaucacacguaacugaacaacuacggaucccuacucuucagccccguuuugugagagaagugcccauucccuggagcugagcggcucucagcuuaaugacaaacauuuguugguguggguaaucauagugugcuggacacagaauagaugugguaaaccagucucccuugcugaaugcuucugcuaagcuguucugcacucaggcgucuguguaaggucgugaagcauuauuuaauucuuaagaugugggaacuuggcuuuucauugauguguuaugguuucucagggaggcaguuccuuaaaggcaggcauaucuguucaaguuccuaagauaguagcuuucugucucucccugccucucgcauacuccuuguuguagggacucucucuacugugccaugucuagucuagcucucugccaacuuuucagaacagugccuuacauaaaguagcucugugcuguagacugagugaauauuuauuaucuuucucaaaguugauauggaaugugggucuucauaauuuuuuuuuuuuuuuggccucuguaaggucagagcauaaaaguguccuuccuuagacauugaaugaagacugguuguguguuagacacaggaagugccagaucacacauucauauguccuugccagucacugaugccuuggcauucagaacuaugaagaauaaauuucugcuuaagccacucggucuaugacagcaguaucaucgucaucaucaccaucuucauuugcaugugugguguaugugugugugcauggcauaugcaugugaguguuuaugcaaacagaagccaggaggacauuuggggcaucuuccuuuauugcugucugccuguucccuugagacagaguuguucacugaagccaguaaguuguuggguucugccuuuuuguaucauacccaccccaacacacgcacaugcacaugcacaugcacacacacagagucacagaauacuaggguuacagucauauacugccauggccaacuuuuuacgugggugcuagaaauucaaacucagguccucaugguugcauagcaagcugagcccucuccacagcuccagugaaggucccucccacccauccacccccccacccccccaccuaaacuaaaacaagaaacccaagccaaccuuuguuaccugaaggaaagucauuaucaccaguaagcauggauauuagcgugaccucugacccuuuagaccugaucgucuagaacuuucaaauguacagauguuuuaaaaacauguuugccacaugucaugagaguggcugccauucaguaaaaagccaggaaaugucacaggcagucggcauccaaaagaagguucuaauucagcccuccccagagggaagagugugcaguccguccuguaugugggaguuuguggugucuucccugcccacgguuuggacucuggggacacuguucuagcaagagcaaacuguuuuacggaaaggggcauagcauaaauacuugaggcugcaaaggccacgccaucucugucauuacucuguccuauuguaguccagacacaggcuaugcuggguauagcuggguucccaaaauuugaauuucacguaauucauguaauuuucuuaugucacaagagauuuuucuucugauuuuuuuucccuaaccauuuacaaauacucauuuuuaaaacucuguugcucuugggcaacaccaaaguaaacagcaucuggcccugaggagggaggacuccuacuguagggucacuggcccugaggaggaaagacuccuagaguagggucauguuuagacccagccauguucccuucgccucacugggcuuacagcaggauucgggucucugcuccuaagagcuggagcagucagugaaugguaagcagacauugaugacuguucucccagguggcugucuucauccaucuggacugcuauagcauccuguacacuaaguagcuuacaaauaucggaaauggguuacuuacaguuguagggccugggaaaucugagcccaggguguaagcagauuuagucugcucacucugcuucgcagacgauaccuucuggcugggcacucacgugguagaacuuaaccccuacuucaaaacaaucccauuuaaccaacuuuacucccucuuuuuuucccuugacauagggucucauguagcccaagcuggccuugggcucauauagccuugaacucagauccuccugccuucucuuccaagugguagggcuauaggugugcaccacaucugguuuauguaaugcuagagauugaaccccaggauucaugcaugcuagguaagcccucuaccaacugagccacauccccagcccuuuuaucuucauuuaaagacaaaguaauuaguuuuaucaaagccuucaacgaugauuguguguguguguguguguguguguguguguguguguguguguguguguacaccuacagaacaaucuuggaaacaaugaacagguucaugguuccuucagcuugggugcacccuuuccaacaaggagcuuccuucgaaggaauucuuuauucuguaaagguaaacaggaguccaugcucacagguguaauaacaacaaaaacagaagucccugagaagcuaccacaauuggacauggagccggcacauccuaguacucagagggcuguacagaguugcauuucugcaccagugagauggcauucaggugugaagcugggucuucugauugcuccgcuacaauguauaaacagagguggacuguggagguaacugggcugaggaaggcugucgcuaaguaauaauguagccuugugucuacacccaauuaccucucaaaccaggaagaugacaguccuagcaacagaggucuaaguguuucucuucuguugucaguagccuaauuggggucuuuucagaugacuuacacucuaucuguccacuggccuuccaaaguccuauugcagagucaaucaaggguuaggaaaccuuuguaccaggcucaguucaguuuguucuuuuauucccaggaucaauggaggaaaggcaugcuuuccacaugcaagauaaaugagugauucugacagccgcuagccacagaauacaugaauucgguugaucccuuggggaauuccccuagauaaggaaccuguaaagagcuugggcccuggagucaggcuuccaaugggugaauuccugccucaccugccuguugugugcuguugagcaagagacucuagcuaaugaugguuucuacuuuauuagcagccaauaacaggcgguuaacuuugggaagugcuuggacagaaccugggacacuacuggcaacauuuuaaaauuaaauguuaaguguauaaauggauagagaaaaugugucccagacagugagguuuuguugagucaugaagaauuaaauugcgucauuugcaggaaaauggauugauguagagaaugccgugcuaagcaaaauaaccuagacucagaaagaaaaaaugucacauguucucucucaugcggagucuagaauuaaaacauuauguguguuuacaagguuacaucucugugugugugugcauauacauacauguaugaaacguguauaugaaugagaggguacaugaaacaugaaagaaagggaacgacuugggaagaggaagggacucaaugggaggggacuaaaaagaguauuggggggaugguggaaauacaucguguauauauaauaugaaagucauaaugaaaccuauugauuuuuauaauacaacugauauaugcuaaaaguauaaaugcuaaaaguaaauauuuucaaguagauaaauguagaauuggagauaucuccaacaguaguuucuaaaguaucuuugcuuugucauggcuaagagugcugacaccuguggugauagccugagaggaccugccccacccugccccgccccagacuucucuuccugaugccuaaccggguguuucacauuuuuucccccuguguacauagccaguucguuuccucuuccaagauaacugucuccugggaaauagaggggucacugugguggcuugaaugagaaugguccccauaggcucauauauuuuaaugcuugcuccccaguugauggaaguaggauuaggaggugugcccuuguuggaggaggugugucacugggagugggcuuuaggguuucaaagucagcucucccugccuccagguugucuucuuaacgugugugcucucagcuacugcugcagugccaugccugccugccugcugccaugcuccccuccaugguggucauagacucuauuacccucuugaacccugagcccccaauuaaauucuuucuuuuguaaguugccuuggucuugauauuuugucacagcaauagaaaauuaacuaaaaggaguaccaaguguacuugauacugauuuccucccggacaaaggaucugcaggggaugacgggucucuugguugaaccacuuaacaauaagccacugguugcagccuccccaucucuaguuagaacagaguacaaacaguaacccucuuccucccaaaaggacgggaggacccuauugauguacaagugauucucagacugggaaagagaaaggaguuuugauuaagaauuuggugugagugggaauuucccuaaguccucacgggccagggagggcucugcugaguuuaguuugcuuucaugggaugccugcgguauggucaucgggaguugggaagugaugauaccucugaguaguuuucuguaaauccccuccaccaaaagcacucaguucggauaaugcccugggacuggaaagcuauagggccuugugcaggccagaagccacgagggcccgggagacugucucaccaggauuuucacuucugugccagggauccuuaugcuggcacagcaagcacuuaacuaacacugagccaucucccuagccgcugucuaacuucaucaagaaaaaucccuggggagaagaugagccaggagaguuaggcuuugguagaaugguggagcugccugaugaccuagugccucuugcgugugcagaaacguccccagggagaugagagucugaaccaucuagugagguuuuaucccguguuuggcucaacuuuugcaaagauuguauggagaagaggaauuggggggcuucaggaggaggaccuucuggccuccucugcuuucacuacugggccuuucuugcagcagagugccucaaggcagcccaagcgcuccugccuggaggauggccggccaguguuaucaggauguugaucuuggauuaaaggaauuacuucuaggcagccagcccaguuugggaagacuguguagggaagguggccugacuuucuaaaugugauugccgccagcuacuuacccagcaggccuuauagggccagguccugacgggucuccagcuggagucaacuaucaccucuggccucagggagcgcuuaucuuguguguacacuggaaugugaucagggcacugucguuaaauggcucuguggucuggaggaggucauucuguguuggugcucugcccauugcuccaaagucagaacuagagagucccccgagauaagccugcccuuccccugcauauaacacauugaggaaaacgauuccccgcugugacuucaucuuagagcuaaacucuccugcagacacauggcccacacuguuggaggauaccugcuccacaguaaauccauuacuaggaaaucaggcuuauguucuaacagucuuauacauacucucaauuguucauuuaacacuuuguuuuggacauaaauugaggaagcuuaauugcacgaaguuuggaaauggacgguagagauuauaaacuuccagugggagcugaccaaacagaagcagggaugggucugugccucauccucucccacgccuuugugauaaaguguuuaccaaaggaaguaggcuuuuggcuagagcaaauccucuaaccguaagaagggaacuuaacaguuuaccaaacucucacaugugccauuccagagguaacaggcuagcaagacuuuuccuguccuuugaagaaauguggcuuccucggaacagugguccugaaaguggcuauguagagcaagucuccgaugcuguggaaggacaauggugggcuuccugcccuccuggagacucagccaugcucaguaggccaguguaggcuucaacggucugcauuuccaguggauaucccugcccuucugcuguagaucucuggccucuccucucugcuuugugggucacgagugacuguucuuuaggguacuguuugaugauggccaugaugucauagggcaccuugggagagccguuacuccuuccauuacaugaguuccggggauggacuucggucgccuucucucuggccuuugaugguaaagcaaacuaucagaaccacauggguggaaacagugaagugugagcccuuucuucucagguuagcagucugugguuuacagcugcagucggcuuugcauucuggguuucugugcucugggaggaggcaguguuggagcagggcuggccagcaggccccuggcucaggccacaggaguuccuacuugacuuugcagugucagagccaccauaauggagcucucuuggaagcuucccgugcucccuuccucuggaacugaacgcauuugacaggcuuugccguuuccugagaggaagagcaggcccagggaguggccuugcccgugcaggcauccugaagaaccuugccugcguggauagcccgagaugagauguaguucagccagcaccucacaggcuggccgugagugcugcaccuaugccuucauacuuucagccugucuucugauuugcuaguggacuuucuucuaaguccaucaccagcaauugcccuucccccaacagcagggucccacugcgggccaggcuggccuggaacucgccacgcagcccauguuaaccucagccucucagcaguggaauguugggauuacaggugugagucccuguacuuggcugccaucuauaaugguaucaaguuaaagguccuuuaagaaacugcuuuucucuugaagauuuuuuuuuuaauauggaacaccucacagguugacuuaccauuucuucauggggccacaccaaucuucucugcuggucuaguguuagccuaugugccgcccaagcuagcacaagcauuugcuuuguaaagcauacugcucggaugcugagggcagcagcaccguccagcugggcacccaucaguaaguaagaagcacagaaaguguccagcccucacaaaggagcuggcuuagaguucaagugguuauuuucauaagauaugugaaaaugcuaauuucuaugagcaauuuaaagacuuaaccaaugagaauuuauuguuuucccuaguaguguggaguaggugaaaucgcaucuuguccucugaggagcagaaggcccauuauuagcugccucagccucucacuugggcucaaaaaaccuuccagaggaagcauguauuuuuccauuaguauggaccacaaucccucgagauuguuucuaggcucauacaugauugugaaacacucaaaagaaaacauuggaagcugaagucuguuagacgugggauguugucugccauccaucuuaacuuuguuuuguauuaucagacuuaucagcuuuuauugcuuauggggaaaguuccuuggaaaugaguauaaucuuucuuaaguugaagacgugaggcccuucccauuaaccgccauuacagccuuugggaacguggguaaaaccuuuccugugguguaugcagcuuccuaguaugcagacuucccaucugcauguguguccuuccgucucacuucuguguuacuguugaaucugcuguugcagcucuuaaaugcagugggaccugaccccugaggaggaagucagaucuuaugcagauccgaagccacugucacgaauaacgggcucauuggagaaaugaaagauuggcucugugggggacgugggaugcugagguaguuaggugggagguaguguuguggaagcagaacugaccugcucauccauugugcaggaggaaggacaugguccuguggugugggcagugugggcccuggcccuggccagaugaguuggccuuugaaaacauccaaggguuuggaaagcgaagccuagaaacagccauccuguuggagggccugcugcagaggcguggcuaguuuaagagcuuggucaggguaucagcagaucuggugggccugcucugugugaacguuuaaacgugaucuaaagauugcuugcugcuuuccauuucucuucacuguaguuuuaaacauuuguuuauuuuauguguacgaauguuuuugccugcuuguauaucugugcaccacacaccugccugguacccucagaugucagaacacaguguuggauucccuggaacuagaacuaugauaguugugugcugccuugcggguguugggaauugaacccuguucucuaccagaacaagugcucuccaccacagcccugcugcuuucuauuuuuaaaccauguccuuaaguagaacugugguugcaugcacccagugaaagcaccucguggacugcugcucuugcucucucagcaccaggguaccaugccugugcuccagaaccgaggcccugugcacugguugaugagugcguggccuccggugugccccuaaaaccagcaccgccauaggguuuaaguuaaacuucagugugguucaaggucaucaaccuuucagcguuugagaaaagccauagaggaacuucuguuuccugcugaaauacagagaauggagucugucuuaggcagacucucauccuccucaggaguggggcaugcagacuuugaguuugagaguggcaggacacuggcugagaaagcugggugaacaaaacacccccgccccaugaguguagcaccugucaagucagaacagcacccgggagccggaugcuagggagcgggaugcuagggagcgggaugcuagggagcgggaugcuagggagcgggaugcuagggagccggaugcuagggagcaggaugcagcccggaugcuagggagcaggaugcagccggaaugcuaguguaagccuuacccagcucacagguggggauguggggaugcuuaggcuccaugcauaggcagguagaugaugcuauuuggggagaguauuaugaggcuuagaugacucuguagaacaaaaugguuuuauugacaguguuacauuacuaucaugcaaacgcggauggcuggaggcuggagagccuguacuucauuacaguuuuguuuuguuuuguuuuguuuuguuuuaaagaaaauugguguauguguuuauagaaaaauguucagacagaaggacaccaaaguuuugggagggaccauuucuggugauguaguuauggucacuuuauuuucuaauuuguuguccaaauucaucacaggagugaguguguguguguguuccuuauugcuugacauuaaagucuaaauuugugaccagagaggugacuuccuggcuaagaguacucgauguuuucauagagaccccgggcuucgcucccagcacccacguggcagcucacaaccauauauagcuccauccaguuccaggagaugugacacccuuuucauauccucacaggcaccaggcacacacucauauauacaaaacaaaauaaauauugaaaaaccugaaauuuaaaaugaacuuuuaggcuaagcacacgggaggcagagauaaguggaucucugaguuugagucuagacuggccuacauagagaguuccaggguagcaagggugagauccugucugagaaggggagagagagagagagagagagagagauuaaaaugcacuuucauaaaagugcagaagaguaaggucuucgagguagcagaacgacacugggucugggcagagcauggauucccugcagagcaguggcagccugagacuccacaucagaucuucaggcuucucgguuuaguuguggcauuuuuagucacauggauauuuucuuugcuugcuuacauugaggcuuuagaaagacuuucuguuccaagaaaguagaaaugugaggacauuccuuccacguugcuaggggagagagucaacccugugacucagccuggagccagccccccagaguugggggugggggguggggggcagagaaucagcuagugacuugcaguuucaagucuguccuucuggcugucacuucuggccaggacuaugcccaaagcagaccucaccgcuugcugaccaaacucucuuucccguugaucucucuccacuccauggcucuguaaguccagcccuuccuucaucuccugaaaaaaugcaauagaaaucuaagggucucuuaacccaagaggcagaagagacaaacagucuuaacuauguagacauuuccuuguaacuuuguggauuuuaauccauucauuaauuuagcaaguucacuaacuuguucaucuaaugauuuguauuuaauauauuaagucuugaaucaauuuugaaguaauucuccacuaugacaaguuucucauauacguuguaauacauagugauuuuauuuuuuuccagauguuugacugguugucagugccauuauucaguagguaauccuuucuccacugguuugauuugaauuguuacuuaaauacucauuuauacacuuaaccuuguauuuugauuugcuagcaguacauauucuugcuuuaauuauuguggcuuuauaauaugcuugacuaggauaggacaguuccaugcccguuauuucagagugaacuucaaaagcguuuuauggucuuuuugccaagcuuugaauuuggaccagacuuuuuuagucuggagaaaugaaagauaucucaguuauauagcugugguguguguguguguguguguguguguguguguguguguguuacuaaucuuuaaaacugcuuaaugggcuggagagauggcucagugguuaagagcaccaacugcucuuccagagguccugaguucaaaucguagcaacgacaugguggcucacaaccaucuguaaugagaucugaugcccuccucuggugugucugaagacagcuacaguguacuuacauauaauaaauaaaucuuuaaaacucguucauucagaaagcagccagucugagaaaacaguggauuaacauucgaaaaagaucugucuugugucucaccuccagccagcucagcauuuuaugucgaucuugaugagcaagagucucauaguuugcugcuggguagaagaaaacguuugcuuucgaacugucuccgcgacaggaaucacuuaggucuucuuaagaucugugucccuuagacuaacugcuaggacacggugcuggcuucucucuaaugcaccauugucuccuuuucaucuuuaggggggcuugggaucaguucuuaggaauggggccauggaccagggaauuaugguuuauaaauguacagacuaaguguggggguggggagacagagacaugcaccacacauucagggaugugcguguauguguguauauucauacagaggccagaggacaauuuuagcuguuauucuugggugcuuucuauguccccuuucucucuuuuguguguguguguuuguuuuugagacaagguuucuuguuggccugaaguagguugacgucuaaccaacaaggccuaaaguaggcugacaucuaaccagcagccccugggaucccuuugcugugucucuccagcgcuggaauuauaaacguauguuacugaugcugcuacuuuccuuuuuccuuugccuuccucuuuuuuguaauguggguuuggggaucgaacucagucccucguacuuccaaggcaagcacgcucccaacccagcccucccaauuacagaguucugauaggugagcauucucaacuggaggaguggagucccagcgagugaacagcugaggcgaggcagucacaagcagagacugcgcuaacaggugaagcccagcucccuggcuuugcugcuaaguccucagccaggcuccccaguaauacguccuaccguggugagcccuuaagagaggucugcugaaaagguuugcauaguuaaugacauaaaagucuaagucaggcaaagggaccaguaaguguuauacaauauacaucguaucugggccgucgacauauaaaauggacaauaaauucuuuugacacuucuaauuucuuuauuuuaaaaaagaaauuucugcugaaaucaacaaccuuggaauuaaauaaaugacuuaguguaguauuauuuugagcaccgaggugaaagcugucuggguuggaggaaaggcaguucuuaggguccucaagaaggaacagaaagccagggccugacucaucuaugggugaguggguuccucgauucaauacugugguggcuuaaguauaagaacuuguggcagcagcuggagcaucacaugguacuucuuaggcagcugccaauaacaguuccuccucaaccgaaugaggcaugccaggcaccauucucugauuuuccuccucaaccgaaugaggcaugccaggcaccauucucugauuuuccuccucaacugaauaaggcaugccagucaccauucucugauuuuccuccucaacugaaugccaggcaccauucucugauaucauggcucuuagaagcauuacauggguaccaugcuacaguuguucccauaaagccuuuaucugccucaccucucaccuccauccaacuguagaggagacagccaaggugguugcccaagauguuugguuuggacugggacugcccaguugaauuugagaaucugaguguucuugagacagcagcaacaacggaacauaagaaaucaggcacauauuugccucucaucauuguucaagacaccaaauuccuagauccagugagaucggcacauuuggcuugucuuagagaacaacaaaacaguaacuagcccuucaucccuucuucuggcucugcccuucuuuuacauuauucccugagccuuggaagggguaagguaaaugucccauguguggcuuugcauuuuuuuggccauuuauucucagugcuugcauugguuagagucuuuucaguuacugcugugcccugcagacagaaagcuucucugaccacagaagacagcagcccuguggacauagacagacacaucguagucauuucacuccuagauuucugugaauacguguguaaauacauguaugugugcacauucacaggugugaagguucacacaugggagcacguggagacucaggguugaaucagaugucucucuugaucacucuucuuuuguuuacugaggcccaguaaccugagcucacagauugcaccuagcccugcaacccagcucucucugggaaaggauguggucucugucuccugaaugcugggauuacaagcagcugccacacuuuuuacaugggucucacguggauucuggagagucacacacuggcccucuugcuaacacaacaaguguuuuuaccccugaaccaucuuccuuggccaugauuuguagauuucuuuuugaaacucaaacccaguuuuuugugccugauagaccacccccgggccagcaguucuuaguucuauuagaaagcaggcugggcaacccauggggagaaggcuguaauaguacccucccagggccucugcuucaucccuaccuccagguuccugcccuggcuuuccucggugauggauugugaucaggacuuguaagcugaaauaagagcuuucuucccaaguugccuugucuaagaugcuauauucagaggcuuucaagccuugcaguggucggcccuaaucuucgacuuccuuuccccucgcuucaucugcauggccagggguccuucuuccagagcuguugccucaccuggugcccuuucucucagcucccaccuuuuuguagaaacaacugaguggcuuucuuuuccuccuaauggacaggacuccaguucccaggugcucaguggaagcuguggcaugagugaguggaagcagugcuuggcugauagugggaagaacugccccuaacugcucagagauccuaaguccacaguuuucuuuaccuugggccaggggugcagagagcccaggcuagagcccugcagccuggagguugcucuggagaguaacagcuuggccuuuaggccucuuacuuacucucagacaugcaugcccugugaccugggaagcacugugccugacaguacuccauaugccagcauugacaaaguccccacauugugacuuagcauuuuuucuuuugcaugggauggccugcaacuaugagaccaacauugucuucuuugcagcuuuguuaauaauuugguucccauauauuuugguugauuguauaugcacuugcauauauggguagucuguauaguaugcgcacaugguguuuaugggcuccuauccuugugucuuacugcagggggacauugaaugcccuacuccaucacauucuaccgauucacuuaagaagauaggucucuuacugacuagaccgguagccagcaagcccuccugauuaucccaaccccacccucaccaugcugggguuacaggcagucauaagugaccaugccugucuuuuuacaugagauccgguuaucacguuagugcagcaagaauucuugcccacugagccauccccucagcccuugguugacuuuuuuuuuuaauguacguauauuacaggcugaaaucuguggguuuggaccaguguguagaaucaugacugccacagugguugugauacaggaauaacuaacucuaugagcccuguuucucuguguuugccccugguugucaguuccucuuucaccaucaaaccuagaaaccccacauuguugcuguucuuguacauucggcacuuuugguuguuugaagauacacugugaccuuuaugucccagcuuccuucacugagcagaaugcaauaaaagucauauguucugugaguccguacuuugcuccuuucguuaugcggauugccagucuguuuacccgucugccagcugauguguauuuuggguuguuggcaguuuuuggcagcugggaacaaagccucuauaaauguucacguaugagcuuucgugugcauaguuuuauuccucuugggcaugugugagaagugagguuuuguugucacuugguaacuguacauuuaacuucacgcagaacugccaagcuguucuuaaagaaguuggaucacuguguaugcccaccacaguuuaugaaaguugucauugcuguauacuuuuucugauccucgguacuacaaaaugaaauaguaaccauuucugagcuaaguacagaggacauacauguaaucucaaaauuuacaaggcugggacaauauggucauaguaaguucagaaccagccugggcuacauagaaaacccugccuuaaaaacugugagugacuaccaccaaccuaaucuuuccacucccucuucaaaauaggauacugucugagccagagggugacacagacguccugguuagggcugauaacgcugcccucgcuaacucuugauauuuugaccaguuaugcucccucacuaacugccacucacagcucugagaagguucucugagcaaggcugagaacagcacuaaucugcaggugugugucugaguguuugggaggcaguuuuacaaaacaacaguaguagguuccguucuaggccuaugaguaccucagccaggggcuccugacuagguuuauaguacuaggcacagguuucuccaacccuguggagcaggccucaaacccuaacaaaagguagguggcugugcccaccacaaccauaccaacauugcaccaguaagcauagcgugccuuacagguuggugcuguaccucuuaggguucacaucugggcagaacugcugauggcuugucucccucagcagacuggcucagcaguauaaaguguagacagcaggaagagugcuucagcucuguucaacuucguuucuucguuccguaucugaaguauguggcugguucacuccaggagagucuucccauuauguucucuugggcagccaaggugcucucuucuuaaugcugcucucuuccuguguacaguuuaaacauggggauuuuuagcucuuuaugcuacuggugguucuaacaaggucccccuccccucguucuaggcuccuaaucgugagcucaugacuuacuggcuacaggagcuucagcagaaaagaugggaauauugcaacagccuugacaugaugaagugggacagcaggacuuccccgacuccaggggauuuucccaagggccuuguggccagagauaccacagguaagacagaggugggaggcccugguggcagguauggaccugcucuuucuggguagacauuugacacagcaacucagaucagcagugagugaaaaggaaugcagaauggcaauaaugacagucugcaguccacagugccaagagcucagggacacagccaauacugggcaaggcuggugcagagggcuaugaggcuagcccacuuucugccauaauuaaagauggagugcucucaccuaugcauucgugcuugggccagcuuccggaaggcuugcaucugaaugugccaggagaggaauugcacagccucuugcugcuuauccucugguacucuuaggaaggcugaaaagccaggcacugguucugguuuaugcagguccaugucauugucauugucauuguccuagcaaguccuggccuuuuacagccgagagaaugugcuuuuguacuugaaaagcaaaauuuaaaccccaagaucucaagauucuugauuguauugcacccucuagaaagaaugagucaguuaugugcaaaccaucuuucuaaccuaucuuuaccccuacagaggcuauagggugaggcuugguuuugugucuccuuccugauagcuuguuaggacaagcccggagcuccuaagcccugaagugaaugcuaaaauggccagggcaucuuauuagcaauuuaaaaauaauuuuaaaauuauauuugugggggcuggagagauaacucagugguuaagagcacugacugcucuuucagcgguccugaguucaauucccagcauccacacgguagcucacaaucauaaugggauccuaugcccucuucuggugugucugaagacagcuacaguguacucauauacauaaaauaaauaaaucuuuuuaacuaauuauauuugugugcgcacggugcaugcauaugugcacacauguggcuaugcccguuugugcuaccgugagcacgugggggucagagaacaacuuucaugugucccuuuucucucccugccguaugggucccagagauuucaucagccucagcagcaagcacguuugcccacugagauaucuugacagccuuguauuuguguucuuaguuacuucuuuugaguuaagagucucauuaugcagccaugguuagccuguaacucacuguguagaccaaggugaccuuaaacacauagagauccgccuaccucuuccucugcagugcugggguuaaagcugugugacacugugcaggccugugcuaacacugcaaaggaguacacauucaaauugaaaaccaguacaggguuuguucuagcacuccugugaaaagcuguggacgcucugcucggcagcgcaagagcagugccgucugaauucugagcacagagcugcugcuuucuucuggaaucgccaucuuaggcucucgaauuugccagccuggcuuuccugguuggggguggguggugguggugguggugguagugguggugguggugguaguggugguguuuuguuccguuuuguuuuuagcagacugucuaucuagucagugagaagacacugugucugucuguaccuguggauguuuuucuaggagcccuugucauggagucuuaguauuccaguucuccucagaguggaagggcacccuuuauauucaagugcacguggcuuccugcugcccaagccuuaguuuguuugguuuuuuauuuuauuuuauuuauuaauuaauuuuuauuuucauuguucuaggcuagccuugaacuccugaucacccugccuuaaccuccccuugcuagauuacauguuugcaccacuacauugauuuauggguuacuggaguguaguaggcaagcacuccagcagcugaacugcacccuuuuuuuaaaauuuguuuuuugggguuuuuuuuguuuguuuguuuguuuauuugguuuuuuugagacagagucuuguaguccaggcuggccucaaacucacuuuguagcugaagaaaaccuugaaauccuaaucuuccugccuguucucccagcccaucaacugagguauucaaagggcaccauuagcauuguuucugugacuagaagcucucccucagucucagggucacucagaaccugaggaagaaacuggagggcauggccagccuccgugcuaguggcuucaguccucuccagcaaggacucgggugugcugcugaaagguggcuucccucugucaugucuguccugccuccuugcaaaaccgagguuagguggggggagggagaggagucaucugcuccuucucugguuuggggaucccagcucugggugcuuagaguuugugcugugcuguuugcucguucagcaggugccugaagucguugccaguuucuccccucaaguguuccugucagccagaauguuugugcagagaaaagcaagaagugucagggcaaaugcagggcagccugggcccuugcgugggcugagcucagcguuggcguugucgggggccucucuaaggacacgaugcuuagggccugccaagccaauccuggaaugggcugggagagcuugcuggcuggccuuaacauuugagaucuuuaucuaaaggcagaaaauguaaaauucugaaguagaaagucaagaagaccagggacuaucaagauggcucagaaguucggaaugcuuguugcucuuucagaggaucucggugugguucccagcacccauguaaguuggcucccaacugccugcaaucuaguucugugagauccacgcccacuucuggucucugggagcagcaggacacacauggcauauacacaauggauugcgcacauaaacuguuugcuaaagagaagucugcauuucagacccuuucauuucauccucaguggggaggaacugguuaaaagauaaauauugugguucuguaguaguguccuguaauuguuuguagcugugcucuaguuaccgcccgcuuuagcccaacugggcucaagacuagcuuacugaaagaugaccguuuuuucuuagcacugguuugcaugaaaacuaaaacaugcuuuugacuccuggucgcccagucaucucucccugccaaacaugugcauuuauagccgguguguccacccauucaugacccuccaggcaccugaagucaggguggagagagaaagaugcaggugcagggaaagccaaguucugacucagaaggugauucugucggagacuuguggaccuggcuccaagucuugacucugaaguuuacugauugucgggcucugagcaggucacuuauccacuacuacaggagugcacacugugccgugaaaacaaaguguguccacccuccacaucacaaggauugaaagggaaaacccauugcuaaggguagagauacacgcacacgcacgcacgcacgcacacaugcacgcacgcacuccuucacucacucaccugauaaugugauuuugaaugggugaggauuguguuucacuacauuagauaggaagcuggauuaacaaaaacaacauuauuuuucucacucaugggcaguucaaagcucuagcacugacuccuuggccacguccauugucccauucuuaggacuagcauucugauucgcgcuugcugucucugggguggcccucaugucacaagaggaugccuucacagaaaccuucagcuucuccuuagcagugacucccccauggcaguuccuucuggccacagcagauaucuagaagggaauaaggggagcugagcgcauggccaucagagccuuacucuuaagcugggcugaauagcugguagugggcgggcacugucacgugacugcauaugcuccuguaguauuucgugccuuuagaguaagagacugucacccguaugcuuuuucaguuuuucagucaggcaucagagaguggggugacuuugugccucuuuguguuuugucuguuaucccuucacagcuuggccucucaaacaccauuucccauugucugcuggauuggguuggacaaggaccuagcuucagauuauuacauggaaagauacaaaccaacugccuacauauagagaccuucauauccacuaagaaacaagggugugccugcagguucucauaguauuugagaauccacacugaaagugaauucaggguggaugucuaguccacuuguucacuuuuguucuccacaaggccuuuagagaaagagcagagauaguaaguccuggcuguuggugaggcuucccgagagucaggcauguaaagguaguuaucacccuguccucucugcuuccugccgugugaguuaguccaggggcaggagacuaucucaagcuagggugguagugggcugauugccugcaugugaaugguguuucuuaagaagacgguauugugaaaacagcucgcggugaccacacauuuccucugcaucaccuccuguaacugucacaccuucugcaguucuguaugagagcagggauucaguggcauaggcagagguccuucgaggccaguggucuucaaccuuccuaauggugugacccuuaaauacacugccauguguuguggugaccccagcccuaaaguuauuuucuuagcuacuccauaacuguaauuuugcuacuauucugaaucauaauguaaauaucugauaugcaggguaucugauaugcaaccccugugaaagggucaauugacccccaccaccaccaaagggguuucgacccacagguugagaaccacugcccuaggccuuagggcugcagggaggcaugugggcggagcacagagcuggcucuagcaccacagucacucgucacccucuggugccacagucuugugcaacgaucacacucgugugucuguguuacccugcuugugaaguacuacucgauaccauucgguguuucacauaugcgccaugguaaucagcaguguugucucugagaggcuuguaucaccguaacucccugcaucucagcauccucuuuaggaaacaagauguucucagagugagguucuguggaagucaggcuguggucaagaggacauaguagagaugugugaagaauccucugaagggaaacugcccagaacuggccgggguuuggccccuagaggcugacuagagauggcagcugaggcugagauugcugaagagcagggaggaaugggagagaagagacgaagaugagucugauguaauucagggaacuuaccaggaaauggcaggaaagagggaggucaggaggagccaugagugugaacccagugagaacuguggagaccucagccaccuccugcaucauuuccucaacccacaggaagccauucuugccacguagcaauuuccuacgauuagccauucagccagccauguuacccauuucauuugagucuuucugcaguuaaguguuaacuaugcuauuagcgaaucaggucucaggcuguguucuugguggggaucauggacagauaggcgagccuuaauuuaggugcauaggcugguccacccuaggggcucucagaacccuguggcuucuugucucuaugggaauuauagauucaugaagauaucccuauuccuucugacuauucacuccuacacaaucuagauugaaacucaguuugauuuuaaaagccuuuugaaggcugggauuguggcucugugguggaguaccagccuagcaagcaccagagccuaauccugaugaaguauaccugauccuccccugccuacuaagcucaugccagcuccuugcuccccagugcuggaguggggcggauggcucagugaucuuucccaugggacuucucuggagcaugcaugcacuugcugucugcugagguuucuagcaaagccaaacugacacuguaauaaccauaagaauauacucagggcugcagagauggcucagugguuaagaacacuugcugcucuuccagaggaucugaguucaguuccuaggacccacaugaugguucacagccauccauaauuucaguuccaagggaucugacacccuuuucuaaccuccauggguaucaggcauguacguaguaaacauacauauguggacaaaguacucagacaggcaggcagucagacagacagaaagacagaaaguacucaaacacagauagguagguagguagguagguagguagguagguagguagguagguagauugauugauugauugauugauugauugauugauugauaguaaacacagauagauagauagagagaggggggggauggauggauggauggauggauggauggauggauggauggaugggcaggcgggcgggcaggcaggcaggcaggcaaacaaacucagcuaggaagcugcuucuuuuucaaacaaaguugugacuucuaaaggucauuucuacucaagaccacaauagaaaucaucucugcaguguggucucccauggucucgcugaagacucuuucugacccacacccuccagcuucucuaaagucuuuccuggguggacuaugaguuuuuaugguaauagguagcuugcuacaucugauagugacacccccugcucuugaguggccuuccaaccuugcugccagcccacacaggaaagagcacugcaccgacuguguagcaauggguacaguuggggcucauuuccuggccaagcuuagaacugccaugcucuuacucaagcugggucugcaagagaccagccuucaggaaguguguggaacagcgcggccuuucucugaaguagagaguagaucucagugugccugugggcuggcccgaguacucacagauggugagugauggcuguauucuggcugucagguucugagcagucuucucugcuuccuagccgugugaguuacugccaagggcggugacucuuaugccuggcucaggguuucaguguucugacacagcaucgagagauugggcugaauugguggugucuguauuuuuguuuccuuuugcuuaugagauccccccuuccaaaugaaaucucaaaggggaccccaacauuucagugaagagagcaaccacuauguuuacccuucucuccauccagugguuucccaggcuguuucuggaacccacgaacauagagcaggggucuggcuaccaggacuuucuguguucuguggugacugguuccuggccuuccugaaagaauucuccuuuaggguaggagcucugugccguuggugcuacuccuccguuccuagugcuuaggacugacagcguguccccgagcuguguccugucacgauccagugcuuucccagggcauucuuggagucuuucccacugacauggaagucagguuggugagcugccugcaaagugagagggcauccccagcuaggacaucugucgccaggagucauuacugccucagguucuugggcacugcuggcuugacuagucuuuuguggagaccagcccugggguaugccugaccuauuagaaauuaauuuucuucuuggcugucagagguuagcaguucuauucuaauuguguuuucacauuaauauugugaauacuuuauuuaaaagacauguagauaaaguugauuauuaucaaauaacaugaagcucuguuuacaaacauuacuuguucucagaacauugccaacugagaaaaagacaaaauauuuggauugucagaguuguuucuuuaaacaugaugcaaaauguucauuagauggcuucaucaguuacuacuuguaauaugacauuuuuauuuccuaccacuaccugccuuucuaguuuugaaacaauuuaacauguuauuugaaacaaauauuauuuaagcuauaaauauuguuauuuuaaaggaaaucuugggcaucacauuauuucaagcuggaauauauucccagagguuacuuuuuuuuaaaggagaguuuauuuuauuuguguguaugaauguuuggcugaaugugugugguacauugauaagugcuccagaugacugcaguacucuuggaggccagacgagggcaucgcauccccuggcccugaguucuagauggaugcgaaccgacacguaggugccaagagcauccagugcuguuaauuacugagccaacgcuuacauuuugaagaaaaucuuuugccugugaguuugcugggcuccuguacugugagaaaccguauuuccucacugucaccguuuauggaugcuagaaaacaugcuuaugucuaaucuuuccguuuccuaggagaaaugaagagcauacaaagcugauccuugcuuuacugcguucaaaucgcagcuuaauccuggagaugauuccuuaucacacaguugcugaucuacaagacuagagggaaagucuagccuuuucucugccugaaccagcagagucgauguguggucuccuugaagcacauaacccuacucggagaggcauggcucugcuuuagaugaagagagcucaugagcacaaaagcuacucaaggaccaguucuuuuuuauauaguagacaucaaaaugugcucuuacacauguggcugauauuuuuauguauaccaagccaguguuuuaucuggguugacagguuuccugugaaaguuuggguuaacugacaauuauuuaccuuucuuucagauauaauuucccagcacccaaauccuucugcagaaaaagccagaacugugcucgcuguggaagcugccccuggagagcuggugggagaccgggcugcucaucagccagcucccgggcauccgaaucccaucaacuuuuacucucugaagcaguggggaaaugagcucaagugagucugugggaaguagcaggugcuggugaagauggauucucucugauaaugaguuauaauguggguuauauguuuguaugugacauuauacagccacuuuacauuuaugaagaagggucuuugugcuuugcugcacacuuugacacaggucauuuuuuaaagcuguaaacaguaugccugcgcuguuucuggugccaggccaagucucaucacaugguuucaucugaucgccugacucuauucaauagaucagauggcugacguacuacagagacugaaacugaaggggggugugugugucugggaugacaaagcuuccagaugcaggacugggcuuguccuuccagccucacccucuuucuaaaucucagggcugguccauaggcucugcugugggguucuguucucugacccuguguggaccagugaggauagaguuuuugucguuuauguguuuuuuaaaaaggccuuguugagauauaauucacccauuuacaauauagaauuuggugguuuuuuuucauauauccaguuaugcaaucaacuuuagaacauuuuguugcuuguuuguuuguuuguucuuagcuauaguuuugcuaaauguccaaggcuagucuugaacuugcaacucuacuccuuucucagcuuccugaaucugggauuauagacaugugugggcugacucaauuuuagaacauuuucgucauccccaacagacagcuuuuauacaauccuuuccugccucucuuaccuucuucucucucucccuaccucaguccuaggcaaauccacuuucuaucuguguuggauuuguuuauucugaaccuuucauguaagccgaauugcacaauauauuguguggcuuucuccacuuugcauaacguuuucaagauuuaucaagguaguggaauauaaguaucucauuuccuuuuaugguuaagcguacacuguccuaguucuuguuuccugccgccaugaugacagaagcaacuuuauucagcuuacaauuccagguuauacuccauaauuguggggaagucagggugucaagauccugaaauagcuaggcaaauccucagacaagagcaaacagaaggaaugcauguguguuguaugcagcucguauucccucucauauauagcccaagacccaaacagcucuuccaacaucaauguaaucaagacaguccugcacagauuuguccaaguccaagcuaaucuuggcacucccucauuagggcucucuucccagauuaucagucucuucuagauugacagcugacacuaugacaugaauaagcuauguuuugguuauuuugcuuaggcauuguucauuaguuguugaacaugaguugauuucauuucucauuuuuuuguaaauguguauauaugccugugugcuugugugaguuuaauguguaccacauguaagaacccuuggaggccagaaaggccauccaauucccuggaacuagaguuacuggugguugcaaacugacaugugggaggugggaaccagacccagguccucuucaagagcauauaaaugcucuuaacuacguagccaucucuccagucccucuacuuguucacuguugcaauuaguguuccuacaaacccuaugugcaaguuuuuguguggacacacaguuuuguuucuguuagcuaaguaccuacccuugccagacccauauugaguaugaggaaccgccaggcuggcccaguuuuucugucugacauacugugucagccccauaugagaguucucuuuaugaauguguagcaugugccccccaugcguguacaucucugcacccauaugugaacaucagagccccuccuauauccuuugccuuauucucuugagcuagaucucuggacccagagcuaggauaggauccagcaaguuaucgugguccuccuggauucucacacucgcgcgcgcgcgcgcacacacacacacacacacacacacacacacacacgaguccuagugauccuccuggauuuaugcaaaugcaaacaguccucaugagcuuccugcagucacgcacacaguguuaaggacacacacaaggggugugcaggagcacaccugccuguuuguuuguuuguuuguuuguuuguuuguuuguuuguuugguggauucucaagugcucgugcuugccuagcaagcauucuucccuaccgauccaucucuccagccccaggugucaccuuuuuaaaucucagccauccuccuaguguguaucggcuggugucucauugugggauugguuugaguucccucgaugacuaccaacauaagcagcauuauguuggaucuuuucagauucuuugccuauuuuaaaucacauuggguuuuuuuuuuuuaauuauucaguuguauguauuacuuaaauggaggugauccgucgauguucacagcaauacacuugguggccacagaaucuuugaaaacuugacuuaaguuagacgugggaguugguaggaagguuugcacgcugcaguuuuaggacagcugaaagcuuucugcucuacuguaggacccacgucacgaccagugcgaugucagacagccaugcuccagcaguccuccugggugaucagagugucuuagaagccaccaucuaaaaauacacuguuuuagcaagugccuuccccauacuucuuuuuauguaagccuuuguguuugguugaauguaauaaagucauuuuuguguguguuuucaguucuucagacauaacuuuguauuggaacugaguagaauguggcaggggucuccagaccucagaagaccaacacuugugaaagagcuccuauggugccuguccacuuugccucuggccugggcaggguccugccccagccccugguccugcucugcucuguucuauucacguuccgccccucuucccacugaccacguccucacccugcgucagagagucauggguagcagcugucccaaggcucuuccuuugacaacuugagagucagcagugugacucuagucugucccuugaguagcuguuucccagcauucucagucucugagccucugcauucuggccauuugcuuccuuccucuucaucugugagccugugcucaccacacauuggcagaggcccucuuucguuuaucucauggagucccacuugccuugugaacaucugacugcucugauaggaggccacacacagagucucccagugcccaggggaagaugggagaggaggcaagagaaaggcugccucccccaggcccaacaccauaucgugcuucuuaguaaagaaagaguucugugcuccucaaaaacgucaggaaaccacagagacucuugcuucauuuuucauguuaaaaagcugaggcuuagagaauuagagcaacugucucaaagcuguguugcagaagugugugaccgaacugaaaggcagcccagguuccuccacugaggacuucgucuccuuucagucuccaacauaagaaccuaccagagcugggcaugauucugcaguggccagccuggguuuccuggcaagacagggucucgguaaaacaagaaugcacguggagggcuguuaguuaaccaggggguuggucuuguacagccccaucugcccucagaguagacaguggacugagguggaaucaggccuacaguuagguacuucccauuucccagagcucagagugucuccaccuggaaaagagaacacaugucaccuuuguucaggacaacuuuccgaguaaguucggagguacugucagcaggagcaacgucggcuccucugucauggcgcugcaugguguuagaggcagacucccagggaggauucucagcugugccauuucauaggcagcugccucaagcaagucacacaccauucucugcuuccagaucucauuuguaagcaaccuugcauaccucaugagauggacuagauaaggaaaaguuaauacgcccaggggaagagggcguauuucuuuuuacuugugggcacauuuuaggaaggugacaacaaaaugaucugaguggauagagaaccuuuuuuuaauguuuccagcgauugcaacacgcuaagcaagcuugugccuucugagcuacaacccuaacagagagagaacuuaauaacuguagaaauaguaaagccauuuuucccuaaaaggaauggcucaaauguuuuuguuuuggauucaaacaaguacuaaaggagauaacccuguguuugugugugcauuuauugaacucaccaguucaguugggguccucuaugagacuccccugaugaacugaguuuaaauuucacacuguuguacaagacuugaggguccuacuccuacugcugagcuagcaauuuacaaagucuaauuaacugauagcugucuuagugacuuaguucaguugucaugauagaguaccaugacccaggcaacuuauaaaagaaaguguuugauucagggguuaaguuuggaaacgguuagaguccccauggugcuggguucaguagcugagagcuuacauccuuauccacacguaggaagcagagagaguuaacuggaaaugaccuggguuuuugaaacuucaaagcccaaugacccaccucuuccaacaagacaacaccuccuaaaccuucccaaagaguuccacccacugggucaccaguagucaaauauccaggggacauuccccuucguacagccacagaugccguuguaacuggucaugugucauaugauugaaucauuucguuuuuccuuaagauagaggagauuuauuuuccauuaaaaauguguuagauacauagggggaaaacugauaaaggaggccaugccacuaaaauacuguugagagaaaguaggugacgugguuaugaggaaucagggaaaaacuuguuaaaagccuguaagauucuaggcuuacauuguaaguguaugcccuuauuccauuaagagcagcagcagcgaaacaaaauuagaaaagucaggugaacaucguacaagugugguuuaucccagcaaggcagacuccagccagugguccugccugccaggcccacuuacuccugcuuaggcaccucuguuggagguguaguuaauuuuacuuaaguuucccguuuuagugacucugucauuuuuuuaaccuuccccgccauccagaucacaccagguaaagagcuagaccucgugugaaauuccagguggcauguaugaauagccucagagucuggcugaucgcuagugcucagccagaggugccuagaggauaaaguaauacaggcauugauacagguucugucugcugggucuucugguucugcugcuugcugguuccugguccuucguuucugcuuuucuccugacccccaagccugguagcaacgucacuuguaugugugacugcgauucccaggaauccacugguuuugucgucaucuagagcuaugccugguggugacucauaaucucuuucagagccccauuucaaagagaaggccaccacagcccaagccagugcccagauaucuggugcguuuggggaagucauucauaucuguggcugggcgguacuuguuuauauuugccuuguuuuaaugcauagcucagccuuugccaagacauaugaggcuuguagucauguggcugucucguggauguuuucagaacugggccuucuggaggggaaacauggggaaggggguggaagauguuggucaggcucuguguguguguguguguguguguguguguguguguguguguguguguugcugucaaugucuuuccuaagcacagguuguuuauaucuagcacuucuugucaucauggcuagaaccaugcacuuccagggaccuguucauuaucagguccacuuuagcuuuagagaaaucaugacuggcagaaaucauggcuugcagacuggaagaccuuaaccaugccuagggugacaucugacucaguaugggaaacccagcccgagagaguguccuucugugccuuauccaaggucaucaaccaacuaacccgagucucauauccuguuuccaguugggagcuauaggagggggagcaacuggccucuucuguugguacugcuggaucuucuuguuguuggagccaaguucucgguguccuggaucaacucauucugcucuuagccuuuccaauaaccuuuccgaugacgagaaagauagcuuuucccauugugucagauagcccacaugaccuccccaacucaagauccuucguguggucacaacagcagaguucucuccugggauucagaugugcacauugugggcagugggcauuauuuaucccaccacggguggcuuucccuuggguggcacgcgcucccccuccccccaucuccucuuagacacugugcacacucacccagagccaccuggcuugagugcugccacccaccagcuccauucagccuguccuuuuccuuagugguguuuccacuugauggugaaaggcaggcgugcuaguaaaaagagaagccugcucaugcugaggggcucggccaaaaagugaagccuuuuuaaguccauacucaagagguagcuacgagaaaugaauucguauauguaagcacccugggauucucucugccuguuaagacacccugcacugcauacugucucggugccuuagcguccaccggaccuguccccuggaugugcuucucuguguccaccaagucaugaggcccacuuucaccagagccaugcucucagcugcagcaugaggugaggugaggcagcaacaggguguggaugacaaauggcuucaugauucccagagcagaggcacuguauagucuggaaugcccuaacucaguagcucuguuggggcugguccacagaguucauuugcauagcuaugcccugguuuauuuaaccuguccccuagcugugggugucugcucaucacuucagagggggucaagcugagucaccuucauggaggaaggugucacugagaugcuacauccuguuugguuucucugaccaugaccgagggaagggagugcuaccucugggcuagccuacucuccuacugcccccagccuucugucaguccaaacucacccuagcacagccucucaccacugaagaguuggggugcuggccacaguguagccacacugugcaggcugcuugugaaauuaaaggcucuggagagauuugauaggacauuuccaaacacuucucucaacucccaauguccacuugcucauugagaucacaguggguauuugaguauaaaaauuacuguuauuugaauucauuuaauuuauuuauuuauuuauuuauuuauuuuggaaagugugcuucauguggcacaguguguugcacgaucaagaauuggguucugccaagaacacacucacccagggcuugauuaaauaguacuugagcugaaagggaguucacuuugaagccaauuucacuucuccauuacccaagccuuggcaguugucacagcacccuaggcugucccucagcuguccuucaacugcaggggcuugcaacagccuggaaaccaaccaugcuagagaaagcagaugacauggaaguuaguuacuggaacuaccuuucuuccugccugggcugaguuugggucuucugguuucuccuuuuguuguuguuguuguugucguuguuguuguuguuguugucguuguuguugacucuaagaacaggaguggcaggcugagcucacucccccuuagcacgcuccucacugguagugcguuccacacaccauuguggagggaaagaacaagagcacauuuugaagccaugccagauggcaaggagcuuuuaacuccugaaacaugucaggaaggcaggacacaggagcucugggccgggaaaugucccuagcacugugggcgggcucacaggugcugcgaaugugcagggguagaugaagcauuugugagacuuccuuuucuuccagagcaacuguuuugaaaucauaacucuccacaguuuugagauguugugaaaccagaauugacuaugacauuagcaugcucucuuagguuccccuggcuguugaaaaggccacucugcccagagccaggcaccagaagacacuaggcugugagaaccaugggacaugcuuacucugugugccaccuguggucucaguacucaggaaacaguugccaggucuuagacaaguguagccaccuguucuagggacacaaagucgcauuuucuaucagcaggaugagaaccuaugugugcuauauaaguucucuuuguuccucuaaaacuuuaaauuacguuaguaaaauucaaauacaggggaguaaaucaugcuuuuaaaaucacaaauauugggaaguagaggcaggcaaaucucugagguugggccagccuggucuacagagggaguuccaugauacccaaagcuacauaaaccacaaauguuacgggacuugaugauucaaugaauaaagcgcuugcugcuuaagcacgaggacuugauuuuggauccccaguauccaugugaaagccaagcauuuggguccgcaucuguagcccaaggccuggggaggggcaccuaaaagcuuucuggccaaccaaacuagugaacacagugagugcuagguucagcgaaaccuuuuauuagaaauaaaaacguggaaagggcugaugagauaacgcugagcagacagauguguccaccaccaacucugauuaccugagaguuggaaaacuguccucuggccuccuccccccauacaccaugguacacaucccuccucccuccuuauuuuaugagcaugacucuucuggguauauguaugucuguguacugcguguuugccuggugccacgaagaccagaagagagcaucaucucuccuagaacuggaguuacaggcaggcaggagcagccaguggguguguguuagaauuauacccagguccucugcaagagcagcugaugcucauaaccgcugagccaucucucuagcagaaagagagagagagagagagagagagagagagagagagagaaaauaaucaaagagcaauagagaaauacuugauccugacaucuggucuucacagauacaugcacaagaaaccacaauugcauauauguguguacacacacacauaacaacacacaccaaaaauaaaguacugaaauguagcuacuucauacaacagugccaucugacucguucaaacuggagacucucuaguuucccuucucaccuucagcccgcuucaggaaacaccagagaugcacggcuuucucuccugcuuuagcagccauauugagguguggccuguaagacucaguuacguuagguguacaggcugaggaguguuagaaaauuacaccccauagaaacaccucuauaaucaaaauguauugcugcaugucagggcacaggcuuguaauccuagcauuugggaggcagaggcaugcaaaucucaguacacuugaagccaguuuaguuuaucuaugcaguucugggccagcaaccagaguugcuguaguaacugaguagugagacccuauuucagauaggagggagggaaggagggagggagggagggauggagggagggagggaaagagagggagggagggagggagggagggaaagagagggagagagaaugagaaugagaauacaugcauguucccucaugagccuucccuuaaucucuggccucaggcaaccuccaggcugcuuucuugaacuauagcugugcuuuuguaaggguuuaaaauaaaugagcucuuguggccuauaccuguuguauucaucaucgacuugacauaacucuucaaagugacugcuccuuuucacgugcccagcaacacuacuggccaguuccaguugcuccacauccucccaaacgcuggcaguuagcugcuguuuuuaacuuuagcuguuggaggugugaugcaguuuuaacuaauguaugauaacuagugaugcuuuuuaaaguauauuuauauguuauuuuuauguguguguuuugccugcauguauaucaguguaccacaugugugccuagugguuggaugccuggaauuaagaguuauaaaugguggcaagcugccaugugugugcugggaaccaaacuggggucuucugcaagagcagcaggugauguuauucgaugagccaccucuucaaccuugauguuaucuuacugaccauuccuagacagcugccccucagcuuaagcuggguuacaugguaggaguauguccuaccaaacccaaacauaaauugaaaauacuaaaaggcaaacgugcauuggcuuagcuucgugcacucuguagaggaccuguuguugaguucacacuuacugucucgcgguucacuggaaguuaaucccagcuccgugucucucugcacaucgcuagcccaggaaaaagcaagcuucugacuaugguuugcagugaauguguauugcuuuggaacggucguaaaguuuguuacaagaaaaucuuaaguccaacuuuacaaguuagaaaacugcguguauuuuuauuuuucuuucuuccuuuuuuaaaauuuacuuuucucgucucuugaucauuuuuaaauugaguuguuuauucaucuuauugaacuuuaagcauucuuaaauauccugaauaugagccuuuugucagguauauauuuugcaaauauuuuccaaaggagaaagguuuucauaaacucaguuuuucucaucuugucuuauagauuguacuuuucaaguucucuuuaagaagucuguguaauguggagcuguggagauggcuuagggaggaaguauacuugacuugaguuuggacccaagagacccguguagaaagcuagauaugugucuguaaccccagcacuggggagcuggagagaggcugaucuuugcaguucauugccuagccuagcaaaguaggugagccuuggguucagagagaaacccugucucaaaacauaagcugagcagugugugauugaggcagauaccuaaaguuggccuguggccuagacaugcuugugugcacacauacauaugcaugcacauacacauacauaugcaugcacacacacauacauaugcaugcauauacauacaaaaggagaagaaagucuaaacgucaaaagcacuuucuccuuuauuuucaucuagaaguuuuguguuuugguggggcguguuuuguuuuuaauuugaaauaggauuucacuguauagcccagacuggccuggaacuuaggaaccuucugccuggcuuccuaagugcugggaucacaggaguauaccacaacaaccugccucuaugguauauuuugaacuaguuuguaugugugcugugagguaagauucaaguuuauuuuuuccuauauauaaccaguucuuauagucacacuuccccacuagauucucuuuacauucuugcggacagucaggcgaccaucagugcaaggagugguuaacauggauaaugcagucuguguuguggugucucuuaggaaugcuggcaucuugagaaaggcaguucuaggaaucuauucacugaugacaguauaaaguccaauguggagcacccagcuucagaauagcuaguguaaccuacagaaguccccugcgaugcauaggcuuugggucugguuaaucauaaugugugauuuuuuuuuaaauaagguuuuuucgggggugggggguguuuuuuaagaaauucuugaauuuaacuuugcauugcuacuuccugagauacuaguaucgguguauacucauacuggcaaugcauauuuucucauuuucuguauuuuuaccaacauuugguauuaucagaucuccauuuuuaccaguccuauauacagccguguuuugcucugcccuuucuuguuuuuaaauagaaauucaaugucaucauuccguccugggagagggcacagugagagucgcaggaccguguuuuacaccaaugaagagugggaacuucuagacccgccuccuaaggaccuggaggagucccugguaccagaagagaggaagaagccgaugccugagggcaguaaagguguguguguuccugugcccuguugcucucucugccccugggauagaggagacucuugacuggcaagucccuagaagcauaaagcauaggcccuuguguuauaggagggggauggugauaggggugugggcaaugauucuuaaagguuuguaaagggcugcaagaaacagauguccaagcagcuacaaaccuccuccgggagauuugauauguuaugccucugugcaucacagaggugcugccugaagaaacuuuguacuuauuaagccaggcauuaugucauauaccuguaguucuggggccagggaggucgaaacaggaggauugcaugucucagaaacauacacacacacacacacacacacacacacacacacacacaccaucuuuauuuacagaaauuugauaaguacuccaaaaaaagagaacauaguaucauagauucuggagaagugguuagauuaguuguauuccuauuacuguaacagguagcugagggaagccaucuuauguagagaaacgguuuauuuugguucauagucguagagauuuuauucuaugaccaccugaacccauugcuuugugccuguagaagugcaucauugugggacuguguggccagaaagcaaaagagagaaggcagcccgggguaccacugucuaaaagacuucauauuaagcuuucaucaguaccagcaagcugcuggcuuaaggcauuaacacaugggccuuugggagacaugcuagauccaaacaaggccccaaguccgaaagcacuugugcacuugugccucugugagcugucacauaucaggcacaccaggccuccagugccaccugggugccagguacugccacccacccagucuuccagucucugcgugaccccagggagccaccgaugccuuugucuccccuagcuuuaaauaaucaaaaggccguaguacuuuugugccucaagcuuguguuuuugaguguacauuugaauuauuugggucaacuuauacauaaagucucacuuuaaaaaguguauuuagacuuuuaaaaaauccauuuuguuuuuguuuuuagccaaaaacaaauguaaaaguaagaagccagggcuugccuggugcgccucaguugucuucgugauacucauacuauagucuucuguaaagagugguccagcaaagacucugcagcuuuagaccucucggggcuucuguacagugaagcaggacaaggagacauguccagcugcccugcuuucugcauggguugaugaguccacaacccucaggaugauguguaagaauaccagaagguuugacaugcucaaaaaaaaaaaaaaaaaaaaaaaaacuucuuauuuuuaaauauaggagucgcuaguucaggauuccccuuugaauuuggacggaacccuuacaaaggaaagcgccccuugaaagauauaauugggucauacaaaaaccgccacagcaguagugauccuuugcucgagggaacggcgacaucaucaggcagcagcggaggucccacuaagccaguccccgaaaugcagcugcagauucaaagccagcaggaggagcuggagcaacucaagaaggaccuauccagucagaagguaacugucgcuugauuucugugugcccucggugggccagagacucaggagcccuucccugaggcucaugcucuugggcugccauccugugcccugagcuaugcccguguuuauucaaugacccuagaccaugacccuagacagguuacaaggugcuccucucaguacccacgcccgguuucucagacucgaguucccucaacuuugcacaucccgucagacaauuuuuccaaacugguaagaauuccuucuaccuaauugcuaggcagcacaguaacccauaaagcuuggccccucccccuuuuaauuuuauuuuuagcuauauguaugaguauguaacuguaggcauccacagaagccagaaaccaauguccgauucagugaaccucccaguguggguucugggaaucaagcucaaguccucugcaagagcaaugugugcucuuaacugcugagucaucuuccuacccugccccuccccauuccccccccacacauauacacuucuauuuauucauuuauuuuugagacagcaucucacugugucaucuaggcugcccuggagcaguugaucccccugcucccgcacuggaguuauaggcaugugccaccacgcaguacuucacagaucccuuagcgccgauaagcaugugccaggaaccauugcuaauuacagcacgcacauccauuauuucccguuuccuauuauuguucucuucaggcuguauuuguggaguacauuuuuuccccucucuauuuuugagaucuuucaagaggaaguucaacauuaaaauguuuccaguggaguuuauuucugcauuuccucagauuccagugacugcuuauauaacacucaugauuucugcuuuucucccccacaccccagcuuucuuaccguucaccucauugucuucuuggcuccuaggagcucauucggcugcuccagcagacaguccggucaucccaauaugacaaguauuucacgaacccccagaucagccaggggguccccggggacacacuggagcuccugcaccagaaggacgagcagauccugggccucagcggccagcuggagagguucggccuggagaaggaaagccuccagcaggaagugaggacgcugaagagcaaggugggcgagcucaacgagcggcucggcaugcugauggagaccauccaggccaaggacgaggucaucaucaagcucagcgccugugagggcagcgugucaucacccacccuggggcccagcucuccuuuggccaucccagccagcaaggaccagcuggagcuggacaggcuaaaaguaagggcagacugugggcuggcuuucuggauagacauugcaaacacauugcaaacucaguuaguuccguccuuaguuccauacccgcugaccccuagaggucugguuguaacgggcuggucuaguaagggcagagcuggggaggaggggcagaacuuuaugcucaaaucccaggcauguucaggaacugccuugaguacguccaacacccuugcuauugcugucaucaccugggacacuuucaguucuuccugucccuggcacagaaaaagcugaaacacgccuccccucugaauuucccaccuucaaggagguugucaguuuccccucugugcacauaaagacaaacacagacuuaauuuguauagccucccacaggccuggguaggcaagcauccucugggacacugggcaucagguagagcccaaccgacuccagcagaccccaguaugucuaccacccccaguaguuccaugcagccacugguucuagguguuugcauuccaaguggaguuuacccuugaagaguccagguguguucgcguugagaucaugauagagcgugugcuucauggcuucuagcaccuuucauuugccagcagugagcugagugagugcucacaggcuggggacugcagaguugugaacacugagacaguggcugcagggcugggaugugugggugggccauuuuagugacaacacaaagccagcauggugucuuuauuuuuguaugucuguagcgugugcaugcguauacucaugcauguggaagcuggguauugguacucuucuucauacuguuccacguuacuuuuugagacaaagucuuaacccagagcuuacuaguuaacccgggaaccccagggacccuccugccuccgcacucccugcacaaggguuauagaaguaccaucgcacaggcuuuuacgugggugaugggaaaccggacuuaaguccgcauccuugugcagcaucgaccguaccaccuaagcccuccccacagcucccagucggauugauuagugagaaaccaaaacaccucuuacuaugccauauuuauaucuacuauaaaacagccuuuauuuuauuuauuuauauuuugagacaaaguuucaugcuguaguuuaugcugacccagaaaucacuguagcccagguuggccucaaacucaagucaacccuuuguccccauguccgggguacugagauucccaggugugaguuaccacgcuuggaugcuuguuauuuguuuuuguuuuauuuuucuuuuuacaagagcucuuagugcugccuauagaaggcaguuaguuuauauacucaaaccuuccuaguucuuccgugucuuaucaggacacacuacagccucaagaaaguucagucuggaggcgggggaguauccagaaaagucuguagaaauggucagggccagagggaggacgugguuacaaaagauggaauuuauaaggcaucuucaccaaccacagccuuaaagaugguuggcucuccuucaucuuuauuuagaagccuccuugacuuaucacgaggaugaucuaaggggugugugaacuuguuuucagggcauuuuacaugaacacucuucccugcucagccacaccuuccuucuaguagaacaggggaaaacuugugaccacaggagccugaggcaagccagaccucugaguucaaagccagacugguccacauagugaguuccaggacagccaaaguuacauaauagauccugucuuuaccagaaagaaagauaggaagaaaggaaggaggggaaaaaaagaaaaccuuugucuccaaccuuuacauucucuaaauacaaaauaaauguugcagaaguaaacaguuggccaauccagugaagugccgacuguguucuugauaauuugggaggcggugcuggggucuggacccagggccuuguaucugauaggcagauacuuuaccacugaccuccacccucuguccuaauguccuccuucagcuuucccacaguuugagugcucuccaaagucccugaugcaccacagaucauaguguucaucauugcaugccuuucuuaauuaagggcuuuugcauauuuuuauagucuuuuaaaaauagaacuauauaaguaaaaaugagaaccuacuuagaauacagucagugucucugguuuaaaauaauauuaaaugacugcuuuuucucaucaacgacugugugacuggaguuagaaagugcacccuguuuacuucugccgucagcugagaaaaaccagcgcugcugaguaaauauucucccaccuccuccugcugccacaaauggccaaaaagauucaucagaaagcuccuacuaaugucuuccaauuuguuuagaacuugcucucacuuggcaggccucaaagaugcuaauuacauagaauaauuagccaacaugcaacccacaucaguugauuaaaaaaaaauuuuuucccccaacaggauagucugcaaggguacaaaagccaaaauaaauuucuaaacaaggaaauuuuggaacucucggcucuacgaagaaaugcagaaaggagagagagggaucugauggcuaagguaagucaggaccgacucagcuuagcacgugaagggagggcggaaaccaugcuucagcgguugugcuuuaaaaccuacccagccaccgcaaugggagaaagauggcugcugcaaucaguacacguaaagaauguagagugcaauuucucuguugaugacaaacucgcccacgugggcuucgucauggguuuucagaaugaaaacaaagugcauucaugggggucacuccaggucauaggggucacuccagauuaaaguuaccuagauagucgucuauacugcugagauuuaguuucacaugugugagacaagagaggcgagaauauucccauccccguagauccagcaggauuggcuuaagauuacggcugcagagggcuuuggaaaggcuaaggggccacaggcauccagcugugaguuauaaaugccuggcacguguccacagcugccgcgugcagguacuauuuuugagcagccuuccaagcacauuucuagaaccuuauuccugcauauuugccaggggaaaguugauuuuucugaucagguagcagauaggaacuaauccugccuggacagaaugcccuaacaaaguuggugugcauggggcagggggcagcauucauggccuguguaaccauguagggguaggcuucaccucagccaguggcuuaugacccaguuucuguugcgcauucuaaccuuguugaagguuggucccugugcuuaucagcaccccucucugcuuagaaagaagggggagccauagugggcucuuuuaacccugacuuaacuuuuugccuauguuauacuuugcagcaggcucacuuccuagucuuuuugagcaugcugguuugggcuuauugguugccugugaugccuaaggcuugcuuuuccuguauuugucucuggguggagguaacaccuugcauucucuccaguacucuagccuggaagccaagcucugccagguugaaaguaaauacuugauacugcuccaagaaaugaagacaccaguuugcucagaggaacagggcccugccagggaugucauagcccaguuguuggaggaugcucugcaggucgagagccaagagcagccggagcaagcauucguuaagccucaucuggucagguaaaucugcuucagucuguuggggcaguccacccauuucccaaguucccuuuccacagcaguagacauucacagggcacuuaacgcuagauacugauggcaagugcuaucaggauggcaaagcagguguugucauucuuccacagaaaucaugugcuagaacuggaaucagccuaggccuguugauuccaggacuaugucaaaguagccucaccuccaauacguaccucuuucuucaggggccaguuuucuaaagaacaggaccccuuucgugacacagguacaucccaucuguaggggaacuaaaagcaaacaggccauggagaaaagcuggcuuuuccuugugugggagggugguuucuagaaccugacugaguagcugaagaccacuccaucugagacaaaucauggacccaccuccuaagaugcacuuggacauauacguauaaaauaccgugguuuuuggggggguuuuuuguuuguuuuuugguuuuuuguuuuguuuuguuuuguuuuguuuuguuuugugagggucaaagaacuuagaaugaaucucggauuaaagacucauauaauauauuuucugaccagucucagugucagggcuagagggggguuccugcugcugagcuuuggggcccgauugcuggggccugcugggaacaggacuucuaacagcaaguaugucuggaaggcuguggugcaaggccauuuuugcuggcuacaaaugaggucuccggaaccagagagagcacacggcuuucuuaaaauugaaggcguuuauacccgagaugaaacggaguucuacuuaggcaaaagaugugcuuauguguauaaagcaaaaaacaauacagugacuccuggagguaaaccaaagaaaaccagagugaucuggggaaagguaacucggcccacagaaacaguggcaugguucgugccaaauuccgaagcaaccuuccugcaaaggccauuggacacagaauccgugugaugcuguacccaucccggauuuaaacuaauggagaguaaauaaauaaaaguagauuugugcucuuguaaaaaaaaaaagugucagggcuaggcuaaaucugcaaguucaccugguguaaccucuucugucuuugucucucagauauagcacuguuucugucccuugcucuuugcagucuccucucuaccuuuccucagccucagauagagaccuuugacaugcuugggccagacugacagaucccaccuaccagcauugacugugcuugucaagugacagaaauggacuuugagaauagaaccaaccccguuguugcagaacacuuauucugaaagaugugcucgaugcaggaacaguuacgugguucacaugcaggaucguauuaaacgcucauugcagguggauuugcccucacuccguuaagugagguggguaaguuaggaagugcuguagcauauucugggcuacacauccuauggcacaugacuaaguccagugacauuggauccauggcauaggauaagcccaggcagccagagucucaaguucaagaguacugccuccacaucauguaugguugcuuuguucauagucacuggugagcucugggaguucugaaguguguuacauucuucccaugugcauuuaggaagccgugcauucucuacuacuuugcagaacuccauuagguaaacagaccacaguagcauuauuguuucuccucaugaaaagcacuuaggaccuuuccaguuuucuuaguuacaaacaccaugguauauguucugugugcccaggcaagaauuucuccaggauguagaagaaaaacaagaugucuucaaaccuacuagauuuccaaaguuccuaagacuuuugcauauucguugugucagaaguuuacugggaucugauaacuuccgugacuaaccauagacuuagcaucaaguuugcugucaagaguucaugggucagaaggcaacauaaagucuuacuggacugaaaucucagcuuaaucaaggaucaggcuccuuucuggaucuucuggggaacaguucauuuccaucauugaaaauguugcuugauacaguuccuugcagauauaaagcgacacccuguuucccagccucuagagaucaccugcacuccauaguucauggcuccuuccaucuuuaaaagcaucagcagcugauccagucccugcacaugcgugagcaagugcacucacacacucacacacacucuucucuccugccuuuuguuucuuuugucaucuuccucugaucuguucuuuggccuccccuucucugaugguucauguggacaccagguuccuugguaacccagacaaucucccugcauuaauucugucaccuuaauauuaucugccacuguccucuuuuuggauuuagucacagauuucgacggcaggauguugacaucugugggggccauauccuguccaccaaagccucgauuagcuuuuauauccaauacuaagaggguuucuuacuaauacccucuuccuugucuuucacuuuuaaagugacgccuucugaacagguaugguggcacauaccugcaaucccagcuacuucaaggcugaggcagaaggaucacucaaaccuaagccuuugagacaggcugguaaacauaguaagauaccuuuuuuuauuaaaauaauaucuuuugaaacaugaaauuauuuauuauauaggugugauauauaaagaaacauagacauguacccugacauagccacauagagaggucucuuuuuuauuuuuaauuuuccuuuuuuguuuguuucuuucuuuuucuucugagacagugucuuucuagcuacacuuagaccugccucaaacuuacaguccccucucuucagccucuugaacacugagaucagaggugcacaccacugugcccagcuuggaucagucuuguuugauaauagugccuguguuuccuccugacuuuauaugaggaguuuuaacccaucugaaagugaauuuuccuguacacuauggagagucgaucuugucugacuucucuggccgugcucaauuuagaagcauaaugugcuucauggucugaauagguccuguuucucugcacccuuugccaagaccaugccguuucuaccgucccucuuguuauuucuccacagugaguuugauaucuacggguuuaggacugucccugaugaugaugaggaagagaaguuggucgccaagguccgagcacuggaccugaagacucuguaccucacagacaaccaggagguuuccacuggggucaagugggaaaacuauuuugcgagcacaaugaacagggagauggcaugcucuccggagcugaaaaaccugauccgagcaggcauuccccacgagcaccgcuccaagguguggaagugguguguugaccgucacaccaggaaguucaaggacagcauggagccagacuacuuccagaccuugcugcagaaggcucuggagaaacagaacccggccuccaagcagaucgagcuggaccugcuccggacucugcccaacaacaagcacuacuccagccccacgucggagggcauacagaagcugcgcaguguccugcucgccuucuccuggcggaaucccgauaucggcuacugccaaggccugaacaggugggugucagccuaagaaaagcuuguauccugggggaaaagagggacagcggcaggacaguuucaugauucagcacccccguccuagaguaaugcaggcagacucugcuucagaaagcauaaggacugcagaggggucugggguguggcucaguggcacaaguggagcccuaggccaguccccggcaccgggauuagucagcacagaagacggcucgcuugaagcaucuuggaggcuccuuuuuuucuuccuugcucuucucuucacacuuggguuuuaaucguaagaaucugacuguacugcuugauaguugguggagcaaaagcuugugccauuugcuuauacaggauccugaaugauccuguauguuuuuuuccuacugacuaaaacaguccuugaaggacuuaacuugcuugccuucucgcaagcaauauaaaauauauauuaauuuuuucuaaccaauuucacacaugcaugugaugcagccugacuacucuuuuuuuuuuuuaaagauuuauuuauuuauuauauguaaguacacuguagcugucuucagacacuccagaagagggcgucagaucuuguuacaggugguugugagccaccaugugguugcugggauuugaacuucagaccuucggaagagcagucaggugcucuuacccacugagccaucuuaccagcagccugacuacucuugucccuagcacucucccagccccuacccuccccguaaaucuuucccauucguaucuguucaauuuuguagccacuguguagacucucuuacacgucuugaauaucuuucauaagcaaaagccacuuagggccucucacgguuuguuaguguuccaggcuugucauccugagcucugugugcugggccaggacaaggcuuugggagucccgcagucugcuccccacccaucuccucugcucuggggacugggagcagcuuccugcugugagucuccucuuucaccucugucugcuuucuaucucacugcaguugguguauucacauuccuucccaggcuugucagaaagauaaagggagcguggucacuuaaucccagcacuguaaauggaucucugugaguuugaggcuagccugggucuauacauugaguucuaggccagucaaggcuguauacugagacccagccucagaaaggaauggaggaaagaugaaauauuuguguguacuugagcagaucucccauaaggagauuguauguucccgagguuugaaugcuggcguguagucuggcugcucagggcuuucaugcuccugacccaugcggguuccugaccccacccccagguaagcugugugucugcagugggagaacuacgggagggaagguuucaagcuggacugccacuuacuuaaagcgcagaugaagcccaauggcuacaaggaagccaugcauuugaggacaggguuguucucucuacccaggaaacccugacuucuccauccucaaggauggggucguucucucugcucuugggagguuaaaagggacuucagcuucuccuggauagucugcauuuaaaaaccaaaaccagccuaaagcaguccugguuuuacuuaaagccacagcucacacuauacuggccagggcaccauggugaaaacuaaccggugcccuccuggagccaggucuguggaucugugggugcugagagcucuggcuguccccacuccugugcuguugaagcuucugaaacuuagcaguggguguggggagcgcuuucccucagaguccuuggcacaugucccugccuucgaugcccaguuccuuaguguaagggccgucucuucuggauuugugcuuaucaugcucagccucgguuuaaaugaugucuucaugucucuguuuuggacuuugcaccccacuccuggccuccucaggggcuguaccuuugauuauuugguuguuauuuugauuauuuugucuguguaacugucccccgggugucaccuucccgacuccccaucccuuuuaggaagcugaggucauccccuugccgccuccuacucagguucuguuuuucaaguugaaguuugcugauuucuuucauuuuuaucaaagaaaaauagagcaaguucugagcaaggaucuuuucccucugacucaagcagauaagcagaaguucuugugucagcuaagugcagagggacauuuccucaacucugcuccauuucuguggauugcccucagggcaucaggcacagucagaagagcucucugcugcugagucagcaugcauccccuaccccguuuugugaugcugagguuuggacccaaggccuaaggccaacuucuaggcaacgccauaccacugagcugcauccacaguacacacaccuccguucuaaacuuugccaacucgcccagacaugagccucaguugugcuuuccccgggcucaagccuacuccaaaacugggauuagucauuaccaaccaccucuugauuguggcaggguucaaauauuuggagccagguuuccacugugaacaacacagcaguuggugugugugagcgccucuccugccucaugugcacaccucaggcaguuccgaaggccucccucccucccucccaugggauccuaugcaucucuguuuccucccugcaguguggcagcuggauagugggugaaaucacauccguaaaccuccucauacucucucacauucaccuuauucuuuagacauuaaaggauuaauuaaacauuguaagcagugagcucaaagagcuagcugcauuagcaaaauguaagagugaaacauuucuuuaagugaggcugauggaucacagggagaugauuucauugggaaauaauuucaacuuugaauaaaagccaaaugacaggaucaaaacuuuuguccccaaguuuuagcggacucaucccuugcccagaaauacucaucuuucuucauuagagaaguagaaaucagucugacuucuagagaaaauggcuucaggagaugcagccauuggugaaggcaggagccggagccagcacugaccuagucccugucugcccacagguugguggcaguggcucuccuuuaccuggaucaagaagaugccuucuggugucucguuaccaucguggaagucuucaugccccgagacuauuacacaaagacucuuuuaggaucccagguacuuuuaaaaauacuuugucuuggucacuggcauagaaccauaguugucaugugaccugaauuaacgggcagggguuggggggcagcuuauaaacauaacugcagugacugacuguaaauggacugugucagcuucuucagcucacuggguaccacaaagagacagcccucccuggcagucugucacagagcaaagaugcugggggcgccuauuauguuaccucaggucuuccagaaggcaggccacaccuggagaugugccuguagggcgacagagggcugcuaaggaggcuggguaggacucuauccuggggaagaagcaggaguugaagcagagucucucagcugucagaggagccacacuagcagcuucccuggugcccugccuugccuuucccugguuucggagaacaagacagugauggaucguaaagaguggcucaggacuggcggucaccucccagucaggaucagaaugguucccguuccguuucacaccuagaucuugacaucuggggucagaguaggguggugugggcuggaagaggcuggcucaucuguccccaccuggucuggccuugggaacuucccugugggcccaggacuacccuaguacuauucccugcuucucugcugcccuggcccuuuucucuguguccuggcugccaugacuucagacuccuccugucucucaaccacagcagugagugccacagcugccucccccgguccacagcaaaccuugcauaccuucuuacgccuguccuugcuuccugcuccacuuaggcuauagcccccugggcuccuggacuguuuuccacccacccauaaggcuguuggaugcaguucacccucuagugacaggacacuguuucucugugugugggacuucucuccuagaacgccauccccugcucaucuagaaagcuccaggucaguuccagaaucuacccgcccuuccacacugccucccuguguucccagggcagcugugaggggcuccucagugccugccacccuugccugugaugacuguugccuagcuggauucacccuugccugccugcuuaucuguccucuagcuaauugguggugucaucugggccacagcucuauuaucuuaggauguccagcacauuccaaagaaaugucagcaccuucaggagcuacuguuugaccagaaaugggaacugguauuuagugagccuggccucagaccguguagcaucuuuccugucccacauugggcucgggagaaaaggaagggacagcaagauggcucacuggguaaagucacuugaagaccuacguuuaaucuguagaaccaacauaguagaaggagagacuugacuccugcaaguuuucaucuccacaccaugguacauggacgcaugccaaaagaugaugcaguugcuguggggcugagcuggggaucggacucagcccuugggucaccaugccuaagcuugcaccucuuuccacaguggaaaugucacuggaagguggugcgaagcugagcucuggccuucccacagcggccagaucccagucccugugacagcugcaugaguguccauggacacagagagaagcucgcccggucucuuggcgaucccuucccuuucugauuaccugugaggugcaucccugucagcaugaguuuguaagcuaggacaugcacaacaagggggugaggcagugcucucagucgggugggaucuuaaaauccaguggcuagugcucugugugcucacagcaccugaaagcagcccuucaggcucaacuuaaagucucagaugacucacgguuugggaauagaaaaaacgaagcccugcuuucccugaacacucugggacaugucaucagguaccuuuauacccuuagguuggugcuaguuucuucucucaggugccuauaacacauucauuaucuccauuaucucugugugcugcuccuaaaauaagcuugagucagucccagugcaggcuucgccagaucccagagcccuaagccugcuaccugcugcuacugugacccagcugcuggccaggauucccaccuugccaucuuuggacugugugcugugugccaggaucucaccaggcauugcagacacuaaugaauaacacacuuaucccauguccuccaguguucagggaaggagggauaagagaggccugagcaggcauuccuuggcagccugcuccaugcccagcccucugccaaccccugacagccucacgugaggcacugucuugccaccuacuugggagaagagaucuguacacagauuuccucccacuucaaagccagguggauauccugcucuugcagaugucgucagaugaccaucucuguuccuuucuagcuucuucaaugcuugaagaguuggcgaaugugucauuguuugagugcugacggaugaaaggaucugucaggacggcacuccucaggggaggggacugaggcagaugcuugaccucauaggcaacuuuugggaaccaugggaugcucugacagcuuuuaaaauaguuuucgggauuuuacaucuaaccugaguuugacaggcagguagacgugggugugaggugaggcgggccccacagcuuuuuaugugcacuuuuguuucuuaaguauuugagaaaaugauauucauuucagcagucuguaccugaguuugucucuuguuagaaagcaaaugugcauuuuaaucaguuguucuucgucaacucuagaguacauuuauaguguagagaauuaguuucuaaaacacuguuuuuagcuauuuauucacucauuuguuuuuggacuuuugagaaaggguuuugcuguguaacuggcccagaacucuauauccuccugccucagccucccaagugaaaggaauguagguguucacagccaugcuugcuaguuuauagcuuugccuuuuuguuuuuugguuugguuugguuuggugguuuuugguuuuuuguugggggguugguuuuuuggggaggcgggguguugagacaggguuuuucuguguagcccugacuguccugaaacucacucuguagaccaggcuggcuccaaacucagaaauccgccugccucugccucccaagugccgggauuaaaggcaugcgccaccacugcccggcccucacuuugccuuuuaaaaaguuaaaauuccaauaggaauuauuuuuuuaaaaaauagaacuuucaacaagaaauaguugccaucaucagaguucuggucuguccauuagaauaauauugucaaguguuagcaucugcuuagacuguagcuguguuagcaccccaggaaucccagucgugcgcacgccuguaguccugacuaacuggggcuguccuaguccugguuacugucgcuguaaugaaaugccaugaccaacacaauuggaggagggaagcguuuguuugguuuacagcccuacauuacugugccucuccauaggaaggcaggaacgugggaaccuggaggcaggagcugaugcagaggccgugaagaagugccacuuacuggcuuguucuucguggcuuguucacccugcuuuccuauagaacccaggaccacuagccuggggaugacacuacccacaauugguugggcccuccuccaucagucacuaauuaagaaagagcucuacagcagugguucucaaccugggggucaugaccccauuggggagagggggaaggucaaaugauucuuucacagaggucaccuaaaaccaucagaaaagcaaauuauuacaguuuauacaaguagcaaaaucacgauuaugaaguaacaauaaacauaauuuugugguugggggagguguuaccauaacaugaggaacugcauugaagggucacgacaccaggaagguugagaaccgcugcccuacaggccugccuacagccugaucuuauggaggcauuuucucaaucaagguuccuuccuagcagaugacucuagcuuaugucaaguugacauaaaacuagccagcacagggagacaguuggcagacuugcagaugaguccaggguguccuccaggguagacuccauauaagcaccuucaguacccgcaagcugccauacuguucuccaaaguggccauccaguugauuuccccgucagcuucccuagagaggguguccuaccccauggucccugcacgagcagaccagagccugaccuccaggccuggcuuugugcuucucuucacccccuucucgccguuggaccucucacuguaggggucucauccuaaaggugcccuggggcaccgcugcuucuccucuuuccaguccacuccugugcccugucucagaagccacgucuuuggccucuuaguggcaggcucagaagugggguguucugagcagcuuuuugucucacucacacaaagcugaguuuccuuuggcaguuaccgucaaguaaaguuccgcacacccacuuccauuuuucuguuuucaucaguuuggccaggggggccucggccguccagucuagucuuccuguugcagcuagaaggauggaucuagagaucaggcuucacuguuggacacccuacugaaagccuuagaauacuucuccuuucuucucugcuguucgcagacuagggauagagaaggugguuuugcagacugguauuaaucuuugcaugugucaaauaaaacugaucagacgugaagaaaaugcaugaguccacugugcuaccucaguguuguucucugaagcuuguuucugcugccuacacagagagagggggagauggggggggggcuuuguaugggucccacaguagggaaagcuccuugguguggccucucagcccucuuccuagaagcccgaucccugccgcaguuaugcuaauccacuugugcagcugccccucucaccucucccauucuguaggucauccuugaacccuguuuagccuucugcccgacacuggcagcacugaccagucgccugaccuaacaugcagaggcuauagcccccuguggcuggucugucuugcaguaguuuacaugucucuuuuaaugcucacagcagcacaguggguaagucagcuaucucugccuauccuucagaagaguacagaacuguuuagaacauccuuuguagguggaacuaacucggauucaccugggauccucuaacucgcguguucuuucugccacccugcccugucagaccugcucacugcauggugugagcagucguguucuauuucuuguccggcgcucaugcaucuaagacugccuguauucauaggaguguuggcaggcugacaccaaccuaccagcucuuuucacuagccugcuuccacauaagaugcugaguacaggagcugcuuucaggcuggagaccauucccuucuccccauacccuagggagaaugacacauaguaguggccuugcagaauuuucggucagcugcuccugagacacagagcagccuggcucuaugaugugccccacauggacauccagaagagcuguguugcugcacguccccacgggcuccacccucugcucucagguggcacagcuguucuggcuugcuugcuucgugcccugccagaccccaggccuuuccgcccucugugcccucuccagguggaccagcggguguucagagaccuccugagugagaagcugccucgacugcacacccauuuugaacaguacaaaguggacuacacccucaucaccuucaacugguuucuggugguauuuguggacagcguugucagcgacauccucuuuaaaauaugggacucuuuccuuuaugagggaccaaaggugagugggcucugcagcuauacgcacucgucggacugugacaggcugugucaguaguggcagaauggcugauucuccuggagcuugugagguuaccacagcaccaaacuuaccucccugugauggguuccugcaggccuugggaagcagcagucacaugcucauccgugaagacccucagccugaagcuaggcaugguagcucccagggagagccugucacagaguaaccuagcaugaugcucaguagcugagugggccagcccuugcugugcucauacaaggccucuagguucagucccugcccuccagcugcccacccccccaauacugcacuauaccauagcacagcacaccaaaaguaaacaaacaaguggcugguggaacaacguagcaagccccuccgaccucuauaaacgaacaaauagacacacuaaauaauaaauaaauaaauaaauaaauaaauaauguuaaguaaaaauaaaaacuaaacauaacuaagaaaauauaguaggaaaacagucugucuccucaauuuauauguugucuuucauguuucuuuuuuucuuuauuggauacuuuauuuauuuacauuucaaauguuauccccuucccugguuucccguccagaaacccccuagcccaucccccuuccuccugcuucuuugaggguguuuccccauccacccaccacuccugccuccccgcccuggcauuccccuacacuggggcaucgagccuucacauauuucuuaagcguugcuuuuaacuuuacugugucuuggaacuaguucugugucagcacauagagaaccuguuucguaacucacuggaguuuccucgugcaccauagccccugaugguggccacuuugguugcuuccaaucucuugcugcuucagaaaaagcuacacccagcucucaugggacuuuucaucucucugcaugugugcaagugcauuauagauuuagcccagcauugcaggaucaaagguugguccauggguagcauugagguaacagaugaccacucaaaagggccuuuugcagucaccccauaugcagauucaguguccaacacaaagcauugccacuuuuauagucuaauuugucauuaauacaaagaacuuucaacuagaaucauaaacgcugcuccuauugggccauaggugaagagaaccaugaacaauuuaacccuauaaauaccacuuacuaaguaucauacagugugggcuagaguagccauucagggcucuuagauguggaaauagcaguuuguuccaaagcugccugaacuuguaagaucaccaggaguucacuaccccccuagccuuccccuuaguaccccaaaagcaaaucagcaaaauccacuguuauuucaccauauugaaaaggcggucagaaccagccgagacuaugccuggcucuggaguuggcaguuucacauuuucagucaaaaaagcccagguuuugaucuuauguaaaaguggugucuagauauguauucuuuguugacuacaaagguuaguuagccaaaagugaaaggauuccacaagucagucagucaccuuaccuccuaggaacacggcugccuugucggaaaccacaaguauuuguuuuauuguaccuaagggccuuguccaguccuggaagucacccuucgguucagguguccgcccaagggcagggcccucaggauacuuccucuagccagccccagggagaacuucaaagcccagccucgugcaauuaccguuucccuggcuuuccugcagguuauuuuccguuuugcccuggcacuuuuuaaauauaaggaagaggagauccugaaauugcaagauucgauguccauauucaaguaucugcguuacuucacucggacuauccucgaugccaggugaguccacaggcuccucagacucgggguuguccagggugccguggugcucuuuccuagagaaagaaaugggaagggccauguguuacaggagugagaugguagauaaaaagacagcccugagcgcugagguuuccagagggaacaugccuuuccugauccacaaacguagugugaggaagcccaagccgugccucagggaugccuuggggcacagaggugcucagaggaaacauguuugggaacaacgagaggggccaccaaguuugugcccggcugcuggggcucauggcuacauccuagccuggcuccuuaggccguacucaggaauuuuagcuucauucuaaucguaacagaaugucacugaaagauaagaggauugaggcaggaccagccacugggaggguagauggugacuguugaaaguccccaggaggaaaggugguggcccggagugggguguccugagagguggagagaagugggacagauggaagagauuggggauuuugaaauugaaagaacccuagguuuccagcuugaagaggagucaugaaucauguccccacauguauacacacacacaccuugggccacguggcuauuucuugucugggcugccauuuucccuaggccacaauuaguggcugcucugguuccagcagcugggguagaccuuggcaacgaaaguaguuggcagaagcuauaccaggucucugggaggucgucgcuguuuuuaggaucuuucucguagggaguacauuuucaagauggcuuuaggcuuagugccuaacuaagacuaacuggauuugugcccagugagaaagggcaucugaaaguguuugcugugcaagacuggugaaagguucagggugaggauuguguucaugucgcauugguuaagauuauuaagaguaacugaaugaauucccacaugacaguggagagcauuuugguuccagagauggauuugccucaccaugacacucuuaagggggaugucagggcugccuggagauaaaucuuccuccucuacuuccugucaccauuggacagaacaaggcagcucccaucuugccugauccuacagcgcccccuggugaauggcucaugaugcaguuuccccuuugcuuuagaaagucaaggccacagaccaagagcucccaauauguacaugagguccugguccuauucccccuguccugcaaccucccaccuccugggagguugcugagguugcuggugccuuuguuccaccuccacacuagaguuucaguauuuuaaggagcugcccauacuagcugucugaggugaggcaguuccgcagacuagacaggucuuacaaaguggucaggcguuuccauagccaggugcauucaggagacaccggacgaugcaagauugaacugguugguggcugcaggguccaugagaggcugggcauucaagggcagugucuggguuccccuauuuugcagcccgggccauguugcuguuggcucuuuccaacuagaggaguaaaggaauaaugccauacccccuuuuucacuuuggagcaaggccugagguuucuggcuuacagagccuguggcucauguaagagaaaggacagugguaaacuccuggaucccagucucaguggcauaccccagcuagcucacaaggcugggccugagacacagcugggccucgucgggccucucauaaccuccaguacuugccuguccuagaacaaacgcauggagaacuuggccuuuaaagaaggcaggccagucucaccuuuucacuuccuuacaagagaagcuguuggaauauaaagaugagaaaggugcauauccuuuauacacccaugcuaaauggagcucaggccuuggagcagcagguggcuaacaagggaaugagccccugcuaucagggagcaagaccauaggccuggaagaaucaguugggaagugaccuaucccuuggcauaagagaagcucugucuuucugugauaccaaggaaccaguacaacugacccgugagugcuggaaagcaaagccaggcgugccgacugucccuagcucuauuuuuauuacagacuguccaguagcugaaguauuacaaaccuaagacauuguugucaguuggugcauugaaugcugcguguaccucuguagagugcaucuuggcccaggucacacugcagauaggaucugacgccaucaccaugccuaguccguugguaucaggacaguuuuccagagaaucauacucacugaccccugcuaucucugagugaacaccaggcuauuagugccuacuacauguagaaaccauauagaguacaccucccaucgcuuccagggugcagauggagaaucaggucaaaauggagucugagcucacugugccuuccgccucucugcauaagcugggccuggguucccagggugauauucccccaucccaugguacaugugccuuacucccuucucuggucucuaggcagugcucugggcacucaccugagcucugcugaugcucaucucugcccuuugucccaccaggaagcugaucagcaucuccuuuggggaucugaaccccuucccccugcgccagauccggaaccggagagccuaccaccuggagaagguccggcuggagcugacagagcuggaggccauucgagaggacuuccugcgugagcgggacacuagcccugacaaaggcgagcuaguuagcgaugaggaggaagacacuugaauggauccccacccuaggaugcugcucuucuugccuuccuucauaaccaaaaguagcaaaggcacaucacugcacaucagcugucagauuguaacaucuacagccucuggcuucugcugggcagauguccagagcuaagcugcacuuucucaucucccauuucggggcagggggcagguggcuuuacagccauuuccgugucacaugcaucauaugcuugcugccugauuggugacucaccgggugacuguuuccaagggccuguuuacagcaucugccaguugugugcguguuucgccccacaaaaacuauguuccacaucucccuaugcucuuucuuuuacccaagggcagcacuguggaggaaugugcagggcgccacaguguggcugcuuccagggucacaaggucaccauaagaagagggaccucuuuaaaaagcaagcacacaacuggccucccaggcuggcgugggagcccucugcugguggcuuggcacugccagccgcagucccuucuggacuagccuuugcucuccuauguagccuuucagacugcagcacucccccugaucugcagcagugcccacacuucucacugccagcugcuuugccagcugucugucccagauugcaguggggcuaaacacaucuccaggagcugcuguaggaagcucuucuagcugggagcugacuuguagacaccauucuccaacucuggcuggcuugggguuccaaagggaccuugcaguagacccagcccugcauaagggaacauaggaaacucucagaucuguggcuugugggcuccuggauucagggcucuagaaucucuccugccugacagcuggaguggggcugacugccagcuuccugcaucuggaagcaccuggaguggugaguucuagucucuguguugccuggauuauccuugucuucaacagggaucuggggccacuauggccucuggaauagcagacucuggggacuuggaacacuucuuucuugaagcccagagaggguuugaacaagaaagguuauuuuugcucagucccagcgcaucgcugaugggugacugucaugagaaagcauguuacacaguauuaugggagcacaagggaaacagccuuggacuacuuuacacuaccugggggaaaauuggaaacaauccuuaguguaaacacacucagacucaggagcggagcaagacaguuucgagaagcgcuuuuuccaugacccauuuuccuguuuuugcugucugcuuucuagcacuugaguggcugaguccauuuuucaguaucuagacuaugcuuaacuucuccaaaaguugcuucauuuauuaccauguaaaaggagcuggucucucuauuuagccaauggccuuugccuaucuucagguaucaaaaaugucauccuugugucuuuaggauggugguuugaggccugguuucuucaggaagcuugucuggagcuggacaguggucuuacugcuauuccagagccucccugagaccaaaugcagggagaugccccacccccuuggaagugccggcucucagccuuggggacagcuguuaggaagugccgcaggguaggguugccccagggcucaguugccaugucaguuucguaccagaagaugccaguccagaugugcauuugguguaaauuuacuggcggguugcuuuuguccuguaugcugguggaggagucuuuaaagcaccuggugaugccggggacauggcuuagaacaugugccuggugugugggacucuggguuccagcccagugauuggaaacgaaaaucuccaauaugcaugggguccuguucugccauucccugagagacggcauuaguuucucaagcaguuagcaucagugcucagguaaaagucucaagaggccccaaggggaaugcacaaaugcacacuuagaggcucucaucccuggauaaaugacucaguggcuucagagcugagaaggagggcuugcccucuuuccaguuuggggacaaaauggcagaugcuugucccagaggcaaggcuccggugacugagccaucuucucccauucccucaucacggagacugucuuuacccuccucuaguguuccugagguuccagacuucucccagccaccguggcagguaccccucaugucagggacugccucgugcugcuuuucaucugaaccuuuacccagcaugcaacgcauggcuccugccuggugagccucgugggcugagaaagccaaagcacagccuccagcguguggguccaaaugcacgugccacaguagaggagcacccugcgcuuggcgccccgucuggugggaccuaccgauauuccaaccguugacacuuuuauauuuucacuacauuuuauauuuuuauagacuauuuuauauuaagguuuuucuagauccuguacaacuuuuauauaacaaguucuauuuugugugcacgacuccccuguauguauuuauaucaacccgagccucccagauugcaggucccucuugugccaccuuuuccucuuagccuugacugucccucuccucugcucacccagguagccucaggggcuacuucuagccgugauaacacccgaacagcagucacuggucagcauguacuucucugguguuuguuagcuguggucuguugauacaggaaguacucugggcaguacccagucagguuaccacacuauguuaccgcacaaaccccucucccucaguacaguggguguccugaugcagcgaccucuggguggguggcuggucaggaaaguccucgaagacagaggcuagaugcaagcccgauguaugaggcucugcuccugugggcaacuaggggacuugagggcacacugccaaaugacuguccuuucauaucacagcagcuucccugcucauccuugaguuaaauguagacuuguaaaggaagaaauaaacuaauuuuuauuacauucugccucaaaagguagguguagucauuugugac

SEQ ID NO: 5236 - RNA, 2529 nt, Mus musculus
uauggcugaggauuuaccucaguuguugaaugcuuccaaggcccuggaucgaauuccuaguaugucaacauguguacaaaaguuagucaugauguuaggcauaagcagggaggauugccaacaaguuugaagccauucucaucuacacggugaguuccaggcuagucagaacaacauauccagauccuaucuuaagcauacauaaacuacacacacacauguauauguauauguauauguauauguauauguauauguauauguauauguauauguauauguauauguacgguaagguuacuuuuuaaauguuagaacugaaauacaugguaguaagaauucucuacuuaauaguaagcaugaaacaaauuaggaaagaaucaucggaaaaguaaaguuuuacuucauaaccuuugccuuauuauucccuaagcacaaggauagagaguaaacccugccuuguacauaccuacagaguuggaagaacgaauucuagcugcugacauuuuaaagagcacuuaaugagccuuccccacagcucacuuccugcccuuucuucuauucuuguucccagcauuaacacccacacugcccauuaaccugcacugcaucucacaacaguauccuuggguaguggaacucacucccaauguucccaucuuucgaguccugcuccagaaguacauuuauuauuaauacuaacaaaaggcauuaauuuuacaaaauguccauauaauugaucaaaauuggcuuguuacaaaugauucuuucaaaaggacaaagcaauugacugacuguaacuuuucucccaacuucauucuugcauaaauaaggcuuucuuugauagcucugauuacagugcagaacaugaucccuguuuucuaugguuuguggacuuuuuguuuccguugcuucuuaggaaaugcauuugucuccaauuaccaaaauguuaaguaauggcauaaaagugucagaaaagggcaucaaaaucaaagcacaguugaacgcaacuagacaggaacacagagcacauucaauguuuaacaauauaacucaagauuccaacauaaaagccacuguuacuggcaauaauuagcugauauugcaaauaauuuuugucccauauuuguauugcagacauuuuaguaaguacuuucacaauuauaaguauuaaugugguagauacucuguguaugucuguguuucucucugugugucucucagugugucucugucucucccucucucccuuuuuuccccucugucucucuuucucacugucucugucucucuguaucucucugugucuccuucucucucucucucucuuucuuucucucuccugugugugugcaugugugugaaugauacccuauucucauuuccuccuuuucucucuuccuuuguaaguucuaucaacuucucacuuauaauugucaggguucaguauaaaauuaaaauauauaucccuuguucagagaaauaugccacugaggguauuaaaauauaaagacuuuuccuucauaguguuagcacucaaauauucaaauaguggugauacauuagaaacaacauaaauuugcaaauuucaaaaaaaauugcuugaaauagaacacuguuuuucuuuuuuuuuaaauuagguauuuuccucguuuacauuuccaaugcuaucccaaaagucccccaugcccacccccaaaauccccuacccacccacuccgccuuuuuggcccuggcauuccccuggacuggggcauauaaaguuugcaaguccaaugggccucucuuugcagugauggcugacuaggccaucuuuugauacauaugcagcuaaagacaagagcuccaggguacugguuaguucauauuguuguuccaccuauaggguugcaguucccuuuagcuccuuggguacuuucucuagcuccuccauugggggccgugugacccauccaauagcugacugugagcauccacuucuguguuugcuaggcccuggcauagucucacaagagacagcuauaucuggguccuuucagcaaaaucuugcuaggaacacuguuuuucauuuguuaacuauuuaauaaauaaaauuacuuuuagcaagacacacuaugucaaaauuauccucguucagaaacagauacaggcagagacagaguguucuggcacacagaaagaacugaagcaggagcucuguucauguacuucuuccauuccuuccuccucauguggggcuauauugucacccaggagaucuagcucucuuauugacaacaaaagaagaugaagaugaagaaggaagaagaagggaggaggaagaggaugagaaagaggaggaggaagagaaggagaaagaggaagagaaagaggaggaggaagaggaagggaaggagggaggaggagaaggaggaggggaaggaggaggaggagaagaagaaggaggagaaggagaagaacaacaagaagaacaagaagaacaaggagaagaagaagaacaaggagaggaggaggagaaggauaaguagg

SEQ ID NO: 5237 - RNA, 2477 nt, Mus musculus
auauuauuuucuagaauuaugauggaaaaagauguugugucuggugcugaaaucauggaaauguugguuuucauggcuugguuuacuuucucaaaacuacuuaaaguuaauugagagacaaaacauacaaauaccuucaaguuuuaaggucgugacuuuagcaaauggagguuguggagagucuguaagagcugugucugccuucuaagcuuccuugagaacuucuguaaagcagaucuuucauuaagaagugcuuuaucuucuacugauaugaugcauuucccuucugggagcauuacugaaguccuuccagaacccauccacuaucuguagaugucaguauuaauggcucaguuuuuauaauuccaauaaugagacauaaucucaacuuaaaaauguuaaauguguguauccuuuguccaaggggggaaaaaaaccugaaauaauaaauuccuuucucuacauuguucccauacucugaaaacuucugaucgagcuacuuucccucagagaaugggauucuguccacaaaaauaccacuucuuauuauugauaguuuugggaacauuucaauguuucuguucaaggaauggcugggucauguguacacaggguuuucaaggcaucuguacucagccaccgagaaaauggugccuauggugcagacggggagaauccaccuagaauuuguugaauuaaguucuugcaccuggacauaauuguugagccgcugugcugggguuuucuuaagcuacggcuaaacaaaugagcucaaauuaaacuggcauccaguggagaagcaacaacucacuucauauaauguuuuucaaauaauuauuuuucuauuaccauuuuuaccucaugaauauuuuccugggggccagggaaguaaaaaauggggcuaaacaagagacaugauaaaacucugcugaaguuggaggcucugauguuauugcaguguaacuaagauauggauugguauauggguauaauuccagucaagcuggauuuuuuuuccauacuaaacauagcauggauucaugaaguacauuuuaggaaauaaucucaugucuuuaugcagauucauaauuacugcuacacuuucugccuauguaaugccaugacuaucuuugcagguagacaaaaagcaugugagaauuacgaugcccagauacaagauuuaguuguguuugucucuagacuuugugaaucucauuuggucaugcauuuuuaaguuauuuauacuuggcaauaaacuucauacguuuucuggaaauucaacaaauucaagaauucagugacugagaagagugaauucaugaaaccagaagaagcugccucuuguagccagguaggaccccccccuacaccaccacccccgguggaaggaauaagagcaacaauauacccaccaaacuuuccacccaaaauuugucauggcuaaaagcaaugcagaaaaaaagauggagcagagacugaaggaauggccaaccaaaaacuggcccaacuugagacccaucccaugggcaagcaucaaaucccugacacuauuaaugaaauccuugcagacagaaguuuagcauggcuguccucugagaggcucuacccagcagcuggcugaaacagaugcagauacucauagccaaauauuggcugaaggguggggccucuuauggaagagugugugugugugugugugugugugcgcgcgcgcgcgcgcgugcagugggggugggggugggggauuaaaggcccugaaggggauaggaacuucacaggaagaccaacagaucaacuaucuuggauccuuggggcucucugagacugagccuccaaccagagaacacacuggacugagaucucuggcacacagagcugccuuuucuggccgccaugggagaaggugcaccuagcucuguagagacuuggugcacuaaggugagggauacccgagugauuccaccaucucagugaagagaggguuugggaagguacucugggagggaagaaaugggaaggaagacagaauuuuggucuguaaaugaauuaauuaaaaauaaaauagcacuacuaucaaacaaacagacgaaacaaaacaaaauaaaacaagaaagggaaauaagacuaagguuuagaggacccauacgcaguuuucugugcauucgugcauagucaccuaauucaaacuucacagacagcaaauaggugucugacaggauccuuaccaggaaaggaugggaaauuuuugguuccuuaaaguuuucauuucaacgagggaggaaaacuauacccccauaaauggaaacaaagaaaggauguuauuucaaucaauuuuaaggacuaugaagaacauaauaugggcuagcuuagauacacuuagguuuauugggaagguuuugugaagcaugugucaauauguauauguugccaaugucaacagagcuucuuuuguacacugaaugccuugccacugcuua

SEQ ID NO: 5238 - RNA, 1034 nt, Mus musculus
uccccuccggucugguccguuguguggcuugcucccacccccaacucgcucacucugcccucccauucccaucccagucccuuucauucagguaaaacuguaaauuucccaacgcgccauuguuccucuggaucucccaaagcucccuagagaucccggaauacuuuuuugguauuuaaauccccgguagauaggaccaauguaaauuuugugacauucaaaccuuuuccaguucacaaaucagucacccuugucacaguuauugaaauuccgcaacuugccacaacaagacgguggaaaaagcgggcgcggucuuuguugccaaccaggcuuuugaucgccagagaaaauuuacuuaccuucagaugagugagcagaaaaagaaauaacacucccuuugauuuaguuaggaaaaugcagacauuuggauuccgugcaaacauacaacacucgcuuguuuucgcgaugcggcccucgauuaaccugucuuugcccagcgcaaagucuauucaacaacugcgcguaguugcuuuuugucccauccacaaagaaccauugacuauauauuaaaaugauuguugaaagguagagggguauggcacguaaaagcagggggaaaaucccuguaacucaaucaauuaaaccgggcgacauuuauacauuucaaaaacugcacgcggauguggagccgggggcgauggagguugcgguucuacuuagcucaguuuuaagcccaucagcuuggcccaggauuuagccuuagcgccugcauauucauuaggucuaauuauuuucuaguaaggaaaacacaaaaagccaagagucggaauucuucaauuugcccuuuguuucuaacuucauuuggcuucuuugcaacugaaucaaggcucuaaacucuuugccagacaaagagaccuucaacucauccuuucacaugauguccgcuuagaaaacuuaacaguucuccaagcaaaagaaaaagaaaaccucucucucucucucucucucucucucucucucucucucucucucuc

SEQ ID NO: 5239 - RNA, 66225 nt, Mus musculus
cgcccuccuuggcugcucuuaagcccgcgccgcgggcgccuccgguuccgucguccgcuccuugcgcucggacuccgccgaaguccgcucaauccucuccgugcucuucgguacccacgcaguccucccaguccgcccuccgcuccagccccgggcucacgucugguccugcgcucuucggggucucagcgucucgcgagaaguccucgccacaggccuucggcucccggguucaggggcggaugggggaccgcggagcgaggccggggcggcugaugcccaugcucgcccugcucuccugggcggccggccugggcguggcggaggagacgcccgggcgcaucccugcaggugagcucugcuugcugguuuccaccggcggucuagagagaacugggcauguuuccucuuugcuugcuccaucccugcgggaccuagccgcggggcucccugcuuugagauuggcagggaccuccuuuccugcgccccgggaagcagcuugccauccugccucugucuacacgcagcgcucgggacccggcuacgaucggacccagugugcucccacccacuccuccuuccguuacacuuuggggcgucccugagcccuggcccuggccgguguucggaagcugagcuaaagcuaguaguuggaggcaaguucgugugaacaaaacuuucuggguucagccagaggagagccccgccgccuauuugucucaacgggacuugcagcgcugcuguaucgcgcaggggaguucuuugguccuuucuacuucugggcccugggcucagcucccuggaacugagccuugcguuuaaaugacccgaugcacucuggugaugaguggguggaugcgcuaauuuugcauucuauaguaacuaauuagauucuuuuccucuggaaacuaaggcgaggagcaaacauuucuaccuuggaauuccaauucagaggguaacacuuggcacaaguccaguuggacccuguaaccaucgguuuuugucuuucucauggcgcaauaggugaaacuuaaggacucagaagcaccugguucuguggaacagugcucgcuuuguuggcugcagucacagggaaaucugaaccuguaugaguauucugauuuugaaguaacuuuuaucucauaucaaagguauuucuuucagcauaguacuagaaaaaucacacagauaaaugagaauagagacagaauauaagacuuuacucugaaaacggucuuuguuaaaacaccaaaagcuuuuauugauaaguaaaaauaaccgccaggauuugcuaauuuuagaguuuggcuucagcuucugucuauuuuaugccaccucgaugcgacuucucacuuguuuacagaguauauccaugccaggcugcuaccuuuaaauuugagguuaaaaacaaacaaacaaacaaaacaaaacaaaacaaaaaacccaaacaaacaaaaaaaacaacaaaaacuucccugugcaagcuuuuacauuucauggaauuggauguuaaauuuuaagggauuguaauaucuaaggcaggggauuugagauacgaauguuuuucauauaaagccuaugguuaauaucugagacaugguuucuguggugguaggugggcccagaguucaguuaugagcuaaauguuggaaauguuucugcauuaauggagccaagugaggaguagccauucugguuacacacacagauagaugguuucacauguucugugguaagcuaauagaugcaaaagaugcauuguuugguuauuuggucagauuuauuaucagcugugguaaguuuuaucccugaaguaguauaacuggaaauuacuacauggauauuacuacauaaauaaucuuucaggucuaaguugucuagaugagugggcuuucaagagugcagaucaccugugacaaccccccccccccccauuauuugucaauguguuccagcuggucaguaaaaagaauauucagagcuggggagauggcucaguuaguaaaguacuuguaccaaaagugugaggaccugaguucuggauccccagggucuacuuaauagcuaggccugguggccugugcuuauaaccccauugaggaugaaauagacuguaggcagaucccuggagcugacuggcuaccuaguguagccugcuuggcaaagcuugcuuggcuaaugagauccugugucaaaaagaggugguggcugguacccgagggaugacuccugagacugucuucaugccuucacaugcaaccccccccccaccagugugugcucacucucccacauaaaaggaaugggcccucuugauaauuugagccauacccccuuuguaggaauugcaagucuagcuuuuuccuugaccucuaccuacuagauggcaguggcgcccagcuaugaaagagggaacaaaagaaggcuucagcaaaaggccagccucuugagaggcagaugauccaggcuugagaaucacugcacaagauaaauagguguccuagaggcaaugugacauuacaaugcuaucagcgggauuauagguccuacucugcccuuccauuuaguuuugagaguuuucuggaacuucugggcucacgugagccuccuacuucagcuuccugaguaguugggauggcagguuuuaguuguuuaaaagccauuuuucuucuagcaguuuuccauugugacggugagugugcuucuggaauaaauuuccuggcuuuggcugugaguucaacacuugggaaaguccugcuuguuacagcaacugaaaggucugcugugugcugcccuggaugucuuuuggcagcccuaguaguccaggcucagagagacuaucgaaaagauuucgguuaaaaucauuuguccccauuuguccucgcagcauuuaucaaacuuuucuuuccuggagcuuuucccaggcagaggucgucagucagguucuaacguugaugcuucuuucuguacuccaugccuucuagaugagagaagugggagagggcuuuccugccaagucuuugcaguccggaugcuaguccuggauccaaacuagugagugcuuuuagagguaucuugacuauuuuauggacuccauugggccaaacccaagucuggagcaaaauugaaagagaugguuucagacauuucuguuaagaccagcauuuuucaaugauguucauuuauaagcucuuuaauuugcuaugcugcguucgaggaaggaagagaaggcuuguccccuaucugcugaugcaaaccagcaauuuacagggcggagagggagacagugaguccccagagaggcugugggaagggaaggcgggaagcaccaucucgggacucugccuuuccugcucuucuccccagucugagaccugggagagcccgcacuugcucucuucuguguuugcuuuccuuucuuuuauaauacggccaguuucugcagcucaaaccuguuuugcuuugugcuuauaauuuaaugacuuagacuuugugaagcagaguuucacagucuucagaaugcacaccuggcccauuuaccacaaaaaagauucaccguuuauuuuguaaagcuuaaggucucuuuuaagaauuaggaaaagcagcaugcagccauugagguuaguaggugcgcuucuuccaggccuucagcuaacuugucuccguguucuuucucacucggggacccuugcuaccaagauuuaagcgugcccugucagccaggucuguauuucugagcuguuguuagcagcuccuuuccauagcuuguguucccccccacccuccuugauuucucuugauccgagacagugcauucacuauucucaucaggugcuuguauggcacaaucagcuauaggaccagaguugagauuugggguguuucauaccccccccacaaggccacugggaacuauaagaggagcccguucuccuucugcacucuuucuguuuucuccaugcccuaccugcccuugguauuguucuguuggacuuuuggguauuugggaaagaaauagcaacugggcuucagugacuuagagcgaugguuguuuaccagggaaagcaugcuguucguagguuaugcauaugguggcuuacgugcaagacugacugaaggccaauaugccccucagccagggacagaaugcaaaccacaggccaaacccacaaggucagacccagcuuugugcuucauauggccuuucagcaaccagacuccacaauuuaggauagauggaaaagaucagaaggcgagucauauaucauagccugugaaaacuuuaugaacucggagcuguauuggcugcagucgcauucaugugcugacauauugucugugguggcucgagcgcucccaggcagagcugagucguuccccacagauggaauugacuacgcagucuuaaaauguuuaccggcuugcccugugcugguccuugccauagaggaugacauucuuacugaagcuguaacacaugcagauugcuccucucuuggaaggagccacauuugggacaguagcagcuggcugugggcaugccagaggccugguuuucauuuuagauguugccagugauuucugcaauuuuugaaacacaauacuugccucuaacuagauauauacuuugguguaaauacuguuuauguaguuaaaaacaaaguaucuuuauuuuggccaaauggaauggagacacuuuuuuuuuuuuuuuuuuagauuuauguucuagaacuuuauucaagggagggacuuggugaugaguuuuuggcuuacuuccuugaaugaaauaauuaguauauuuguccaucagaaguuuuagucccuuguaacugcagcaguaaaucagguugaaucuagaaagcagugaaauuucaagcuacuugaacuguuuuguguguguguguguguguguguguguguguguguuuuucuuuuuuuccccucugugaucacacuauaaaggaauaauuuucaaagcuauuaccauugcaguuaccccaccccccacccuaguaguuacucggagucuuagaauaugggcugugugacugcccugaaguugccuugaaaggcugguuuguuaagcaguugcugacagucaguggagcacuguuaaauuauuacccugcucauugggucacaaggauacuuuuuauacucgaaaggcuucauaauuuuaaacuguaacuucaaaugaguuacuguuuauguaaagaaaugcaguuuauaauuuaaaauauaguaacuuuguguucauuugaaucuguuuucauucaggauaacuucucccuccuacaaacauacagauuuuuuuggguuucuuuuuuuuuuuuuuuuuuuuuuuuuuaagauuuauuuauuauauguaaguacacuguagcugucuucagacacuccagaagagggagucagaucuuguuacagaugauugugagccaccaugugguugcugggauuugaacuccggaccuucggaagagcagucgggugcucuuacccacugagccaucucaccagcccuuuuuuggguuucuuaaaggagguacaauuaugugcuaagggaccugugacaaccuuguugguucuguauacgauuucuguacugcuacgacaacuuuagcuuaacaucuagucuguaggcuuagaaauugcagagcaaccagugaggcgucuguaaggaggcagugcgcagcccuugcuccccaugucgggagcagccaacgcugaaaucucuccuuuugcuguucuuuuggauugccacuucucacaaaccugcaagguucugagugacaggacaauccucaccuugcugagacagggagacccuugccuuggcguagccuucccuucugccuuguggauuucugucagugaaggacagcuggauucagagacaucaccagagaugaaaacaaaacagacuaacagaucaccacauuucaaauguuaaugccaccaccuacaguacauguuuuagucccugcgaugauucuuagugaacacaggauaauacauggaccuauugagggcuuguccggagguguuucugucaaaccagggugaguuuaaguaggacaaagguaaagugacaucucauuuguuagauuauguguugauuuuaguacuaucugucuuagugauagauagauaagacauccauuuaucaugcuaacuuaucugugucauuuuugucgcaggguugcagugucagacguugcucaggaaguccuccauuugcucuucgguuuuaagauuucuuccaaaagcaaagcgaaaagaggcuuuucaguagauuucaauagugugguuguaucccaggcagacaggugaaaauuucuuauugcauggaauaaaggggcuuucaaauacuaguucguauguuuugaagaggagggucuggcuguguagcucgccuggcuucauacucguacuccuccugcuucagccucucuagggcuggcuaggguuguagaugcaagccaucauauuugccucagcacagacuguucuuacacucuugucgucccugccucagacacucagauacagggaagagauaucccugccaggucacacccucucagggugggccaccuccgcccuguuuccgguguccccucucuggaacugccaggaagggcugacagaccaacgugcgucuuagauuccucacagcugaaggcucaauucccacuggucucucccggcccucaugaagucuaaucccgauuagcaccuggcauuuacagauaacuuggauugcagagggguuguggaagacaaaacugacucaagacauccaaccuuggccauugcugcacagaugacccuuaaccccacgauuccccggggcccuuuaaacuuccucagccagaagugaaaagaaagcauuuccuuaagucuaacuggguaaugauagcugaccuugggcccauuuucuuggguagaacacuuucucccuccuuaaagaaaugacuauguacuuucugggcuggccgaagcuucccguucgucccaguguccuguccuguucucuaguaaacucugccugaaaauugcuccuucucgguguuguacucuccccauaacugaacagugccgcaugguugacuguucugcaggcuuagcaaugcgugaaagaacugcauggauucagccagucgccagguuccucuugcugcagcaucccugguugguaggagacccagaagcccuccuccuuuccucuagagcccagggcacauguuuggugcugccuuugguuuaguuagcuuggagccaaaguuuauaugaggucuuagggggcuaauuacuuaauauguaauaucuauggcccagaggggauccaguuccuuuagguacuuucccccuuuuaauccacuuagcacuuauauagccuagcugguccuaaucuccuggccuuucucccucugucgccuugggauuucaggcccaugucaccaggugugccuucuaauuuugguauucuagauucaguuucuaacagguuccuggagcauuuagaaacuuuucuucuugcuucuuuagguaugguaaacuccagcagcuauuuuuguuuucaacaauucugcaaauggagaguuuaaaucacgucuuucaaaacccaaaugaucugacuaauucacucucccaggaagccuugcuagaccuugugccaaacggccggcugucugguugguuguuuggguuuuuccaguccuggucaagccagcucugagaccucuugucuccagaggucucggcuccuacuucagcuggcauuuccuggcugccagccugcaguguggcuguggccagaaugcucugcucauccaggcccuacuaauuccugcuggccucuucuagaggacaguucucuuuuucuucuuaguuuaguuuagagaagguuggaauuuuucaaacagugacuuuaccggguaaccaagggcaaaacaaaaccaaacccaaaucuggaaaaucaccaaagcaaagaaaugaccagacccacgccgcagacagggugcucaguguuuucugacucgguguccuuaaagcccccaugcuccuggcaugcgacugguuuccaaaaaccuaugcccaacuuuugucuggccaaucuuuuaucuucuugcuuuucccagcacaauauuuugcagagacaaaugcuuuccaagguaggaguccuugacauucaagauagaaaaagaacagcgaauggcuguuuguagccuagccucucggagacuuguuagcauaacccuacccauuuaauagcuuuccauuuucuucaguaggagauagauuuuguguuuuucuuuaucuacuuuuuaauuuuugugcauauaauuccuuuuccccuuuauuaguuauucgagagcuucaagucuguacauguuuugaucauauuuacauccuguuccaauucuuuccagguauaugcaucccuccucccuucacacccagcuuugcucucuuuaaaaaacccuucagggcccguuugugcugcccagguguguguguguguguggugguggcccaguggagcugggaaacuccuuuguauuguuauaauucuugguuuugaguaggcuuuugugauucuguaguuuauuaaauacugauuugaguaacuaaacuuuauuuuuuucucuagugaggguuuuuguugauagcuaacagcaccaccguucccauuguuugauacucuggauaugacaauauuucgggguuccaauguuuuaucgaaugccuuaaguuuuguugcuuuauguagagagaagauaaaacuaacacaaacaaaaucacaguagacucaguuccuuuguacacugaaauuguaggagucaugauaggacaauaauucauaugcaagguugaagaaauccaaaauccuuuagagugaagagccaggaagacagcuggcgccaggaggcagggaccugaggucccuucauucuguaagcugagcccucaccaugccagcaaaccugauuggcaguguaagagcuuuuccccugaguccuugggaaaacugcuauuauuuuauucgaccaaagagaacagagauaaacaguggucuuguauuuuugaaguuccuaguuauuguaucucucaugagauuuuacugaaauuugauguggcuuuuuuuccuaaugagcuuuugauuuagagguaagguaaugcuaacaauaacuagaauuaaauuuacauuuuaaaauauuccaaauguuucauaugagggagaaaaacagucuaguguugauaugaaguuauuuuuuuuuuuugucuucucagaggaauuagauaauccagugcauuuaaauacuguaaacauuuuuuaaggaacuguauucuguuguuuccuuccuauuuaaaauuuauaaguuaauaaagaugcugcugauaacccuggaauggcuaaaacucaaccuaugaaguaugugcuauuuaaaaauguacucucuuuaguuucuuuacugaaauaguuagauuuaucccauaauuuuaaaauaugaugacauuuauugugcuacaaccauaaguucaaaagaagucacuuuguaggagaagagcucaugaguguguguguucuggagaguguacgugcaugcucgcaugugcucugcuagauacagagaucacccguaggccuuuagaauggaaugccuucuggcuggguugcugucucaaugguauuuguucuugguguuugcauauccacaauugaauguuaucuagugagcagcagccuuaucgauaaugcuugcaggauugcuuugccuuuucuuuuucuuuucuucuucucuuuuccuuuuuuuuuuuuuaucuacucuuuccacaaggaccacacccuacauccagcacucggggaucaaauuuucucuugcuagguaagugguuuaguugagcuaaacccccagcucuccaaaaugacuuuagguaaauuaaagaaagaaguucaaacaggauaaucagaaggaaaguguguacauuuuguaaaagcaaaaugacucuuguguuaugauacuguaacauugcagaagcgcucaccuugauuacugggggauuaaccaugaguuguugacuaaccagguaaaccuuaacaguuauucgucccaacauauuacguauuaaagaaauaucugguuuauuaaaaugguaaaugcguuaguuguguggguagacuuuuuagugcauagguguacaugcucauuugcacaugugugcauacacaugaacauguauguguguguucgugccugaagggccgggguugaagcuggggaucaugcuagaacucucuacuuuauuuauugagaucucucccugaauccugugcucggagauuuuuauuuuauucuauuuuagccagccagcuugcccaggggauuuuccugucuucuuucaaguacugggauuaucaaugguccauacccacucaguuuuuaauauggaugccauguaaccaaauucuggcccuugaguuugggagcuugcauuuuauagagccuagcuacaaguuaacaaaguuauuuauuacuagguguuacauauuugauguuuuuauguucuucaaguacaagcauuucccccuacucggugucagguccuaaauagcuaagcccaccacauuggucagucaauggcuuuucccugacugaggcuuuuguagugcuuaugaugaguggcuuaugaugaugggggugggauccuggcugaagugugcaggaucaaguaagaaguuuauguuuuaaaacgugcucaagauaagaaagagccaucauggauagugcauucccuuuccuguagcuaggcucggauucugaugggccugugugagcagcucaguacuagauugcuugacuagcauguucaaggaccagugucaauccucagcacugauaaugaaaguaaaccaauucaucauagguggaagacaugcauuuuucucaguagucauaaucucccacaugggaaugaagugaagaguccauuugcacuguagggaaaccuggaaaacacucaugugaggaggugacaagaagccgaguggcagagaaaucuucauaugugaaagacaagggcccagacaacuaagaaaaacauugaucagaauccacugaugggguuuuguaauccauuuugaugacauaaguugaaccuuuaauucuguucaaaguagaaauauggauuggucaguuucacuguaggacuuuaucuagguuaugcuaauugaugccauggcauuuuacauugaccauaaugaauguacuguuccagauguucuugcucgaccauggcauuuagcuuguggucuccuguggguggaccugguaguauucucucucccccgucucucccucucacuuuuucucucucccuucuccuccucccucugucuagacacacacucucucuugcgcuaaugcgcgcgcgcgcgcacgcacacacacacacacacacacacacacacacacacacacacauagugucuguuucucucucucucucucucucucucucucucucucucacacacacacacacacacacacacacacacaccacacauucucccuguauuuguaucucucucuuuccaucugucugugucugugucugugucuuugucugucuaugucugucugccugucucugucugucugucugucugucugucucugucugucugucugucucucucucucucacacacacacacacacacacauucucccuguaucuguaucuuucuuuccaucugucugugucucucucugucucucugucucugucugucugucugucugucucucucucucucucucucucucucucucucucacacacacacacacacacacacacacacacacacacacacacaggaaauuaucuggcugcuuccaugaucagcagagauggagaaagguagacauuaucaacuauauggauguucgacagugaacagggucacggugcacaugucucuugguacuucugaugaauugagguguaagucucccgugcugugaaugacaugaauuguuguauuaauuucaccuucauccuguuuaacauuaccacgaguuuaaggaugauauucauuuauuuugacauacaaagagaaauacaggaggaauacagaagagugugcuugcuuucugagaauagccagugaagguucacuguagaacacugauagaacccuaacugugaauuuaaaguacucaugcuguugucuuugaugcugggcuauguaauguauuugaaagcuaagggcuuacaaacugcuuacaaaguaacggaaagauaaacgguguggaaacaguguagggcaauaguuaagaggcuagagcuuuccaaugagcagaugagccauuaaggugucacacaugagcagauuauccccugcacaagcuucuuaaccucucugaacucucacaguucccuaacaguaaugcugcuuccucggcaauagaggaagcgugccuacaaauggaaauugcccgauuugugcuauuacucuuguaccauuguaaggaauauaauucuaguuagcaguuuuucuaagguggaagcuaaauauaguggaauuauucuuacguucacauaauggaauauauacaggaucucaucaggcuuuaacaagcuaagcuauaaaggcagcauuuugggaagaccucaaaggaaauaaaagauaaauuuaacugugcagaugucaucuuuuugaugaugcugauuacuuuaguuucaaaacuuaaauuuuuugccauucuucuuauauaugauuuuuuuccuccuuuuuuuucuuuaagcccagauuuccuuggaauuuaugauaauaaaccugugauucgcuugucuccuccugagucuuguccaggguuugauuaguccaggcacucagaucugcugugugcaccauuauuuccuuggugccugcuuuauucaucuucaguagaaguauaugcacacauuagucaaugucucagacagccacccccuuuaaauacacaaucugaaacuacgaugaucugaauucaucucugcugcugguucucagaaauuccuucacuaggagguuugugugaucagauccauuaaucucuguuucuaaacucccucacagcugucuccaucugacaccagguugcagagucaaaucucuucuguuuauaggauuucagaaaggucagagaguguuggguuuucagggucagggaauuuaaccugaaaucucucuuuauuuauuuuucuuuugguggggagagagaaagaaggggggggggucagggauagaugggagagagggacagacuggcaggcagagacaccccagagccgccuugcccauagauagggcugcagggggccuggagugaggggugcauugcucccaguuccuucacuuggauacuuuguacuccugucccucucaaguucaguggcccuggaacaggagacauucucccaaaggacaaaugauaaugugugccagggcucugcuaugaguaguaggugcugcugggcuucuguggauaggcacugauggaugggugauugggugggggauccuguaagauccagcauggcucccaagaaagaaugcucuguccugauuggcagaucugcugugugacgaaagauuccucaucucagcucauugccgaguccacugccugcgcccugggcuucuccugguuccagguguaucuguguucccucagccaguacucaccguacucuugguugucagccaagcuugccuuuaccuguagcuacuuugggucacaguucaggacccuuugacuuuuaaaauucaauuuaguaauuuuaaguccucuguuagugcauccaugaaacaguuuuugauaugcacuuuaucuguucucuaaaaacugucgcccuagaagcggaagccuucgcagagaaagaauauuuuacuauauucucacuggaguccuucaucugccagugugagaaagcaguguugauuuuucagcuguuuauuuaauuuuuuuuuacugcauccauuuuauucaguagcuuuuaugaauuuuuaauaaauagcgaguagaguuauuucucuguggcgaaaccagcaacagcaccaccaccaccacaccagaacugcuugcuucugucucacuguugcuaaguagccgcugagcaaccccuccuuucccuguccucggccucugggaacuaggauucuaucccccaggucuaagggagcagguuguuuagguccguuagcgugagugaagucacgggcucugucuuucugugcuagcucuuuucaguuaaccuaaugauucccauuuaaucacaguuguuguagaugauucuuuaacucuuuuguagcugaguaguauuuccuuuuugguuuuucgagacaggguuucucuguauagcccugacuguccuggaacucacuuuguagaccaggcugggcucgaacucagaaauccgccugccucugccucccaagugcugggauuaaaggcgugcgccaccacugcccgccgcugaguaguauuuuauuguguggauguaugugugucuucagcuguuuagugacucuggauucauuuugaagaccugugucccgagggcaggucuuucauguguagcauguccuaaaaugcuccaguaagaaaugccaaaacaccaauaaaaucagugaggacugguuaauauacaaacuaugccauuauuuaaaauugugguuuugcuugcagugaaauggguuucuguaacuuaaaauauagucacuagcaaauugaauuugucugggauuccacugugaaguaguauguaaaauauugugauuuuuuuuucaaguugcuaucccuucauguauuuucuuuagaagauccaguacauccauguuaacaggcauggaagacaaugucauauucugcccugcuucagaacgugguucuguaagucuuucccacggugcuuauuuguuuucggggcacguuuuauacucguaauauuuaggugucuguggaaggcuugcuucagacuaccuagguucuacucacuguugaacaaauacaucguuuaguaugaugcccuaacucaaauuauuuuguaauaguauuauugaaaauacacuuuggacccauuuuuacuuguuugcgugugauuuguaaaaggagaaugucucacggagugugggcuuuuccuuucuugugucauguaucaaagugaauagcggaaaguuguguggcuugucaucuuguucccauugaaucaugccagcuuugccaauacugcuacugauuuauuucuggaauucauaaugauuuuuauuuuacucucuacuuagcaaaauaagaggguuuuuuuccuccauuuuuuuaaaaucauuuuacuggaauacacaaucuacuugaguggaggaagcacaacagagaauucuaucagugaauaucaauaauaagaagaaagaauguguguguguguguguguguguguguguguguguguguguguguguugaugauccaguguaaaaauaaugagguuguaaccuaccauuucaggucuccucagagcuuuguucuguuuuguguucauguaagccagggguucucagccuguucauugcagccucuuuugggaccuuucacagguagccuaagaccaccagaaaacauaaguauuuauuaugauucaugaugauagcaaaauuacaauuaaaacauaguaacagacauacuuuuaugggugggggcucaucauaaggaggaacuguguugaagggucacagcauuaggucaguugagaagcacuguuguaaguggacuggggaugcuuuguuucugaaggaggaggcuugaaaaagcagagcaugaaaaacaaaacaaaacuuccuggaacugagcaagaugugucuguggauuagcuagacuagugggccugccaugauguucagaguucagacccacagauggguaggggacacuguaccaaagagcuggaacuguacuuaaacgaagagagacugcugagaucuccugagguggaaggagcuuugcaggcccccucuccugaugacagugcgaagaauugauugacuaggucuggagugguugcugugagguccuuuagaguaugggacaaggggaggcgaugauggugucugacaugggacaggugacaaggagaggcugggccacauuacacggauagaauucuuagacacauugcacaugcccaagagcgaggaacauaggauauaagacaugccuacauuuuauacaugcaugucaguuaaaugcuuaaauuugcuuuaaucuucacaaagcaaaaauggacuaugccugcucuaccacucugacauggagguaacuagagcugucugagaagcuuggugaccauuuuaccugucgagugcgaaaacuagaauucagauaucucaucagccacauaaaagccagauguauugcacaucuguaacuccaccucuggcaagcagggacagguggaucccaugggcuugcuggccaguuggccagccucacugaaacagccaguucuagguucgucaucagacccugucuuaaaaaaugaagaggaagacaacagaggaagacccuugaaccgaugacuuuuggccuccacacacgaaugcacacacaugcacagacagacagacacacacacaguuauuuuucuuauaucagcauuuggccagugauacaguaaggaaaguuguuaucaguccuccaacuaucuaagaacaagacugacaaaggaaguccaguccuggaacauugauuuauugcugguuuaagaccauuuuccugcaaaugcauuucuucacccgguaaacucuucuuuucuuuagguuucauuguuaguauaaauuucucagaacuaacuauucccuaaccuucuaguuuaauacaacuuucuucuuuaaaaauaccucaucucacuauaguuuuaaaaagguauucuuugcucauuuaucacaguuagcaugaaaccuuuguuuuguggcaaaacuuacuguguguugucuuaaccauuccccaaguuacguggagucaggaaccugucuuuugaaguaaauccguggagaauauuucuuuacacugagaguuugucagucauuaguuuauguucuucucaauuuuaguauuucuuuggcuuccuguggcaggcaucucuggaggaguuggcaccuguuucaagguggacaaugguaacucuugaaaauaaaaaugaaacaaguaauauaauuuguaggaccuuagggcagaguggagccuggaguuaauuuaagucugugguuuaggagccagacuugccucaagaaugaaagcuccuuuuccuuaaaauauccaaguguccugcuacucugguacucucuggcuacauaugagguuuucgucuggccauaaaggaaaaaggacuaaauguagccuugagaugcuauuaguucuuaucuuagauucuguauuaguuccucugggaucuagucuaagcaucuguguucaacacagucuuuagguguuccaacugcaugaagguuucaaagucauaucccaaaagaggauggcgcugcuggaguguguggguggagcguucauauuucuucagucauuacuuauuuuccguuggcaagggacucucuagauagguuguuuguguguuucuccaggagucuggaauguuuuccaugcuguucugcuaguuaucaaaacacaguuaccauucacgggauaccacggaggcuugacaugcuuugcacugcucugcugcagucucgaagugcguggcucagucuggcguuucuuucaauaaaagcauaacuuuccuaugcuuaaauucuggauaucaucagaggggguguaugcagucugagcaaguuucaagauacaucucuuacauguugguaaucaguuuacuauuggugaaaacaugggcuacagauauuuuaacagcucacuguauugucugguuguagcuuaaaguccagagaguauuuauauuaccugugguuaaggacuacauacagagugaacaaaugagcuuuccacaucucaguauuaaauacauuuuaaaaaucauacaggaauagcuagugaagaggcaugcuggccggugccaucagguacccugacccuucagauauuaaacugggaacuaagacauuaaagacccaggaccaggaacacagaucagugguggcacacuugccuccuguaugcaaaguccagaguucaauucccagcaucagaaaacuaaaagcaaagcaagaacaaugaaauugaaguugaaagcauguaaaaaaucgucccccuggggcuuuucucaugugguaauuaggagccacagagauguuauauuuuuuauauggcuuuucuaauuauaggaugauacacagucaguucugaucaguagugggaaugugguauagcagaaaugcagaguaauuuuugaauuugagaaacguuuuuacuugaaacacacacacacucccacacuccauaguuuaacugguauagauuauuuuauuuagcacuaaaugaaauuauuguguuucgucuuugagaaaucuuggaauugaggguaugcaaggcccucugggagaggucaccgguucugaggaaauacugggagcuaacagcacuucuuggcuggggagauuagguuggauaaguaucaguuuucuagcuguggacagggugacccuguacuguacaagauguuggcagagcucacaacucucaggauuccuguuagaagcuggccgcaugggauauugcuacgcucuccaacaagagugacugaugucuucauuucugcuccaagauugcuccaccuuaacuguugauugccugaguacugcacagccuggccagugcuugagggugcgggugggggugggguggggguggggggcauucuguucuguguguacauccucuguggauuuauacagauguuagauugcauccauagagccauugugugaacaucuguuuuaaaugugugucaucuuuaugacuaauuaaugcccugcugugcucuuguggagucaucuuaguauuugaacaaccauguggccugccguuuauuucucauguauuguagcaagaaagugauugaguaguucuacacagaagacaggggaaauguggagggaguaggggaaggagggcuagcuagaugaagcccuucacccagcccuuccuccucagcguccuccaucugcaggauuuuccuugccagugagcuucaauggauauauuccaauccuuguaacaacugucuuaguaauaacuuaaaguggugaauuuacauaauccaccaguggcuuguuuauuuuacucuaguuuaaaaugaagaaaagucucugcauacugauugcucagucuggugaaauucaaacuaaugggaaguccagaaaagcguuugguguugaggugaacucaguccccgccaucacacaguguaguaaaacccacagucacauguugcguuuucuugcuaguuugugucugagauucuccugggaaaagaaaauaucaacacaagaaaugcuaucagguuacugucacauucuagcuuucuuaggaucuauguugucauuggaaggaauuguaauuuaaacauuuucuugccacuuucugggcaagucaccuuaaauaauuuggaauuccuucuucucuuccuuccucacauacuuaauuuaauauaucaguuaacuuguugaauuauucaaaacacacccaaaugaguugcuuuucacauucuucauugcuacuccuugguuccaaucaugaucuuuagccuagaguguuguaacucaccccccgaccccaacacucccuccugccccagccagcagugccugaauuuauuuuguuucuuucagagaagccaggcaguccugauaaacaguagucauaaugauugagaaagcuccauuauaucgcacuaagcauuuucuuuggccucaaaucugggauccugucacaucaaacauauuuuauucagggcagcauauuugauauaaaguagaauguuuagaaauuagauuuaaugaguaauaggugaauguugcuugcuauuagcaaauccuaaucuuggcuuuguauuuuaucccuguccucaaccuucugaaagcaucugaggucaagauuaaaaucugcagugaucugugaggcccucuguaguuuacaagcaguucugagguuugcgugugccacaucuugucuugcuugauaucuucugcccauggaucugccugccuuguccuuucccaaggcagauuccaugacauacuuugaauugauuguugcuucuuacuagagagcuuccagcauauuaucugcaugguucacagccucugcauuagacucuccucucaccgugcuaugugugugacucagaauugcagcauuacagaggccacgacucccaguguuuccuguccaggcgccucagcagaaaguaucagaaguauuguccuucguauuugccccauggcaacaaagauugauuucuuuuaucuuuuauucccucuggacuacugaggcuuuaggacacugucuggcacaugguccuaacaugcagugaagaggcugaggauauucuggcaucuauagaauguuuauuccucacuuggaaacuguacaggacagcaucuuccccugucugggccugguacuucucagagcugugcauggucuuuuucaucuuggcuuccagauaccuuuucucucagugagugcauuuaaccacuucuucuuauuuucgaaugcagaagaugggaaucucuugccucuauuucuuauuauuuaaaucuuacccuuccuucaggaaccaccuacaguuuauuucuucuguggaauaaucccuauuacucuuguucuuccuccuccuccuaugucuuguugcacguuauuguggauuuuugcuggcauaccuagguuaacuaguuuauaaugugauccccauuucaacuuuuaucaguaucuccugaugcagagaaauucauuccucagcaguccauuauacacuguaagugaggagaaauguuuaaucuauguuuaaaugagaccuuggguaauucugacccauguucaugucugagaaccaguggucaaggacagaguaugaauggaacagacgggugauaccugagauuugggcaccaguugguaaauuauuacuacuagcacugaauugucaggguucaguaaucccuaggaauagaaaaucaaaaguggaaaugggggcgcagagcuucaguguuccaagaaugaauaauaugguuauuucucugaguguaucauuaacugcacaauguccuguaggacagagaaccgucaaugagaugaaaauaggucaguguuuacgucugugguuucaaaagacuuuggucuuuugagcacauuuuggauaauagaugguuagcuuucucgcuuccugugggcuucacuguuggucgauuugagacugguaagccauacaaaggcuaaauguggcacacauggcuucuugggauggcugagaaccuuaggguccagcuucaugacuggaauaugacaaagggacuggugacuuggugggaggcaguaaaaggaccaaccucauagaaaaacuuagaauugucaggcacagacacuaagcaagggugcugugcuuuucaggauaagguuaaguggucucgaguguagggguugcuucugagggacaaguuaaauauuuaucacuaaggucaacaaagugucuucugggagguguacaucaaauuacuccaaguguuuuacuuggagacaggccauacauucucuuaucucuuugguaccugaagaaugaauugaaauaaaguacuuugguuaccuacuguuugugagcagccauuacuauacauguguauuuacuguauggugcuaaacgcuuugauuucccuacuguaaguugagaugggcacuuccuauaccauauuagucccuccucauggacucaggagagguauggcauccuuucccuuccaagauacauauaauuuugcuccuuuugcuucgcacacucauuauaagccugaccaaaagcagccagucacagucaugccacagauugaaugcuaggcugucaugaaauuuacccugucaaauaaauaaguuaauuacuuuagaguucagcuucauuccuguuuccaggagacugggagaauguggucagaauuaaccugaggcuccuccagcccagcaucaggagucauuguugcugcuugaaaccucauaaacagucuuuacggcccauguuucugccagcaucccuugcuuacagcacucauggguuucugugucugcuggaaauccuuccagaaagcagguccuaagggcugugaacuacagggucagguuucucacacucugagaacccuggaccucucucuucugaacuuacugauucucucauugcuguaacagcauuccugauacaggcaacuugggggaggacugacuuaugcuagcugugcugccagaggacuucaguccauaauggcagagaagaaauagcagcaggagcuacuccaucugcgguggagagcaggacaccaugacuguugacaguaggaggcugaccaagaagcagagaauggcucagaaucagggcccaaccguaaugcucacaaggucacuuucuaaguuuggcuuuucccagacugaccuaaccacuuaaagucccccaaauccagaccaacagguaaaaaacagcugcuaugugccuuugggggacagugcagauucagaucauaauagaauugaacuuggaauuuguuguauagauauagccuucuuguagaacuauacguacaucacagucaacuguaucuucuucagugcucuuaaggauagcaguguuuuaaaauagcuuaacuaaguccacaacauaaugguuaaauaaguuauaguucauguaaaccaaauuauacuguuguuccauuuggaaacagcucaaauauaugcaaaaccuauaaauggaaaaccuggauuagcauguaaaaugugcuuauguauaauaauauaugaaauacccacuuguguggcauuaagguuucuuuagaagcaagcagcagaaccaguuuucuuuaaaucucuugagugggaaccacucugaugucugaaaauauauuuuaaauucauuauuuaauccaaaagcuaaauuauaaagaaggaaauaucgaccaucucuaucuaucuaucuaucuaucuaucuaucuaaucuauuuaucuaucuauaaaacguuauuuuagaaaauuuugugcauaaguguuuugccugaauggaugucugggcaucaguugugagccugauauccacagaggcuggaagagggugucggaucugcugaaacuggaguuacaacagguuaugagccccacugugugaguguugggaaucaaagcugagugcuggaagaauagacagugcgcuuaaucacugaaccauugcuccaguccuauguauauauuuuaaaaauauuugacuuggcacaauggagcuagacuuuuacuaucauacuuucugaaacuucccccagaacuguuaacuuuucagcaagaugcaagugugacaguugguaguagagcauacagaugauuuuuuguaacgacuguagucauuccacagaggcccagucuggaaagguggcauuguaagucauuugaggguuaccuuuauagccucagauuaucgugcaauauccuaggcccuauuuuuaguaaucucuuacauggcaacuucuuaugaauaacaugaaaggaaccagcaggaagguguuuuaaagauucucacuuccuugaguaggugcuguaaaaaccuuaaagacagaauggggcugggcugcugcugcuuaaucgaauccauucuacuguacacaagaggcagacagagugggcaaggucaccuuuucuauuucuuacauuaugcugugaaucaagccaggcccugagcaugcuaaggaagcacuccaagaaucaagaaucaacacugcaagauugaaaauaauucuguaguguucucuuagaaaugcgggauagaggaaacaacuguucccuuguaacugaagaugauaagugaaguuuguuuucauuaaguuuccacagcacauguuucugggucuucuuuaaucagaccauucucuuagagcauggucucuuaaucccagcacagcugcauguggccccugcugcagggcagcucuuacacgugugugagcucgugggaauguauguuaucuucaucuguggguauuuuuuuuuuuuuugguccugguuccuaaauggugaccccuguguaugaacauaggggauauuuuuacugccuguguaaacuauggaauagacagcaacaucucaaauguguuucaacaagcuccauaaugcgcuugcagauuucagaaaggcaguucccagucucugauaaagcauuuggccagcagauguguuggguguacuccacucugaaccgagaaaguucucacugacacagcuuucuauuuuuuaacuguucaugucucugaagcccuggaguucauuaauguauacucuuucuuucgggcgggugguuggcagcauuuugugucuuugauauuagaauuaugacaaguguucauguuuugugauguguggagguaucaaauaugcuguuauaaauucugggaaguugcacugcuuuuguuggaucuaagggauagacugcacauuaauuuucucauguagcucguuuauuuuggauacaucuuauuguuuuuacuguuaacacaucauccucaauuaauuacucuuucucucaugaccaacucucuaaaguuaugcagaaaaaccuagguauuuuuccccucuuaaaugaaaugaguuagugcaaaaggugguugaguccuuucuuauuuuucuuuuuccuuuuuaucagaguagaaaaacaucucaguccaucaacugugauuacaugguaugauuuccagaucucuugccacccuggucaaacugcacacagucaacccuuccugacauagcucacgaguguccuguaauuucacaccugggaaggugcuggcacaugccaccugccugguaaagauggcuguuuuuugagccuaugucagccuugugaguuuuguuuuuuaaugcagaauuuauauuuauuauuaaauaccauguaggagaugaucauagugaaugcuuuucccuaucuguuuuguugauguauuucaaauuuaacuuugguuuugcuugcuuguauugcgaguccuuuagcuugcucguucuuugguguuugaacuucguuuucacauucuaaacucaagaaaaaacuucuuggaucuccauguauaguuuauggcugccauccaggcuuguguaauuuuuauuucuauguuucugggaagggauuacucugaaugugggggaguggauccucuucauagucucauuuuucuuccugucacuuaugacauugaccuugggggcuuuucacauucaagucugaguaagugaaguuacucgcacaaguguggcucuguggagaggugcgagcguguuggaugugaguggggcagucuuacaaaguguuucugaauggggugcauuuuguacagauuagauaaguuacguggcccgagucuuauuaaucuuaagcauguaacuauugcuacaacaaggacgugaacuuaucuaaacuaguaauuguguuauggccaacuaaucucauuuuauuuucuguguucacucauuguuuucaucaacauaaagcauguagccaacaauauauuaaaaaauacagcuuauaguaggauagaguuuuaucauuucagucuuuaucuaauaaucacuuuuacuauaaaauuuacuaauuuuguuuuuauuuccaauauaaguaauguaacugcauacuuggaaaaugucuuuaagcaccuauaacucugugagaguuacuuugucuuccaaucacuaugugacuaccuacaaaauaacaugcaagacaaauggguauauauaaauauacauuaucagaaaauaguauggaagggaaacagagugaaucuaauacacauuuuuaaguuuuaauucuaguucauguucaauuuuauuugaagugagugugcagaaguguguugcuuggcaguguuugggaagaaccaucguaauggccuuagugauguuuagcguuucuuaaagguauggucaguuugccucaaucugguuccagaagaguuugccuagaacauagugccuucauguagaacagaugaucaucuagccuuccugccaguagcucaccaccccacagugugcacacugcuguggugaucaguguaucccaguuuguccauggauuguuuucuacucuaacuacaagcaggaugugggaaggggaaugugugaacagccagcccauauucccacuacacgcacagcucccgauguccuguuugucuuaccucaugcaguuuaguguggaagugcagaugaaaacguuccccugucucccauuguucucgcugaaaugacgaugggaauugcuccugaggcacauuuaccuugaguuccuuccaaccauuucacaaaaucaaauguucuccccucgccaccuacagugcaguuaggcuguuguuuguagcucgguacuuagucacaaaauggugcuauaagaucugggaaaacacauuuuuaagauuuauuggccauuucuauguauguguucuugugaguauaugcccuugcgcaagugcuccuggggccagaagaggguaucauaucacuuggagcuggaguuguauccuuuuaaccacugagucaucucuccagccccagccaccagaaaaacuuauuuuuauguaauuuguaucccaaauuuaguuuuaaauugacugguaucuagcuacaggaucuuaggcaagucuuauuuucucuuuagaccaucaauuuuuuccucuuuauaagaaguggguuuacucuucuguugcugagguaauuuacauuaauaggaaaugacuguuaguggaagacuucagcaugcccgcccucugcaugaauucugcuucucgcaucugucuacagucuucucugucuguccaccuugcauucugagucuugaaaugaugaacagucauaacauguaacgaaccgguuggccuuguugaggcaucagguuccuuccuacacccaguugucagggaugcacccagaggacugaggguucagcccaacuuacagagacagacggauaacuuggccuggauccucagaguguuacaaagcaagggcagccuuggagacuccggagagccaugcagggcucaccuagucuucccugguauagucaaacaagauggguucaguuuccaagcagccaguaugcaugagauguugguaacauggaaagcucauuagugaccuaguaccccaaugaggacuucugacauacucaagcuccuucccaccauuccaaaaccuggcagaaaaucagguuguugagcuuuacaaccuaaucuucaggcagcaggcaaagggggcuguaggggacuggggagagacagacagagccacagagagacggaggcagauagugggccuggaguagguuuuuaaaacuucaaagcccaccccaguaacaucuccucuagcaagguaccacuccuaauccauuuagacaguccaggcccuaaugacuaagcauucaaguauaugauccugugguggccaauccuauucaaauaaccauacucagaucuucauaacauacauuaauugauggcuuuauuuuauuuggaacauguaugcaaccaaaaauuuuguaaggugauacuucauuuguaacagaaaucuaaaaauacauuauuuaucuucaugggaauguuuuuccuuuugguuugaauaaugaaugcuuagcuuaccuacauuacuuauacuuacuauaguaaaauauuuucagaauuugauaggaaaaauuacccuaguuuuuaaacugauuucugugauccaguaauccuaugacuaaagguuauuuaugacuaaggggccaugcaggaccuucuuagccucuuguuucccuaggccauggagaauuaagugggauagcuuggugcuuacaguguugaguuauuagcucagcugccuuacucccugacuccuaauucugggaacaggaaugccccacuccuuagugcgugcuggggaggaugcaauuuuuaugaauuuuccagcaugcuuuugccugauaaauauugucccaucugucuacagcagcuuuuauggguauuuguaaacagauccugaguccaccugccucugggaagaagagaaccuauauuaaacuccagagccauuauaaaaggcaacuaaaagcuauguauuuacugauaguguuauuaguaucucugacuuuugauccaauuucuguuuacaaaaccaagaauacauaaagaauauaaaugcaaugucuuuuaagacuuuuaguauaagaccuuuuguguagguggaaaauuggacuuuuuaaauagucucuuuucaauuuguucagcuuauuuuuagagacuaagaauuaauuagucuuguagucagguccuccuuugugagugucgauguggagugaguagaacuuacuaaggaaauaacaugauuauaugccucaaaucugggacgguuuguagggaacagugcagauggcugauggagugauaucuacagaagucauaacccauagagauaaaguaggcauuuugugaaagcucaucuccuauaauugaaguacucgauucaggaccuguuuuccuugagccacuaauaaacuuucuucuaccaguaaaauaauuucucacuacaugaguuagucauugccguguaauacagcccauuguacaugccuguuuuucaguagcucuuuguguaacuaaucagaggcuuucccaugugauaaugaaguguuuaaucaccauaauguuauggagaaacagcauuuaauguuuggcuaaaccuucuuucuuuaucuuuucagauaaauuauuagucauaacugucgcaacaaaagaaaaugauggauuccacagauuuaugaauucagccaaguauuucaauuacacugugaagguaugauaugucuuucagucuuuggacuuguuggaauaugugccuaaaauauauuaacuagugguuuauuuaaacauguucuauaagcaacagaaauguguauauauguaacuuuccugacuuccuuuggagggucauguccacauacauuguaaucaagguuugacgguaacuauuuucacugacuaaagggauggccugcuguggugucaguugaaaacaugaugggacggggcuuugggggugcgcuauugacaguguuuuuccuguuuuguuugguuuggguucauugguuggaacauuggcaaguguuuuagauguuuugucuacauggcacgguucauggauaugaucagaggugacuuggagccccugauagagucuuaaacugccuuaugugauaugugcuccuuggaucugauuauuauuauuauuuuuuugauagaaagcauaugacaggcauaucuuuucuagaaagaggagcauagggaaguaucugagagacugaaaaaaaauuaaaaacaaaaagaaggaaaacauugcuccuaccuugggaaaaacugggcuguuuuagccuauaauauagagaacaguagccucuagaugacaagguguggauuuucaugcagaguauuaauguugcugaacuuuguuggaaagagaucuagugauaacauguacgugcuuaaagaggauaagugagaaaguaaaugagaaauaucauuagcuugccuugauggaaaacaguauauacaugcaaacaaauaagguaugauuugccuggaauucagagaaagagccaauaauggaggguucgaugugaagagagaauagguagucucucauguucaaguauuaggaaaauuguaugugguaugcaguugaucaguugcaugaccaaagugagauaaacauguuuaugaacaaaauuuauuuuauuuuugaggaaaacuugucccagaguacauagcucuaaccugucauaccugagacuccagucccauuugaauaguagagauuugggcccugucuucaucguccuguucuguaguccagaaguuucuaaaacauauuuuauaccaaggagaucuucauuacuugaaggaguuagacaggaaaauucucccacacaugucagaucagugagucacagaguggaccuaggagucuugcuuucaccauuuguccaugugacuggugugccucaaagccugccuccucccugugcauggcugggaugggccucagauguuguuggcucagugggcucaguauuggagacuccacaggaucgugggaggaaucucagcuggagcacugaucauucagcagauugaauccauuuccacgcuaacuucaguuuguuuggaugucuuuaccccagacaucccuguaagcaguaaaacgucugagguuggguucacugaguuuauuuucauugcauuucauuuaaauuccauuccucuuucguucguucucccgaucuacuuguaugucaggagguggggcacguguugguuacaucucuuucucuccuucaaagccaggggucaguuaccacuuacaguucagggugaaguggcugaggcugaggcagauguuggaaagucagggccugcuuagcccagacuagcuaaacuucaucccuugccuuggguaauucuuauuuaacuuuugaggcuaauacaaauguaagauuugccaaagaaaugaggguucuuuacacuggaugcuuucaguguguccuuaggugauaggccaggcuaggagccuuugagcagaggaauuuccuuguagauuuccuaucacauuagacaggugaacuacagggguuucuucauuuucauuuaagucugaaaacaagaaugagaugagaaauacuuccugaguccacuucuauagguuaaaaucaaccuuugaaauauucggaauguguuuuagugguagaucucacuguagaauuaugacccucccgugcguuaauuuccauuccuuccuagcauugugauuuaauuauaaauaaguaguggcuuucaaggacuggggcacaucuucuguugacauuuuuaugcugcuaucgccauuggcauuuuccucaggaugagcucuugauuucauuucuagguucuuggucaaggucaggaguggagaggcggugauggaaugaacaguaucggagggggccagaaggugagauuacugaaagaagcuauggagcacuacgccagucaggaagaucuggucaucuuguuuaccgagugguaaggaaaauguccugugggcuucccagucuguauuauaguaccuuuaaagacugaauuuuauaauugaagcuuaaauguugaaauauuuuacuaacaaugacucauuguauaaaguguauuuuccucacauauaacugaaguuuuuccagugagcaguuccugcuucugagccccaacuuaaaagcaagauuguuuuauacuaauuuuuuucauuagcaggaauuuuucuucuauguaaaauaaagugucuaugcgagaaaagucacaaucugcaccgaucuuguaauauuaaagaugaugaguuauaagcacuaaugcgaaaacaaggaauagucuaacauuuuugggaaauucauuuuaaucuuggauuaaaagcacaguagaggucaugcuugagugugcaauugagggagacaacaaaaugagcucuguucaaacaucaaaaaugcuucauaaaguugcaaauauaaggcagacauaugaggccccgcgcugucaagaacaaagagccuuuugguucauaaauuucuuugcguuuauuuacuuuugugcuuggcuaaaauccaaagggauacauacccaaagcauauauuauaccauagcgccaucucccuagcccacagaugccauuuugcauacugccuuauucucuugaaauauuuaacaucuucucaaagcuuacauauuuuaaaaacaccauguugccccauauacugccuuguaucuuuuucauuuucauaaugcuguuacugaucuuucauuuuuaaaucuuguugaauuucucucauugguguagugaagucauauuaaauccuuuucuuuucaauuucuaagugcaaaaccacacuauuugcagaugaaacuagagaugaucauucuuaggcaggaguauaugugaggauggccugaacucugacguaaaaucagaaacagugaugccuccgcccugccaacacucagcacuuuggugcuuccagguuucugagauccuccaagcaccagcuuuauuuucuuguaugcaccuuuucuugcaagaugaacugugauauggcagguaggguauagcuuaugaacugugaaguuuuguacauugucuaauauauccaugccauauauaauauacaucaucuaacgucuagauuaaaugcuaaauaugauuucaaauguucacaucccugaguuugaaccuggcaugagcaaauguggauuuugauugugaggcagauagucugcgaacaagcaucugugaagaaccuaguaaugaccucuaugguccccagccuuugcuuugcucugcgcuucccuucccagccucuguucuccccuacucauacucuucauccuggggaguuggcaguuugaggaucccaguuguuucugacagacagaagagggcauuauaagacacccauacccgagacaagucagccugauucauuuggauuguauuuaagacucagcuugcagaaagaauaggguuugaaaaauguccgauggcucuagguauugucagggucagcuaugugucaguggaucagauagauuuuuuugagaacaaaguuuuaaaagcaaaucuacccuuuuaucaaagaaagcaggcuuauuuggugaagccuccucccuggcaguaguggcagcuuacaugugcagacacaaaggaucucaccauuagugauggacagugcuucacguauauauaauagcagccacugcucucucucucucucucucucucucucucucucucucucucuccucucuccucucucucccccuaucuccucuccucuccucuucucucucucucucucucugcuuucuuucucucucucucucucucucuccucucuccucucucucccccuaucuccucuccucuccucuucucucucucucucucucucucucucucucucucuccucucucucccccuaucuccucuccucuccucuucucucucucucucucucucucucucucucucucucucucucacacacacacacacacacacacauacacacacagaaacaugcaugcauccuugcauguguauucccaagccaaauugucuacuugaaauuuuuuguucuuuagugaacaaguauuagauaucucuauauucaaaauaagauaguaguuauggguacugacagcugacugggacagaccuucugcuucugaauauuuuuucucuuuuauauauguuuuauauauguuguaacugacacaagggaucuggaagguuacuuauuucuuuauugagugaauacauucucauuuuuacagauuaucauaugccaacuuuuccaguucuuauauucagaggaaaccccuauuauuuuaaaaaagagauggggacucucaucgaauucauuguaucauuuuaaaauuuaagggacugauggagaaacaaggagagauccuggucuggcacuuagcugggcugaggagcaugcggcuuugagauuugccacauucuccucuggcugccaucugugcacuguggcuccugcucuugggccccucugaaaaccaucugggugcagugaccuucuagaaagaggucuucacugauucugacucuguucagcaucaguaauaauuucauacccugcacguguaacuucauuuggggacauauucaucaaguaaugcucggcuuuuaagauagaaccaacuuuagcccaccaacuccccuuuccucuaucgcauauugcuaauauuuauuugauuguuuucaauaugguauguacuuuauucugaaaauucacuugagugggcauuuucaguuagauaaaaugguguguguguguguguguguguguguguguguguguguguguguuauguaugugucccguauauuugugugucugugucaucaguguauguugcagguauuaaaggcuccauacuguggcaucaugguuuuaucucuggaaauaccaaaacuuauuugagggaaggcuuaagauacauaguuuucagggaugggcuguuucaauuucauuagacuuuauuuuaaccugugcauuaugguuucaaauuauaauuuguguuuaacugugugcauauaaugaucaguaaaaucuuggauuagggaagaguaagagaguucggggagacuucuguggcuuuuuuccuuggcaacccaguagcuuuuaccucuuggguagauauaguugaauucauuuauugguugauucacucauuuguucaaccaacaauuacugaaugucuucaaaauacuaagcuaaggacuaacaaagaaguuaaagacgugagcccagcuuguaagguagaagaugcagccuggaauaagagggguuuugauuagaugcauaaaauagaauggauaucuggguggguacagagaauugaaggcuagugagagguaaguggaaggaaaugcuauuuuccugcugugccuugucuaguggaguugacacuggaaauaagccuugaaagcaaaucaauggguggggcccagguuaaguagauucauauuagcuucugaauaggauagugaaucaagguuauuguugugagccugaucuauuuagauuuuaaucuacagggcagguaucuauaaaugggucuugugugaccaagcauuguucuguaacugagaacucuccauuuacuuaugaagacauaugugacugcuuuuguaccagccuggcagaauuacguuguuugacagaaacuguguggccuuagaguccagacugucuucugguggccaguguaaauauuuggugacuuauuuuaagccauagcuagaaacuacugguagacucugaugugugguaccuucaggagagucucagacuccugagccaggaaugccuguguggcaggguggcagauugcugggaaggugcauauggagccuguggggguguaaaucaauauggaccaucaucuucucggagagaaacugaggaguggguguaagguggaaucaguaaaacacugcaaaagaguuucaauggaaguugucauggaaaccaaugaguccaggaugaaugacgaauuuuucauccaaucugggucacugugguagaaguuaccacaaacauaacacagaaggacaaacacucauaaaagucucaaugaccuguuagagacauaacuaugacaugucugggcucacucauggguuuugcaggacuugugaauauuuaccauucucaaauguggaaaaguuuuauuuuauuucucguauuuuaauggacugaguuccugcgagaauuauuuuuaugaucucugugcauucgucuuuugaaaaaaaauauuuuuauuggacaauuuugaggcucaaauaauuuuaaguagaaaaacuuucuuccguuugagaaguuuuaaauaggcagagagaccucucccacccaaggaccucaaacagaacugacaccugcuagaaggaaaugggaaaaaaauaccaucaacuuuaccuuuuuuagcugagugugguggcgccugccuguagugccagcccucgggaggugaaugcggaaaugucagggcaagccuggccuucaaaccaugucccuggcuugccugaguuacgugagacccuuucucagaagaggaaauauuuuacauuuuuuagucaaaauaauauucuuacuugaauuaugugaaaauaauuuccuucucaucuaccuuaagagaauugcauuuuaaaaauaaugugcaugaaaugcuaaauuagcaaauuaaacaucauuaucuucuucuuuuauaagcuauugacuuuauuaauaaccuaaaauacaguuuuaucuuuguccuucacuagaguuccaaagaggaaaacauucacuuuccauauggcaucuacaacuuuuuuggccaaucuggggauuaaauccagguuuccuucaccugaggacaaggcuguacguggaguuucacacccaccacccagcuccugcccuccuuuguaacauuugaguauguggugcuacuuaaauauuuucuauaaacuauaucugucugucugccugccugcuugccugccuuuucauccauccgucuguccaucuauccaucuauccauccauucauccguccauccacccagugauuauaaaucauggcucuuucauccaccaaggagcauuuuuaacuauuuucagaaacugucuuggccuuuugaggcucucucuccuccugacuucacagaguuugagcuucugcucucaucuuuagucuuauccucucucucucucucucucuuucuccuucccucccucucucucucucucucucucucucucucucucucucacacacacacacacacacacacacacacacacacacacacauacacaugcacgcaaaagcacuugcauugugggcacauacaaacaaaauuaacaacuaguauuuuggaguaaagcaacuaugguaaaaauaggauugacaaggucaguuauacagaaaaguuuuauaagucagauuagcuugcuuauuuaauuuuaaaaacacaucaaaaaaguuacuuuugagauuucagaguacguuuacugagauauaaaacuugcuuuaaaauagacauauaucuuuaaaguuuauuuaaaacccauacacauaacauguauaugugcaugccuuuucccguguccugcuuuguaagcagccccuccuccaguuaauaaccagcagccaccgugcuugcuaauguauguaguaacacacuuacaguguguuagcaacuguuaaccaacaauugcuauuuacugucacuuucccucuguuuuauaaaugagaaaguaagcuagguuaaauaacuuguuaauaacugauagccggcagcaaagcuggagucagacuguagcugguacacuacacacugugauagacugugauuauacuguuaguagugccaagagcauuuuccuuauugauuccagaaagaaaaaucacauauuauaauauguaccuaucuaucugcaaucuuucucugacagucucccuaucuggauauucauaaacagaaauuuaauuuugaagugcaauauuucauaauagaaauauaaaucacugauuaauuuuucuagaacagcaucaagugaaaagaaauuaacuuauuuaaacaguagcuuuagauauuacuucaaaaaaccugggggaugguguguugagugguggauuguaugaguaauuccagcgcccauagguugagcuaggagaauuucaaguguaauggcagucugggcuauguagugagaaucuuaucucagaauaaauuaggaaauaccaaauuuguuuagccgaguuacagaauuuaguuauauaauucuucauucaguuuuuagccacguauuccauuuucuaaagauguaagcacuuguucccuaugcaaaggaaggagcagagagacaaugcgggcagcuucauuuuuaaaggaugagguguggcgguuaauguguccugcuucuucauacugugcuggacagaguuacucacaugacauaucuuacuuccuuuccuaguacuuucuaagaaggauggccugugcuccacuuacacacgagugaggccaccauuauaggauucgcauguagaagaggggcagguauuaucuuugccaagagcauaauggaaaacauacacuuaugguauuuuugcuaaguucuuuaacucaguaaaguauacauuacuaacucuuacaugugcauauccagucccucauagauacagcuaaagaacaccgauggagcagcccugugcugggccaugugacucacagucagccugcauguuagccauuaggaaacccuuugcagaacucaagagcuuguccuucguauuugccgccuaccauaagcauuagcuuagagccggacagacauugucuuucagcugcacugauguaaaaacaaguacugcuagauuuaaaguuguaauaagcuagaacuuucugcagagauguuacauuucuaacagagguuauuacaauucauuuucuguuaaguuaugauccuaugaguuaguucugaaaaauaaaguccgggaaggauggugggaucaggaaaacugagacuuaaauuauaugguuaauuucaccuuguuuugaauuuauggaucugacuaagaauaagaauguaauuaagauuccauauuauagaguauaucaacuauuaaguguauacugauagcagcgugagauauguuagucaaaaccaguuuaucagggauaauaaugaauuggucacugaaacuuccugucuaugaaugucacuaaaauauuugacugucaagagagaagccuuaucaaguauuuaugcuggugucauucauuuaaauuaacuguaacauuugcccauuggcuuauaauuuuuauuuggagauaaguuacuauauauuaucaugaaaaauaucucauauuuuuauuucguuugucaaauguaguuccugugaugugaguugggaagagguugccugcuguguucucuaaaccuguuuuaauccuguauggauucuuuuuuuuuuuuagagauuuuuuucuuacucaaauugugcuuaaauucugaaacaugcauuuugagacuuguuuguuucuucuaaaaacaguuuugauguuguauuugcuggugggccugaagaaguucuuaaaaaguuccaaaagacaaaucauaaaaucgucuuugcagcggacgggcugcuguggccagauaagcggcuggcagacaaguacccuguugugcacauugggaaacgcuaccugaauucuggagguaugaacagugcugcuauagacggaagucucaaccccauaagcaugaucuugcuaggaaauauucugaaagcucacucacagguuagcgcuugaaaaccauuucccuuggacuaccuguguaucuaggcaguguggauauucaacuuaccacauuauaagugagaauuaagucuucucauuacaguucauugagguguuuuuggcauaggauauuaaguuuuaauaaguuuacuuugaaaaaguuucauguuuaaucuguaauuguguuauuaaaaauagucacuuguuaaucuggucuguuuuuaaauauauugugcuuaauuacuuacugugacuauuuuuagucaaaacguuaaauagugucugaguguacagaaguguuguauuccccacaugaaccaccacagauuaaaagugaucacauacacuuuuuuuuuguauuuuuuuuauuagguauuuuccucguuuacauuuucaaugcuaucccaaaggucccccauacccacccccccaauccccuacccacccacugccccuuuuuggcccugguguuccccuguacuggggcauauaaaguuugcaaguccaaugggccucucuuugcagugaugaccgacuaggccaucuuuugauacauaugcagcuaaagacaagagcuccgggauacugguuaguucauauuguuguuccaccuauaggguugcaguucccuuuagcuccuuggguaauuucucuagcuccuccauaaggggccgugugacccauccaauagcugacugugaucauccacuucuguguuugcuaggccccggcauagucucacaagagagaguuauaucuugguccuuucagcaaaaucuugcuaguguaugcaauggugucagcauuuggaagcugauuaugggauggaucccugcauauggcagucacuagaugguccauccuuucgucaccgcuccaaauuuugucucuguaacuccuucuauggguguuuuguucccauuucuaagaaaggguagaguguccacacuuuggucuucguucuucuugaauuucaugcguuuggcaaguuguaucuuauaucuuggguauccuaaguuucugggcuaauauccacuuaucagugaguacauauugugcgaguuccuuugugauuggguuacuucacucaggaugauacccuccagguccauccauuugccuaggaauuucauaaauucauuuuuuuuaauagcugaguaguauuccauuguguaaauguaccacauuuucuguauccauuccucuguugaggggcaucuggguucuuuccagcuucuggcuauuauaaauaaggcugcuaugaacauaguggagcauguguucuucuuaccgguugggacaucuucuggauauaugcccaggagagguauugcgggauccuccgguaguacuauguccaauuuucugaggaaccgccagacugauuuccagagugguuguacaagcuugcaaucccaccaacaauggaggaguguuccccuuucuccacauccucgccagcaucugcugagaaaaauugaccuuggagacauuauagacuauguuccccuugagcugagauuaauggaaacacacagacagaaggcaugaccuccuagauggaggaccugcauucugugagagcuuuggauuagguuguauuuuguauucaauuauuuuuuccugaaaauggcauguauccugugguacacauucaucuagacagcaaaaaagccacugauggaaauguuagaggaccucaaggugcuguggagaugacagauauuagcauaucaaugcugguggcagugaucuaauacagggaagcccucgaagauaggggaggaagcgucuaccugcagccagaauuguuagcgagaaggcggggaccaugagagugugcagucaaugugugcuuucagaaacagucugugagagguauucaaaggacaugaguuaugaccuagugagaguggaucauuuagcuuuaaaacacgccaguagaaaaaaauauaucaagcauguauaugaauguaauucuauuucacuuauuuaaggauaguugaccuuagaagaaggauaagaaaauaauuuuuuauaagacaauauuauaaguugcuaaaaaucuuauguuacuaauuuuuaauuuuagaacaugacucauaguaauuaaacauacauuguuaggcuggagacguucucugugugaacggucucacuguuuccccagcucagagcaccaacaucagaucagcuagcucacacauccguaacuccaguucagggggaucugacaccgucuucuggccagugugagcaccugcacacacugcacacacugcacacauacaaacaggcagaggagcaaacauaaaauaagucuuuuauaaacuguugucucuguguggugauucuugccugucagugcagcagagcagccaacugcaugucugaaccucaaaggaagacuuagaaaaggaucuuguugucucuggucuuuaugauacaugccauuggcagauuccgugcauaggcucgaaggccaaggggaacacuccaauuuuagaauucccuucuccagacaaugacauauaaaagcuagccagaaaagcaaucuagcagacacaguaagacugguucaaguaauggaaaaaauuccccgcauucccuagauagaaaauuuccucaugauguuguaguuagugacagccuacauucuuugccuacacuggaauccuggcacagcaggagacguucccuucauucagaagcaguggcuccuuuucuuuucagugggugcaggcagagcuauucccaagguccuggggagugacaucuuaccccgcuccuuccuuaguaaccuuugaagguuaguuccuaugugccacuuaacuucaggaaugaagugcauucaaagcaucuuugguuaucuugcauuguaugauaguugguaucaucucuccguuaaagcauaccuacugauacguuagaccucaugacuucccagcauugucagcugcccaacggcgcuaacauugacauguggaugugcauuuagauccuagaaucccgagcucucugcuguguuuuugugcauugcaggcuuuauuggcuaugccccguacaucagccgucugguccagcaguggaaucugcaggauaaugaugaugaucagcucuuuuacacgaaaguuuacaucgacccacugaagagggugagcaguagcuugcaauuucucauuugcuguuuuggcugcuuugauauauauauaguccucaaccaaguggucagagaaacaacggauuuuggaagcugaauugcaaauuaugugggucccaucacaguuagaaaugcacaagaaaguguaaccagcauggaguggugcccuugcucacucuccugcccugccuuggguaugagaacucucugucucuaucucucaguggucgagucagaagccuuguccaaccgggguucaucagcgaggaaaauaauagguguaagacccuguuauuugcuguauuuuguggaagaacacaauggaacaacuagaaaauucagggcugacaucuaccauuguguuugccacccacuguagccucauuacccggccuucaaauaucacaaugagguuaaggcaguaacguuucugagacuggagaccaaagacaaugccaaacgaucauaccaaauuuggagcacaugacuauuauuaagacagugguuuuagcaauaacaaaggaaucugucuaucuauccauccuucugucugucugucugucuaucuaucuaucuaucuaucuaucuaucuaucuaucuaucuaucuaucuaucuaucuaucuaucuguguuugaguacugucuuucugucugucugucugucugucuauuuuccuguaaggucccgugaagcccaggcuuuccuugaacuccuuauccuguuucugucucuggcgugcuguaauuuauaauuauauacagcugugacuggcaauacuuugaugacuuugaaauggcauauggauaaguucacuucagagacaguuuuuuuacuugaaaaaugacauaccucuucucaucucugugagacuugucccuucaaguaugagggaguuucaccauuguccaguagcugguguuguagauacagugugauggacaggguccuaugaagauaaauuucaguagguuuuauagccagcaggaaggcuaagaauguuggcaaaggggcuaaacagaugucucaguggguaaaacacuggcugugacagccugaagaccaaguugggauccuaaauaccacauaaaugcuaagcagacucaccuguaaucccagugcggagaagcaggcuggcugucacuggggcaaucgagcuagcgggcuagccaaauaagcucaguuggugagcuccacauucaagugagaagcccuaccugccgccauagacggucgagagcaguagagaaagauagucaguguagaccucuggcuucuacauacaugugugagaaaaagagugcuuugggauguauguagauuguggaaugaauuaaucaugaaauuccagagauaaggccugagauucuagagagacagagacagcgucuuauuucuuaauuaaaauacuauaauugucacaaacagaauaauuagaaguaguagugggccuaauggcauagguguuuuguuuguguauuuauguuuuccuucuagaacacuaaggguuggggggagaucaugggcuguaacacugguauucugcuuucugcuugucacugcuccauuccuagccuggaguguguauuauccauguguccucuauagccuagaugacuggugaaucccagucuuuauaggcaugcucuaggcagauaaaauucaggagaguuuacaaagaaugccauuggaauucaugggcuguccuuagugagccuuucuggaaggguuggcaagugcauuugcauuucuuugacaacauaucaugugacugcacguuacacaugaauaaaauuuugugcuucucaaauacauaggccauauuaaaaauccuggguacuguuacaacucaguuugccucaugcuuuauagaaaacauucguaaaauuuauuuaagcuuuaauucagaguaaaagcaaauguaauuugaaaauauauacauauuuaaauaguaugagauaacguuuuguggauuuucugugcacuguaaauauaauuguaauuuuccuugaauugggaguccugcacacugucaccagggacacaagauucaugugggugcaaaugucaggugugcaguggcgucugucucagacauuugaauauuuucaaaugcauugaacaaguauuuuaaagugcaaaucccugcaaagauacuuauagcaauaugacugcacuguuggcuauuucuguuguaauuuucaguguuuuccuguuuuccuguuuuuuuaggaagcuuuuaacaucacacuggaucacaaaugcaaaauuuuccaggccuugaauggagcuacagguacagacgcccgugcuaccuucucguacacgugaaugcccguuuucagcauucucuccugcauuagaccauucggugcuauagucaauguggccaugcuuaaaauguucaaaacaucggggacugaauucaacccgauguguuuccauauagugcagaacaauucuccccugaguaaaaaaguuaagugcuggccuugcaucacuuacauuggcugggcagcuuugaguuuauuacaucccuacaacacacuguuugguucaagcuuuuugggugcugagucuuguggaaggguuaaugguccucuaguaaauugaaagucaauugguaaaaucuaugaauggauugcggaagagugagaggagaucugaacaccuguacacuggugcauaugcacagagugugugcaugccuacacauuuaggagcacacuccacagagcaccugugcucacagcacuuaugugaguacacucccacaguguguaugcaugcaccaacauauguaagagugcauacacguacacaccuauacauaugugaauacccucucaguguacacacuuaacaccugcacccuuacgacuauaugcacaagguguaucacauguguguauacucacagaaagcauguguguacacuaguacguauaugaauacacuuucacagagcauaugagcauacauguuugcguacuuacuugagagugcauguacagcgugcuugugcacacucguggcgagccauacagagcauaugcacaccgcauaugcacagagcaaaugcacacagcugcacauguauauauacaucuguguacaccugugcauuugucaguacuugcucauacaacaugcagauauaucugcacauuugugugugugcacacaacuguauacuuguggcuacucaaacaguacuugagcacacacuugcaugccugugaguacacacacagaaugugagcaugccugcauuuuugaauacaucugugcacauguacauacuugugaacauccuugauuguauuauuuuucuagugauacauacaccccaguaggacaugucagugcauuaauuugugaauugaaagucaaaagauuuuaucuaugaaugcauuauuacuuuaaaaauuaagaaugugcuagaguucaacauaguuuacagugcugucgauacagugccuagguucuugggauagaaaguguguaguguuuagaacugugaggagagaagccuaaaaugcaaaugcaaugccucucacgucccuuaugucuuuugggaccgucauagaaggucaacugagaauuguccaccuuaucagguacccagucagcuguggagucuugcuuauaucugggaucgcaugcuuaccacacacacacacacacacacacacacacacauuucuugcuguuucuagaacagcccuucaaggccagucuggguccacuacaggagaauaacuugugacagugugcuggcaucacacugcuaggaaccaggucagggaccaguguaucacccuucuaccacuucagcacccagcuuagugacaaggcauuugguugggagccagcuuugguuugcuaacuauggacuuggagaagauaguuucuaugcauuaaaaaaugggauagaaacccauagaccuacauauguuugaaguugacaaagacuuuucucuuuuuaacccagaugaaguuguuuuaaaguuugaaaaugguaaaagcagagugaagaauacauuuuaugaaacacugccaguggcaauuaauggaaaugggcccaccaaggugaguaccugggcccucaguucacugucuguuucucaguguugggcuguggagaaauacacgagggucaucauguguuaaaauuuaugugagaaacuuuagugugaauaauuuauuuacauugucuuuaugcaauauagcaucugguuuacaauaaacagcauuuucccuuagcaagauuaugaccuuguauucuauagguagacacuucacuuuaguguucauuuuuauuuuuuuaggaagagucaaggccagaagacaggagagcaaaccauauuccccaaauuuuucagagaccuuaggauaaucaccuguuuugcacaggaaaagaaguaauuucuucaauucucuugauuuauuauaaaaugaccuuaauucauguauccaaaucauaaugcguagccacugugaccuucaagaauagcuagauaugguucaggauauguccuuggcaagugcacaugacaucauccuuggaagugcuuugaagaggagucaggaaagugcuagacccagugcccaggaguccagggcggccucgcccuguaagcgacuuuccacaccuuccauggcagccaacagaaauguguccaguuaugaggaaaacagaugcccuggugugugggaauugguaggagguggagaguuugccaugggaugacaaacacggggacauuucccaucagaaggacuguuucucaauaucuuaaucacucagggaacaaagggcagaagguggaaaguuacaagauaaauuuuaauuccgaaaacagcaagcaaaaaugucccuuugugcuuuaccccuuggaacuaguaaccacuucucauucauacagggaaucuaguagaugaauucauggcauagauauuaaauuuuuauguuauuucuaaauugucagucauauguugugaggauuuuuuaauguguccaauuuuauauuuccaacuuugcaguuuucaugucuuuuaaaagugaccuguauuaagguguccauuuuuauauaagcauguauuauuuuaauagucacuuuuauuauuugacaaucagaaguacuuucuaugucggcuucuguuaugcauuuaaaauguugccauugccuccuaccccuuuucaguggugucauuguacacuccuggcuagccugaaaccugccucauagaccaaguuagcuuugaacucaaagagauccaucugcuucugccucuggagugcugggauuaaaggugugcacccacaugcucagccacacugacccuugaaacaucaaaaugacugccauggccauauggcuccugacuucugacauaccauaucauccaaaguaaacgccccuguggugcuugugcauugucuuagguuuccagagguucaguguagcugcaucuauagcaucuuagcggcacaaaggcuucccuguccuaaugcagagcuuacugguuucagcagccuguuauugaaauuuucagugcaguggaaauauguggacagagcuguggaagggcucuggucaaguggcuaagucaacuccuucugcacugcaguuuagagccaggagaagcuggaaaacaauucuccugggcacuuccuuaugucuuuuuacuucuaucuuuaauacaggugacauucuuuugaugaucuuacuuaugccaugauuuuaaaaaaugguuagauaagaauaguggggauuugaggaguguucucacagugauaauguuagguuacaacagauccugugugguaucaagacugcaaaauauguagugacuuuguuacuuguacaucuagagaauaucuucuucaaugucccaauuucagagaguuucuagauauguuuagggcucaaagguaauuguacucugcuugcuucuugugccaucuuccaguuaaucucagucgauacuuagaagggaggugccuaaaucagggaggaggaggcaccuugucagauagguauacagccuguauuuuagcacauccuugguuugcggauuggacaguuuaguccccugcugcaucugugcucugagcagcaccccaaagccuggcugacagauauguauccagaaauugcuuaauguucuuuggugaugaaguuuccuuguggggggcgguaaccucaguauuuguuuugugugauguguuagggagagaucguauuacuccugccccauuuucugcagguguugagcuguacauuuaaauacauuuaucucauuacuaaauuacuaacacaugguuuauggcgguucgucucaaaugucuuauuugcuccuuuaacacuuuucugugcggcauauuuuugcaauagucauuuugauuacuauuccuuccaucaaguuauaucaauuaguacaacucccauguuuuaugacaauacagacauuucuagacacgguuugcagcagguagugauucgcugucugaagaaaacuuuuguuaauguguauguauuguugauaaauguuagugugauucuggggauauacuagguacagacagaauuccagguacagacagaaugcuguggagcuauggguaucgguugaggacaugguuguggguaaggacuuccacuuaccuguuuuucuugcacuuacuagauucuccugaauuacuuuggaaacuauguuccaaacucauggacacaggaaaauggcugugcgcuuugugauguugacacaauugacuugucuacaguagauguaagugggauuuauuuguaugaacuuacauuaaaaaucuacauugucauaaaaugcagcggcucaggaaaaaggcaaauuguuauguacugucccuuggcgauuacuaguggacuuacacuguaaaaggacggugacugagaaagucuauuaguuugucuuuuugaauuguuuugaaaccacuaacagccaaaaguugggggaauugagcauugacagcaugccugggagauaaagcagcacagggugaaaauaaagucccuggggacuuguguggcggcagucccuggggagcaguaaggucccccacgcagcacacuggaacucccaggaugaaugcuucauuucucauugcugccugaagggaggagaaaaaguacauuguccgcauuuaguaacuucugaauagagcucugugucacuugaaaguaaggauuuuucuggccagacuuucaagcaacaaacuaaauguuuccuaucuggaaagcaagccagaacacuucugaaugaauccgcaccacagagauguuuaaacguuugucuugauguuuuuugcagaaaauggugguguccucuggaaggagaaucaguuccuucuguuuggauuuuccuuucuaauauaaaauuucugguugaaggauaaaaugcucauguugaguuuuuuuuuuaauucaacauauaaauaauguuuuuucguauauaaauaauuucguuaagugugcuugacuuacaacuuuaugaaaugugcuagaaaaggaaaacaacucauuccuaaauauaauaaaaucuguagucucaaaauguagucaucauuuaauagggacauagaaauuaaauauuuguaggaguuaagguuccagauucagcauggguuuagaugugggucauagcacauauuuauuggguaaaaguuucuguuguauucuaauucauucaugcuuuguucgggcauguguuugugugcaugcuauuaugugcuauuaagccgucagaggacagcuugcaagaauuuguucucgcccuuuauuaugaguccuauggggcauaaacacauuuacuaccuuuacugcuggaguccuaguggcacuacaugugccuauuuuagauacuuuuaguguuucauagaugucuaacuauuguugcuacuguuuuaaagaauuaaaauaagcacauauaauggcgcagaguuacuccugauuccaucuugcucuuguauaaggugggaugguuaauaaccauuaggacauugagugaaacccguacaagacugggagcgacucucgagucacuuccuccacugaacuggaagcuccuagaggcugggugugcugccuccaggguuuuccccuuacuuacagucuagcaggcagugucugaagugacgagcaaagcucaggcucacauuccugcaaacauguucacguauucagguaacggagggaugugcgugaagagaugaggagagccaagucagcacuucccaugugugggacugaaggucuggcucagggguauugagcuugcucagcauguuucggcuccaagaaggugucucguaucucuugcuuagcacggcugcauaguaguuggcuugugucuauauuuuuccuccuuaauuguaaccuuuuaaaaccaggagcuuccauucccuuugguaaaagcaucacaaagacugccauagucaacguguauccaggcaguugcauauagagaguuaaagaaggaaacuacaccugaguaugcuuaagguagauuuaagaaaaugcacaaaauauuuucauuaagauaaaauauuagugaaaguaguguauauaaaauaaugugaagaaaagaguaaaaacaaaugagccuauuuauaaggugagauuauucaucuccauccuccuccuucuccuuuuuccuuucuucucaucucuccuaucucccugccuagggauagucagaccaucuaccaguaagcaauaccccuggccuggaacuuaccgaauuuuucaaaacaguucagcucugaagauauuuuucugagaacagucaugaaggaaguggaucacggaagaguaggcuguaucccacauucaugcgaugaguaggauaaaaccuuucaggaacaugauaugacuugaucaaaucacuuuggcuucauggaaaugaacuugcagugugagaggacaccggcgauugaugcaagcuuagugauuaugcugacugacaugaaagucuagugugcuguuguuguaguugucguuuguuugugguugacccccacuguggugcugcuuaagauuugaguagaauuuagucgugcugauaguaauuugcuuuuguauuugcuggaacauguaggucccucccaagguuacacuggguguuuuuauugaacaaccaacccccuuucuaccucgauuccugaacuuacuguuaacacuggauuaucccaaagaagcccuucaacucuuuauucauaauaaaguaaguauuucccucugaggguugugggugagaauucuuuugaagugacuucccuggcaucuaaaaccaaguggaagguuuuacuugcauucuaccuuaagaauugaaaauuaaaucuaauauuaggcugagcagugugaaauugacacuuucuguagaccaaaaugccugaguauuaguccuuuucauacagcaugucugugaaggguguguggaagagcuguguuccuuuccauuggacaggguuuggggcuuucuuuucaguggguuucugaccauugcugauuuucuaggaauaaaaccauaacaucacaacuaaaacuagagagagcacuacuuccagccaucucaaaguggcaugugcuucaccagaggaauuugauauuuuuauuucuugcaagacaugaagcaugcuauguuauacuuuuguaguaauagugggguuuuuuguuuguuuguuuguuuguuuuuaacuauugucuuuugaaugucucagaaucuuuuuuuuggaacuauuuuaaauuuucagaagaucuuuaguaauuucaaagaguaaauaucaggaauuugcuaucaaauuaaucaaauuaaucauaguagagacacuuaaaacaaacccuuuuuaucuuaaagguacuauacuuuuuguuuacauuuuaccugcuuucagauggccuuaaaguccuuauugguuucuguuugucauucuguuuaagguugugucaugcagccucaggugacaagugaccuuucugugcugugagggcgcuuuugagaaggcaggguaggaugugcuacauaaauagcuccucacggucuggugcuagcgagugaauccaccuggacuucaguacggcugaaccaugcuaaacugaugguuuccaccacagaacggcugucaauaugaauauguugaacaggcuccguuucacuaaagacaaucuuguguaucauuauuaauugcugucuuuggcuucagagauuauuguuaaauuuuauuuugcacaauggauauuaauauccauuauauuuaauagaccuucuuuucuagauuuuuauggcaaauguauaagaaucuuaggcaacaagauuuuguuuuucucccuuuuguucaaauucucuugaaugaucggaauucgaguaguauuguaggaccuaaccaaagagcagaugcugaaauauuuuugaagccacuucucuuuuuggauauugaugcaaacugauuuuaugguuguuguuguuguaguuauguguguguguguguguuuaagugacaguuaagugcauuuucuguaauugaacaacugugaagcaaauaauucacgcuuucaaugugacacauugucuuuauguauaaaacaugauuguuuucuauuuaaaaucuguuacaggaaguuuaucaugaaaaggacaucaaaguguuuguugauaaagcuaagcaugacaucagcucuauaaaaauaguaggaccagaggagaaccuaagucaagcagaagccaggaacaugggcauguaugucugaacgauguaugcugaauaguauucuaauagauggacuuuaugaaaaaaauucucaaaaucauucuauuaaacguacagggcagcuguuugcugugugucacagauccggcuguaggagucaguucugcaugugugugguuacacaggacagcuguagaaauuucuuguauuuuucuuuaagccgaguaaaacauuuaaccaguuuaugaauugaacuuuagauaaagauugaaacaaaacaacagauaaaggaaucuuauggcuucaguagugaaugacuuacuuuuaaacucaccauuagaaggccuuguauguagugaagcuccuguggggaauacaggugcuucuacuugacaaggcuaauauuguauacucagaaaagcauuugaagucuuuuaauauuucuaauagaauccauguaaaacucagcucauagagaagugagggguggcugggacuggcuggcuucaagucugccucuaggaaagugagagacauugucuuaagggaauaaggauaaauaaggauuaucuguuguccugcucuggcuucugcacaugauaggugcacacaccccuccugucuaugucccuguagucgugggcugcaggccugcguguuggaucaugcucaguguuuuacauggauuuggggcauaaguucuuaugcuugcacagcaagaacuaugauccacugagccaucccuguggcuccuauauguuuuuaugccuuaaaauacacagugacuuaaaauucauuucucccuuggucuaagacgguggugauauauacucacgcauugacgaauuagggacuuucaguaucaagcaguguuguuuagaaaauaacgucagagcaucucuacuuaauguuugcuuuuugcuaauauuuccaaacaagaauuuuuaucgaaugcuuauuuuauuuuccuucucaacaucagggauuucugccgucaggaugaaaagugugauuacuacuuuaguguggaugcagauguuguuuugacaaacccaagaacuuuaaaauuuuugauugaacaaaacagguaugaauuaauuagucauaagguaauugcccacaguugugagggcauacuaucuaacuguaauaauucgagguaggucacauucaacuuucuucuguacucuuuaaguucccuguacuaaauauucuguuagcagucguagagccaaaaguguuuaauaguauuuacagucaaaaagugguuguuuaaaggcauuuggucuauuuuuauauaagcaacauuuaauuguguuauuaagauauccaauacuaguaaauuuucuaauuuuuaucauuuauagauauuuuaaauguagacuuuccuaaaucucaucaguuauuccguagaguuguaguucuaaaauccaaauuuuccaauacuccaaucauuccacagcgcgcuguaguugcauuuucuguuguacuaauuucugcugacucgaauugaaaucgaauaaaggcauugcggauacaagggucuuaauccuaccuguuauaauacagcuacuacugagucuguugcuauuuauucucugguccucauggcgcacauuugugcugugugugugcguuaauaauuguuccucacaauaaaauugaaaugucagcaugacuugacuguuacacauagggagucugcuaugcugcaucagcccauccuguauuuggagacaugcuccuuuugcugcauaacaugacucagcacauguagucauaacuugagucagcacaagucaagguuggaauuuaaauugucacaucgacaguuaagagcagagaguauaauugcucuuagauaauugguugcuuauucucagcuaguuuuucucucuuuuguuccuacccaggauccccuguguagggaaugguaccgcccacaauagacugagucaucgcaccucaguaaacaauuaaaacaccgugagagaugcccauuggccaacccgaucuagaaguuuuuuuuuuuuuuaauuuccauuucaauuagagucaggaacaaucagcacaacgggagguacaacuacagcucgcuguggaaugaucagauuauuggaaauaccugauuuuagaacuauaguucuaugaaaauuuuuuuucuuuaagacucucucuuccuuggugaugcuaaguuuuguuguguugagaguuaaaacuaaccagcacagaugaguuaauuuuauggcaguuuguguagugcaaaugcuugguacuguguuugucucaaagguaccacuuuccaaauagcuguuaaggcagaauauugucacagugucuuacuguguuugcuauggcuauaacaaaaggccaccaacaggguaagcuauaaagaguaagcuuauuauuugacucuuguggacguguacacugggugguucagcgucaggagcagggcuucuucagggcugccugcugcuucguaacauucuucggaauguucugaggagaggaggggcaagaggaaaagagugucaaggucucccugcuuuuauaaccuucucugaaguugaugcauugcaggccacucaaagucccgucucagcacaacgcguuagcaauuacauuuaaacucuaguuuccuaagggacuuugaguuccaggcaagcgucucuguuuuguuuucugaagugaaggcugacguauccguugcuguuaggccagcuuacaacuauaacccaguuuuaaaagcccuaaaaucccggagacagaugguaaagugauuaggguuuguuuuaggaaccuugacucaucagugucucggcccaucugcguauuuuguuuuuuguucaacaaauauucauuggcuaccuuaauguuguagagaguguucaguuugccaguuaaacuagaauuuaauuuaaacacaaggaaacaauuuaguuuuacucucuucaauguaacuaacaugcuguuaaaaaguuauuuuaguauuuuguuagcauuuucaauaaauguuccauuuuuucuuuuuuaauuaacauaacugaaaauuuuguguaucuauugaagaaaagacgaagagacuaauauuuauuuguguauuacauaugugucuauauguauguguuguuauaauauguuaaaugaacuucaccauguuauaugucuugcaaaauacacaacuccaaugaauauuuaaaaguuaauaacacuguggguuuucuguccuaggaaaaucauugcuccucuugugacacgucauggaaaguugugguccaacuuuuggggagcacugaguccugauggguacuaugcucgcucugaagauuacguggauauuguucaggggaacagagugugaguugccugaugaaucauuucauauacaauauagugacaauaugaucuuacuaauauuacuuuaaaaacaucuuuaucugucuucauuuugcuuaggauacauuugagaacuuggagaucacuuacaguuacauaaaaacuuuuuuuauuuuuuaagaucgaaaggaaucuacaugacuaauaggacaacuucauuguuguaugauaauacuugguugucauguguacacauccagugguagagaggaguagaacucuuuccuaaaguuggacaagaauuuaguuuaucuaggucauuuaauagcucuaauaaaacuugucuucauugucuuuaaaauuuauaaauacagaaauaauaaugcagaaaaccagaacuuccacacauucgcaauuucaugaggugauuuuguuggagcuggugguagcuuuuaauuugucaucucuguguguaagaucuaauguguacauaaaaagguaagaaaccacugacauucaauugucaucuuuuagaggauucaaaaaauacagacgcuauagaguacaaauguacaaguaauauauacuuucuaaaugauagcugacauuugcuaaaauuaaaaaaaaauuagucugucaagcaucaaaagaguuuuuguuacggaaaugcuaggcaagaaugucgcucuuuuuuuccccagauuguaggcuagcauugccugaguccuaagugccucgucuuaauuaucaaacucaucagcucaguuuaaauggggaauauacucugacuucuaaaaggaggugcccuuagauuaaauaacucauauuuuccuugggaaaauuguagcuguggcaagacguuuuccuucugaagguaaagguugacuuagaagauuuucaucugaaagauaccagugugauaaaguuuuuguuaucugauagcaugguagguaagggaucaguacuaagucaacucuguuucaguuacuuuuauuaaguguaaaaugacauauaagucauauauuuggugcuauccauggauuugauggaaaugaaggucaucaagugcagaagagugccuucguguugauuggaguaaaccauaauuucuuuguacacaguggcuuccugucugauuuauccguaaggaccguggucaguuacugagugcaucugcaugugugcccuuagagggaagcaugguguauuccaucacguuuaguguuagaguuuaccggacacauuguguagaucuaaaggccuuuuauuguuuauauuuuuucaucuaaguaagacaaaaugaggucuuacacguccuuggucaggauuuuuccuuacugcuuccuaaacgugacagacgcgggccuuggggagcugauaccagucauauagagggagcccugucagaauggggugggggggggcgcagagagagaaaggucugcagacacuuacucugcagcuguguuuccucucagcuuuuuccacagacguaaggaaagcucagggaauuccuugugaauaccauguaaggguucuuauuuuuaugucuacuuauuuauuuauuuauuuuugcugugguuggaagcacgcccucagucguagccuuuacaaaauccugugguauaaauaccucucugaccuauaugucuuggcucugaugucugcucuagggagcuaugccagccaaggccagcacagcucugguucugugugagggcuuucgcucucggauguucacuguuaaacagaaaacagucugugcguagacugucgugacguaacuguaacaaccgugacagguagcaacagcuacauacaaccuaacugaaagucuaucgagggggaguaauuucuccuaagccucauuaggauauguguauacaauaauucauauuugucaaacaccaucauuaugcuuuaccagccaaauaauuuacauauacaaaaccugaacauuuacaaagcauucuuuuuaaaauguaagcaugaagcacauuuuucuaugugugauauuuuuggaauguauuuuuuuuuuuaacuuucagaggaaucuggaaugucccauauauggcuaauguguacuuaauucaaggaaagacacuccgaucugagaugaaugaaaggaacuauuuuguccgugauaaguuggaucccgauauggcucuuugccgcaaugcuagagauaugguaagguccaccacugcggcucccggcagcguucucaugaggugcuugcuuuucaguccgugugucacuauguuuggaugcuccuuucuucccgauuuguaaauacuagccaauuuuuuugaucguaggguuuuaaggaggauaauuugugaacauuuguaacauagauuuugaaauguuagacuaggcuugucucauaagcagccuaagaagauuuaauaaaggcagaauccaaaaauaagcuuuguucuuuuaagaauacuauuugcucacauuugaaaaauuuuaaguaaaauaaucgaguuuaguuaauauuaauuugaaugaaauuuacuuuacauauuugauaagcacauaaucuucugacaucaguagcuguuuuucugaguguacucuauaauauuauugaugguauacucuuaugaagcaggcucccuagacuauaaagauaguauauguaauauauuuggagcugaugguguauuaguguuuuagaaauguacuuuuacaauaaaauguaaaugcuuauagaaaauaauuuuucaaaaugugcaaauauguuuuaauucagaaaacauauuuauaagauuuucuguuucagauauuguuauuuuguuccugaauuuauaugagcagccauggccuuaggaauaucagaaaaguuggcaaguguuuuuccuuaguuuaacaaggcauguuuuccagaauguuuguacugccuguguaucugugugcacccccauugaacacccucaggaccuuugauuguauuugugugcucauguuuggcugauuucacucaacagcgcauccggaauggccucuuacucauuauuuuuuucuguugucuuaauuaugugucuaaugaaguuuugcuaaggaaugagcuuggaucugugucucaccaaacacguuaaagugaagcagcagggaaggcuugaggcucucgugugcucuguaagcuuugcuuguucugcaugccgucuaggaagggcauuucacagugucaguuuuuauccaggcugcuguauuuauuuaccaagaugccucccucacacaugggugugcagaucaacugacccgaugcuucucuucauuuuagaccuuacaaagggaaaaagacuccccuacuccggaaacauuccaaaugcucagccccccaaaggugucauuuuuauuuauuuuuacuaaauuuuuuuuaauguaauuguuagauaugcuguguugaguggcaguaaagccaccccauaauagccuccuuugcacugauugguaaaauguugguacucaugggauccuuuucugcucguauguguguugugggauuuuggaggacuguugcuggauagucagcucuugguugaugaaaguaauuugcauuuuauaauuagcaggugagagaaauaacagauacuuucacuuacuguuguaagguuugggcaugcucugaagaggagaaggaaguaggcugaaaguucaucuccauuagagaugagaccuggccacuugcugauguguguguuugcuacuaauccuucuuauaagaaaaacagguacaaagagacuuccuugacccaguggugucugccacauugacuggguuuagggcgaagacagaagacgucccucuuagacccuggcagggccuacagagcugugggugcugagucagaacaguagaggagugcugcacugagcaagaacuuugacaucucgagcuccauaaaaugcuuugaaaggaaauaaagagaaaaagaagacacacuugauugccuguugaugucuggaauguuuucugcuuuccccaucugugucuaggauuauugagagaguaacagaguggccccgaagcccaguccucucuuucaguugacacuuagugcuauuuucuguguugugugaauuuauaacacuauuuauuuuaaauaaugcauguuuuaugaaaaucaaaauguaguuacaaaugaaguauuacaaaaguugaaauuaaugcauuuuauauauuuuucccaugauuaaauguucagugcuuugagaguaauacucccuuuuuucugguacauaggguguguuuauguacauuucuaacagacaugaauuuggacggcugauaucaacugcuaauuacaacacuucccaucuuaacaaugacuucuggcagauuuuugaaaaucccgugguauguucguguucaacucccuuguuguuuaucuuccugucaaauuaaauggacauaaaucaugcacuaauaucgacacauaaauauuuuuaaauggguacaguuguguuuuaugaucugcgauaguucuaaauuugaccaagaacucauucaaauuaagacacaguuaucuuaaaggaaagcaauuuaucaauuucuuugcuuucucccacuauuaagcauaauuuuaaaaauauaaauaacaauuuuuaaaggggguggagaaagaccuuagugacuugggguuagaacucuacgcuagcaucaaauguauuaaguucaucccuagcugcgcccccacccucacacacacacacacacacacacacaaaauaucacaaguuagcuuggggaaacacccaguauuuaauuaaagcugcuuagugucauaauacuuaguaaaguaaucugacaguuuuauaaaaauguuugcuaagauaaccagaggacaauguagaguaaaacugucucccauauaagguaauauacccuuaaguugaggaaauuugagucagauaguuauggcggcugguuuugaacuacagggaccuuguucaccaguagcacuggcacauagaucuaagaaagcuuucuugaauagucauuuccguuaccuucuuaagcucucuuccccucccucgccaacaguaagcuuuaaauuacaaagacucagaccuccugaugggaguagucuuugauuuuuugaaaacuagcaggauuccagaaagagcaacuuugagcacugaguccucuguuggauuaaaaaaaaagaaacaucuuuuuguuauugugguauuucaaaggugcauuugucuucuuuuccuugugcgucuucagcuuuaaugaggucgaacuagaaaugguucucuuuucuuauggagagaauagagucuacgggcuuaacucugcuucugaauuuuugagaguuuugagggauagcacuacuugguuauagcuucccggugaacuuucguuccuguccuucauugccuguauuccuguaggaacucagcucuccugagcaguaugugcugagcaaguaggcucugcuaaccuuggcauggucuugcucauucuuucauacuucagucugaagauguucagugacagaauacuuagaguuuuucccauuuucagaauuucuaaaagauaagugagauuauaauugacuugaugacuagaaggauguuuuuacaugaagaguuuaugucacugcccaacauaaaacguucaggacguuagcaucaacaaauuaaacaugauggcucaacccaacuggaauuuaagguuuuuuuuucccuauccuuaaugcugugagcuacauucccaguuuuguuuuuuauguuuacacaccacauguuaaauaucagaaaaaaauugcaugcagaucuaccuacccauuauaauauuguucaauuuuaauagccugagaaaugaaacuuuauaaauaaaaggcuugauuucaugggguguacccauacacagaaccaggccaggauuaaaauauaaacugguuucugaaaauuacuauuaauuuucuauuucuauuacuauucugaaaauaguaauuuucagaaacuuacaaguuucuugaacuuacaaguuauuagaguauuuuuauaaaguauacuuauuuauggaacaguuauuuguuuaaauguguucuuuuuuuccuuaggauuggaaggaaaaauauauaaaucgugauuauucaaagauuuucacugaaaauauagucgagcagguuuguacuaauaauucuacuuuauagaguguucuuccucuaauuuccacaaaaucuuaagcaacacggaaugaacagaaaauuuaaauauggagaaaguauugguuaggcacuauucauuagguuuacuuacagcuuuuaguuuucuuaauggaaucaaccaugaagaccuugcugccuuugaaagcaugcagauauguaucuaggugcuggagcugccucaagccgcaaagcuggggagcuauggacaguggaaccuuguauuggaaaaacacuggacucccguucuuaaacagucuuuacucagaucuguuaaaaauguacugcauuucaauguucaaaacuguccuucagauguguuucugaggaaguuucgccaggucugauaccccauuguuuuauggagcaagaaggcacacuagaagaaggcgaugauaaaacuuauuuucuagcaaagaauuuuaaaaaaagcauacguaucaagagcuaguguuacuccaccuucuaaagacauaugcuguauuguagccuuguccagaugucuucugguuucccauauuuucugaacgagccugugaugaguugguagaagaaauggagcauuauggcaagugguccggcggaaagcaucacgugaguugucauuugcagaaaguaauaaaauggggaggggagggguauauauucagagauauuucagaggacgugugccuuauucguuacacgucucuggggccuugagcuaauuguauuagccaucgagaaacguguaagccucauuuuacugauuguuaauuguuuuaacucacuccguaccugggucccuuucucauuuaugacaguaauuccacuguguggccacgagggacccgugcccccagacuggaagucaugagggaauccaugucuucacucaucaguguuccaaggacaguuuuuauucccugugccuauuguuccagcacacuguacugaaaacuccaagacagucguguguaaaauagugcagcagaucuguaauucugcuuuuuauucacauucaguuaggaaacuuggcaggaaguaacaugggcauugauuccaugccugucucuuuaagaagccacagggacagccugcucuuuaacauuacaguggaauuuuagugggaugauuuggccuuaacugcauuugcccagcguggcucacaguuauguagcugaucaggaaggcgugcuuucaagauaugguggcaaagucguagucuaucgauggugaugugauggugaacaguuacugaaagccuuggguuucaccaaacacaagaagggcugcaggggcucugguccagagagcgcucagugggaucuacugcaaggaggcuuauuguaaaguuauuuuaaggggugguaugaagacucagaaagcccacuuuaauacugaaacuccgucuacaauuaauaaguagaaaagcauuuuccuaccgaagcucgcuucacugcugacacaugcaugucgugugcaaagcuguguguguuaccuaaaagaacuugauccucgugcaacucaaacagauggcacagcauaaucaaacagcugcuuauuuuauuaugauucuugaucgaaaacaauaccaagauaccaaucaguacaaauugucuuaauauauuaaugucguuuccaggauagccgcauaucgggugguuaugaaaaugucccgacugacgauauucauaugaagcagaucgggcuggagaauguuuggcuucauuucauccgagaguucauugcuccagucacacugaaggucuucgcaggcuauuauacaaagguaguuguccaguucuuccuuccuguuccgagucugccgaccaguuuaggcaugaauaugcucugcuguguuuucacugcucagcaagucuccugcauugaucuucuagggauuugcacugcugaauuuuguaguaaaguacucaccugaaagacagcgcucgcuccguccccaccacgaugccucaaccuuuaccaucaacauugcucugaauaauguaggagaggauuuucagguaauuaugacaaacauaugaaaaaaaaaaguuuaggaacugugguauuauggaaaaggcucugcugauauuuguuuuuuuguuguuugguuuuuguuuguuuguuuuuugcucgccauuuagauggcacaguuugaauguugcuacugauuaaaaaugugcauguuuguguuuaacuuuuuuagggagguggaugcaaauuucugagguauaauugcuccauugaguccccacgaaaaggcuggagcuucaugcauccugggaggcucacacauuugcacgaaggacuuccuguuaaaaauggaacacgauacauugcagugucauuuauagaucccuaaguuauuuacguaacucaaacugaauggcucucugagauggaugacuggcgugaacaugucucugaaguuguacuugagaagacaagaagaauaaugucaacagaacaacaucacuuugggccaagcauuugaacacuuuuuauauaaaauugugugaugucucuuuaugucugcucugagccuuaaaacacagguugaagaagaaaagaaaggaaaaaaaagugaaaguugguauuuauuucugugcuuuaauugucucugaaaauaaugacaguuuauaaaauguuuagguacaaaggcauaaaugauaauaaguaagccugguaauauguucuuauuuaagaagaaccugagaagguuuuauuuaucggugggggaaguauagcaaacgguucuaaaugaaaaucagcaaaccugaaagccugggauucugacgccuacuggcucuauguaauuauuaagucacauugaccucuguguagggcuguuuuccaggaauuaggaagaaaacccaaagaaaauauugcacaaagguuucccucaggaaaccuagugcagauagccauggaagcauagccacuggaaaggaacagugcaugaggcagauguucguuucugguggaaauugggccccuguguuccuccagggcaagucucaggggaagcucaugucuuucugcuuuacaaagugcuucaagcgucagcuccaaguguccuuaugucagcaggauuuguuuccuucuagucccccccccccccauuauagaaaauaguaaggaaaaauaacaguuucauugagaucaguaguaaauuuuacuauguuuuuuuuaaagcuuacguacuugaauuuuauaucaggaagaugguuuuugagccuguuccuuacccuugacuauaguugguaguuggucucuuuuuucccccuaggggagggguuuuucuuucccucacugcaaucuauuuucucauucuuagucuccuuaauuacuuuuccucuacccuacuuguuaaaaguucccacagcaaaauuuuuuauuucaauuuuuaauauuucuccaaaugagguuuaaauauacuauagcuacuguuuuuaauuuaaagguuaaacuugaagaaagucuuuauucacggugccaaaauucauuuuucuaacucuguguguuaggaaauaaugaaaaauaaaauaauuuaaaauaaacauugugccucucu

SEQ ID NO: 5240 - RNA, 6983 nt, Mus musculus
acucggaaagguugcggagaggcauacucugaagccucuucagugaccccgggcccagaaagauuuauuacuuccuccuugagggagaaaccacaaacccgcuggaaugggcuagcaccagggccaaggcuucagaacuggguucccgcugcacacagcgcuguugggcggugcugcucgcguccuaggaggggacaccagugcugaccgcuggggaugaaaggagcguacguccgggguauuucugcucaaacuuuuaucaccaacucuucuccagagcgaauccugggagccgagucgugcagcuacagagaacccaagucuccggcugugcgggcgagcugggaaucaggcgccggcgccgcgccccgggcgcaccuagagcucuguucugcuacuaacggcuggaggcccuagcagcgccuccuugaaccgggucgcaucuccagccccuaaggagguggcggcgggagucuggagcugcgaggagggcgggugugggacaggcagaggaggaggggagcacggcgaaggggaggagccggggcgacagacggcggcgcgcaccaaccccgagcgggcuggcaggagccgcgcagaggccggcccgagcgcguugcaggcgcccggcguagggggagucggguagcagcauccucccgggcgccgcuuuagugcggccgcggcgggggcuuccucugccucgggaccucguagggcagaagccgcuggugacgcggggguggggggucccgcucuuuugccuucagcuagguguacagaguccugggccaguccgcggccacggagcgccggggcucgccugagccgcccgccaggacauccuccgggugauggaagaagcagccgccgcugcggggccgcgcugcacccuauccgcggccgccggagggaugggaagguucgcuacguggaggccaagagagagcgauggagagcagaacagccuggagcuggggcguauguaagccaccccccacugucgccuccugccugcuucgugccccagagccuggagggaagcagcggucccgagagaccuaaggagacgucgcuggagccgggacgcgccgcgcucgguggagcgcagagcugggcuccgggcccggugaaaguuuccccucccggggugcagggcgcccgcugcuggaaaacucugccuagggcuagggcagcggagucucgcggcucccucgaaggcuuggggaccccuagcagaagagaaccggagagaaaccgaggagagugcuagccggacaguccgccggucggggaucuggggacgcuccgaggcgcacccuccgcuccaggugaguggaggagcccgcagacuagagggugggcguuacucaggcggaggaggcaucuggaccggagacugggcucacccauucacuccgcuuccccucgcagguccuucucggagccgcugccaugggagagccagcccugggcgccggggaccagcagccucugccgccgcgcccgccucggaucggcggccccagucccggcgcccgcagccggccugcagcgucccccuccugggcugcagggccgccuccgccgcgccgccggccccggcugugccugugaugagccgcagcucgccgcgagcucugccccccggugcgcuuccccggccgcugccggccgcgccugccgccgugcagcgggcccugcucccgccguggccccggcgcgcaggacgccgcuggccugcguccccgcucgggaugaagguauuucgcaggaaggcgcuggugcugugcgcgggcuaugcacugcuacuggugcucacgaugcucaaccucuuggacuacaaguggcauaaagagccgcugcagcagugcaaccccgacgggccucugggugccgcgguaggggcggccggggccggcuggggacggccggggucgccuccugcagcgccaccccgcgcucacucucgcauggacccccgcaccccguaccgcccuccugccgcgggcgugggggcaguucccgcagccgcggcugggagugcaggagcugcggccucucugggcaaugcuacucgaggcaccagggguggaggggacaagcggcaguugguguauguguucaccacguggcgcucgggcucguccuucuucggugagcucuucaaccagaacccugagguguucuuccucuaugagccuguguggcacguguggcaaaaacuguaccccggggacgccguuucccugcagggggcagcgcgggacaugcugagcgcucucuaccgcugcgaucuuucgguuuuccagcuguauagccccgcaggcaguggggggcgcaaccucaccacucugggcaucuuuggggcagccacuaacaaggugguaugcuccucgccacucuguccugccuaccgcaaggaggucgucggacugguggacgaccgcgugugcaaaaagugcccaccucaacgccuggcacgcuucgaggaggagugucgcaaguaccgcacgcugguuaucaagggcgugcgggucuucgauguggcuguguuggcgccgcugcuuaaagauccagccuuggaccucaaggucauccaccuaguacgugauccucgugcuguugccagcucccgcauccgcucgcgucacggccucauccgggaaagccuacagguggugcgaagccgggauccaagagcccaccgcaugcccuuccuggaggcugcuggccacaagcuuggugccaagaaggaggguauggguggcccagcagacuaccacgcucugggugcaauggaggucaucugcaacaguauggccaagacgcugcaaacagcccugcagccuccugacuggcugcagggacacuacuugguggugagguacgaggaucuggugggagaccccguuaagacccuacggaggguauaugacuuuguggggcugcuggugagucccgaaauggagcaguuugcccugaacaugaccagugguucgggcuccuccuccaagccuuucguggugucagcucgcaaugccacucaggccgccaaugccuggcggaccgcgcucaccuuccagcagaucaaacagguggaggaguuuugcuaccagcccauggccgugcugggcuaugagcggguuaacaguccugaggaggucaaagaccucagcaagaccuugcucaggaagccccggcuuugagaaggguucccaagagaucugacacucuccggagacacccacaaaaaggaugguguuguguuuaaacaaacacagcccagacccaagcugaggaagcccacauauucuauuauagauauauaauauaaauaaccacacaggcacuugcugucaacguuuugagucagugcauuucaaggaacagcccucaacucacacgugcaaacacacacacacacacacacacacacacacacacacacacacacacacacacaccccucagaaaaggcaagacuugaaaguucugacagauugcccugugucccugucucuucucccucucuccuuccucccucuuucccuccucccuuccauauugaaguggaauguugauaaaucaaguuccaguaacccaaaucuuguuuacaaaauuuucgugguaucugugaauguguaagaguaauuuggaugugggaugggguggguggagaagggggaagugacccccagagcagaaagcccccacugggcugguaaaucaaggaggcaggucuucaaaguagacuuuugugucagcaaagguuauaugugaguauuaauaaagaagauaauaaauaauagucuuuuuauauuugauuccauuacuccggcuuuaccaguguuacuugucucuguagcuucagguggacccugucccuccauuuccagccaucuacuugcuaagcugggacaagccucugccuucuuacuaaccgagaguuguuuucucacauguaaagcguugccugccagguacccaggaauggagcaaaucuacaggcaaaaccaaacaggguagagaagaaagagcacacacuacucuccuguucagcuuugaguccagaaaggaagaacaagcccuggagaguugaaggcauucgguuuugauuacugcuguauugaguugagacaggguaccucgaagcagagacugcugguuuuguucugauguugguucaggggggaaaaaaaaaaaaggagaauuugaaagacuuugaaagcauacaauuuuuuuuuuuuuaaacaaguucugaugacuagaauacaguuuucaaaacgaggugaucacuuuuggcagugguagcagcaacuucuguuuguuagugggauaagagaaacgucugucuggaguguauucugucuaugacacaguaaucagaggcauaugaaagcaaacacguuuuaacugggacacuccuagguuuucuuucuccucugucccauccaaauuaaugauauuaaagggcagggauuugaacucauuuacuugggacuugggguguccuggagauaugauguucucuuuauuuccuuaaggcaaauuugccaagcgaugaacauguugcagacaguguagggcuuuagcuaagaacguuuggauacuggaaugaucccaaggaagaggaaauagaugcggcuuaguguguaggauuuugaaauuugcugacuuucagugagaaaacuauugaucuucccagcagcgguuaugauacuccuaugucuguguccugaacucauauugugcugauguguucuguauggugucauguuacgauaagaaauuaugaagcccaaauaggaaaaacagacaguauaguuguauauuguauaucauaucaaacacgguacaaguccagcauccuugcagcuuuguuuuaauguaauuuauuauaagauucaggaaagcuaacaaguguggguuaaaugcugaggacuucuuaaaaaaauaauauguauauaggaaauguuuuaacaggagguguuuuugaauuuaauuaucauuacaauguaaaauucaagaugaagaaacacuuaaaaaaagguguaguagaacgguuauuucuuaauuuacuaaaauuguugcucaugucuuguauugagcuagacuuucuaacucuaaugcuggucaagauuuccaugguguuuuuauggucgugccuucagcagcaggggaaucuauguaagagcucuaauuuaagaauacuuuaaaauuaaaugaacaaaauaaauauuaaugcugggugacuaaagaugaagaaggcuuagcagcaaguuaagguagggucauuaaaaggcaaugacuaggcauaacauaaccauuuaaaaacaaauuuuauaaggcauuagaaucagcucuuaucagccacagugaaauucauuucuuguugagcaaaaagauuuuuaagcaguugacuucauuuuucuccaauauauccacacacuuggauugcaguagaauauaauuauguauuucuaucuuguauuuaagacguauuagaugcucuacagagccuugaggcuuacagagcauuugugaccucugcuaagaggaaauucucagcuaccaccaacagcucucccugccucuguuugcagaguuucugucuguauuuuuccuuguguguguguguguguuuuuuuuuuuuuuuuuuuuuuaagcugccuucuuuccacucugccacucuugggcaccucaauuugaaaaggugaauuguugcuccuggagauuuguaccuuacugcauucuaggaaagugagauggguguuguucccacuagaggcugagauacucauauccgugacauuuagcugccagagcuugggagaaggggggaggcauuuuuggcguuaacaagcucuugucagccccuggugcaagccgaccugugccaugacaaacugcaacagagcugugaccguuucugaggcagcguguaugaaagccagccuuucacauuuccuaaccuggcaggauguccaucagugggaggaaguaguccucagagcaguuuaucuaucagauuguguuuguaaguucugccugacugguagcacgccuggcuuggcccuuagacuuuggaauguguuugcuaauuagaaaguuccauuuagagaaugaaguguaggcaguacauuuagucaacaauaagaguuuggaccaagacaggggcacaggcugggugcuugaguuucaggaauuucagaggcaaucaaaggcugcauuuacacugacccugaguacagggacaggagcaaauugguguccuccagugucuacacacaacaagugcuugcuaaauacuuguuaaguaagugaaugaaauguguaacuaucaaauacagaaaagguuuagagacaaagagaggacgauuguguuaaccuguacagagaaagugccaugcuucugggugagauugugguccauaggccguguugaugcguggaacaagcaguggugcaucugcagcguuuccaaggugacacagaucuuuaauccccaccaaggaauuggaaagaaauguagaauuuauuaauguggggaggaaaaaaauuucaaaauaaggaaugaaacuuccagugcuaguuuucuaaaccaacacagaagaagggcagggaccagacauaaccgugguucaaaauugcucaggugccuagagaugguccguaaaguucauuuuugaagaaacaauaugauguuuaugguuuuggguacugugaaugcauagacugaagaaucgugguguagacuguggccaaacagagcaauggccacugucagaaaguccaucccacuguggaugcugagugagacaaguucuguccaagucuuuuuuuuuuuuuuuugucaugcacuguauaguuguggcuggauucuacuauuggcuugaaaugaaugugaauuugggugaagcuaugaaguuaauauucccugggaacugagcaauuaaauaaagaucauuuuugaaacacag

SEQ ID NO: 5241 - RNA, 1767 nt, Mus musculus
gccaacaggccucagccccucgccccaggaaacccucgaaggccagaggcuucuguaggcccucgaccacggugagagaccccccugacugacggagaucucuaagaaacuaccuuugaacuggccuucugagauccgccuggcguuuugucggccaucuugagcuuugcuccuccuucagcggaggcagcagcgcgggugagucgagcaccgagagaacagauagcagccgagcgcgccagaaaggcugccaggccgaauagccgaacgccgagacggagaccuccgcggcgccggggccgcgugacuuccgcgucgaggcgcuuuuacgcgccccgcccaccccgcucgccuuccggugaauugcggcgcccagucacgucacgcgccugcggaauuuagggacucuccuugacccgacuuucaaggccaacugauaauucagucauuuuccucccagagccaaccggcguuagaugcgagcggguucuacuuccugaggggggaaggaagcugcucuuuuaaagcaacugcaguagccacgugagccgagcgucucaccucagcugaugaggcaguucgucgagacacuuugccgcacgaucccccagggggcacaggccuugguggcaaggcaaauuugcaaucugcucacguuaaaaaauggugagcagugacuucagaguugagaaaaaacagggaaauaggauaaaaacuguuuaggacgucggagcaugguaccugcauagacugggcauggaguuggggagggauggaucguaauauagacgcuguucuaaaacgagcauguuuauuguuacugugcaguacaggcacgcccuagcaacuguggggagguuaaaggacaguuugaaggaguuggugggauuuggggaucgaaaugagguuggcagguuugcucagcaagugccuuuuucccucugagacuucuggcuacccgcaccuauuucuuugaagcauagucgcaaaaguuguguagcagaagauagccuugaacugcugauuuucccgccucagguccugggaauuagucuugggccaccaugucuaagcuuuuuguuaauugaagggaagcggggaaugaguaaguuugguuugauuuggguuuuuccaguuugucggcauuccaccccuggcugucccugugcuguagaccaggcugaccucaaacucggagaucugucucccaagugcugggagaaaacgugugugccaucaccuagauuucaguuacagauaagggucagaccuagagaagaggcucagaauuggagaugugugacaggaccugagaauggaaauaaauucauuugggcuggagggcacagaaccguauuauacuguacuuucaugcauagcaaccguuacuuucugaucguuggcuuccuguuacuacgguuucuaucucugguaccuggcuuauuuauaccucaucgccuaccaccagauuuuauugauauuuauuuauuuauuuauuuugguuuuuucaagacaggguuucucuguguaguccuggcuguccuggaacucacucuauagaccaggcuggccucgaacucagaaaucugccugccucugccucccaagugcugggauuaaaggcgugugccacuaccgcccugcuuauugaccuuuuuagagaguucagcaauguagccuccuagacuaaugcuucccuggucgcucccccacccccuucacuauacccccaucaaccaaaaaauaaacuucaacuucuguauggua

SEQ ID NO: 5242 - RNA, 1767 nt, Mus musculus
uaccauacagaaguugaaguuuauuuuuugguugauggggguauagugaagggggugggggagcgaccagggaagcauuagucuaggaggcuacauugcugaacucucuaaaaaggucaauaagcagggcgguaguggcacacgccuuuaaucccagcacuugggaggcagaggcaggcagauuucugaguucgaggccagccuggucuauagagugaguuccaggacagccaggacuacacagagaaacccugucuugaaaaaaccaaaauaaauaaauaaauaaauaucaauaaaaucuggugguaggcgaugagguauaaauaagccagguaccagagauagaaaccguaguaacaggaagccaacgaucagaaaguaacgguugcuaugcaugaaaguacaguauaauacgguucugugcccuccagcccaaaugaauuuauuuccauucucagguccugucacacaucuccaauucugagccucuucucuaggucugacccuuaucuguaacugaaaucuaggugauggcacacacguuuucucccagcacuugggagacagaucuccgaguuugaggucagccuggucuacagcacagggacagccagggguggaaugccgacaaacuggaaaaacccaaaucaaaccaaacuuacucauuccccgcuucccuucaauuaacaaaaagcuuagacaugguggcccaagacuaauucccaggaccugaggcgggaaaaucagcaguucaaggcuaucuucugcuacacaacuuuugcgacuaugcuucaaagaaauaggugcggguagccagaagucucagagggaaaaaggcacuugcugagcaaaccugccaaccucauuucgauccccaaaucccaccaacuccuucaaacuguccuuuaaccuccccacaguugcuagggcgugccuguacugcacaguaacaauaaacaugcucguuuuagaacagcgucuauauuacgauccaucccuccccaacuccaugcccagucuaugcagguaccaugcuccgacguccuaaacaguuuuuauccuauuucccuguuuuuucucaacucugaagucacugcucaccauuuuuuaacgugagcagauugcaaauuugccuugccaccaaggccugugcccccugggggaucgugcggcaaagugucucgacgaacugccucaucagcugaggugagacgcucggcucacguggcuacugcaguugcuuuaaaagagcagcuuccuuccccccucaggaaguagaacccgcucgcaucuaacgccgguuggcucugggaggaaaaugacugaauuaucaguuggccuugaaagucgggucaaggagagucccuaaauuccgcaggcgcgugacgugacugggcgccgcaauucaccggaaggcgagcggggugggcggggcgcguaaaagcgccucgacgcggaagucacgcggccccggcgccgcggaggucuccgucucggcguucggcuauucggccuggcagccuuucuggcgcgcucggcugcuaucuguucucucggugcucgacucacccgcgcugcugccuccgcugaaggaggagcaaagcucaagauggccgacaaaacgccaggcggaucucagaaggccaguucaaagguaguuucuuagagaucuccgucagucaggggggucucucaccguggucgagggccuacagaagccucuggccuucgaggguuuccuggggcgaggggcugaggccuguuggc

SEQ ID NO: 5243 - RNA, 3720 nt, Mus musculus
cgcgccgccgccgccgccaccaccgccaccaccgccgcagucagccgcgccaccgccgccaccgcagcgcggccggccgcgggcugagagacccgagcguggcgaggacgccgccggcaagccgcgcgcgcagcagcagccucccgcccggugcgccgagcccccggagcagcccgcuuccaagccgaggccgcguagccaaccugcggccgcggucccgcgcgcgcgcgcgcgcacaaaggcuccgacggcgcccggcgcccgcgguggccucgcgcgcgcccuagcuaagcccggggcaccaugccgcggcgccugcagcagcggggcgccggcgugaagggaccgccggccucgaccucccggcgcucgcaucccgccuccgccuccgccccccggagcccgccggcggccacgaccaagccgcugcugcgcugggacgaggugcccgaugacuucguggagugcuucauccuguccggcuaccggcggcugccgugcaccgcgcaagagugccuggccucggugcugaagcccaccaaugagacgcucaacuucuggacgcacuucaucccgcugcugcuguuccucaguaaguucugccgccucuucuuccugggcggcagcgaugugcccuuccaccaccccuggcugcugccgcuguggugcuaugcgucgggggugcugcugaccuucgccaugagcugcacggcgcacguguucagcugccugucgcugcgccugcgcgccgccuucuucuaccuggacuacgcuuccaucagcuacuauggcuucggcagcaccguggccuacuacuacuaccugcugcccagccugagccugcuggacgccagggucaugacgccguaugugcagcagcgccugggcuggcacguggacugcacccgccucaucgcggucuaccgcgcgcucgugcugcccguggccuucgugcuggcuguggccugcaccguggcuugcuguaagagccgcaccgacuggugcuccuacccguucgcccugcgcaccuucgucuucgucaugccgcucagcauggccugccccauuaugcuagagagcuggcucuucgaccugcgaggcgagaaccccacacucuucgugcacuucuaccgccgcuacuucuggcuggugguggccgccuucuucaacgugagcaagaucccugagcgcauccagccgggucucuucgacaucauuggccacagccaucagcucuuccacaucuucacuuuccucagcaucuaugaccagguguacuacguggaagagggccugcgccaguuccuccaggcacccccugccgcgcccaccuucucgggcacagugggcuacaugcugcugcuggugguuugccugggacuagucaucaggaaguuccugaacagcaccgaauucugcaguaaaaagugagccuccacccccggaggaggcuaugguuugcccaccgguuugcguggaguuucuguuguuguuguuguuauuguugguuuguuuucaaguuuuguuguuuccuucuuugcuggaagagggugcugcaggccacuagggaaagguucccugacaguuggggaaucccaaguccacuggccuuuagaagagggagaugggaggugaaacagaaggaagagggccuccgggaagaaaauuagggacugucuaugauauccagggauuuuugcaaagacagugaggauugugauuacagauagagccccaagcaguuggcuuuucuaacagucuucugugucccuuagugaaggcagguaugcagugaagaggauaaacacaaaccccuggcugcuucugaggucuagcaaugcuuggauuugucgaaagaauggagcuuucucuguugggaaaugggcacaaagacacaaacccggggcuuaacccgcuagacaaugcauggaaugugaacacaaguuaauuauuucaaaauguguaucagauguuauuuaaaugauaauauauucaaugauuuuuuucauaauuuaucgaagccugugagaugcacuggauuuccuuugucacauaguuuugauuuuugcagccuucugcauugcacacgugaacuggaccuuagggcaagcugcuugagagaguucucgacuacauuuuuaaacaguguucugugaaggccugugagugucaugauaaaacugugaaugacuacauagggacucugauuagacuauugguuaggcuccugugguuuguauaggucuccaauuccuacuuacuuugauguauuccacaaaacccacccuggguuuuugucuccccccccucucucuuucucucuuuuuuuaucugauucuuuccucucuacuuacuuaaguugccacuaaaauaaaugugccuuuugaagcaaugcccaaaugacugguccucaaacguagcuucuuguacugggagaacagcauauucuuuucccacuuugcugcaaaucauggaugaacagaacggagggaagguggaggguggguuuagguuucuaguggggccagaaauagcuugaugguguacagaguguuuggcuucugcaagagucagcccucuaacguggcugagguuccuacugcagccacaacggcugggagguuaggacagcgacacauguauccuugcuucaauuuuaaaaggcagucaggaucaggaaguucuauuaugaaagucagaaucuuguuauuuauuacugaaauuuuugaguuaagacuacaauugcccaguuaaaccucaaagucucauuugaauccaggcuguggaaaugauugguagucaccccaaauccuugcagaguuagggaacauguucccagauucuuucuaaugacccuauuggccaguguuguuagacauuucuuauaaauguuaaccugucauuaaccuaacagcaguauauuuaaauauucgccacacuucuugguaaaaguccuucagacuaagaggcaacuaagaauggggagcauuggcuuagugguguaauugaagacaagcacauggggucuaugaacacuuaccucaguccugguaagauggugcuccugaaaagauuaguguuuugucuaugcuuuuaauugcuauuguauuuguaaauagagaaccuuggcacaauucccuggaggaaccaaugcccugaguguguucacuugcacacagaaguuaaaugugugugugugugagagagaggggggacgggauguauugaauuuaggacuucuuaauaggauuuuaaauuuuacuuugcaugacuccugaugaaugucaaugucuuauccuuugcaaaaugccaggagauuucuguguguuuacagaaguugauagugugcuuacuaccagugcuguuacucagugaagccgaauccagcacuuauauccggggauaacuguagacaucaggauguauccacguacacuuucuugcaugcugcuguuacuucuuguagagucucaaagaauguucauucauaaacuaaagaaacagcuuaagggauauuauguaggauuuuuguuguuaugguuguugaauugggacacccccucuggaaggaacucucaagagagagacaucuggaagaauccaugaacgugagaacaggcacuaacacccagaguuugucacuuuagguuuuuguuggagaucuuccggguccucucuagcugugugucuuugucuuuaagcagaggccacuugaggaua

SEQ ID NO: 5244 - RNA, 2068 nt, Mus musculus
gagccaaaagggaaaucagggcaccaguaaguuauucucuguugacaaaaugagccaggucaggccggauuagaguauauaaagccaguuuuauugggaagcaucucucagucaaguucacugaccacacaggagcagggcagugaagacgccuugggaggggaaagagaaagagagaaagcauucagagagagagagagagagagagagagagagagagagagagagagagagagaaaggaggaggaggaagaagaggaggagcaaaaaucgaagagcuucuagaggaggaaagcccagucccuagacuuggaaguucaaggcagaagguaggguacgccaggcagccccuguaauagguagggacugagggaugcugggagaaccuggggccguaaaagaugcaccucagccauuuguccugggucugaauccagacccacggagagggaaggacuguucgucuucaaggugcuccucccacaagguaaccgacuggggaaaaggcacgccggccggcauugcugagaagcugaccaaagcagggacuauuacugcauuuuuaaaacuuuggugugaauauucccggaauucgaacucccuuauagugccauacagaugggauuuucugugaaaaaaaucucauccagcacuguagcagaaaauucaguuuguauugucaugaaugucuaauuggaaauggugucuaaaagaaaaacaagugagcuguuaaauaaucauugucaagaaauaguaaugucgguagacaaguggaaaaagccauguuugcaaaaacagaggacaccguccaagucccaggucauuaccaaggaaugagggcagagucucacugugggcggugacauggggcuauucuugugauucucugcuaggaaaaacaaaaucaaguacacacagaaagaguccuuuucacaaguuucaagaaccaaagccacuuaacuuuuguguugccaaaaagaauguuccuaggggcaaaauaaucacauauauaauuacuuuauauauauuaaaaaauugaugcuugaaaugaugccaaugaguugaacauuaauaauuuacuaaauaguuaauguccaaugcaugccaagagaagcaaauguucaaauauucuccucaguuucaugcuucucucuaucauuccaacaucuugcuucuucacuaauugauuuuuuucuuggaggaccuuaugcuuuauauuugguaagucauuucuccaccaaugaaaugagcaaauucaagccagauuuuauacacacacacacacacacacacacacacacacacacacacagagguuuauugggaagcugcugcucuuggguggauuuacuggccucaaggaccaaggucagagaagccacaaugggaagggaaaaggaagggggaagagagaaagcaagaaggaacacacacacacacacacacacacacacacacacacacacacacagagagagagagagagagagagagagagagaaggauagaagagagggaaaauugugggcgggguaugccagguagggacugagggaugcugggagaaccuggagaccaggucuguuuugguauguaaaauaugugccucagucccuuguccuggggucugacaccaaacaauacugcuuacucacuacauuuuaaagacagaaaaaugacaggauuagaugaucuuuucaccaagcugacagcuuccuccagugcauauuucacaauccucugaaugacgauuauugagaaccuuguuuauguaguuuuagcuguguaguaguugaagccagggucucagaaaugcuagguaaaaaucuauaccacggagcuaucagaaacaaaagcagaaagaagccaguaguugcaauacagcguccugcuuaagacaacuggacacuuggcuaggugauccggaagcugugucuuuugugauggagauugguaaucaguaaaguggcauaagugggcggggccuggggcgggggaauggagcuucauagaauaaguguggagacccagagcgucagggaaagcaugcccuggcuuugguuaguga

SEQ ID NO: 5245 - RNA, 29563 nt, Mus musculus
ugacacacuucagcugagcaacccucagauggaacucagucgucuucaauugggauugaucuuuucauucuugcacaggcgagucuugggugcaaucccuggggagggauuggaaccuucuucuaguggagagaccuagagaaaagccagcugggaaucuuagcagccaguacauccagaggcuggagcguagugccgugguccuggacagagaccacacaauauccacagcaucauucaccaauucaaaacaucguugaguuugcaagggucugaaaaucgcugaaggaagaccccagacucagauaguaugcaaagacaacgaguguucauucugcagaaacaaccaucauggaagggucaaccaauuuuugaaauggugaccccagacaaaggcacucaggccuugcagggaacagggaacucuauagaaggauuagguaaucucaaauuucauugguaggugcuagagggggugguagguggucaguggucuauauuccuaagucaugaguguucaaccaugugaugacauagggcugcccagcacagaugucccauacugagauaagauauuuccccauuuuugugguuaucccagggcuguucuuugggaggggguuuuaugauuuuuuuucuggauuuuauggucuguuccuggagcuugugccuuauggcuuuuuuucuaaaucaggucggguccuuaaauagagacaaaugggguuuauguugucccuucaaauuacacacacacacacacacacacacacacacacacacacacacucauacacccauuugagagagggucuucugugccucuuguucucagucucacuauguagcaaaggcuggucuugacccuuaaucuugauccuuugcuaccucccaagugccagaaccacaggcaugugucacuaugccuaccugaagaacaaugcuuauugaauaacuguuaaagcaggcgcugggaacguaucacugccggacagugauggcugagagcuguccuuacuaaacacagaacuuaccucaucuguaaugaugggcucugauaguucuugacccacagcuugcuguaaagaaagaacaaaggagacauugcaugcuaugucuguaauauuuugccuggugcauggcagccgcucaauauuagaugcugugauuacaauguuaguucugcagugucugaaggacacugaauaauaaacucuguaucuucucaaggcucuuauguaaaauuguguaguauuuguacauaaccugggugugucugcacauuuuaaaacaucucugagucacuuaauaaccaacccaaguaaauaucauguagagcuguuguacuauauuuuuaagggaauaauuaugugaggaugcaaugcuaauuuuuuucucaacguauuuucaauuaguucuugguugagccugcaaaugcagagcaaucucccaguguaggugcguuauggcucccaacagccuccccggcauugaugaccagccuguggugacccagggacuuaguacaggaaggcuacaagaagcauaugugacaaaccacagagccuucugauugaaaucuccaggggcaugagcauggauuuuuagaaguaaaaaacaagauguggggcuggagagauggcucagugguugagagcacugacugcucuuccgaagguccugaguucaaaucccagcaaccacacgguggcucacaaccaucuguaaugagaucugacguccucuucuggugcaucuuaagacagcuacaguguacuuagacauaauaauaaauaaaucuuuaaaaaaaaacaagaugcauuugagguaaacaaaacaucaauguggagaauaaaauuaguuaauaaaaccaacauuuacuccccccaaauaauuaguucuuuccaggcuaucagaauaaauaaaccaaacaaaacaaaaucugaaaaaaugaaaccauaccaggaaauauuuuuaaaaccuaaaacaucagaaaaggaaaaaaaaucacuguaagcauguaguauuuccuuagacgagaugucuuuuuuauuaauaauugucuauuuauuuauuuauuuauuuauuuauuuauuuauuuauuuauuuauuauauguaaguacacuguagcugucuucauaugaaccagaagagggcaucagaucucauuacgggugguugugauucaccaugugguugcugggauuugaacuucggaccuuuggaagagcagucggguacucuuacccacugagccaucuaaccagcccccgagaugucuuuaauguaaagauucuauauaagcaaaguaagaaacagagaaaaacaaccuaaagaucagcucauuggaaaaguuuaauaaucuuaauaauugcauuguuccugcaagaaggcacuggaagucaucaguuaauugcagacacaucuuuuaaaaagucagcccuagccaggcagugguggcgcauaccuuuaaucccagcacuugggaggcagaggcagguggauuucugaguucaaagccagccugagcuacaguuucgggauagccagggcuacacagagaaacccugccucaaaaacccaaaaacccaaaacccaaaacccaaacccccccccccaaaaaaagucagcucuaauguugacgcuacaacacaagguuuuaauacuugacauauuuaguaaagcacgauguagaaucauuuaaauuuuaaaaaaaagauaauauuuuauuggguaguacgcacgauggcuuuuucucuccauguugauauccaauggugauauuuauaggcuaauugcuaaacaaauguauuuuuugaaagauuacaacagccaggguuugcucaagaauacuauuguucacauaucacauaggcugucuuccagcagacacuagcuugcuaagcuucacauggcaccaugaugagcuauuacauuugcucuuaaccagcucauuguuccuugcucuggggacucugacagcaugugucacugagagaugaccacccuguggccaccacuucucuucucacaguuggguccacuaagacagagccuucaagcccuuaugacaugaggccuggcaaaagccacccaccaagucaauggauaucaccauguucuguugauaaauucuguuguucuucagguauaguguugacuucagucacugcuuuauucaaucacuccuuaguguggcuuugggcuuuguuugccuccuuugcaacucucuuccaguuggucuguacaaagccacuaugacuggaaaucugcagaagaaaaccauccccuaccaguugcugcaaguuuucuguccuucuggaguuaaaucccugcacagcagagucaggccacccauuacaacccgaguauucuucuaccguaggcccugaacuguggccagauacucaguuccaccaggggugucuuccugcauaucagcuaagugcagcacuccagaagacuggucacugcuuccucauagucuuggguuccugggcucuaugauaccaccugcugccaauuugcgaguggucucccaauaaguucuucuuauccaauaaacucaaagucuguuacugcuucaagugucuugugagccaauguggcaguaacuagaaauuggaccaacagggaagaaacaaagaugagaggcuggcuggguuccagugauauccuuggaaccaggauucaccuuucagucacgagagccaguucaccuuaguuucccuuauagguguuugcaccacuuuuuuuuuuuuuuuccuauuaggcugcaaucuuucauacaagcgcauagggcugaauguaagauggcauagucuacuuuuauuuuuucucaucuagucuuuauuccagucuugagagauaaucaggagccaugguuuuauugucccauggaagaagugauaacacuauguccuuguuauuuuuaaugacuagcccaaggcuuggaguuggccacuuucugauuuggaaaauugaaaaucucaacaugacgaggucaucaagacacagcacuugaucagguuuauuuacaaagauggucuugggaauaauuuuagaaaaaaaaauugauauauuaaauucuuucuucucacaucuauuaauguaaucuuagucuauaacuggucauguuuaccauacaguuccccauguuaaugaagagaaaacuugccucucauaaauucaguugacuaguaaaaaugaacgaaaugcuuggaaacuacacaucagcucccaguuacuuccucagucuucucccagagaacuguuacugagccugggacacagccuguaaguaccccaagaagccaaguucagcugccuauacucaagaagccaauuaaaacagcuaaguuaauagaaaacaauagaaaauggagauuuauucaauguguccacauugagaaggggacaaagacauauccagugacacccaguucagucacauacaagcccauugagcucccuaccugagagcagaguuugacaauaguuaauacaaaaaucaguacaggacuuccaguugccaagccccagaggcccgggauugggugaaacccagagacauucagccagauugauucagguuaagucuugcgcgugcucgacuggccaggaagaacgacgcugcaacaggauccuucugcacacguuuauugggagagcuugauuguagaggcgaaaagaccccgagcccagaacuggugcugcuuuuauaggccuaggagaggcgugucucacacccggauugguuaugcacuaagccucauuugcauguuccucaucugauuggcuacucucucucaguaccuuacagagccucauuaucauaccucauuugcaugucucacaucugauugguuauacucucaguaccuuacagaaccucauuaucauaccucauuugcaugucucacaucugauugguuauacucucaguaccuuacagaaccucauuaucaugcccgggccaggcagugucuuugcaaaaaacuuuacugcauauguacacauugguuguuuguccaaacuuaugcgugguggccagcaguagucagugccacucagcaacggcacauguggcuucccacaguuaagagucuagagcagggcagcaaguggaauguaaagugaauaaguaaaaaauaaaauaaauaaauaaauaaaauaaaaguaaaaaaagaaugccuagggcaguaguucucaaccugcccaaugcuguggcccuuuacuacaguuuuucaugcuguggugacucccaaccauaaaauuauuuucauugcuacuuuguaacugcaauuucgcuacuguuaugaaucauaauguaaauaucucugacuuuugcuggccuuagguaaccaaccccauuaaaucagcccccauggguugugacucauacguugagaucugcuugucuaggugaacaaucugggagcuguucuuucaagaaagaguugacugucaaucucuggggaaacacgacaucugcuguggccaggacucugaagcagcucaaccccagcacuaaucacucagauguuucagaaugaccaguuucuguccauccugcucauaagaagugcuccagaauauuaaaaagccuuaaccaauucaugcuauuuggcagaaugaguaagaccacacuccacugugggcuauacuacuuaguaugguucauuacuauauuguggccuacauugauaaaaugauaauaauaauaauaauaauaauaauaauaauaauaauaauaauaucaucgauuuaauuaaaaaaucaaaaagagaaauuaaaauauaaaagauuaaaaaaaagaagugccccagaaguuuuccacuucauucccccaguaaugaaacauagcuaagccuagcuucaggagggagccagcgaaccccugccaucuugaaaggcucccaaaggcuagggcauguuccuucuuucuuccucuccaacacugauuucccccucucuuuguacaaguuugcaaggccaccccaccccagccuucuuugucuugcuauacgucacuagaaucucacugggaauuagagugccuauaggucucauugcucaccgacuaccaguucuucaaccaccacuuggagucuuaaaguucauuuucuuuguugguuggucuuugcuuuaaauaguuuguuguuuuuguuaaaauuuccagaugcucuuggcagcgauaauguuacagguggaguuauuugucugcuaugcugcugauggagacagucaacaugucuucagacuugcuagaauucuuugacaagacgguaaccugagcuuggauucagguuauaaucauucuggaacuguccacaaagccuuauaguuuguuuuucuucagugguguuguggugucaaugcuugugcccuccucaaauuuuugaagugacaaucucagguacagggcuuagagggugaucuuuuuuuuuggggggggggaggugauggaugauaaggaauggagcucagggcugggguaagugguugaucucacaaaaucaaggcaguugcuguacuccucugccaggcagacaccgagaagaagcaccacccaugagaaucaguugauaucacagacuccaugagagccccaguacaaacuucccuaauucuagagaaacaaagauuugcuguuuauaaaccucugggucuaugguacugucucuagacauaucaaaaggucuagucucuuuuuuucuuauagugcagcucuucugguuucagugacaguguagggaagacuuggguguuuagaucuuucuuuuuugaaaauaagaaauguaauccaagguugucccuagguuugagacccaacgaggacacaaccugaacaguuaggagaggcaaaugauaaagguaucccucugugcauuuaguucaaaacugaauugcccguaggugacagcuguagggcagaagcagacagggacaugacuccccuaggcaucccgagacaaguccaaccaacaacgcccuccauacaagcccacuuacucuuccaguggugagaucucccuggugauggcacacuaugagcgcuggugggagagagagcuagggcacugaauucugacaccugcagucuucacaggaucacaggaagguacagccccuucuccuacuccaugcccaucuacuccaagggguggaaagcaaagcugcccuuugggauaaaacgcuggaauccagcacauaguccuccuuccaagagggcaucugcuguaagaacugucauuggcuggcagcccugcccacuacaugcacgcugagaucuauugcuucagacaugccaaguguuuccacccaugucaaccacaccccucacagccuccugccucacugggcuaccuuugcugaaguuuuucacugcuauaagcuucucagaggauaaaacccacauguuacaaaaugaugagauuauuugaaaaauaaagccucguuuaacaguaggaggugacagagaugggagcuuuggagaggccgaaggacaaccucagguuucaaucucaggagucacucaucuccuuuucgaaacaggguuuuuuuguugaccuggaguguauugauuagacuguugagccucugaauucaggauccuuccugugugugccaauaugcccgaggcauagugggggugcugggcauugaacucagauccugagccaucuccucagcuccuaaaacauagacuuuacaggcauucuuagcaacgagggugggaccaguucuguucuaccucaugcuguaucuccauggugggcuguagcacugggcauugagaaggcucacaacaggaaaaacagaaggaagggagggaggaagagaggggaagaaggaaagaaggagggaggaaaggaagaagggaugggggggagauaaggagagaaggaaugaagaaaaagauguggauuagcccagacugaaaaaucuaaccaguguugaaaagggaaagcacacaagcagaugaguaguagccucagauuggaaucuaagaaagagcguuccaaaguguguuucuaguacuaucugggaaacacacaugagcaggcacauucaccccgccccccaucuacauaagcauaaagggcaauguucaggaauuaauauauaaaacacacauuuauaugccuaauauuuuucucaaaauauuuagugcuuacaaauaagaccuaaauaugccacacaaaaaaauaauaggggagaaugaacuagcaauuacagcaacaacagcaacaaagcuucuagacacuaccauggcaaccuugccaaccaaggaaacagagucaagugccagcuccaggcacagagguggugagucugcugagggcgcuucccauuuguacaguggguugagcacagugggcagggagacagcuguuagugccuugcuaaugucucccagcuaagcaucaauccuaauaucucugagaaaaaaaaaaaagcagucaaauaagaaauauauuccuauuaaguucagucaaagaggcagggguaacacuagacuuuaaaaugaaccaccuuuuaauacccaugaucaauuuaugcuaauguuuaaguauguugacauuacuuaguaugcucauauaccggaaacgaagaugcuuucucgaacguaccucucuuugcaauuaucuuagcaaaaauguguauucagauuucuccuuccuuaggaaaaaaaagugaaguuuugguugagauuauuccgccagcauuuacaggacucuaaaguauuuucagaauucugagagagaagagguugggcuaagcuuuaggccucuuucauugauauuguugauuugugauuauguucaugggcauaauuuuauaugaaguauauguaucuacccguacuuacauacacucuaaguuaugauguaccucuaacugcucucucgcaccgcacuaucccuguguuuucauauaacacuuuuucggaugauacuuucuuugugauucuaguuuuuuggagaacaauagcuuuaaagcaaucgugcacugcaguaagagcccagccuccgauggagaauccaaacuccuuuauuccaggugcucggugagcaacgacugugguauuuucccuugaguagaaaaggaacagccgcgugaguuggccaaacuauuuccugugcccccucgaugagaauagaguuuuccaaagaacaguuaagaagggggcagguaaauggggccccugugacaccuguguuaucucuggauguuuuggggguaagguuuuuuuucuuucuuuaaauaaaguauuuugcagauuuuacaaaaugagcaguuauuuuauuuauauugaaggauauuuuuacuuaagacacccccaaaagaaagacagacagacagacagacagacacagacacagacacagacacacacacacacacacacacacacacacacacacacacgauggaacuacaugaaugaaaagccaauuuguuuuuauuccuuggugugguuagaauuccaguguuuauacaaacccugcccccagccuucuagaaucaguggagaggagggacaucugagggacaggggacccgggaugauggcuccugcuccucugggucuugcuuuagauuccuggcugcccaccagccagcucaguggcucaucuuugcuguccuuguccuuaccucaggugacccuauuguccugccuuucuagcagacgaccccuagcuuccuaugagucagauaugaguaaugcugagcugagugagacagccuggcuagucagcuacaaaaugcccucucugacugugcccauuuacugcaugagguauuuccacguggugagcaccacgguguaagaagaagacaggcauuacaggcagcugauacugaucccuccuauacacagaagucagucuauacaagucaacacaaggagacaguucugagguauuuuggguugauuuaaguaaauguaauuguuuucuaugcuucagacuccccauugccacucgugagccacauaauuggcugcuuguuguugucgcuguugucaucaccguuguuguuuccaaacccagugccuugcacaugcgagcacuauaccagugaguuuuaucucuaggacauggucugauggagcccaagcuggacgugaacuuaugauccaacugcccaugucuccuagaugcugggauuacagguaugacugcaguggaaacuuaaggguucuuuggaaagucaguuguauuggacaguguuuugcuggggcaaacacaugaaggagugguuuccugaagugggcacagguguaagacugaggcagacucaugaaggaacauuucacugaaacagacacaggagagaggauguucugcuaaagcaagcacaugaaaguacacaugaugcaggagucuuugcuaaugacaugcagguauugguucgccuuacauuggguaguugagcuguauuuguugggacuccaaagagagaaacucaacaaaacaaaacaaaacaaaaaacuucugguggugugcugcaguuucuugccacuuccucggacucaggcugauugacagagugaugccagcugagacagacacaugugcugaggcacacagaggacucgugauguuugaagggacuauagaaaagacuugagggacagugguagguguugagcuuggcuugcuuaucgagcuagcugugcaauguuugugggucucccaucuuugcuggucuucacuucccugagagaggcacagcugagaacuucuccugguguuccuccuggucccuccugcugacuugagccaaggcuaaggccuggcuguuucugcuaggucaugccaccacugcugauuuguauugccaucccaaugcaacuaaacuggacugcuggcguauccaugaagugcuugugaguggaucaagcugcugcugcugaccuauaaauugaacugcugauuuccagacaacacagaugggaguugcuccaaagcaccauuucuaaacagguccacuuccccuguauccuuucuuuuccacuaccucugguggguggugggauaaaagggagaucaaaguguuuaagaaccaucauuaaaaauaggcuuugaaaaaauuaaaguuacgcaugggcacacauaaccggcuagcacagguauuugauuagcacuuugacuaucccuauagccuccacugacacuuucccaguauuacauggcagaccucugauuuuucaguagucuuuguaauucuuggaacuccagccccuuuaggaaggcuuauggucuguuguucugaaacacugaccucaggcuuggaccuggaacuguuugcuuacacacuacuuccaggggaagaaagaggagauaaaaauagauaauugaaaaucuugagugagcucucucauucaguccucaguugcauucccuaccugggugccuaaggaguggugaaagggcuuaguguucauagaaccacaaagcacaaggaggggcgguuucuugcagaaggaauucugggaaggcaaacagcaucuugccaguccaguuacagcugccauuuccaugugcugugagcauuuuguguccugauagaggucauaauggguuagcuuacaguauuuauuaaaagccugauuuuuaaauuagcccagguucaaauaccaguuuuucguuuaugugaaugaguggcuaacugcuuugaaugucagaaucacugccuguaaaauaacaguaaacaucuuuaccucacagacuugaaaagagaaggcaaguucgucauauuauacuauauuuugucagguuugguuguuaucucuuagaagccuguucuuuucuaaugggaggcagaaagggaguggaucuggaggggagagaaggcagggaggaacugagagaaguagaggaaggggaauauguaaucauaaaaauaaaaacaugagcuaagacggaaggaaagaccauccagagacugccccacccagggauccaucccauaaacaacuaccaaacccagacacuauugcauaugccagaaagauuuugcugacaggacccugauauagcugucucuugugagucuaugccaaugccuggcaaauacagaaguagaugcucacagucaucuauuggauggaacacagggccccuaaugaaggagcuagagaaagcacccagggagcuaaaggggucugcaacucuauaggaggaacaacgauaugaacuaaccaguaccccgcagagcuaugucucuaguugcauauguagcagaggauggcuuagucggccaucaaugggaggagaggcccuuggucuugugaagaucauaugccccaguauaggggaaugccagggccaggaagcaggaguggguggguuggggagcaggguggggggaggguauagggggcuuuggggauagcauuugaaauguaaaugaagaaaauaucuaauaaaaaauaaaauaaaaacauuauauugcaugagaaaagaacacuuucaauaaaaggaaaauaaucauguauuaaauuuuuauaauuaaucauucaguaaugaucauuuuuuuaaaaagggagaaauaauguuauuguacaggacucaucacaguuccuguuaagacacuucuucauggaagaccucccuuggaaaccagccagccacagcccacuccucugagcucagcuugucuagcuucucauggcugccuugacugacccagccucaucuauguagcugaaacacauuaccuuggaaacucacacagaaagacaucccuucaggcuggucuccucagugaaggagauggacacauugaguuauauagagccccuaacauggguguuaauucuucucaugccugcccauuggguuuugaaagggauuucaauagccugggccccucaugccccgugugccaaguuucuaccucccuugaagcugagauggaggcaggcgauauggacuguacaguccuaugcacugcgaugaguccuuggaucccguguugagcucucauucuguagagggucacaggaguguugcaagcuggaauuucccagagcagaaaagugcccaacagguuugcugcagaggcgaugacaguagguaacugcauuuagugcuuagauuuaguggccagcgaaucucucaaagggcaucuuuccaggugaaauucuggucauuauuccagaguaauaagccuugagucuucuucucuaguuugugaauugguugcuuggcuauguuugugacuacgaagacauuucugagucagucccucuguaacaccggcuuuuuugguaggguagaaggaaaguuuacuuuucuuccuaauguauaguuacaaauuacacacacacacacacacacacacacacacacacacacacauacauauagacagagucucucuauguagccuuggcucuccuggaucucucuauguaggccugucuagccuugaacucacagaggcuugcaucuuugccucuagaguguugagaugaaagauauaugccacugcaccuggcuaguaacacaauuuuuaagugaauuuuuaauuguaaaauuggaagaacacagaguaucuacugacugaguauugcauaaaauucaaagccaacaaaguuccuccauguugauauuguuucucaagauggcuuuagagguugauuaugcugcucagugcagaucucuugaguagcaggcgcaaggcuuuggguucaaccucccgcaucagaauaauaauaacaauaauaaccccagaggcuaaaugaacagaaaaaaaaagcuugcucuaacaaagacauuuugaaaggcuguauuauuagugucaaaacucaacuaucauauuaucccuacaagaacauaaagacuucccacuuucauaagcucugaagaguuaaaaauacuaugggaauaguaagaauguuucacuaucaugaacuuagguuguacagugauaguuuuccagguccccuugcuuccucauauuauaacacguauaaaucuggagaucaaugagggacaguuggugccagagcacaccugagcuccuccaggcgcgcuuaaaacagcgagagggagaguccaggaacgcacacuccugagcccauccaaagcccugguaggcuugguuuccuggcacuuuucaagaugaccagaggaagucgugucuccugguuugcuuccucuugcugugauaagcaccaugauagaaauaaguuuagaaucaggaagggucuauuugauguucauuuccaguuaccaguccaggcaggacccuggaggcagaggcugcagcagaggccaaggaggaucacuguuuaccaguugguccccauagcuucugcucagcggccuucucauauugucccacacaggguaaugcugcucauggugggcugggccugcucacaucaaucacccauaaagacaguccagcauuccagaggcugaggcaggaggacuguuguaacuuauagucaaccugaguacauagugaacucuagguuaaccuagguuaaaaauugagcuggcaagauggcucagugguuaagagcgccaacugcucuuccgaagguccugaguucaaaucccagcaaccacaugguggcucauaaccaccuguaaugaggucugccgcccucuucuggugugucugaagucagcuacaguguacuuacauauaauaaauaaaucuuuaaaaaaaauuaaaccuugucucaaguuaaaagaaaaaaagauaaucaggaggcacucauaccauucuuggaguuaauugugugggaaaagccucuuauuuucuuaaagcaggcuccacauacuuauggcagauauugaaacauucuggugggcuuuaucuuaaaauaugaaacuaaggauuagaauauuaaauuugguuugcauuuucacaaaaugucuguuauauuucagaccagcgcuaauucucaucacgcacaaggacaggaucaguuugaacuuuuuugguguguguguguguguguguguguguguguguguguguguguguguguuauguuguuuauauguacaugcacacuuccauguauggccagauguugacaccaggaugucuuccucaauaacacgcugccuacuuuuuugaggcagagucucucucucucccucacugaaccuggaguucccggucucagaauggcuggcuagggagcccccuggaucuaccugacuucccuucuguccucgcagcuuuuacgugggugguggggauuugaacucagauucucccuugacuccuuagucgucuucccagccccagcauaaacuuuuaaaacacaacuuuccugaugaaaccgcauuuuacacgacaagucuucucuuugcuuugugacucucacugcugcugucuguaucuggagcgguccccaagggccugagugccgagacccucagcccacugugcuauugucaaagggagggguccugugggugguaacugagggucuaccccucucuaagcagguagauggauccuggucccuucuuggcucuuguucucuuuccucccucuguaaggccaacaguuuggcuccccucaggcuccugcugugauauucugccucuggcuggaagcaacccugccagccagucacagauugaacaaaaugguaagauuuuuaccuucuuuucucuuuguaacuugauuguugcagguguguguguguguguguguguguguguguguguguguguguguguauguucaugggguguaaaaaaaagucaagagacucacuuuugaaaaagcaccauaggggucuaucugucucacagguuucuguuaauagauaauacuuugguauugaaaagcauucccuugagcuugcaguguggcuccgagguaaagcucacguuuagcaugucuugggacccugaguccaauccaaagggagagaagggagacaaaagucaucguaguuuggagacuuuucaucagccaccuccuuuggcuucuuucaguuguucuugaaguagccuaaguucagucgccguauaaagcuccccaccgucuccuuuuggucaauaucuuuuaaugcuggaucuuuuaugggcuaaugcugucucgugagugauuguguugaauuuacggugcauucuaagaugucuacaagguugguaaaugaaccagagaugaagcaacagacacaauggcccacuugaugccaauacccuacagagcccaugcuacgcuugcaaguggucaguucacgggugauuuuguucauguucccaugacucuuugcacagccaggcaaggguaacucauccuuugagaaggaggacuccuggccccuccacuccgcuauccuucagaugaccuacccacaagacuguugucucucagcagcucccuuuagcuacuacugccugcuguccuguagcuucuuaccccaacucugcuucauaaaacaccagaaaccgaucucacgcaugugacguguacacacuccuucagaggucccuugagucuaucucaaauuuaacacauuaaacaucucaggacauuuacgguuuauaauuuuggucagaacuguaguuccaggucaaauauguguuuuuaaagagcaaacaacaugguucuuaauaaacuuuuaaaaucacaugguaagaucaaugucuuucuuaugagugucagcaacaacagacugacccauguuagaaccuuuuacuuuccagugaggaaacaaacacaggcauugaucuguaaauuaagaaaagaaaacacugcugcauaauuacacucaagcaguuuucuauuuauucaugguuaauacuguuuuauauuuuaaaauccuacaggggaaguauuuucaggcaugaaaacuccagaguauuacuaggcaaaaaaaaaaaaaaaaaaaaaaaaaaaaaaagagcaauguuuucaccauauaacuccaaacugugacuuuguaauaaacuaacuacaaacucuugaguuuucugauagcucauucuggaaauguguauaaacuaaacaacuuauuuucuucuuggcucuucuaaagacauuuuuacuuaguuguggguguaaguuucagaauauaauaucugcugccaagucuguaauuccuuuuacaaaacugucguacagggugugguacauuuagggauuuuuuuuuuaaaguuguaauuccugguaagguucuugccccccaccaacuuuaaaaaaugaaaacaaaacagaacagaaaacccaaugcugggacuagggagggcauagagagauggugcagcgcccacgagaugggucacaacugucuggaacuccaguuccagggggauuuaucacccucuucuggucuuuguguacacugaacacacacacacacacacacacacacacacacacacacacacacacacacacacgcacgcacacacacagagugcauagauauauacauguaggcaaaacaccuauuaaaacuuguuuuaaaugcuaaggcaaucuaaacucugaagaggacucugguuccuagacagguccuuggguuuuccaguuuuguuuuguuuguuuguuuguuuguuuguuuguuugcuuguuucugaaacaggguuucucuguguagccuuugcuguccuggaacucacucuguagaccagccuggcuuuuaacucaaagaccugccugccuuugccuuccaaguacugggauuaaaggcgugcaccaccaccgacugguagguuuuccgacuuuuagguuauugccuguagucauuguuauuugcuugccggaguguuaaguucuuaagauuacaaguucauuauuagaaauuaaaucuuuaaaauauuugugugugugcccaaaaaagccagaugaggguaauaagucccagggaguugacugauauggggugcuggaaaugaacuuggguccucugaaagaaccacaggcaaguccucuuauucucugcgcuaucgggcccuggaguuaggguauugacaagucuugccuugccuuguuuuuguuucuuuguuuguuuucuuuuaucuuuuucuucuucuuauaaaggugaauguaaugcaaaaggcgcgucguuaaugaaacccucaaguuaaguuguagcucccaugagucucgaguacauucugcucuugguggucuuuuaggacucucuggugacguuaaaaaaaaaaguaugaaauuuuucugaaguuaaauaaagccucgaugcuagaaccguucucggggauauaguuuauaaaucuuaacucaucaauaacguuuccuuuuccggcguucggaaaacuucaaaaaaaacagaggugccugcagagaaacaccguuuucacaaccuaacguggguggugagaugagaggaucugacauuuaacaacaauucacucacaaaucgcuugcuugcaaaugcauguugaaaucugcccacaaaaucaucucucuagccauuguuacacuccggugcacacaggcucaagcgcgaguguauuuaaagcgagaguuaagggcuggaaguccacuauggaaggaucucuuuacuugccccuugggacugcuauuccaagaacacaaaggaggagccggguuccccagcaguuuuacuugagagcagcugggggcaaccccccaccccggaaaaccaaggcugguccuggguaccgcuggcggggcucccuuccccccugcggccgcccaggggacaggcuguggccccucccgcuggagaacaaacgggacauucagccgccgcccgcggcugccagggcgcguccccuggggaaauuaggcguggaguccgcccggaucgccuucaaaaaccgcccuccugccggccgcggcgcacucuguaccuggcugcgggcgcccggcgggaugcugcagugagcugccggccauggggggcgcgagcgccugcaucccgcucugccugcuucuggccaccgcgcggauggcccggccgcagacgccagagagguaacgucccccgcccucccuuccccgcgcccgggaacccgcacagcgccaccgcggacugcggugcucccccccccgagcgcuggcccuacggcucccgggccaccacguggcgcggcucgcccucccuugccuugccucccagcgguuugggcgccggcgcuuuagcgcuugaauaugcuugaauaugcgcccuccuccgccccgcgcuuuuccucccagcuuggccaaucuaagacuaaccuggggagccggucuuuaagugacuccucacuaacagccuagugccuggccagaggcaccuacaggauggcuaacucccgcaucaccuccaaccgcggcugccuccccuuuucccggggcgcgcugagacacccaaguuuuccagaaaggggaaaaaacaaggccugucucuaaaucuggagacaaacuuaaucuuuaccaugucuuuuaaaccaugcagcucugccagagugacucucaauaccucucccacucucucccguuaacucauucaauuuuuauauaacuuuuugagugggauauuuuacuauagcugcacguauauggucugucuuaaugaugaauuugggcgagugcguuaucgggcuauaauuuaaauauucuaagagauggcaagcauucagaucuuuucucuggugaaagauuuuauuaaacaacauucacucguuuauaucagcacguaugccuuuuuggaauuaacauuagauuguuaggcugcagaucaauguaaacguucucucucuuauuuucacagaccuguuuucacauguggcggcauucuuaccggagagucuggauuuauuggcagugaagguuuuccuggaauguacccuccgaauagcaaauguacuuggaaaaucacaguaagcauuuauuuuaaagguguucuucuggacguggcuacuggaaacaguacacacggaugccauuugcgucuggugucaggauuuggguuaguggcagauuccagaaaacgugaaaugcuggauuuacuucaccuaucugggagguuuauuaagagaccugggggauguccugcaauagcgauuagagagggcucaagaugaugguugaaggaagaaacccuucaagcacgaguuucugacaaaguuucugacaacucgugccugacucgauugagucauuuugaauuccugauuaaggcuguuucuaguuagaggucugguguaaacaccauugaaaguuagauacuguucaugcccacacaacucccugugggaaauaaacgaucaaagcaguuuugacuacuucauacuccggagaaaaagaacaacaguuaccaccauugcugccaguugcucucccuucuuaggaaccaccacuaaaggccaucuaagaauggaggaugcuagugaugagggcuuaauaaaauucccauggugcucacugugggcuguauuagccgcagucaaggcaggaaaccagauacagacauaauuaaugaaauaaaagucgccugaaucacacuuucuggucacugcugcuguaaauuuuguugcuaucuucauuuucuuguuccugggaaguuauuugguaaccaaaaguauucauuuagucaguuaugauucauugcauguauguguuuucuguggcuguggacugaacccagagccccaugcaugcuagauaagugcucuaucacugagcuacauacccagccccagaucacauuugaaggacuaugugccagacacuuaaccaugccaggugauuagcaagcauuucagcgaaccugcagaaucacuuugaccauuauauccucuacuuuuuguaggaaagcugaggucaagcaaauuagucagagacauugguuugauaagcccaacuuuaccuguagugaagaccugaguuuggcaggcggauuugagagaaggaccccucuauaauauaaaacguugcuuuuuugugugccuugaugcccucuuguaaaauucuagugaauggauauagauuucauucuaucauuauagcacauggagcuaggggagacuacguuccagaaacagcuuugaaacacugaugcuaauaaaugugacauaaggcuggggaacaaauguaaagagacuugguuucuuauuauaauugugguuuaauugugacucaguugcaaggucaaaaagagucaucgugugccuagcaagucaaacaccaugguugguuguguauuggaggacuuagcagucacguugcuguggcaucagacgagggagggguguguccacugggaggggcuucuggacuagagagagcuuugccucagaggaaaugcaguugccaaaaagaaaaagaaaaagaaaaaaaaaaagaaaacaagauccaaaaaacaggcauagggguguggugguggagugaguguggaguguuaagugguaggguggggaacguguuuaauugccuuaauaacucaaggaggcugggacagaaggaacaaagaccauugucuggacaggaaguuaaagccgaggaucguaauggagcugaagccaaccaaaagccugaguagagaguccuggacucgaagagguugggagggcaaagaugaagaaauaugucaucucuuaccuucugguguuucauaggcaggcaugcaugcaguuaggaugcuguggcuccagcugagaggcccacugcccuuuguggcuccuguccugggcagggauguccucuugggugacuacccaaggcaguccagagagacuuucucaaagccaguuguauuauacaggguucccagaaggaaugaaaccaauaauguguguguguguguguguguguguguguguguguguguguguguguuuuaaagucaacuaagccagauaccuuagcagucucaaucugguacugaaaaccuggaugcucccuggagcucagcugauguacaacugaaguacauuuccagccucuagucuaggauauuaaauuuuaauagcaacuucuuguaugacagggcuguucagcacauugucuucucugauuauuuaaauuaaccaacuuucauuuccuaaucguauagccaccuuuuaagugcuuaauggcucucucucucucucucucucucucucucucugugugugugugugugugugugugugugugugugugugucugugugucugugugugugucuguguccuaugcacaguuccagagaauucuagggauuaguuuuacccguguaaagacauugcagauggaaaugcuccugacuacuuaguuguacuccugcccugucaauggggaagcugauacuaggccaccacagcugaugacuugauuaaguuaagucgcccuuaucauucugucaacuugugguggccuuaguugacuaggucuuaguaauuaauuuggcugagcacguucuuaaaaaaugcauggcuagacauuaaaucagaggauuugagaguuaggaaacaguucaguauuagguaauccaugaggagacugugugcuucuuaacuuccuguagaguuaacuucuacaggaaguuagccacacagaugucugcauuaaaugacauaguccuuaugucuaugguaagggacaagaauugaguaugauucuaacaacuaagguccuuugaaaaguggaaauuaaucuuccaagcugauuugacauagugagacugggguguagucaaccucuuccguccauauugaagcaugagagcggugcaccaagcccuggcagcaaaacuugaaacuccagaccuuggcacgcuaccaccacacuugguaacaguacucuuuugagacaacaugcaggggaugaugggaggcaucugagauccucaaagggaguaguaguguagcaguaaaccugucggcagggucucggccaguguggugagcucagugcuucacuaggacauaggccagaaaccuuuccagcauccuccuagucaagccaagaugagguuagaaguguugugagcuggaggagaugagucugaggugugagccuggcucugaguggccucugagauaaagcccacccaacucucugcaguucuagcugcccagcagccccgacauccacaucaccagcccauuauuagcuucaggauaacuucagcgcaaaccuggacccacugaugcaauaguucuugagauuuucagcuuacuuguucauuuuauaauucccaugguggaauuaaagauagaaccugaugauuacuagaaacaauuucucucuuuucuagaaaagucggcuguaaaaguggcccccucagaguuugacuugaggaauaauugguguggguggccaggaagaacagcugaggcuuugcuuacagaaacuauaaauuacaggaaacuugaagcccagagccuauugggaaaucuagaagguacauaggaauagcguuuaaaauuaguugcugaacuuaaaauccagcagagaauuggaaugcagaaaggaggugaugcuacagagauaacaauggguuuguaauugauauauacacauacauauacauauaaaguuugaaggguauugaaaucagccaguaacugagguuuuaaauuaauuucagcacgaaucugaguugggaauaaaaccaagcaguuuaccuauguuucuucugcauagagacccucagcugccuagccaacgccuguccugcuguccaucggcuacugcuuuauucuaccuaggaacauuuaauauacuuaacaugcaacuuaugcuacuaagauguuaauguauaguucucggcaggccuucacauauauugacccacuuuauucauuugcaucuaauucucugagcugguugaggcagacauuaguuuaccccuuucacucauggguagaggaauugcuaucucaagaacuuggguaacauuuuuagcugggugugguugcuaacaucuguaaucccagagguaggaggagcgcuguaaauugggagucagccuggucuauauagugagguccucccucucucucucucucucucucucucucucucucucucucucucucucucucucucucgcucucucucucucucucucucucucuguguguguguauuugcaucuugccuaaucccaugaaaagacucguuguauuacagacacagcaauacaauuaguugugcacguacuuagcucuuguauaagcauucaccacaauucgcugagucacuuguauagguaggugcuccauugugccgcccuuuggguacagucauccucagagaguuggaucugguaggaaggagagaagagacucagugauaggaauguuuaguaaucauguuguugcucacucuuaaguagcuuuauguauugcagauuuugaagaguucuuuguaagguuuuggauucacagguuuauuuuauauaugccucgguuguuucuauaaaugaauaauagugaccccuagagagauauuacccucauugccuugaggguaaucuuaugacuaauuguauguuaaagucaucauacugagucuaccauucuagaagccugauuaaaucuaaauggcauucacaaccugcuuaaagaauuuauaaauuaaagugggcuugggguuugugucuucuaaacaacuuuuauacgguuaaugagaagaaaauuggcagcaaugguggugaggucgaguguguuugaaauauauagcgguguucuagaagaccagugguagguauauaauuugagaaaacaaaucauuaauuugggcaggaacucagcauuuaagucaguuaauuauacccaaggguaaggaaaggguucuaaaauuacuuaacuauuauuugucuggaauagcuuuaggguugauagaagaauggaauuuuggccuuaaccucguauuuccuggcuuuugacugcacauaggauauuuaacauuauauggagacuucuaauuuuaacuauauuuuuaaugaauauauacauuucucuuauaggaaccugaauaguaaucauuuagccaccucaauaauaauuuuacccaaugcuaaaguugauaugauuuacaucaaagaaaaguaugggugcgggcgauuaguaggacuuguuugcaucuucuuacaagcuugagaaccauacgacugggcuaaggacauugcaauugucuugcuuuuuauuuuuauuuauuuuuauuuuuauucuuuaaccuuuuuuuauaguucagacuuuaucccccucccgguccaccccuccccccuacuguuccacaucccacaccuccuucccccagcuucccccucaagaggaggucuccaccccaccagaccuccacacuuccuggguucccaagucucuugaggguuaggugcaucuucugacugaguccagaccaggcuuuuaaaccgauaguuuguaauucagaaagcuuacccuguucagaacgcuuaagcgucuuacuguagacaaguuccuccagcuaggguucaaucauuaagacacuaggagugcaaagcuucccuguugccuacaguccuuuugggaaggacaaauauaaauccuaaauaaauaagcaaguggguagcgcuuucccacuggggccccaguucacuuuuucuaaauuaguuuaguuuucuguuugcuuuugagggcuucuuuugccucuuuuaauuuuguuuuucuuuccucuuucacauggaaauuaaguauguuuucauugauuggaaacacgauguuuuauaaauacacuuauuuauucugccuguauuuuuagggcuguuuucaauccgaugccuuuagaaaggcuuaaugaacagacaggggaaacauggaaaugaagucuucaugguuuucuuuuuugacagaaauucuuugaugacaauguugccaauggagaaggcauuuaauaaagguaaacacccaggaaggauuuuuaaaaauguauuauuagcagggcugagaaauuuacuuucauaucccuugcuugugaccaguucaauugaugaugugaacccaguggcaaauuugaauugguccgugacgacuuugcaaauuccuuaaaagcuaucaguggaagagaguggacuccuuuguugugucguguuugaugaaugcagucuuagaggcuuuacaguuccuuagaguccuuuccacacaguuccuuccauguccuuagaguugggugugugcuugcagguggcuguugugucguauucuucacccagagagauguuaugcauauggauugcugucccuugagccugaggaacauccuaggaaauugucaauugcccucacaugugcacaucucaacagugcaauuacacugauggcuaucuuugaauuucuuacucuaggaacuuggcggggggggggggggcgacggaccccaaguguuuucuucaaauacauuauuuauuaacucaugaaagguaagucuuggacauccggaauaagcaggaaacuuagagcaggaaacuuagagcaguguagaaucagaauugaagcuuccuacaccauaaguccugccacuaaauaccaccuuccuuccccaccacacccuaggugcucccaucgaauguucacucuugaacuauuuggcaugaccaaauagugcuuuccaaaugucaaucaagggcaaggcaagagaguucaucaaagauaggcuauuaccagaccagacugauaggaggaacggcacauagaagccuaugacuguuuuaauauuagguagccccagaaauggaugguagggucugacugcuagacauggacuugcuaaaaucucugggcuaccacugaccuccucugaaggaauucuaaaucauuaauucaccaauauugcucaugauguacccauccggugcugaacuuuaaugaugguugagaaaucacaccccugaauagaagcagggagaggcauagugaauaggggucaaaaugguggguuguuuguguggcauuccuuggagccuagaagaauaagcauuggagaguccuauugacgcgagcuuuaagcccuguuuacgcauuugcuaggucuguggugaaguuccugaagcuggcaccuugguugaugugagggaugaaguggguauuagauagaaggccccuuggcacagugugcuagaggugauguugaucuuuuaaaaccacuucuccggggcugugaaaaggaauaaaaauguggcguuuguguagaacuugccugcaagccaacugguuucaagcuacacgcuaaucccuuggggcauggcagagucccaugggaaacugcucacuguguccuuucuucauuuaaaauacgaucuuucauaagauuucacccacagaagugccuccaagccucccuucccagcccgcucccaccccagcaccaacugaagguuccucgugacuuugacauuggguauuuagaagcagagaaaggauugccagcgaagcccacccacgagauagggcugagcucaauggaaaggcacuugcucaucaugugcaagguccuggcuucugccccaggacuacacuaaagacauggcgagugcauuucugucuuuacagauaaagacuuuacccuucuuuggcauuccaaaucaccaagcaagcuccuacuuauacaaaccagcuaaaaccauuauccagggauucccagugaagacauaucacauccuagugucuaagacguaguuucuggagccagacuacuggguacauauccagcccuguacuuggagucuccaaagauggccuccauugccaugcuccugguuucccagugucccccaggagugaguggaagagacuugugggaguggccuggggcagaagagguuuuagcuuuugccuaaguucuuugucuuuucuucuuuuuacccuccccuccccuucccccuuccuuuccuuucuccuuccuucuuuuuccuuccucccucucuuacccuuuccuuuccuuuccuuuccuuuuuuuuuuuuuuuuuguucccuaugcugggcaucaaaccaagagucacugacuacacccccagucccuccuugguuuuuaaaaauguacauucuagagcccagggcaugguggcauauggcuauggucucagcacuaaggagucuggggcaguaggaugguaaaauugaggauaaccuaggcuauauagugaauuuggggucaaccugagcuaccuaagaagacccucucucucaaaaaaagaaaaaaagauuccaagugcauuuuggaucugaggagaugguuuauucaguaaagugcugaccugcagucaggagaaccugagugcaguuauucaucacucaaguuaaaauaaaaauccugggugucauccuguuuaaucccaucacaggguggguagagacaggaggccccuuggagcucacuggccaaucagccuagccuacucagugagguccagguucagugagagauuaaggaagauacuuggauguuggccuggcuuccauacaaguaugcaccuauauacauauauacccccuacauacaugugcauuugcaugugcacacacacacacacacacacacacacacacacacaugcauaugcaccccagguaacccaagauacuuuguaaagaccaucauucugugaaaacauccguagagagacggucagacagcaccccccagcaguggucuuuaaagcuggcuucucggaccuauuauugagaaagucaucuaggagguccaggccuugagaagacuguuuucugccagcuuuccauaauggaggagagaauucaagcaagguccaucucucugaggccagcgaguccacgguauuacaacaggagagagcagauuguuuuaagccaugaggcuuugaggaauucuguuaugagcccuggauucccuaaacauaugucccagcuguauggccugggucuugcugguuauccucuuuguuccuggguuuccuuaucuguacaugugaauuguauuauucccucgcagaacuauguuggguguuacauuauuucauggauagcauuuaguucaguuagagagauggcucagcaguuaagagcacugguugcuccuccauaggaucuugguuugauucccaacaccuaccugguagcucacaacaggcuguaccuccaauccaaaggggaucugacauccucugcuggccuccaccagcaccaggcacacacaugacacacauacacagacaaaacacucauacacaucaaauaacaaguuuaaaaagcacaaugccuagugcauaguaaacacuaaagaaauuauuuuuuuuccaugaaccaugaacugaacauuuacugucagucaggcucuguugcauccugggauauuauagggaaggucccugaaucgguagugccugccuagaagcaacgaaacauguaagagucaggugaggacaugugcugugaagacuacauacaggacauggaaugaggauugugaacccagcugaaauggggucgaucuggugacagcuaagcugaaauuuggaugucacagagcaucuuuccacuuacaguccucaagaagcuugugaggugaccacuacuccaagugaggaucauuuagucuguggugguaaccucucucugagucucugcucagaguagcuacagcaagcccuca

SEQ ID NO: 5246 - RNA, 45311 nt, Mus musculus
uaagccccgccccggugucgucgccuccgcggggcugaggaugacgugaggagaaagccgcgaaccucugccuccugugggugcugcugggccagcgguucccacagccccggagccagacgugcugcgaagcgcaccgccgagcucuccggccggcggcccccucacucccucccaggccgggccgcucccugugcggccccugcggcuccuggcacggccccgcgcucggcugccgcccuggcgcgcuccacucugucguccccggacgggcgcggaccagcucgaccggggcgccggcggcugggcagagggcgcuggccccggggccgcgccagcgcggccaccaaccuggggcuguccguggagggcgagugcugguuucggggcgaggcgacgcccuucggggccaacgggccgcacgccgauguggccgugggaacgacucacccguuuuccagcucggggucggggucggggucggcgcccaugggggccccgccuccgucuccuggccugcccccgucgugggccgcgaugauggcggcccuguacccgagcacggaccucucgggcgucuccuccuccucccugccuuccuccccauccuccucgucgcccaacgaagugauggcgcugaaggaugugcgagaggugaaggaggagaacaccuugaaugagaagcuuuucuugcuggcgugcgacaagggugagagcuaggcccccuucuccaccuccggacacccuagcacccacuccccggguccggccccugccucaacuuaacuccuggcacucgugcuuuuccuugugugcagcggcuauucccaccucugugcagcccgcaggacuucugccuaauugagcuugagcagcaggcagguagggcgggggcgguggacucgcgcaggugggacguuuccauggcgaggagggagccuugaucccaaaguugccccacuucugucacuaauaaacucuaguuugaaguuacuucuuccuuugggagccagaggcuaguuuuggaccuaauccgaaaauucuacgaauuucccuuaagacuucuccgauuuaugggcugucaccuuguagguuuguuguuguuguuguuguuguuauuuuuaaaaaagacuuuuacuucuguuuagcaucagccagcagugccuuagccuguuacaguugaguaguaucccauuaucuuuaacacaaauaauacgaaaaauccugcccuaguugccgaaacuuuccccaaauuucuggaaccccuuuuaaaugucgguauuuuuuauuagggagaaagauuuauugcuucagagaguuggagggaggcaaagguaguaaaaaaaaaaaaaaaguaaauauaggcgaaauaauguggaauauacugguuuugaaucuaaaaauugaucacuuucuggccacauuaaaagacaagcauggaacuugguugcucccagauugcuuuuaucucuuaucugaaaaacaaaaaaaguacugaaacauucucauuccucaguuaagcaguuggauguugaaaggcaguguuuauuugggaaaacguuguuggaaccaugcagacuucugaagccuacuuccagaggccagcucacacuaugggaaaacuaguuacagaaguuuuuggauuuguucacauauagagguuuaagucaacaacaucucccuaaaccuuuuaaagcauuugagauagguuuuuguuuuuuuuuacaugauuauguuuaaucuuagccaggccaaaaggcaaucccuucuugacauuucaucauggauuuagagccaggauggggagggcagaauuccccguguccccugguuccuccuaguugucuucugucaccuucgugagaggcuugcugcauuauaaggaaggaugcuuuagguuucuguagcagcuuugugugccucggggcucaggaugguuucaaaaugugcaacauuuccuggagaauauaugccacuguuguauuaacaccuuccuuaauauauuuagugguacuuucuguuuucccuauuuuggaggagauuugaagggugugagguuagggaggagagcgguuuggguaauuaagaagcagagaccugaguauuugguugagaaguuuuauauugguagucagcaccuaauauaaagauguguaugaugaggaaaauaauuugcauaaaggaggggugaagagaguauaauuaguauguaggguacuggagcuauauaggcaucguucuauacagcucacaagugucacugguuauagaacuuaagcacucuguacagggacauuuuguaaaucaccaaagcuuuagaacacacuaguugagaaguguaccaugggaagugguucgcgguuauuuuaaugaaggaugguagagcagcuagcuaccuuacuggcauaucuacugaccucacaauguguuucguuuuauucuuuuuaacuugcugcucuuugccuugcuauuauaaacaugaaguucuuaauuguguuaaagcauuggacaaaaagcucuauuaaugaguaacugacuacguccauauucuuuaagaauuuuucucuaauaaagauuuuuuuuuuugagacaggguuucucuguauaucccuggcuguccuggaacucacuuuguagaccaggcuggccucgaacucagaaauccaccugccucugccucccaagugcugggauuaaaggcgugcaccaccaccgcccggccccauaaagauguuuucuuuaugugcaguagugaggaagaguaaggguaaaaauguauguguaugugcauaauggauaucucugagcacacacaaguuaagcuucgguuuagcuuaaguggccuaaugagguuuggaaggcaggcuggcccuaguacagaguccucucuccccugggacguuaaaaacacauuacccaagugaaacauuaguacauuguguguuaagagacugaaggguguuuaaagguuaaaucugaauguacaagcacuguuguaaucucaguuucucuugucccuaguacuauaaacuucagacugauugcaccaaauuuagugaugccaaagaaccuaagacuaggaguaauaguuuaauauagguaaugagaaguucaaauguuacuuagaagccauaauugauaacauuaaaaagcaaaagugaacgaucaggacuaaauuccagcaccaaagcaauuacuuaugaguuccaguaggauuucuuuggguuccaaagcuuuuuuuuuucucuuaaucuguuuuaauauuaauuagaaauauuuuaaguagagugucauaauuccaugucaaaaguauuuuguagaaaguuugguuugaaaagauuuauaaauauucugacacaaaagcuucccacacuucacaacuagccucaaaucuagcuugggccuguaguccauguuggccuggaauucacuauguaaguagucuaggcugaccucaaacuuacagcaacccuccugcuucugcuuccugggugcugggaugauaggcaugagccaccacauguagcaaaacugaucaacauuaaagcugucaucauuucaggaauggugagauuuaccaccauauguuagaaagucaaaggagaagccagugagggaauggagaaucaucuuuccuaacugauauuguaacacuucucuacugaauuucucuuaaggauuuauuagaguuggacagaggaaauuuauuguugcgauacauacuauuacaauugcuagcccaguuuccaguggacuucauagauuccaguaaaaauagugcccauugaggaugcuagaaguccacaaguuauaagaauaauaugcuuugaagaggaagggcuagaacauggguggcuagcugaucccuaagccaaaucuguuuuugcaaagccugugagcuaacucugacuuuuacauuuuguaucuuaaauacuaggaaauguuucuaauuaaaagaaaaguuuuauaacaugagaauucuaugaaauuugaaaaguuuuauugcuacacaucuucauucauuuccguaugcucugugucugcuuggaugcaaaagggucugaguacacuugugacugagguaccacguccuacaaagcuuagcauauuuuaaugccuggcccuuuuccagaacaauuuuguugcccccccccccauguuaaaguacaaagcauugaguaauaauacagaaaagagcccacugugaacugaauccaacuucauuuuggacaaaggaaacuaguuguuuaaaggguuagagaggagugugaguugagguucagggaagugaaaaauuauaaaacagcagggaaaauuuacaaaaagugggugguugauuuaugguaauccaauguagauuuguuaucuggcacuaagggggcuuagauggcuauccuuucagaggggccaggaauugggcccccaucuucaaugcucaaaugaacugagagugaugcauuggcagccaugacuuuucuagggcaugcauuuacagagaaucaagcuaguaaugcaaccuagagcuauuagaaaguauggugauguuuuguucaaggcuuuaugggcuaugauagaagccuuguuggggggggggagcauuagcuugcuuaggauuuggucaaagagaaaacuuuucggugggcauaucaguuaagagucuuuuucauacccagaaggauggucuugguuuggaugaggguuugcugugucacagggacagggaaaugaguaugggagauacucuagagaucggacugagaugacuugcuguuucguugccacaguagcuaugaaauagacugaaaaauuuuucuucuuucuuuguugaacaaagacaacugucuaguggcuggggagguagcuuggcagauaaagugcuugcugugcaagccugaagcccggaguuugggucucuggccagcaaaagcagagugcauuaguaugaggcuguaaaccugggcaagcagaucccuggagcuuggugggagccagucuagccaaucagugaccuuugagcucagggagagauccuggcuggcaggggcugggggagguggaguggcgguaguagaagaccagccugaaccucuagcccccuccucggcacccacacagacagaaauacacacacacauacuucucacagacucacaaauaaaaauaaaauuuaaaagcaacuauauuaucagaaacauaaggggauuauauugauuuuccaaagacgagauguaacuugcaaacaguuucccuaugaaagaacagaguaucuggcauugcaggcauugugacuagcaucugggcuguuaacuuccccuuucacauauguauugguccucacagugaacagcuguucuugccuuuaugacauaucacuuuaaacgacuuguaaauauaaacuguaguaauggagcagcaguuaagaaggcacggcuggaaguauugcagaguugcugaaacuccacaacuuuagauuuggaaagccuaaugaugccaagaagguggauuaaaaugaguaccuucaccuggauaugccuggauaugccuggauaugccuggauaugccuggcuagcgaagcagagcuugauggguagcauucuccuauccauaggcuuagaaucagauucaucugaaauacuccuaaauguuacuuuuuagcaauagugaugucauuuucauggauuauucggacacucuugguguagcugacgacuuaagagcaucacuucaucaguggaauuuaaauguuaauuagugcugugggagaaugauuucaugacuaguuuuuauucuugagacaccuaaggagauguguugucaagaaaacuaauauucagcuucuuuuaaaauguacaaggaccauaagcggacaucacaaauaauggaaagguuuuaguuuucacagaugagaucuguuaacuuacuugcaauauugcuuuucuuacucauuuagucuaauguuuucucucuggguaucaugaaauuauuucuucuccuuccaguuuccacucugauuauccuuuuccuauuucuuacaggcaucuaaagaauuacuguauguggaauguuuauuuguuuuguguuuagaacaguaaaauggaacaacuaucccacugcauucuuucucuaaugagaguuucccuuucgguuuuuauuucuuuuuuccucacacagucucauuagugggcaaauauaaugggccuuuggugacaguaauccccaucuuccccacaugggaugacaaguuuguggccuucaaguuaggcagaagacagccugccagcuccugguagaucaaguagucauaauagccccaacuuagcuuucugugagcuggauguuuucuguuuacuaauacucuacaccuccucuuccuuaacaagaugguguguguguguaugugugugugugugugugugagugaggugggggggagagagagaggugugaaaggagaagagagggagggaguuaaggagggagggaggaguaagagcauuuagguacccuuauuaugcauacugucaaguucauauuacuuuuuaaguguaugcuuccccucuuucuaauaucuucucccucuggucuccauguuaacaaaucuggugcaugaguaaauguguauguauuugagaucuaaaacuaauaucuuuuaaguuucauuuuauuuuucuacaguagccgccagccuguauuucgggguauucuauauuaagcuguuuuacauaucuucuuuaaguuuuucuccuuauaccaucaggaauuuuaaauuagagauuuuuauuacauguuacacauuuauauuuuucuacuucuguuuuauauauacuguuuauaucuguauuauuuuaucaagauauacuuuuuuuccaggaaauguucacauuuucugugcacauguccacaugcaaagcaaaaaugaguuuagguauuuuuaaucuuuuaauucagcaggauaaaauuuucuauauagucauucuuguuuaaugucuuaaguauuaaauuauguuuguguauuguuauuuaggugacuauuauaugguuaaaaagauuuuggaggaaaacaguucaggugacuugaacauaaauugcguagaugugcuugggagaaaugcuguuaccauaacuauugaaaacgaaagcuuggacauacugcagcugcuuuuggacuacgguugucagguacaaggcuagaugauuuuauccaguagcuucuaagaauguuagcuaugccuugcuuucaucuguccuucuagcuuacuuucuuuuucuucgcuuuguuuucuucucuuccuuugucuuucuucuucuacuugguuuuaagccccuaaaaaguuuacaaaacaaaccaaaauaagcuuuuuaaguauaauauuuuaaauuuauuuauauuuuucuuccuguuuccuuucccugcaucagacggaaguaaacuaucaugaauuauuaaagcugacauuauuuuuauuacugauaggauuacuauuuguauuauauaccuaaaaauagugcgagugaucuagaagcgcaaggggacaagcuuuucucugaccuggguuauuuauaggcacaugaauaaauguuccucacaaaacaguuuacaguucaauuugguuuucuccuaaguuuauuauguuuuccuuuuuguuugaaauuuaguguuugcuuucaucuaaagaugaacgauuuguuuuuaaaacuggagaggaaagaacuuucauuugucuuuguaucuguuaagguggaaaagcagacaugcauguacguugugaagguauagucuaaugcaucauuuccuguuccuuuuugguucacucaggauaaauagcauaggaacucugaucuucuguuguagcuguaacgaggcagaguuuuggaguuagaucaggaagcgcucacagcauauuuuuuaaaguacuguaugugguuuuagguacaucccuauuauuuauauuauaauacaguaucaugacugauauauaagccuguguguguauauaugcaugcacgcacacgcauacacacacacacacacacacacacacacacacacaacacacacaacacacacacacacacgguauagaaaagggaauuggguauccagucacuuagcugucuagaacacaacaagagacuaaaucaaaggucuucuguaccgcuguacugcuagagucguuuugcugaaguuucuagguuaaauuuaguuauagagcacuucuucaaagucucuauuuuucauuuuagauuucguuuuuaacuuaauuuuuuauuuuucugaucugaagagaaucaguaaaggcaauaaaaggggcauuagagcuguagcuaaacaaaaugaagcuugggaccauucacucacacuguuuaguuagagguugucagcacugcaugucugcuuggugauuaugcuuuauaacagugguuuagcaucaguaagggaaauuaaaguauacucacuagcuuagugaguauacuuaagcuuucaccuuagaugaaagcacauauauguauguauguauguguguguguauguguguuauaaaaacagaaaacuuccauuaaaauuauuuaaaauuuaaaauuaaacacuuaaaggcauaagcuucaguuaccuaggaaauaagacuauaaagaaauuaagucauuuuggauaagaaaugcuaugguauaauaaugguauuuacauacauugcuuuuguguagcuaauaauucugcaguacacaugguucuaucacauauuugaucacauuugaacaccacagucagucuaucaagaugcuauauuuuauagauuagaaaacagaggcucacagacuuuauuguauugcccagaguuguaaaaucaguaaaggcaaagcuaagguuugaauuuaaccuucugacugcaaaccagucuucguauucugucuaaguuaccugggucucacucugucagucaacaaaugcccaagaccuuuggcugcauguggugguggaaacaagagaguucugacuuccacacagugaauccucaaaugaaguagacagcugaagcacaugugcauuacaaagggauuuaaauauaaggcuguauuuuauaaguccugagcaguaacaaugcuugaugcuuguauaugguuugcaguuacaaaacuggaaacuuggcguuuuaucuuggguuguaucugugguucucaaauaaauaacuuugcccacaccaagggauauuuggcaguaucuggaaacauuuuuagucucacaguuuguggguagauguuauagauguuacugaacauacugcaauacccagggaagguacuacaacacuacccaaaccauaccugacccaaaugucaauagagcugcuuuugaaaaguccuaauuauacuuaaauuaaguuuugcaauucaacauaaaugucuuagcaguaauaauaauagaagacuauuguggguuggaguaaucaagaaaacuagguuucuguguagcauaugugaggccuugcauuugauuccuggcacugaagggguggaggaggcuugcuugcaucuauuuauuuauguauuuauguauuuauguuuaacguaucgaaacuggagaaaugguuugguggauagaagcacuugcuacucuugcagaguacaucaaguaguucauaauuccagcucuaggagacucgccuggcucugccucccaagugucaccaacacuuaccuaaaaauauuccuuuuaaacauuuuaacaaacacgucacuggaagaaugucuucugagcucaguugggaaauacuaacauugggcuggagagauggcucaaugguuagagcaccucucgugcuugcagaggaccuugguucaauuucugauauccacacagugacucacagccaucucucuguaauucuaguuccagggaauccaaugccccuuucuggccuuugagggcacaauacagacauaugguacacagacauauguucagauaaaacacccauacauguaaaauaaaauucaaaaauaaaaaaagaaauauuaacauugcuaacuuugugcugcuuugugacagugggcuugaccuucugaucuucagaaagauaaaaaacuuguccagaguuacucugucaauggcagacuugaaaucugcaccuguguccuagagcccauguucuuccuguuaccuaugucuauuuucaagaacuuagagguauuuaaggaacagaggcuucaggaaagaauaugcagauaugagaaaugagucucuugagauagugaauucagucuuuagaacaaaauacuggguuuguaauauaauggaaaucucaagaaaauagcaaaaauaaaaaagaccuugaaugggaggguaagcauuugugcuuuaacuauaguucggugucuuucaaugcauucugauagaagguguggcuugugcauuguguuuuacauaggugaccaugguaaucaggcuuaggcaagacuagaaagauagggagggcucuagcccaugugagcaacuuuuguaguacuugagugugaauucuaagaugugaacuggaaagcugccuauaagagcagucacagcuaucaugaagggggcuugaggaauccaagagcuuuauuaaucuuuaauauggaugacuaggagagaggagagaaaacuagcaagucaggagaaguuaggcuugaugucaaaauguucaguuuccaggcuuuaacuuugcuuuuugggggcugucugacaaugaccaaggugucauaagaaggaagaugacccaguauaucuugagaauggcugguaucacagagccaagaguacuacagagucauucuuagggagcauuuaugcuuaagaaagggcacugcaaagagggaguugcaugaguuauugacaguuuggggucaguuagagugguggugugaaagccaaaggggaacuuucauuuuguuuguuugcuuuugcuuagaaauuaagacccaaagaggagagagaaaaagucauuggacuuccaaaguauaguacugauaauucagggaacaugauauaaguuaguuugauaauauuaacagugaaauaaagcagaaaguauuuagagacaauggaaagauaagaucaaguuaaaugaacgaaaggagaaaacguaaaguugggcuaugugggacugaugguccuuggaugaaggaccaaguucuuacagaguauaccagagcauuaauauaugcugcacagugggaauuaaguuuagaaaggaaauaaguagcuucacgcccugaguguagaggaagggaugggagcugccggaaaagcucugaggcaagagggaagguagugguuucaauuacauagaggguauauguguucaauaugcuuuaguggaaaugcucagauuacugagaaaucaggaaagaaaauugagugaguaauauaugauuuuaaauauuuaacaauacuuaaaauguaagggaagaggguugcaaguucaaggccagccugcuuucaagacugugucgcaaauacauuucuucuuaaaaauucaaauauuuuccuuuagaacuacuauuuauuuaucauauaucauacuauuguauagaacaagccaggggccacccuuuaauuacaugacuuuuaauacaaauacuuuuauagcugaagcuuauccuuuuaagcauugacuguuaauacauuuuuaccccuuacugaguagugugucugaauauauuuuaacuuuaccaucauuaauuggaguucuugagaauauaauaauuuuacuuugccucacaaaguccaaaauuauuaacaauuuguccuugcauuaaagucuguagacugcuguguuccgacacugauuuugcuauacugguauuuuauucuuuccauggucaacuuuuaguuuccuucuuguuuuccccauuuuuguugauuuuauucuagcugucuauuauucauuaaagaucugaggaaugcuugggaaagccaagucagugugcuuaggccugucucuucuggaaacaaugcccauguguagcuccgugacuuggcuuguucuguuucauuguuucgaaagguguuguucuuguuguuguuuuaaguuguaaauaaauucagggccauauuucagauuauugaaguugccugguguuugagagcaguugcauuacuauuguuagcuuuauugauuaagauuaaaacuuuaaauaagauaucuguaauggaugcuaggcucuuguuuuuaaaagguuguuugcuucaucugauugaagagaagcauuaugaagcagaagaaaaggggagggguuggugcacuuuaggguuguaucuaacaagagauuaaucaagagauuaaauuucccauccacugaggaagcuuuuccuacaggaacguauaggugguuccugagagucuaaugagagcuccagccuuucuuugcauuaucuaaugcuauuuucaacaucccaugaaagccugccauuuugagucuuauuuuagucuuuauuuuuagucuuauuuagucuuagucucuccaaauaaggagaguuaaaaacuguauucuauggaucuauaaagaauacagaucugcuguaguuucauucuugggaacaagaauauugacugauauaaaaauaguaaagguucuaucaguuaaaauuguacaaucuguacaauuagauuuaaauucagauuaaaucauuauuacuucauuuuucugcuauuauguuuuugccuuugaaaaaaaaaucagaggaaccaaaccuuggugucaugguugccagcagcucauagccuuuguuauagagaaguuuggagcccugaguccugagucuguuuaccuaugccucugguuagaaguagaucuacacagcagguugaaauuggaacuguaaacucuucccuaccuacgccagcuuugguaacuggauucuuugugauuuauauuuaacaagagugcugguaccagugucaaacugucuagacccauguauauuuugaagaugagaauaaagguguccccuuuuguguauuuuuccauucuccccucuugucagaacugcacggauuacguuacacccaacauaguccuucacuuaauagcucauagucaauucuuuaauaaauuugaaaccuuaagauuuuucugguucauggcucaagagaaaauaucuugaagguuuuuuuguuuuuguuuuuuagcuuugaacauugcuuggaucagcacuuccauauggagucccuucugggaaauaguuauuauuuuaccagguugcgcauugaaaccagaacaaaaauguuuauacugugguacauagauguacuacugacucuggcaagcaaauguacuacuuguacaauauacauuuuuuugaaaaacccaauacuacuguauauaauacaguuugaagaauuuuaaaauaaccaugaauuaguaaaaauaguuuacauuuuuaucuuccauuuucauuuuuaacuuuuauuuuuuuaaaguccgcagaugcacuuuugguggcaaucgacucugaaguagugggagcuguugauauacuacuuaaucaucggccaaaacgaucaucaagaccaaccauuguagucaguacucuuaaauauuuauucauuuggauuuuuaagccaaaguggaucuccugccccauugccaucuuuucucccuccuucccagcuuauuuuguuuuuaaaaauauugauauuuuuacuuuguaaaauacuacuuugaaguaaguagagacaauaauaauuaaucuugcuuucuggaaacuuuuuuaaaaaauuaguuaauauuuacauauuuuaucagugugaaccaguauuuuuaauuugggauauucuucaggugaugcugaaaauacagauuaguuucuagguagauuuaagaaauguguuggacuagagaaauagcucagcaguuaagagcacugauugcucuuccacagauccugccagcaaccacaugguggcucacaaccaucuguaaugggaaucugaugcccucuucuggugugucugaagacagugacaguguacucacauacaugagauaaauaaauaaaucuuaaaaaaaaaaaaaaagaaaugugagugaugaaaccauaaaaaauggaagaaaauauaaguauuuagcugucugguguagaagaauugcuuuagcuuaaaaacuugaguaaggacuauagauuguuacaaaagccgugucucaguuucagaugcuggguagauguagaaagcuguggaucccugggaaacaggcacccauuaagcaucuccaaguaaaaccuagagauaggccuggagacacauaccuucaaugccagcacuugaaaggcagaagcagggggauuucuaugaguuuguggccauccuggucuacauagcaaguuuccaggacagcuagggcuacacagugaaacccugucucaauuaauaauaauaauaaugauaauaauaauaauaauaauaauaauacagaaaauuugaugcaaagcaccaaaaccuauuagaaaagaacauuuagaaaauuucagaaaauaaaacauaaauuuuaaaccuaauuuuuaauuaaaauuuuaauuuuaacaaaaaaguauaagauaauaaauuuuguuuacuaacaaccaaaucguuuauuaaaaccuaaaauuuuaaaaacauacuacuauaggacaggguguuuuagaaaauauuuuggcaaggaacaacauacacaacaaagaaacuuuuauguguagcaguggaacacugagauacccuaaauauccuaaguacagcucagucuuagaucacucaacuagcaugcccuugauuacauuccuaggauaggagggaaaaaagaaaaagaaaacauucugaaugucaaaacaggaaauauaaauaaccacauguauaaacuuuggaauacaaggcaguaauucaaauuacuuaaaaaauauuuugagacaaguuuuaauguauuccagacugccugaucuccuugauaaccaagaauaaccuugaacuccugcacuccugccccuaccauucaaauguuggaauuauaggugugaaucaccauacucaguuagauaaaaugaggauuguguacacacacacgcgcgcacacacgcacacacacacacacacacacacacacauauaacugaagguugaaaguauacauagaaaagaggcugagagauggcuccaggguucagagcacuugcuauuauuucagaagaccuggguucauuucccacauccacagagucucucacaaccaacuacagcucuagcucuagaaggcccaucccccucaucuggcuucuggaugcuacauggacaugguucccagcauaugcagaugaaacauucauccacauaaaauaaauauaucuuuuaaaauuucuuaaaaaugcacaugaaaagagauauggaaaauuaagcgaauguuacuuuauaguagucauuucuuagugauugaacuaauuaaagauuuuucuuuuauauuuuuauugguuuucucaguagaaagauagucauugaaauauuaauaucaauuauaaaugagauaauuuuguacauugaauuuaagaauuuuuaacauuuauuauuguugaagguauaguaaaacaaucaguuuuaauaacugcuauauuaucagcugauugauuucagaauaaaauguauuuagagaacuaaacaaauuuuauauucauuuagacuacuaagaaagccuaugguuggggaccuguuguuguaaacagaguauaauguuuucugucaugcacacgcuccagguuucaacuuucagacacaaacacacacacuuuaaaaacuaacuaacuaagaacaacaaaaagugugacuuuccuagcacaccucuaaguucgaaugguggugagaaaccaguaagaagggaaugaagaggacugagaagagguucugucacugacgggcaaaagcuaacagaaucccauucaauucccaccaccuaucccacaguuacuacuauauuuguauaugccuguccaccuucuagccuuugaacacacugccuuucuucagagcgagguggagugcugugugccacuacagcaguggcaagcauuaucuccucaccauugccaucagcaguggaaagccuuggcagucccagcugcucagugaagaaggcacuuucugcugucucuaacaaguaaagguuacucagucaguggcuauaaaaucaacuuuuaacagcuuuauuguuucuagacagauacaauuaaauauuuuaauauauuuuucuuuuacuauuuaaguguguucauucuguagccuuggcuugucggcuugucucuucacuauucacuuuaaaauaaagguuauuugaaaacauguaggucaugcuaucagcagugaaauuauacacuuuaaucuuacacaugucuaguagugcuguucuagcugugagcuucauagaaaacagaagggucacuuuucaguuaggacuuuaagccugagaguaaauauaauuuucuuuuugaucaauaacacaaaucagaaaaaguaccuauuuuaggcuuuuauguaacuguugcauaaauucaugaauaugaaaucuccaauaaauaauugaaagguacaugaacaaacuucauaaaagaaaagcauaugaaaaaaauaucaaaacuuaccaguauuuaaaagaaaguaaauuaaaauaucauuguuuuucacucauauuaagagugaccaugccauuugcugugaguaaaacuuuauuauaaaauggauacaucccuuuauuaucaagaauuuaaaccauugaaaagauuuugacauuacguaucaagaacuucaaauuuuuuauagcuuuuuaaccuauacuucuaguucuagaggaggguuuauaguaaugaaauaguccuaaauuuguaaaaaaaucuauuuuauagugauauuugcuauaacaucauuuauaucacaaacuaucuugaacccagauuuugugaguuuccuuaaauugcaugcaaaauuccgugcgugauuuggucccuugaagauccugggcucucaggcgaagagauuauucucucaaucuuugaguacuaggaacuauugcuuuuauuaagaacuguuguuuuuaucacucaugcuuagcacacuaggauguaugcaaaaugugucuuuuaaaaggggugaaguuaagaaaggacuagaaggaaauacugugcuauaaaauguuauuugaguagaaggaauaugggcauuuuuauucuucuuucugcuuuucuguauuuuucagauauuuuaaaugaguauacacuacuuuaacaauguuaauaaaaguuaccaaggugugagcuugaugagcuaacccuggagucaaacagcucucaaggaaaccucugcaaaaaagugagaagcauuggcaagaauaugcaauagucauaaaauagccaaccuuuuuauuuaacccgauacuuaaacuacuaaauguuuugucuucauuucauacgaucauuggccucaggucccaguuagugggaggagucagcucuuggcugacugugguuccgcacauucacuucucugagccucaguuucuucacgguuacuaaguacacucagcucuguaguucccugugggcauuagacgggaagauaaaugacugacagccccaguccuugcuaaguguuagcugugacuguaguggucuugcacauuugcgacaggcugcagauuagguagggauuggacuguauaaagacguagccucauagccaucuguaggacaagguaggccacacgggugcaaacuuuagcuuuccucaugcauuuaugcuguggcugcucuuaacauuuuuccauguuauuguuuuccuaaaauucuuguucuuucuucuuaucauucauguuucuauuaauuuuuaaaaauauuaauucuuuuucuuaaauuauuucucuagaugcucuugcuucuauauuaguaaaaaauggaacuguaguauuaggauguugccuauugaagauuguauuuauuauauaacauuuguuaauuaaaacugaaauuuuaaaguuuuaaaauaaugagucuaaguaaaauguauucuucuuaaaauaagccuuauguuccuuauuuaauauuacuuuuauuccauccuuuagauaaauauauuuuugaagucacagauaauaaccuuuggacauuuauaugaauauuuuucagaaacuuauggaacgaauucagaauccagaauauucaacaacgauggaugucgcaccuguuauuuuagcugcucaucguaacaacuaugaaauccuuacaaugcuuuuaaagcaggaugugucuuugcccaagccccaugcuguuggcugugaaugcacacuguguucugcaaaaaacaagaaggacagccucagacauuccaggugaggaaaugaagauuuugguaaauagaaauguaucaaagcaccugucgaugacacuuacuuggggaaaaauacucuuucagugcaacuuuuaagaaauaugcuugggugacauaggagagccagauuucuagcgccuuuguucacgagguaaauuagcaagaguggaaaggcaccacuuggcaccuuauaaaaaaaaaaacaaacuacuacuauaccgucaucagcaccaccgucaugauggcuuuuugagguagagucuuguguacguauauacacuggcuagccuggaauucaucuugagggcuuuaggcuaaucuuaaagucgugauccucugccuuucuguuucuugaauacauggauuguaggcauguaccauuauucuuggaagaacacagcuuaauugagaaaugugcaaagacuguuggcugcugcuuucuccucccagguguuuguagccugagacagcugccuacagagaucuccuacugagaauggcuagucccuccccugugcuguacauauuaaaugugcugagagguuccagagguagcaaaacccacccugaccccagcuucacuguguaugugccugugugaguguagucugucuuuucuucauucccuucucaugcuuugucaggguuccaagacccaaguucaaagguccugcuauauuuguuugccaccauuugugugcugggaaccgaacccagguccucugcugaggaaugagcacuuuuaacuacugagccaucuuuccagcccacaaaacuucucacuaaguauuugaacucuucuugccucuuauuucccuucuuagaccauauuuauauuucuaucuuuacuacuuaucaucucuucccauuucgccaguugaaauguuaacaucaagaaaggaccugccuucuuuagguucaacaaaaucacuccaugggcaguguuauuagagguguggcugucaguugguugagaagucagcuuuucagcaaaagcccuuucugugcuuuguaugugguuuuugauacccauuguagcagcauugagagauauaggcagucuuagacaugguagcacacaucuauaaccccauuuccuagaaugguaaggcagaagaagggucauaaauuugaggccagcagaggguauuuagaaaauuacccugccuuaaguauuauuauacauguuauccaaagauguuuucauccuaaugaggcagguucauucauuuccuugucuguaaaguagaacuguuaaaaaugcagugauauuuuagaaauguuuagguaauaaauauuaauuaccaaaaaaugugauauucaggguuuuugguuuuuuuguuuuuguuuuuuguuauuuauuuauuuauuuauuuuugagacaggguuuuucuguguaucccuggcuguacuggaagucacacuguagaccaggcuggccucaaacucagaaauccaccugccucugccucgcuagugcugggauuaaaggugugcaccaccacugccuggcucagcuuuuauucaauauaugguucuuucacacuuuuuuuguaaaguaguuaaaaauaguuacaagcucacuugggagaaacccugucucaaacaaacaaacaaaaacccaaccaaacaaaaauaguuacaagcugagggccaccagguuaauguuugcugcuuuugaugguuucaaggcaucaacaugguugaggagggauaauaugauuucucuuaauguguggcuugucuacaaaaucucuugaccugugaauuauuuuuaaauguaguuuuauauacauuuauacaaaagauucccagaauuuuuuacuaguaacugcuaccuuaauucugagggauuggaaaauauaauucauuucugacaaaguguaaaggaacaaaccaagcuuuacucuuuuaaaauguaaaauucuaaucuuaggcuauuuaugaaguuauuauugaucacuuuagcuucagagaauuuaaccauuuuaaacuaacacaccaugcuauuagcaauucucccaguacauagaaacagcagagccuaauuucuguguccauguuggaacuauuuggcaaauucugucuaaauggcaucguuuggcugcugguggcucuugcacaugguccugcauuaagaacuuguuaauauucuuuaggucuuuucuuuuuccaaacuuacauguuacccacaaguguauaauugucuagucagcuaggcauuuguagacaugcuauuacuccauauguggcuuucucauuuccagagucucuccugacauuccugguugguccucucugucacagacuugcagucucagucuugagaagcaaguuuuccuuuggucauuuugcccaggccaguguuugguucuucuggcccagcguuacagguucacuagcuuguacugauaaaacuacagcuuuuuauugaauggggaauaggaaggacugagggagaucucagcuauaaacucagugggaggcucaugaaacuugucaacaguaaaagguucugaauaugaaauggcugaaaauuaauguaaaaucauacagugagugugaccuguuucagagaucacuuugccuacugcacauggggucagccuugcuugcaggucuuuuaaagucaaucaauguagauuuaguugucuacacaucuuuggguaguuauagugcaggcaaaugccucuacaggaauacuuaagauacagauagagcagauauggugauaccugcccaugaucugagcugcuucaaagguugaggcagaaggauugugagcucauggccaguguggguaauggaaaaagaaaaaagacaugcagacaagugaaugcaguuugguugguugguuugucaguuuguuuguuuuaauaugguaucuugguauauuucccaagcuagcuuugaguucaagcaauccuccugccccagcccccuguguaucaaugaaugcagacuaucuuugcuuauaaauaacauuaaagcuauagauuaaaugaggaaugugucaguaaauuuagaauuuuaucuagaaaaaauccauuacaaagaaaauaagaaguuaaacaacggaaaagguauuugcgucacuuuugacuugagaaaaaucaauaggaaaaagugggcuaaagaauuugaacaggcaguuuacagaagcauaacuauaaagcucgaacggauagaugaucuucuaaagaaauacaggcuagaacagccuaaagccccauuuucuauuaaggccaaauuuaggauggcagugccuaauccagugaauauaacagaggcuugugggaaauucacuuuuuuauuuuaucgcucucaauaauaucugagaguauaugauaugcaugcuguuuuugcccaacaauuugaaccguauauaggauguaagaauuaaagaauaucuguuguuucguuuuuauaguagaaacaaauuaggagcaacuuaaguguucauuaauggagauucuguggacagccaucaaauggaaaacugguuguaguaaagaaugagauacauugaaacauggugaccauagagcaggacuguagcauucagguuccuggguugucuacucuaaaaugacaagugugcauuaaauuuuuaugcaaaacacauacauguauuaaaucucucaaauuugugaacuacaaacuauauuuaaauguuuauauuaaagaauuuugaugaauuguuuauuuccuauuuuguuauugaaaugggaauauuuauuaaauuacagagaauaaagggauucguucacccaauuaucuagaaacuauauauaauaauaauuuuacucauaacuaguugaaaaaucuuucaaaauuauaaccuggaauaaugagacauauguuaaauauaucuaggauucugaagaaguuuaagcuuugggagaggaaaacuuaguaaucguucaauccauaucauaguagguauuugcuagcacauuuucuuuaaauuuauguagguucagggauagcguuuuacuuuauauuauaaaaggaauuuuuguaucauuucucuuuuuuuaaaaaguauauaucauuucaauuaacuuaauuugauaauaugaacuauaaacaaaaauaaaauuaagaaaggagaaauacugguuuuaaauuagaucauuaaaauauauguguucauauuuuccagacggauauguuaugugacaggaauuauaaauagaauauuucuccuacaauuaagauguucagaaguaaaagaauauucaguuuaaccauugugaauuuuugauuuuuugaggcaggacacucuauagucuuaguauaguuaugcagcugacaaauuaauuuaauaggaaacauuuaucugacaagaaacaauaaguguccucuguguagucauaaauacaacucgauuaugggggguuuugucauucuuuuuuaauuauuauuuuuugagaacuuuuuacaugagcauguuaucuacauaauucucaccucucccuucugucucaagcucuucuuguguuucuccucugaaauccaugcuuucuuaauuauuauugauacacacacacacucuacugaauccauuucauguuguuuguaugcauguguccagggaugaccauucgggauugaacauccuguguaggagcuauccuuggaggaaacuaguucuuucagcaggcacuggcuaccugcagcuuguucucuagggguggggccauaugaacuuugcccucuguacaguggcacauccucugguguugucauuaugcuggucuuguucaggcagccauauuguugagauuucaugggugcauuuucacugucauaccuagaggacagucuguaggaaggggucugggccacugacucuuacagucucucugccuaccucuucuguguuuccccccaaaccugagauguagggguaaccuuguagaugcaaaagaugggauugugcacccaaaagcuccugguucugcauuuugaugcuuuucuaaugagguacaagagaugcacucaucuguggguauaaagacaaggauuuagaaguucuauugguuuaggaaacaucaguaagcaguaguuucuccucucgggucugugaccccuccagccauaugaaguuguucuuguucuguaucccagauuggccuaaaaccugcuuuguaaccuucaaaccccaauccugucucagcuagcugccugagagaugaaacugcagguguguauauaccaagacagccacaauuuugaauguuugaaaagagacaguaacuuaaagcuguggacaacauuuuccaauguuuguuuucaaaauacuuaaguuuuagguguuucuucuuauggaaauaucuugaaauauuuauacauuuauaaagauuggagaguaaaacuaacaaggguauguuuguguuuuuuuguuuuguuuuguuuuuuacauuggguaauuaaauucuaucacagguuucgucuugauaucuauagaugucuggccaguccagcucugauaauguuaacagaggaagauccaauucugagagcguuugaacuuagugcugacuuaaaggaacucagccuuguggagguggaauucaggugggaaaaaguagauguuguuuguuaugucuuuuguuguagacucuucugccucaaucuuuucauaagcugacuaauguuguugacacuuagaauuuauuuucucugucuaaggaacaugucuuggugcuauuuagucuauuccuccucuguccuuucucuuuaacccccaaauccccuugagacuauccuuauggcggaguaucuguuguagaguccucuuggcagcucccguuugaaaagugccaacagggacuguacuugaaaacucuuuccuuucauaguugcuuguguggcucugcuccaucuugaaaaguuaacacucacuggaacaggaucagagacucacaguuuucacuagccuuaauacaggcauauauaauguguucuucaaaguccugaguccagagacuuaugaaaaaccuacaaaguuuuaaaguuuagaacuacuauucuuuaaguacauuacauuaaaaagaaaaacucaauaugacaucugucuuacuuaggguuuuacugcugugaacagacaccaugaccaaagcaacucaugaaggacaacauuuaauuagggcuggcuuacagguucagagguucugcccauuaucaucagggugggagcauggucugaaggucuugaggagauugacuuccaggcagcuaggugaucucaagcccauccccacagugacacguuucuuccaacaaggucacaccuccuaauaaggccaagcauuuucaaacuaccacaacacacacacacacacacacacacacacacacacacacacacacacauacaauuugagaaacuuacaagacauaguuaaaaacuuaauuuuauuaagacaugaggcuaugaauaaauuuuauuuuauuuaaguaugaagaaguucuuauuuuaaccuuauuuuucuuuccauauaaauuagaaauuauauaauuucuuccaaaauugauuuguacaacuacuaugauuguaguacagucaugaacaaguaaaguuagauuugaauguuaucuuaaaacucacuuauuucaaucugguauucaguaggcagagaaaggggugcaaaugcaagauguuuuuacuaaugucagcaucgaguuaaaagcagagguaagccgggccugguggcuuacgccuuuaaucccagcacuugggaggcagaggcaggcgaauuucugaguucgaggccagccuggucuacagagcgaguuccaggacagccagggcuaaacagagaaacccugucuggaaaaacaaaaaacaaacaacaacaacaacaacaaaaaaaaacaaaacaaaaagcagagcuaaaacugaaugaagcaaaguuauagcucggcauugugccacauccugcagucccaccacuugugagguggaagcaagaugauuggugugugaagccagcuccugggcuacauaacaaagcugugucucagcaaaacugugucucagaaagggagacaaggguagggcauggugacacacaucguuaaucccugcacuugagauacagaacuauugugaguuccaaggccaaccuggucuaccugaugauuuccuggauagcaggguuacacagugagagaccaucuuugaaacaccaaaaaggaaaagaggagggagacgaaacccauaaaguuauauuagagugcaagcuccugguucaccucuaacugaaucucugucuaaacuacacaagcacuuaauuaucuucucauaaucuauuagagguuaaacagauuagaucaauaaauuauguauuugcucuagccaucuuaaauguuuauuuaaagaugagguauguuuguuauaacacuuugaugcauguuccuaccugcaguuauauauuccuaagccagaaggcauguaauaaauacuuuauuugucagagaaauccagugaauuguucucauguuauguaauaauguaaaaaaugagaaaaauguuugccucuaaggaaaaggcugaggauugaguuguagcuucacacagccaguuccuggacuagucacccuguaggaagaguaagcaguggacaccuuccugcucucauauuuuuuucugcaugagaaaagagcugaauacaauuauuuucaaaugucuagccucauaugcaugaguaauaguuaucugcaacauacuuauuuuugauuaacugaguuauaaauuuaauguaauugauguuuaauaaagaauuauuuacuaaaacuucauuucucacaaauuauguuaaagaaauguuuuauaaguaauucaaagacagugguaaauguagaaaauaguacuccugaagaaagucccuuaggagcugcaguuagugggguuuuuaacuugaauuucccucaaaugagugcuuuuaagaaaucuuuuucaguauuagaauagcaugcauauguuguauauaacugaaaguugcuguaagcuuacauugcccaguaauaguaaaagcauuguuuuuauuguuuacaugacuaauaucaagggacauuuuagccaucugugaugguuugaauaugcuuggcccagggaguggcacuauuaggagguguggccuguuggaauaggugugucacugugggcaugggcuuuaagauccuccuccuagcugucuggaagccauucuuccccuuucugucuuuggaugaagauguagaacucucaucucccuuagccucacaucugccuggaugcugccaugcucccaccuugaugauaaugacugaacuucugagccuguaagccagccccaagucaauauuguccuuuauaagaguugccuugaucauggugucuguucacagcagaaaaacccuaccugagacagcaucuuacagagaaugagaaguaagugaagugaagaacugagcaaguuuuauuaaacguuucucaguguguauaaaguauacugugcucaccugaaaucaucaguaugggcacaggaagucuguuucuccaaagcuguggagaauuucugcaccagaaagcucuugugucagcaagaaaagagaagaucuuauguaguccugucagaauuuaaauacugcugaguaaaguaauuucuagugauguaaucuccuugggcagugggagugacauuccuaauagagacugcguuuuguaggaaugauuaugaagagcuagcccgucagugcaaaauguuugcuaaagauuugcucgcacaagcccggaauucucgugaacuggaaguuauccugaaccauacaucuagcgaugagccucuugacaaacgaggacuacuagaagaaagaaugaacuuaagucgucugaaacuugcuaucaaauauaaccagaaggagguaugaagcuuucugugauauauuuauuuucuuuaccuugguucuuaaauaaaaguuguaacaauaugaacaguauaacguugauaacucaguaauguauauauagcuuaaaggaaaggucaugcuagugucugaaaguagaaagauccuguuugguagguuucugagcaucagccaggaccagcagugguccuagcaugcugagugaucagaugcaugagcugagagcaugacccugaaggaagccuuuuagaagucacauugcauccuuucuacuagagucugcuggccacaggaaccacaguuuauugaguugaaggacagaugggaacaguguuggccucuucucccaccaccucucagugacaggaauauagagaauccaugcccaugccucaaacugcuguggacauagaacauuuauaauugaaaacuugcucuucuaaauacuauuuaauauaauuucuaauuauuauuauauuuuguucuuauuugagauuuuucuugaaauuuuacaugaaauuuacuauugaccaagcuuaagaguauuauuugggggcuggcggaguagcuuagcgguuuggaguacuuguugcuuuugaucaggucccugguuugauuccucaaacccaugugguggcucacaaacaucugugauucauuuacaagggauaccaaugcccucuucuuaccccugcaaauacuaugcacuuccauggcauccauacaugcauauaaguaaaacauacacacaaaaaaaaucuuaaaaguaauuuuuaaaagaguucuuuuaauggcucaggccuauaaucccagcuacugaggcaggaagaucuuuaguccaagaucugccuggucagcuuagcaagacugucucaagugaaggcuaacaagaggccugaggacuuagcagagugguagaacacuugccuaccguguacaaggcccuaacuucagccuugcacugcagggggaaacuaguaucucugauaucugauguauuuuaagucgcucucugugcuuuugugaagugugucuggaucugauacauggaccauuuuuuaucaggccaucucuauuccuuagaacuuaggaacuaaagccaguacuuucucaaagauuaguuaaugcugucucuauggaaugcacauuaacuuucaacuuuuauacauauuggauauuuuugugcugacuaauaaaggcucaugauagcauuuaaaugugauuaguucccuaggcugcuaauacuauuaauauuuaaaacagcaugugcugugaccaaggccguauccuaagaacacgacacugaaucuucacaaguucaugaggagcuacuguugcuaucgagacguuagaaaugagggcugggaagcuuggagaggcugaaaacuuacucauggucauuucgucugugucagagccuagaugugaaucugugugaucagacuccauagucuauucucugaaccucuucacucuuaguuguaagagggaaaaaaacuguaaacuuuguaggcuuuuuuccuaauguuaauacuuugaauaccagucaguuacuguuuuaagaguuuguuuuuuuuuuuaacccugcuuuuguuuuuuauguuucuguguguccuuuucaguuugucucccagucaaauugccagcaguuccugaacacgguuugguuuggacagaugucagguuaccgccguaagcccaccuguaagaagauaaugacuguuuugacaguuggcaucuucuggccaguuuugucacuaugcuauuugauagcucccaaaucucaauuuggcagaaucauucacacaccuuucaugaaauucauuauucauggagcaucguauuucacauucuugcuguuacuaaaucucuacucacuugucuacaaugaggacaagaaaaauacaaugggaccagcccuggagagaauagauuaccuucucauacuguggauuauugguaagugucaaugaguucagaagauuugucucuguguguauguguguguguguguuuaugcacaugucugugcugauauacaugugugccugugaaugcaaugaggguguauuaugugacaaaacuuuucccggggagcugcagcauacacaucuacuucccacagauaggaaucuuguggcugaccaaaguauggauaccaugaaaguccaguuuggugaaccagcgaauuguauuggcuuccuuacaggaauauugaugaaggguuacuuaagggcgcaggaauaacucaaagacagcuguaucaccaaagcgcaccccagcucacagagcuaggaaccuagaacacacagcacagccugcaggcagcucaagagguuggagaguguccuuuccaagugccucagcuggucuaacccaaccuugaaggcagcuggucugucuggguugucuuugaaagcuugguuuccuuuggucucagcuuuuauuguuuacucaggcaggaaggggucuagugaaugcggucaguuacagggggcuuuaugaagcuauuuugaguaguuuaccuuccugcuuaaggaacuucucugcagaguggaaugucuuaaucuucuguuacacagcaguaugcagguguuauaccucagggauauccaccucacuuuuuaagacaguaaguaucucacugagggguggggcuggaucagaccaugcuggcuggccagcacauccuagugauuuccugagucugcuguugauauuacagguguuugccauaccugacucugucugugugugugugugugugugugugugugugugugugugugugugugugugugcgcgcgauaggauuuuaacacaaaucaucaugcuuucauagcaaacauaaacugagcugucuucgcagcucauaaguuaaaaguuuuuuuuuuuaauuguauguauguguacaugcauggaggccaaaagucaaaguuggguucguguauuguucagcuguucucuaccuuguuuuuugaggcagggucucucauacaaccuugaucuccccaauauggauagacugguuggcuccagggaucugccugucucugccucccuagcacuggggcuacugggguacacuaugcaccuagucaaggagcucuggucagcauguggugaguguggugagcaugacucuggcaagccuugcccuucucccccauucccacugccuuucuaaaaacccuuagauuagauuccuaauacuagucccuuauuuggucacuuccuccuccugaggcugauuacuaaggccuagcuaucaaaauauuaaagucuagcaaucaaaagcccuuuugggucaccuaauuagcaugcccaauuaaaaugaauacccuaacauccuaacacaggguuuccuguaacuuuauaaccuggcauuuucucauguccccuguuggucuccucuccauccuuuaugugcuccccuucccccacccccgggacaaauacccuuccccccuuccccauguuuccuuccccuuccugaucauccucuaacuccuguccuugucucuuauucccugcccugucccucuggggcaaauaaaucuccuuugugcugagaacuuggucuuggggguccugagccgauacuuuuccuaacaccuggcucuuuaugucuaugccgggaucugaauucacuucccagucuugcauggcaagcccuuuaccaacugaguauauuauggugauuccccugcaggcuuugccacuggcagaaaaagaugaucagaaugagggaagaaugaaacucggcucagcccaaguuuccuguaaccggcgcuggaccaggacuucuagaguuggcccagaucauuuuacuuuagcuguauuuaagcacaguaccauuuuuggaaaaaaaaaaaguguucagauaacaauuaacucagccccauaaguacaaagcuuaagaaguguuugccuugaaguucuuaggagaguaccuauggcuucaucuguaagaugguuucuugacuuagaaacugcugaaaauaagggucuagggagaaugacagagguaaacauaacaacugggagucagauuggccugcccuaagaugacauggaaguccugcaggcuguuguugagcacaaguggcaucacucaugagaauggguuuauggucuagguaucuggaguuaguguuucuugguauggaaauccugucuuccauuucgagugggugucugaauccguuuccugucaccugcacccaucggguuacaccccagcugaagggagcuuaggccucacucuuggggaucuagggggcuuguagucaggcagugggagccuguagcauuggugacagugagucuagccagugugagucuagaguccaugccuagagauggggccagaggguucagagugguggcugaaucuggguucucuaccugaagggggcaugggaggacaggauuugcuuuuguaaugagugugaaguuuagaagaaacaggagcugggguugauucaagcaaugaauugauucauauugaacaacuagaggacuggaaugcuaaugacugaaaugagaagaaaaucugcacgugugaauuugaggcagagaugagcucaguuggacacaucucuaacuagggagcagagagaagagugccuaaauaagcugaguuuaggagagagguuuggagguagaaauuguuauauaaguaugaacuaaguuuaaauaaguugggaagauggcuaagucagcagacugccuacugugcaggcuugaggaccugagguuaggcccacaacacuacauaaaagccauguacuccaguguacaccuguagccucagugcuaugaagacagacagguggauccugcagcuuguuggccagccagaaauggacuccaaguucacugagacccugucucaagagcuaagguggacaggucauugaggaacaacugacauugaccucuggcuucuauacauccgugcaugcaugcacuuauucacugaucacacaaaaauuacggaaauuugagacuguugucacaagaugcuauuuuuaaaccacuagauaaaaaaaaauagaucagagaagaucaugaaagcacuauauuucauaguuaaaagaguugagaacaaaaccaugggggcggcucacaugcaugcauuuaucuuccuaguuuauuucucaucaguuaaugucccauuccggccgauaugaaaccuaagguuaguuuuuuuaaguugcaugaaacauauggcuuuuuuuucuugcaaguuuuaaaagaucuucacccaaaagcuguuguuccccuccacagaccccugcugccuuuggaauacaauuauaccaggguauaguuaacccaagagcuagaaacacuuugucucugaaaguauuauuuagcauauaguugaauuaauaaaccuggcuuaucuuuuuuuuuuaucauuuuagggaugauuuggucagacauuaagagacugugguaugaaggguuggaagacuuccuagaagaaucgcguaaccagcucagcuuuguuaugaauucccuuuacuuggcaaccuuugcccucaaagugguggcucacaacaaggugacugucuacugucaaucaaagauacauuuacuucaaaaacuaagauaacuguguauguaacucagacuuaauguagacccaaaucuaugucugauauauauauauucacuuuaaaauaaucugugugaaugugguugcugacuuuuucaguccuuugaauggcuuaccuuuucauuaaugguuaccugccauauguuagguaccaugguugauguuagguacacaguaucuaauuucauuuucauagcaauucuuuaagacagaacagaagucauuauccucauuuugccaauaagaaaaugacucagauauuaauaaugcaucuaagacuauauaguuuuuaaauacagguccuagguauuuucuuucuaccaaauguuuuauuucuucuuuuagcucauuuacuuaaucuuuuauaauuuuacuuucaucaauauuuaugauuucacaaagccagaaaauauaguagacucuauguuaguuauggguggcauaucuaaggaacuaagauacauaauauugccugauuuuuuuuuugcuauuuauauagacagagcgaugugauucuuucaguuuacuuuauguaacaucuguuuguuuaaguggucaaaagugugcagcauguugguaagagagcauuucagugacugaagugagaaguuacuaaaaagucgcaauuggccaucuagaaaugaaaauggucagauacagugccugauaggucagguggcauugauuuuucagaccaauuucuuuacuucuagaaguaguuuucaaaucuaaacaagacauuuugagaguggaaggauauguggcuaacagucacacagaacaacugguauauggucucagccagcgggacaggcagacaggcagacaggcagacagauguugucuagguucaacagcacuuugguuuuuuaauuugaagggggugggguggggugacuuguaguuugcucuaaauuccuaagucagaggacuagguuuaguauggcuucuaauuaacugauaacauacauguucgugauuuauguuauacaguuuagagaaacuagcuaauauuuugcucauaaaaugucuaauacauuuuauaacuuguuuauuucuuuuaaagcaaagaauuucugauaagucucugcauauaaagugguauuuccuaacauacauggaaaucuuuuguuuggcuaaaacauuaucuagaucuccuacaagaugacaauuucagacauuuuagaaucucucucuucacuuuccugacugaccuuuggcuucucuuccugcuuccaguuucaugacuuugcugaccggaaggacugggaugcauuccaccccacgcuuguagcagaagggcuuuuugcuuuugcaaacguucugaguuaccuucgacucuuuuuuauguauacaaccagcucuauuuugggcccacugcagguaaauaaagguuuucaagaauguucauugcaugucacuacuguugcaucugcuuacccacuuaagcacuguucucaugauguuaaaacucuacuuggcuuuugaaaaugacuagcaagacuuugcuuguggcucauugauaauuuucuuuuaagaauugaaacugaaucaagcugugcuucauuggccuccucccuucauucuuuauagguagucuuaauauauuguuaaguuucauagaaaggaguaacauaaaagucucguuuuuaccaaacuaaauuucauauuuaaacuuugaaagauauuuggcuuuuaauaaaaaauacuaucuauaggauuuuaacauagagauauaugcaugugaaauuaaugacaauaauaacaauaagaccagucugggagaaauauaaacacacuacuguaagaauuucuacuauauucaaaguaauaugauaccacuugaaaauaggcaguaauaaaguaaagauggguguuguaagcccuaaggcaaucaaugagauaaagcaguuaucauuaacaagccaacaaagaacauaaguuggcauuuuaaauuauuuaaaaaaaaaaaaaagacagaguaaaaggaaaaagaaaaaagcccagaggaacuaaagaacuaaagaggaagaaauaacaugaaagacguagacaggucagugccaccccaguccucccaaacacagucaggugugucacagcuguaccccacagccugguaccagcuucuuucuuagggguuuguuuuguuuuguuuuccucugauaaaacacuauguccaaaagaagaaccuugggaagggaagggcuuauguuagcuuacagcucuacaucacagucuaucacugcaggaagucaaggcaggaacuuuaaagcaagaacugaagcagaggguacugaggugugcuguccccuggugugcuccucaggggaacaguaucuacagacuggcagcagagucaaggacagccccuacuccaguuguuguggauuuacaugaagaccaagcugcacaucugcuacauggggugacggggggguagggaggggggggagugcuagguccuacccaaguauacucuuugguuggugcucagucucugaaagaccccagggguccaggucaguugaaucuguuguuuucuuguggaguuaauauucccuccaggacccucaaugcuuccccccaacucuuccacgagacuccacgagcuccgucuaauguuuagcucugggucucugcauucauuuuggucaacugcugggaggagucucugagaggacaguuaugcuagguuccugugugcaagcauagcagaguaucauuaauagugucaaggauugcugcuugcccaugggaugggucucaaguuggggcugucacugguuggccauucccucugucugugcuguaucuuugucccugcacuucuuguaggcagaagacauuuaggaucaaagguuuuaugguugaguuauccuuuuuccccuacugggaguucugcuaggcuagaagaagugaccacuuccauaucuauaucacccaguugcuuggagucucagcuagaguuacccccauauacccccugggaccuccacccaucccaggucucugacauguccuagagauugcuuccuccacaccgcugcuucuccuucucuacccugcucucccugucugacuccagccccgcucuccuccccauccccucuucuacccaguucccuccuuccaucaacaucugauauauauuuuguuuccccuucugagaaagauuuaaccauccucucgugggcccuccuuguugugagccauuucuccaguccccuuguaauuuuuaaaaggcauuuuauagagcuuuucauuggagucaccuaauccuuggcuuuucuuaggugagagguuguuauuuuuggguuaauuuuuauaucaauuacaggauuuuauauuauuuacagucuuucuauaucuuuaugaguuauucuugguagguuauauauuuauaguuauuuguuugucuauuuggacuauccaguuuguuguucauaguaguauccuaugauccucucugugugugucucucuuuuucugugugugugaaucucugugcaugucucucugucucugccucuuuccugcaucucuccuuccuuuuucaguuaaaguauauguguuccuuugcaugcacacacaugcauagaguccugaggugucuucccugacaccugaugcucucuguaccuuaucuuuugaaacaggauuucucacugaagucggcccucacugacugacugaauuaucuggccagugagcucuggagaugucucucuuugucucccccauccuugcagaugaccuagcauuuucucauagguacuggggaucucaacucagguucucauacuuguagagcaggcacuuuccugguggcccgugucccuagaccuccuucuauucuaguccuccugccucagccuccagugcugcacagaccauguguucugcugcauaccagcuuuauuuucauuuuuuuugacauucaauuaacuccuuuauaaaugucaguauugauagcuuaauuuucuuuuuuauuucuuuacacuuucauauguuauuauaucuacaaaugcauaaugcuaugaccguucuguacacaaacaaacaaacaaaccauuucgcugguuuugcugcuugcccaucacauacaaguucaguauucaagccagcgagcgcacugcugagaugucucuguacuauacuuaguucuguaacaugcaagaacuaaugucagucucugcugaucuccuuuaguauuacucaccuugauauucaaacugguuacacuuauuuuucuuaaacuuaguuguguuguuaaaacuuguguauguuaaaacaauuuuugaaaauuaaaauuauaucauuauaaauggucacuuucaaaacuuuauuucuaaauaagugaacagugcagcaaaugucuucgaaggucgucuuuccugaaguugucacaggcaguuguuucauugcugccuuggugcguucccugcugacucugguguccuauucugaauagucacagugugaaugaaugacuuugucuuccuaagugacccaccaaagucacugccagugcauuaaggaaaaugugucucuucuuuucucacguuuuggguuuggcgauucuaaacccucccuguuucuucuguccucacucugcuagagcgccagaggagugcggugcaggcuugaaagcaccauguggcuuagucacugcugcagccagggcucccgagagagcccgcagugugcaucucacagggcuucugcuuaaggagccagcucacucuagugggauaaaggagcuuugucacucgccuguaaauaccacaccuagugcugugguuuacaggcgugcaugggcacacucagccuguacuguuuuuauuaugugauguucuauaaguguucuaugcaagcacagaacauguaaauauauaauauauacaaauauacaucacucuuuuuaaacaauguuuagaauguucuacguuuugcuaucucugucaaugauacuuuuuuuaaaaguagauggacccuuuuguacuuucuccccauuggcuaucuuuuagggcuaauuccucuucaaaaaguacugucaggaacuggagagauggcucagcaguuaagaguacuugcuguuuuaguagggaccuuagcaucuuacaugguggcuuacacacacauacaugcuggcaaauacuccuacacauaaaauaaaaauaaaucuuuuuaaaagaugcauaauaaauguuaagaagugcugucaaaguauuccuuaaucuaaaaaaaaucaagauuuauuaaaaauaccuaauuuucagauacugaagaaguaggaacaaaaaugaaauuagacuugaauaaagucucucauugucccaugagaguuacaaaagauggcgauugcuuccucgacauaauuacuuccuagagcagcuugcacagagggugcagucgcacagcagggaggugagggaaagaugucacuccuagaaaggaauaagggcuggaugucuggaugaugacgcaguccuuuaggcguuagcugagaauugguuacaaaaucagaugaaaggcuucauuuuaaaaugauuuacuauuuguaaacuuuaagaagccacauaaauuuuuuuauuggaaaaaaauuauauuuuggaagaauucacuacauaaggugacaaaauuccaaaaucaaauuacaugaaaauauacaucgcaauuucuuuguacaauaggugaugaaaaucugcuguaagaagaaacaaauauggacuaaggagaaggguaauaggacaaauaucauuuuaauagcaaucccagacguagaaagccuguagcugcgaaugcuauaaucauccaaccuuaauagacaacuuaaaggcgaaaauaaaccaaaucuggauuuuuguauuguuugaaauaaauuucacuaaaaugaacuuagaacagccuuuacacuuuguuuuuaaaguucucaggagauaaugacuaggaucaagagcucucaacagccaggcgugguggugcacgccuuuaaucccagugcuugggaggcagaggcagaggcaggcagauuucugaguuccaggccagccuggucuacagagugagcuccaggacagccagggcuacacagagaaacccugucucgaaaaaaacaaacaaacaaacaaaaaaaaacccaaacaaacaaaaagaagccacauaaauauaagcauuuauuuucuuuuuuuuaauuagguauuuuccuuguuuacauuuucaaugcuaucccaaaggucccccauacucacccccccaauccccuacccacccacucccccuuuuuggcccugguguuccccuguacuggggcauauaaaguuugcaaguccaaagggccucucuuuccagugauggcugacuaggccaucuuuugauacauaugcagcuaaagacaagagcuccccaguacugguuaguucauauuguuguuccaccuauaggguugcaguucccuuuagcuccuuggguaauuucucuagcuccuccauuaggggccgugugacccauccaauagcugacugugaucauccacuucuguguuugcuaagccccggcauagucucacaagagagagcuauaucuggguccuuucagcgaaaucuugcuaguguaugcaauggugucagcauuuggaagcugauuaugggauggaucccugcauauggcaaucacuagauguccuuuccuuuuaucucugcuaacuggccuuuagauaaucuuuauguuaccagcaauggugaugcuugccuauaauccuagcauaugagaagcugaggcaggaagauugugagucugauggcaagauugucugugucucaaaaacaacaacaaauacgaggagaugaagaucucuguccuucuucucccuccacagcagugauacccuuugaagacugugugugacaggagcuguguauuuaguacucaugguaaugguuuauaauacaauggcuuuugucagguagcugggguuguuggguuuauuuuuuguauucccacagcuggagcuuugaugcucuuaacauaacauauugaaauuuaaccaggcuaaauaaaggguguggcuuaugaaucauguguuuguuuuucuuuuacuacuggguaauuucauauuuaacacauaguuuucccaacaguuuuaauguacacccaugugauguguccacagauuucaaugggacagauguuacaagauuuugggaaauuucugggaauguuccuccuuguucuguuuuccuucacgauuggacugacucagcucuaugacaaaggguacacuuccaaagagcagaaggacugugugggcaucuucugcgaacagcaaagcaaugacaccuuccacucgugagugucuucagaguuuacuagauggacuuuauugaguucuguguggcuacucauuacacaaacacagcuuaaauuguucuuuaaagaaauccuuuuugagugucuguaagcauuaacaaaugcucauuuuucuugaaucauuuucaucaucuuuaccuauaggaucuuaaguaguagauccaaaucauucuaugugucuuuucuacugaaaucugucugaagagaggacauuugacauuuuuacacucuuaacacuuugggaaauuucuucuguccaucccauauauuagaauguucagcaucucugccuuuaaacuaguaguacauguagcaacucuugguuaccagugcaacccagagcacucauguuuucauuguuuacaguugaggacuauuagagcuugaggaccaguucccugguauaucauaaagaaugguacagccacuauaauuuagacagaauacuccacuagguuccuuuuccagugcuggggggggggcuugucugaaccaggguauguauacgccaggcaagugcuaaacaccaaaguuacacccccagucuuacucuccucgucauuaaauaaaauacagacaaguauugacuuguauauuugcguguucuuaucaugugucaaaguguucccucauuuaaugaauaagauuucugggcuggccaagauagacaggcagugggggugaucauguaagaccuugcuguuauuguaaugauuuggagcuauuguaauuuaaagucaccugaaggcugaaguagaggacugauagaaucuaacuagauaccccauggacuacuguauugggacuagaaaggcagcaaaagaaauuaaauaggaaugauaucuuugcacauauuuccucauuuaaaauaaaaucuuuaggggcuggacagauguccuagugguucagagcacuuacugcagaagaccuggguuugguuucccucacccaccugguggcucacagcuguaacuucaguuccaggggauuuggugcccucuuuugaccucaacaggauucugcaugcaugugguaugcauacauacacucagguacacacacauaaaauaaaaauaacauuaaaaauaagacuauauauacugugaaaauaaaaauaaaacaaaaaauauuuuauaauguauuauacaagaauuacuaaugguuccuguauauaguuuugacauaaaugcauuaucuguucuugcuaauucauuuccuuuuuaaagagaauguacuugcccuuacagguucauuggcaccugcuuugcucuguucugguacaucuucuccuuagcgcacguggccaucuuugucaccagguuuagcuauggggaagagcugcaguccuucguuggagcugugauuguuggaacuuacaauguugugguugugauugugcugacgaagcugcucguggcgaugcuucacaagagcuuccagcugauagcaguaagugcugucuucacaucccaugagaugugggaaaccaaguaacuaaggaugacagaaucuaugaauaauauuuuaaaauuaaauauagacuuaaaaauauaaugucuagcaacuucacaucuuugaccaauucuuuuagucuauaagaugugguaacauacagacaguuuuaaucaguaucuccaccaaccuucccauaugcauucagcuuguguccguucuuauuuuauccugcuuuuccucauagaaucaugaggauaaagaauggaaguuugcucgagcaaagcuauggcuuagcuacuuugaugacaaauguacacugcccccaccuuucaacauuauuccuucuccaaagacgaucugcuauaugaucaguagccucaguaaauggauuugcucgcauaccucgaaaggcaaggucaaacgucaaaacaguuuaaaggugagauuagagcuuugaauugcaccacaguuuuacaacuguucauuucaauuguaguucuuucuuugucuuauuuauugauccucauucuuacuauguagcuggcauggaacuuggcuuuguauaccaggauggucuacaauuugcguccugugugugccuaugaugggcugcgauggugggugcuugcugccagcuaagucuggccgugcccagcucagaugcuucacagugcagauaugcaggguugauaagagcuaugcugaccuguuucacuuauaugccuaaugugugauuuacuauaucguauaaaacucaauaaauaauugacaauacaaaauagaacuaaggauuuuuuuaguuggcuugguucuuuuuuuaguuuucaaguuucccuaacacaugaacuccauucccauagacuuucacuauagauuuaaggaacgauuauuaguucauacuguuuuuaggucuugaaacuuacucaguguauuucuuauccaaugugugcuucuuguaaaccauggauugguaaguuuccuaaaagaccagacaauaaauauuucacauucuguaaaccaaacaaaacagaaaacaccaucucagaaguuauauaagagaaaauuuccagaaacuuauagaugaaauuaaaaauauaucaguagguagcaguuacuguaaaagguuacuagggaaaacagaauucccuguggucugguugaauuuuugcuuaauuagaguugaaaaccaaguuguccaucaugaaaucacuacagagauucaucuguaaacccuugcuuacucacacaguaagagagacagggauaguuaggggucucucauggcaguuuaugugucucugcaguagaccgagcaucacugagacuaagcuuuuucagugaaaucagccuaaaugagagugaaugaaacagauaugcagccuauauuaucuuaagcauauacugaguaugauuuauuccaaaguaaacuauccucuaaauguauugaaaauacauaucugugauucuauuauuuaaauauugucucuagggcugaaggaugacaugauggcagauguuugucuagcaggcuugcggcccugagcacacccaggcacugcaaauauauauguauauauguguguguguauacauguucuuacauguauaugacuguacauacacauauguuguucugcugucauuaauuaccauaugguugcuuguuuugaaggaguggagaaacuugaagcaaaagagagacgagaacuaccagaaggugaugugcugccuggugcaccgcuaccugacguccaugcgacagaagaugcagagcacagaccaggccaccguggagaaccucaaugaacugcgccaagaucugucaaaauuccgaaaugaaauaagggauuugcuuggcuuucggacuucuaaauaugcuauguuuuauccaagaaauuaaccauuuucuaaauguuguagaaauaauuuuccauaacagaucugaaagacuguauuugcauacuugcaauuaaaucaauuaagaucuauaugggcauaaacaauuacacaaaagccauucuuuaaauauuuauagcauaaauauaugucauguaaaauauguauauagaguuaguuuuuuaaaaccugucuauggcuuuuuguagaagcaaacccguuuuguucgcaugcucuuuuguuuucuuaguuggucagugcuuaacuccaucauguuuaagaggggcagcuaucaguguacacauggcccacuccauuuuauaaaacaaagaucagcaaaugcagcuaccuuaagacacacuugaaaugaagagcucaugguguuuaaaucucuuguuuuaggaguucacacagaguucaguauauugcuuaggaguauaguuucaucuaaaauacccuauuuuuucuuuuguuagaaucuuaagcagcagagaaaaguucuaguaaauauuugaauuuaagccagucaugguaaugcacgccuuuaaugccagcauacaggaggcagaggcaggcagaucucugaguucaaggccagccuggucuacagagugaguuucaggauagccaggacuacacagagaaauccugucuuggaaaaaauuuauuuauuuaugucuaucuaaauucaucuugguauuuguaguguacuauauuuacuuuuacaugguuauaauaauuuuauauuuuuaauuuuguuuugacacauuauuuuauaucuaguucucuauauugagguaguuuauauguucaaguauuuauagaagucugugauuuuugaaaacuaguagccaucuuuuacucauagaauauuuguucauauuuauacauuugcaacgcuacuucucuagguauuugguuaguuuagcuuuuccuucuacguuuccaaguuggaguaaaacucaccauuacaaaguugaagcugcuugucaccauucauguggucacaugcuggucacagugggcuuggcuggagaggccuggagcccugaggaaagcugcuuuccuuucagcugaaggcucuugagcaacucuugcaaaguguuuuccucagagccuaccauagcuuccacaaaaggggccucgugcucgcugcuagagauguaaagcacuguuuauuccauuugaaauagaaagagaaucugacugccuuucaguguucaugugagggugugacugaagguuucccagcugucgcaugaacauucuugaagagcgcuuggugaaugugagccggcauugaggccagagugcagacagcccuggucugugagcaccaccuacccuggggcagcugaggauucuaguguuagcuuucaucuugcuuuuuacauuuguuuuuaauguucagguuuaaguguucccucuuuugggcaaauucuuauaaaaauguuuauuguaaaauuauauauuuugucuacaaugggauuaugcgcuuccaaguugggauuuuacaucaggauuuuuagucauucuaaaaaaauaccuaauuauuaaaaaauuuauagaguaccuaugugugcaugaguaacugaugggguauauuuugaaugacagcauauuguaagaaaaaagugaauaaaaguugacauuagaucauaaguuugauagagcuuga

SEQ ID NO: 5247 - RNA, 92671 nt, Mus musculus
cgugcgggugggggugcgggacgagcaugcgcaguggcgcgagcgcaggagcaaggaggcgggugaguggcagccgcagcggagcggaccagaccagcgggcgcggggaucccgggcaggagcugccgaacggccgccgcagguaccgggggcugggugccugaacgcacaagcgggcgugggucaggagggggaggccgggcaggaaaggcaagcuuggcuuagcggcgcucggcgagggcuccggguuccuccgacaccugcgggcgcgcuccugcccugcggcggagucuugcgcucaggugugaaguccugugugucgcugcuuaagccccagcccaggaagcacaucgugauacccugcaucuaggaagggaggguacuaaguuuucugguuuaaacuuugcguggcuguugaagagguuuuucugauccguuggugugucucuuaaguuguguuacuguguucgccucuggugcacaggcgaauguagggacagaaugaaauugcauccguguuugcuggacuuaagugccuuuccaggagcccuggggccucuggaugcagugcaagaaaugucagucuuaggggaaagugccaagaauuuugugcgauucagcaggcugcauuuucgaguauaagcuuuaaaaauuaaaaagaaaaaaauaccaaaacaaaauacagaaacccauuuuuaacauuauuacccccaucccaggcuucaaugaguaguauugaaaagaaaaacuuuccuaguuauuuacauugugugacuuauacagacauguauccuaccucaaagcuguuguagacuguauggggccaacacggaaugaacauuucuuuguuggaggaauguggaaucauaacuagaauuucaggaugaauacagagaccaauguuuuggccccacaaaggugaagcaagggcauuuaauuccacgccccaccucuuguaaccaacuccucuuuaaacuuaauucauuagugaaauucuauaggaaaguguuaaauuugugaugcgagaggcacgugaccguaguaaguguaggaaacggaaaauugaaguugaggaggaaaaaacaaacuagaaaagagaucacagaagaccccccccccuucccuuuauuuuccugccgugaggguuuuaauggucgaaauaauauacaguuggucugguuuuguuccgagggaccucugaggucagccaguucagcugcuucaguuuacaaaugagaaagcugagaccagggagguuagaugacuugcucugcccgcgcucgccccucagggccaagcagggccugggaagcugguuuucugauuucagggaucucuuuacugugccucucugauauucuucuuguuguagaugauugaccuuucuuucucuuccagccucucccgcucagucugauggaggcagggaguuaguuccuaccuugcucaucccucuauucacaaagccacacaccucucaagccucccugauggggaugcuggucugggaaccgaacccugugcccuuucucacacugaaugcuugcuuguuucccucccgggugugagcucauugcucagguguagccucuucuuggaaguucccuuugauagcagcagccauguguagcucucuuccuaaccccaaccccacagugcuuuaugacuucuguccgugcugccguacuccccuuuggauacagcuuccugaauuauuguuuagaacacaucccuauuuuuugacuguagaguuguuagguguguaaacucuggagaguguaugacuuaaaagaucccacccaguacuaaguucaaacucaucucagcugcuguuugcaggaggagggacauuuccggggauuuggugugcauggucuaugguggucagggaguucaccuuagagcagugcaagagauagagacaaaaaaagcaaguuggagugauuucugaaaauccaaaaucacagauuaguugggagcccuggagaugggagcccuggagaugggagccgaagugaggagcguucccaggauguggguuaaccauaaaugcagaguggaggaugcagacuuaagaaacgccagguuagagaaaagggucagugguuaaaagcucuggcugcucuuccaaaggaucuugcuuugcuucccagcaccacaugguggcucccaagcaucuguaacuccaguucucgagggucugauagacucuucugaccuccucuggcaccagcacacaucuggcacacagacauacaugcaguugaagcacucauacccauaaaauaaacacauuuuuaaaaugauguaaaggccuugugugaugaccaccugucauuccaguacccaguaggcugaggcaggaggaucucugccaguuugaagucugucugucuggucuacauagugaguuucaaccuguuucaaaaaaaaaagaaaagaaaagaaaagaaaagaaaagaaaagaaaagaaaagaaagaaagaauguaaauuaaggauguggcaaaaagaugagguauagagaagggagagguguugaaaauuccucuuucaugauggagguauugguaguggguuuauaauaucuuuuuaaagucuuacaagcacuuccuauugggacauuuuuuuuuccuguaucuuacuguuauaguugccuucucauuccagaagaugagcucuucagucauuacacuucauccucaaaugaggauacccaucguucagauacuccgcaguuccugcacgaauaaguaaaucguguuuuagcacgacgaaggcgggcaguugggguggucggcuacaggaugguacuuuguccagcccaugaccucaauguacaaaggaggaacucuuugugucauaaucaaauguauggguugugaguugaggugggggcguggaagcugcagagucuagagagaucauugcuagcucagcuuaguuaagguggaagaaaaaagcagguuagcccggagucuuuggacaguuauucuaggcuuaagauacucuacugccagaaccaugcucacagagagaguaacacugacgacugauccuuuugagccagcaauauaggggcguggugagagagaacaaggacaaauuguaaucagacucugccuagaaaaaugaggcagaaggcagugauucuaaaccuaaauucuaguucaagaaguguuugggauguacuuguuaacuugggacggagguugcaaauggcugcuuugcaaaucaaaaaaaacccagucuuucuguugaacuguccacaacaccaaggaagcuguuggaggguacauucuugcccuuggccuuauauggcaugauucaucacuucauuuuugacaggcagugauagcuggucucauaaaauauggcgaggagggccaggccagaagaagucucagcguuuagcagcagaaaauggaaguguuggccgagucaagagagguuaucaggcugaggacaugagccaguuagcagagcgcgaagcucgagguuugaucccagcaccccauaaacaggguguuguaugucaguccuguaaucccaguauucaggaaguagaaggaucacagcgaguuucugaggucagccuagucgaaacccugccggaguggggcuggagguuggggguggaggggagguggggggaggggggagaaauuuuuuuuuuuuuuuucgagacaggguuucucuguguagcccaagcuguccuggaacucacuuuguagaccaggcuggccucgaacucagaaauccgccugccucugccuuccaagugcugggauuaaaggcgugugccaccaccgccuggagagaaaaaguuuuuaauauuuuuuuuccccugagacaggauuucucuguguaacaguucugugcuguccuggaacucacucuguagacuaggauggccucaaacagagauccaccugccucugccuuccaagugcuaggauuaaaggccuucaucaccaccaccuggcuaggaaucauuuuaauuuuuaaagaaaacauaguagacaaauugucuauguuugaauggaugugugauguauuuaagcaugccucaauaguaaauauaauuguauuugguaaguuagaauuugcuauagccuuguguaagaugacuauuauuauguggcuuucucaagauaacaguaauacuauuuugguauuuccuuuccuaguguuuucuaaacaccagacaaaauuaaaccuuuacaaagcauccuuugagguagaugcagguuauuacccucauuuuauaugggacaaaaaugaaggguagaacgauaaggauuaucugugcuaggucacguggucagugugugacugagcugagauuugacccuaggacugccugacuucaggccuggagagcucaacuaaucaagucccuuuaucuguggagguucuaagaggugcuuagaauggccagaggccauggcuuucaauauuccaugagcaggauuuuaauucgagaaagcaaacaaugcuaauggaacuucuguuauuuauucuuagucuucugucacuuuugcuuugaagcauuucuacagacaagggacagcagucuuauuuauuuauuuauuuuucuguaugaaacauuaaaagagccucugacuggccacggcucucucuuggguagagcugggugagcucagggugaggguggcgaacaauacgguggaguuguggguaaaaaugugucuguguaagaacauagcaacuucugaccguguuugucagaauuuuucuuuucccugacagaauccuuuucuuggagcuucucgaucaugugugggucuuaguuuuaggccuaagguuuguguuuauaaaccuguaggggaaauccuuaccugaaugaagugugucuucaugcaucccugagauugaaggggcuggagagauggcuccaagguuaagagcacugacugcccuuccacaggacccugguuccauucucagaacccacauggcugcucacaaccaccugggaacccaguuccaggggaucuaaugcccucuucuuguaugccuccugugcuaccaggcauacaacucaaguggugcacagauauauacaggcaaaacaaccacacucggaaggaaggaaaggaaagaaaggaaggaaggaaggaaggaaggaaggaaggaaggaaggaaggaaggaagagugggagagaaggagggagggagggagggagggagggagggagggagggagggagggagggagggagggagggagggagggagauuggagaauguugaaugccgaagugagcuuucaguaguugggcacaaaugcugagggcaggugaagggcaccugaaggccuguugaggccaagaucugaccacauguggucuacuaaguugcuugugagaaaauguguucucucccucuugaugagcuaccaguccucuccugagaaccuugaaauggaagccggauuggaauuccacagaguccuucuggguucuuccagagcuuuuagcuuggggaugaagaaggccuauuggccucuggcuccacuucuggguguuuuaacaugcaucggcucccagugcccugugguuuggaacuaacaguuuacugugggugaugaaggaaacuggggaaggagaaagaggacuuugugcuacagccguguuuauaaaauggcuauaaaaugauugcaugucgguugcugggaccuuugcuacuguaugaggucauaugaucacccuauaugaggucagcuuugaucauccugguucuguuuaguauaccugugucuggaagugccugucuggugugugcauggcuucuguaaaagcagucuguuuuuaaauauuuccuauguuauucuuuucauuggcaaauugugccauaauagcacugugggcacagaaggcaugaggaguuagaugggugggauuuuuuuuccucuucuuuuugaugggaucuagagauagcuuuguuccuaagguccccuugugaagaaagacguuauuuacucuuuauaguaaacugacgaacugauuuucuuuuuuuuuacccagugcuggguccaaaccuagggccuugugcuugcucugcaaauuucuaccauggagcuaagucccagucuuauaaacaggggaggguuuuguuguuguuguuuuaaguuagaguaaaguuguuguaagaacaacaagaauaccuggaggauaacuuauuauauaggcaugcuuucuuuaaaagauccaaucuggggccgucaagguggcucagcagguaaaggugcuugcuguuaagacucucuaucugaguuggagcccuuaaaagccacaggguagaaggagagaacuaacuccugaaagcugagcucuugccuacacacaugcacacacaucacaaacaggagaaacgagagagauccagucugaucaggaagaaaacaggacgagucauagucuuuuuugguaugagaguagauagaugauuuaguaauguagaagcaaguguauauaucuguugaggguggggguuccuuuaugaccaaaagcuaagggguuggaggcguguuuaacuaaaaaugcugaaggaaaccaguuuuauuauguuauuaagaaacaaaagcuuaaguugaaggauacagaucuaggaaauaauucuuuucuuuucuuuucuuuuuuuugaaagauggcagagccuggagcuauagcuugcuuuauccuaguagaguacuugcuugcuuugcauuuauuucauaaagcccuggguuugaucccaaucgauguguaaacuggggguguggccaugcuggucugaaagcccagcacugaggagauagaggguagagucagaacuucagggccauccuugggacauauccuauccaguucaaagaggcuagccugagcuauugcaugagaccucguuucaaaaacaguaccaucacuacaaaaucgguaagggacaguacagaagucccuucaaucuuuuggaaccaaugaaggaaaggguuuuaggaguauugccaaaauagaacuuggaauaguuaauaauaauaguuuaagacaucauuguuaucccuguaccgguaucuucucaucagauccccaucuucccacuuuaugugcuuuggggcuauucuguacuccauagaaaauucaauguacacagacuccaaagggaagggccagacuggaggcauugcagugcguggccuaaaaccaauaccaaucaagcagguugaauguccuagccgguacaggcagcauuuacauguuguucccauagcuggaacagauuaaaguguucaagcacaaggaaagcagguuccgagcugauucauuuacggucaccgaccaauaacacgaguaggcucuuugaauucauuucccuuucuauucuuaaaugcuauguuuuauaguuauauugauucauuuuuuuuccuccauuuuuuuuguccuugaugauaaauaucuacuuacuguguacuguuuauagaugaaaaucaaugcaaacuaggguuuugagguuugauaaaugagucuguugagugucuuaaugcugcucaucaauaauuugguggaaagacaguaucaaguuaguauauaauugagcccguagccugauaucaaguuaguguuuauaaccuuugugagccaaccagaaauucucagguucugguucuccuccaccagaaagcucguucagauuucauuuuauuguuuuucuuaaucuuacaaaggcccuguuuccuacaucuuuccuuagguguaguuuacugugccacccauuugguccaggggauaguuuuuuaagaguggcccaguucuuacagagcuugaaguauuaucaagucagugaggugccagccgugaaaagcagcucuuaaaauuccggagaugcaguggguaucaugcaagugagcuaauagugggaagaaaauucuaauagcaaucuucuucauuaccaccccauuccgugugcaugccugcaagugguguguguguguguguaugugugugugugcuuacaugugcaugugugugcgugcaugcaugcgugugugcauuucuuguuaaaaacagagucucauauagcuugggcuggucucaaacuugcuaugaagcugaggcuggucuugaacucuugauccuucagcccuccuucagccuuagcuuccagaguguuauauggcucaggcugaucccuucucuuucuuuucucuuuucccuuuuagaccaagcuaaaagggaucuaacagggauccagaaguguggcccagaaggggccacaagcacugcccccuucuucuuuucaguuagugcacguuguuacggcauuuguauacauggguaucauuagacucaacuauauccuguuauucauuuugugugugugcacucaugugccacaggguguguucucugcuucuagcuuggggggccugggaugggugucaaauucagguuuucaagcauggcaggaagugccuuuaccugcagagccaucuuaccucuuaggccuccuuaucuuauucuuaaacagccauuuaaacucaagauuaccaucaguggggaaacucugggaaaucucucacuguuuaauaguccaucacagugagccucugcgcaggucagacugaauaugggaaaucagcggaccuuugcaagagaacucaaggucugugguguuucugaggccaggagaagggacaccuucaguuaguaauggugacugcgaaagaagcuagaacuggaaauguggaggaaaggcuuuuauuaauaacuauguuuuuuuaauguaugacuuugcugucucucauugauaagcagcuacuauuuugagaaagacuugucuaccugggguuacccaauuuggaaauggcagagaucaaauccauacuguguuuucuaauauuucauuugaaaaaaaaaaaccauacugggauuuaauaaugggaucauguugauagccaaaugaauaggaaggacucugucuggaagcuucauucucauaucgcuggaccuggugcuuuuccagucaccgugucucuuucugacuagaggagacaaugucuaugugaaaguuauauuugauauuuauaaacuucuaaaauguguucugugguuagccucagcuguggggcuccuuaagugauuucuuuguggucaaaggcgccuuugguaacugccuccucagcuccgaaugucccugggcaaugguguguguggcucucucguauggagacacggauugguugcauugcaccggccuucuuauuaaucacaugauuuaaaggagauaaaaugaaagagcaggauguauggauaugaguaacacgguacuuacccuugagacuguucacgggugggggaacagacacaggucuguugugacuauucucuugcugugaagagacacugugaccaaggcagcauauagcaggaagcucuuaauuucagucuugcuuaguuucagagggugagucuaugaucguagcuggggagcacgguggcaggcuggcauagagcuggagcacuuacauccugauucauaggcgugaggccgagggagacacugggccugguguggacuuuagaaaccucagagcccacccccagugacacaccucauccagcaaagccaaggccuuaaaccuucccaaauaguucuaccagcugagaaccagauucucaccucucugagcccuguugcagcccgucucacucaagcugccacagggaccauuaccugugacagccaccaggaagugcaagggaaggaaggggacucgguagaggagagaggaaagguaacuggccaggagguuaaagaaaguuuaaaaguggagauucucugaaaagguauaaggcaaaaagcccaacccaaaccaaaccaagacaaaaaaccaaaaaccaaaaaccaaaaccaaaacacacacacacacacacacacacacacacacacacacacaaaacagcaaaggcacuuggugacaggauaguggggacaggagaugauggggucgggaagcuuaggacaaggaccuggaaggcagugguucuaggacucuccuugcugggagccaggaauguccaaagaaagacugguuccaaguuccuuguuaccucuccuccuaaaugagacuggccaguggagugaguuccaggacagccaggacuacacagagaaacccugguuugaaaaagaaaacaaaagaaaacaacacagaacccaaagagggaagugcaguuuucguggugaugugugacagcuaacagcuucaaguaacagcacagcaagagcccgaaggcagaaaaagcugguggcuuccugaggcuacagguguuccaguguguuccagaauaugaaccaacaucagaaucagcuagagagguuguuaaaaaccaaaacaaaaacaggaaaagaaaaccauuuccguguuuaaaaauacuuuugauuugucuuugacauuucauacauguagauaguguaucuugaucacaaccaaccaaagaauuuacauguaaacaaguucccagauugugcugaggccguuggccagggccgcucacuucauuucugaucagcuuuuguuggcagaugucccaugguucuggccacacuccaacaacuuaggguccucacugcaacuuguucuggccccucucuaacaacguaggguccucauggcaauuuggggcucaucuucacaguuucacacagugggcuaucagggcuuccuuauggagacuacuggcaugccacagcgugcuugguagcuuucuggaaccguggaacaagacucuaugacucuggauccaaggcugagcggagccuggcccuuuugcucgauagcuccugugugugugcugagccuggggaacacuuuccucugcgacugcuguugaggggcagcggauucuuuaggccucuugagcucagcucucacuuuucgaaugaauuugugauccuaauguuuggagucugaucugugaggucuucucuuuccaguuuucccagugcagaaagagagguucucuuaaugguuacagcuguguccacagcuuaggccuuggguauaccuuuagaauuuuuugagcuccuuuuuuuuccacaaacuguacauuuuuuuaaauauccguugccauaguugccgucccuuugcaccauagacccaggcgaacacuguggguaaugaugcuguuacugacaguguugcccaguuucccuuugccacgugaacaaaaucugaagagaggcugugccugcgcgugaaugagaacucccggaagagaucugucugcagucacugauuggcugauuacaaucucaggacuguggagagucugggguguugccugucuaaaggcuaaguucuggcccuccagaacagccauuguucauuugucccccuguguuggaacuaacgucuugugacaauaggaaaaaaccaaacaaaccccuuuuacaaucugacuuagcaggcaaguaacuucuacaacccaaaagccaucagacaacauuuugagccuauaggaacgcuuccugcaucucauugucagggcaucuccagacaaguggcuccuccuagccauguaaggauuuaauaggaggcacccugucuuaaaguacacucauccaugaauauuacaguuugaaauagcaccuaaagugcuauauauaguguguauacaaaguguauauauaaagugacuuaagggcuuacacaaauugauucauuacuagauguuucuaauaaaaguauacaagcugguuauaauuccaaaagacacucaaaucucaaucucucucucucccuuccccccuguuuucugucucuaaaaauauauuuuauugugggauuggcaagaugguugagaggguaaaagugcuugcuauaugggccugaugaccugaguuugauacccagaacauacuauugcacccacacuuccauacgugcgcacacacaugcacacacacacuaauaaacucaauuuagugagcucgcccuucuucuuggugcugggaguugagugcagggccuccaugcugagccugagagagguggauggccucagcauugugaugcagccuuacacuacuacuggcucuucugagaccauccuuguagcagcaugagauucugugugguugaauucuauccgauaauaugaguuagcccuuuguccgggacacccacagccuguccacuacccacccuucgccagugaguagccaucuuggcuuguaguauuacuguguucaaguaaccucagugauauucaguuuaaaacuucugacauaauucugcaguuuuccguuucauaguuuuggaucacaguugacaagagugaccaaaaccauagaaagcaaaaccacaacauaagaggggaaaaccacaaucccaauauagcuccugaaaacaguguucuuaguguucuacuguugugaagucacaccaugaccacagcagcucugauaaagaaaaacaucuaacuggggcuggcuuacaaguuuagaaguuuaguaugugagccuaaggggccauucuuauucaaaccaccacauugaaccuauuuuauaaguuaaacuuucagcaaaaguucugugggaaaauaauaauauagauuugguggcucagugcuguuuaugguuucugguauccaauggguuuuaggacauaacuuccaugaugaagggaacaacuguacuauuaaccccaguucuggguuauggacaggaaguccugagagcuauguuaacaugucccuagaaugagaugaauaacugaaacucaagauaguaaggauuacuucaaauuuuuaauuuauucuaaaccaacuccaggcaugaauacaguaauauauaguaauagugguugacauguaggagauaauucuugcaugugaaacugacuucaccuuuaaaauaaaugaacacucaauuuaaauguuuucuuauuguguugagggaaaccagauucaaagggacugggagaguagcuuacaauagugcucaaaggauugcuuauuaaugcacagauugacacagguugcugcaguucauucuuccugcuguaaguggauggaggagcaagagguuguuuauucuauaucuuccugugcaaacaaauggauugugccaucggagaugggccuuaagcgaagucuuguuacgagguuaacaucaccagugugguuagaaugccuuaaaaagggaaaauggaaaauaguguggguuuuuaaaaaaaaguuauuuuguaucauuuuauuuuguguguuagugugugcaugguuugugccaucauccuauacauauugguguuagacaccaauggcagacgauucucuccuucuaguguacagggccuggggauggaacucugguucucagaccuagcaguaaacauuggcccaauuuucuaguaauuaagagggaaugacugcaucuugaagcaguauacaaagggaacguauaagagacccauuuuugcaagugaauauuuguuaaguaucagugaugauacccugcacacuguuccauauccugagaacaugugaagggguccuuaggucauucacauuaaucuaauaaggacauagagacacacugaaaacucccuaaagcacaggucucuucauucuguuagggacuugggcacugauguugaauguuacacaaucagguagcagaacuuuccaggaaaauuagaggucucguacuaacugcuuauagucaaagugucuaccuuauguagucuucaguauuuuuagggcaugccauaguguuaguuuuaaaauaauagcucuguuagaaaaaguaccauaucucucaucaacuuaauguaguagauggucaauuuuuaagccaggugugauggggcaugacuuuagugcagggcuccagaggcagaagcaggcagaucucugagucugaggcuagccuggucagcaaacugaguuccaggccaaguaaagcuauguaggaaaacuuugucucaaacaaacaaacagucaaaauauuaccauagauggcuaauuuuagacuauuucuuugccuguuagcauccucuccucaucuccaaccauagcucccacccccacccucucugucuccacgcguagagacuuucuuuauauuuuuaccuaggguuuuauuuguuuguuugagauggucuuauauagcccaggcuggccucaaacuauguguugcugagaauggcaugauuuuauuguuaucagaaucauuucggucagacucugagcucaggcagccccaacaaacuauggccacccauucuuuuuuuuuuuuuuuuuuuuuuuuuccauuuuuuauuagguauuuaacucauuuacauuuccaaugcuauaccgaaagucccccauauccacccacccccacuccccugcccacccacucccccuuuuuggcccugguauuccccuguacuggggcauauaaaguuugcaaguccaaugggccucucuuuccagugauggccgacuaggccaucuuuugauauauaugcagcuagagucaagagcuccgggguacugguuaguucauaauguuguuccaccuauaggguugcagaucccuuuagcuccuuggcuacuuucucuagcuccuccauugggagcccuaugauccauccauuagcugacugugagcauccacuucuguguuugcugggccccggcauagucucacaagagacagcuacaucugcguccuuucaauaaaaucuugcuaguguaugcaauggugucagcguuuggaugcugauuaugggguggaucccuggcuauggcugucucuacaugguccauccuuucaucucagcuccaagauccgucucuguaacuccuuccauggguguuuuguucccaaaucuaaggaggggcauaguguccacccuucagucuucauucuccuugaguuucauguguuuagcaaauuauaucuuauaucuuggguauccuagguuuggggcuaauauccacuuaucagugaauacauauugugugaguuucuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuagguucuuuccagcuucuggcuauuauaaauaaggcugcuaugaacauaguggagcauguguccuucuuaccuguuggggcaucuucuggauauaugcccaggagagguauugcuggauccuccgguaguacuauguccaguuuucugaggaaccgccagacugauuuccagagugguuguacaagccugcacucccaccaacaauggaggaguguuccucuuucuccacauccucgccagcaucugcugucaccugaauuuuugaucuuagccauucugacuggugugagguggaaucucaggguuguuuugauuugcauuucccugaugauuaaggauguugaacauuuuuucaagugcuucucugccauucgguauuccucaggugagaauucuuuguucaguucugagccccauuuuuuaaugggguuauuugauuuucugaaguccaucuucuugaguucuuuauauauguuggauauuaguccccuaucugauuuaggauagguaaagauccuuucccaaucuguugguggucuuuuugucuuauugacggugucuuuugccuugcagaaacuuuggaguuucauuaggucccauuugucgauucucgaucuuacagcacaagccauugcuguucuguucaggaauuuuuccccugugcccauaucuucaaggcuuuuccccacuuucuccucuauaaguuucagugucucugguuuuaugauggccacccauucuuaauaguccuguuuaagcaaaagaaaacaaaagcaaauauuaauuaaaggcagaaaaauaagagcuauucaauguggucacaccuggaagaggaacaaagacagugauccccacguccaucuuugagucuucacaggagaucuggguuuaaagagagaacaggaaguagcuaagcaguccccaucaagguaugagccugccuguugucagugucuucuccuugagucuccagugugguucgacuuaucaaaucgguggaacaccucuuccagggcucuaacaccaggcucccaaccuuuucuuucucuccguaugagacuccuggggaaauuccaaaaucuugggguguauuguauuguacuaauaguuugauagccaaagggagggacagaguuaucuuaggauaucuucauuccugccaggauaguuagugucuaauucuucugccuccacuucuggagugcugcuauaggugugcacugccuugcccacccuaacuuuaaaauuacaaauaaacgggucaugugaccccucuuggcaggcucauagcauaauguuuucaagauucauccauguuguauauaguauauauuaacauuuauggcuauaauauuccauuguauggcugcaccacauuaaaaaggucuauuuguucaaucuguuuggaguuuccucuuguaggcuauugucuugagcaugcuacauuagaaacacagacacuuuuugcaucuuucuacaaugucagaauuuauugaauaauaauaaauucacaaccuauuuuuauuggcuauaauuuaugauguagucccgauucuuccugauagcuggccguuggcaaacagguucuuugauuccaaucugaaacacuaaaaugacucaggucauacacuccacuugaggcaugcacacacagauuaaagaacacggaguucaaagaggccuacuggaggccaagguagagaugaagggcuugauucagacagccguagauacaaggaugaauggauggauggaauuucuugugaggaccauugugagcuaaagccccagggacauucaggaauucucugccuuuugcuaucuugagugucagcuuagagagaugacagguggguguggcacuguuauugcagugggaggagcucuuuccgugggguccaagugagaauguuacauucuucguuggacugguguggucauuaagcacuugagccugguauuugucugucugucucucucacauacacauacuuuaaaaagaaaaacacaaaguaaguuuaugucuuuuuuuggacuuauuucauuuuauauguaugaauguuuuguuggaaccacccacauauacauacauauacacacacauauguaugccacauauaugacuggugccuguagagguaagaagaggacaucagauugaaguuccauucucuuaagacccagugcucugagcugcuaagccaucucuucagccucuaguaggauuuuaguaugcucuugugcuauuggcaaacacaauguacucccagucuacuuugauaaguuuguagguguuaacucuucauuugcauaaguaagucaccaguccaugccccaugauucaugcaagauggguggguggugugcacaaaugacgcaaaguccuucuuucucuaugcuuguauucaaaugaaggcaguagagucacgcaggccuucgagccacuguuuuguggaacauggaagaacucagagcaggguggagcuugagccaagcagccuuaauaaacggcgcugucaugagcauuuauguaaaauuuuugaggaaaaugcauuuguuuuuauuucuuaauuuaaaaauaaaucuauguguaugguuauuuugccugcacuacacauaugucugcacacccuuuuugugauugcccaagcaggcuagaacaggauguugggcucccuguagcuggaguuagggacagucaugagccaccauguggauccugggauauguaggauacuggguccuuggguagagcagccagugcucuuacccgcuaaguuauuucuacagacccugcuuuuauuucuuguggguauuuauaguguccaaguggaaaugcugagucacaugguaacugcauuucaaggaacugccaaacuuuuccaaaggugcugucucuaagagcaguguaaagauguuuauauuucucuacauaauacauagucaccaacguuuguuaucuguuuccuuaauuauggcccccgugccaggugugagacaguaucucauuguuaaaaaaauacuaguaacuuuaucuuuuauaugaauuuucauggaaucaagcaaauguagagaguauucccuguguccccuugcuggcacacaguccuaugaguaauguccuguauaacuucaugguauaguagucauaauuaauaugcucauauugguacauuguuacuaaaaugcacaaggcacuggaccauuuccuuuguuuccccugauggccuuuugucccagggccccaccccacuuuaacucuacauccugggcuccuuggguugccugggcccucaggcucuccuuggguugccugggcccucaggcucuccuuggguugccugggcccucaggcucuccuuggguugccugggcccucaggaucuccuuggguugccugggcccucaggcucuccuuggguugccugggcccucaggcucuccuuggguugccugggcccucaggcucuccuuggguugccugggcccucaggcucuccuuggguugccugggcccucaggcucuccuuggguugccugggcccucaggcucuccuuggguugccugggcccucaggcucuccuuggguugccugggcccucaggcucuccuuggguugccugggcccucaggcucuccuuggguugccugggcccucaggcucuccuuggguugccugggcccucaggcucuccuuggguugccugggcccucaggcucuccuuggguugccugggcccucaggcucuccuuggguuuccaugaccuugaggauuuugaggaagagugcugagguugcagggugcucuucuguuggaaucugucagauuuuuaaaaaagaauauguguguuuuuuuuuaauuggaauaagcuguggugacauugguagaauuuaaaaaugcauaaucagaauuugaaaucagugagauaugguggguagaacauucucaggcauuugaaaaauucaauugcuucuggaaaaaaaaaaugagcagaauugaauucuagguguauuuuccuagcaagggagugacuccauuggaagaggaccagaggucacagaguuuaucuagagacaguuggggaaucuccugacaacagaaaggcgcauuuucuccuguauucacugugacagacagugagcagagaugaugcuuuguaugugucaagucauaggugauuagcuuuuggagacacucauuccucaguuauggaggagaaccaccaaugugcauuaauucuagaacucugcaccaaugccgagugaagggggaggggccguggcucugagagguagagauguuuggcuucagacacacagcucgucaggaguagaucugagguuuucaccucaggcucuggaaguuuauuuaaaacaggaauugauggacuuaggaaagaguccuuaccucaauggaccugugcuguggucuggggaauucagccugugcaguuagcugcacaccuuuugacugcuaacaaaggggaagcuggccagcuuugccuggcccacugcuccauuguguuggacugugaaucaguaacucuggccaccagucuccugaaaggacagaaaagugaacugaaauauuuagugaaaauaaaaugcuauaaaugaguuuugccauaagcccauaaaauuuccagugugucugcaguuaaucgauuuagcaauuugauuuccauuuccagacguggcuucaucuuucaauucuucaggugggagcccuaaugaucaaacugauggguuaaccccauagccuuguguuuggucucuuucugugccuggcucucagugcuuuucauucaccgaggagggaagaucugucaugcacacaggugacccacaccuucccaugggacgaggucuuggacugaauaaagcagaaaaacacacucuuaucuuucucugcuuccugucuguauaggcaacgugaucagucaccuucuguccugccaccuacugucccugucaugacagaacguauccucaaacugggucagaauacuacccucccccccccauuacuaguagcuaauagagauccauauauaugcaauuuaagauugugcacaucuguuggccgcuauuucucaauguaagucuaacacugacuaagcucauagcuuauuuugguuuuguuuuuguaaaacaagugcucuaaacuaauucucuucaggugcuuuuaaugcuacuuuuccauaaaaaugcacuacaugccuggcaugguagcgugugcuguacucuaguaccaaggaaggugaaaagguggaucaggacgcugagggucucauugggagguccaggucagccggggcugcgcagugagacccugacucuacaaacaaaacacugacacucaaguuucucaucuggugaggagaaggagagaaaggagagggaaaaacauugaugacgugaaaugccccaguuaggggacuauugcugugauggaagaccaugaccaaacuuggaaagggaagggcuuacuugguuucuguucccacaucacugcuauuauugaaggaaggcaggacaggaacucaaacagggcagaaaccuggaggcaggagcugaugcagaagccaugguguggagcugcuuacuggcuugcucaucauugguugcuuagucugcuuucuuauaaaacccaagaccaccagccuagggauagcaccauccacaaggggauggauccauuaguuuacuaauuaagaaaauguccuacaauagucuuucucaacuuucuugauacugugacccuuuaaucauguugugaugacuccagccauaaaauaauuuucauugcuacuucauaacuguaauuuugcuacugugaugaauaauaacgccaauaucuguguuuucugauggucacagguaacaccugugagagggucuuuugaccuccagaggggucacagguugagaacugcugcccuagaguacccuacagccccaucuuauggaggcauuuucuuaauugaguuuccuucucuuggaugacuuuagcuucugucaacuugacaugaaauuaucaaacgcaggaaugcacauaauaagcaaaggagcaguacuaaaugauacagaagaaaaaaaagaaagaugaaguaagggcaccgagcuagaccacugcauggggagaaggagagguucauugggggaucagacugcuaaggcugucacucaggagcagagagaagcaaaaugguggaaagucaguggauuguauaugacagucaagcaaccuggagggucuuugagaugaugacacaggcuggugagacugacuuggagcuagauguccuugucccagguaguugaccuugggagugguaaaggagguuucugguuaagagaacccugccuuuaggcuucuguuuacccaauagcaaacucugaaaauagaaaacuguuuucccucccauaguccuucucuacagaaccuugucaucagcacugccauuugggggguugcuugcaccuagcaucuauucuaucauuuccuacuucuucaccagaaauucugcacuaucaguugucuuugauuuuauuaauuaaaucuuagauuaauuuuucuaguugugaccucagcuacaugucauuuaagccauaaaaauaaagugucucaggggcuggagagauggcucagcaguuaagagcauuggcugcuccuucagagguccugaguucaauucccagcaacuauauggucgcucaugaccauuuauaaugggaucuaauguccucuucuggcauacugguguacauguagauagagcacucauauacauaaaauaaauaaaucuuuuuuaaaaagugucccagugcuugcuggguuauuugcuuuucauauucguucguuuuaauguuaaugauugguuauguucagugacuugauuauaucugugcuucauaugcgccuggcgguugagcuuauuuaacuggaagccauccaguucacuuucaaccaucuuccagucagcacggagacccacccgcuuagcuaauaaaauaaccuguccuggauggcucuccgugauccaugagcuugguacuucagauccaaaggucagaagcaaaaggcagauuuucuagauaacuugcaauuaaggaaagcaucuuuuuguuucagccaacugauuuggaauuuuggaauaaaacugugcccuucaugguauacauagccuccaagagcuccaauggcuccuuucccucuuucucuucuucccaaacacgaccucagucaacacucugcaucccgggcuguucaggauggaggcuuauuuccacuaaauaguucaucucucuacauucuguuauaggaaugaaaacaccgaagguuucagaaugcuuauuuugcccagauuuccucuaaaaauagaaguguggugugcugguaaucauaggaccuaagugcuuuaaggacuguacugaagcugucauagcaacaagguugguagguuuuugcuucccucaugcaaaugagaagacagacccgacgcacagaaaauaacguggauugcccaaagcacaccaagaggucagaguggauucagaucugcucgugucaaaccuguacaguuaaccaauuaguuugcucuuagaugggcuagcuuccaggguaaccucugaccggaguugcuuucugggucuugcucggagcagcaggguccagggugguugggggagaagauggagacgcccccagcauuuccagccauuuacuagaggacaaauuucagaacuucuuguuucuguugagauaccugagccucuccuuagaacuucugaaugggaaucuuggggucacuccagggucccaggaaccaucucugggagucacccauugacaaagauaagauuuuaccccuuuacccuuugcuuggcccuacugguguuaacuuaaaggugaaaagcuccgcuccucccaggagcccagcaauggcugcagcagccaggugcugccuacaaaggcacugcuugcuacuccaguucacucucugucucugcucccauguggcaggccucucucuccuuucuuuucuucucuguacucccuucucugcccucauggcucuguucccuucugucuacccucaccccuucuccagguccccauucccucucuuuuccccucccacaaauaaaccuccuuuauuagaucguuacauggugugauuucucagggggacacuuuggcaugggccugcaaggcaccccuccccacgugcauuauacuucauaacaauuaggaacucuugaauauuuacauuuucauccccacccuacccccaucuuccaaguaauaacuguucuuucuugugaccugacgaaggccaagcugauauaaucagcugagucucucaguugcucucguugcuacaaacccagcaguguaacugacacacauuuauuaccuuccuguacuacaggucuggagucuggcuuaggugucacuaggaaaaaguuaggacuauauuccuuucuagagguuccagggacgcaucauuaguggggcucauugcagauguuggcugaaguugcugcucucagguuccccuccuugcuguacauaaacgggguuauuucgaacauuggaggccaccuguauuacuuugcucaggucuucuucucuccacggucaaaguucaggacaauagguuaagugucucugcacuuuguaucuuuuuccuccucugauuugaaagauaccugggcaugcauagauaggguuauguaugugcauauguauguauguauguauguauguaucuaucuaucuaucuaaccugaguccccuacccuucaccaacagcugcaaaggagccugcaaaaguguggcuaagagcacuugucgcuuuugcagaggacuuggggauuaguucccagcacccucaugguggcucacaaccaucuguaauuccauuuccaguuggacuccuccuaggcacagggacaccaaguaugccugugguacacaugccuacauaacagggagccacccccuacaccuaaaauaaaaagaauaaaaucuuaagcaagcaaacagaaaaugugacuuaacuagauauuuuucuaagaaacccaugucuuggccagucuucagagcaaauuuuuaagaggucuguuucaagacuuagaagucaggcagagcugcagcaggaaggggaaaggaucuacacugugccuauuucuuugguaauuuagauuuggggaaagcauucugaucugaagcccuguuuguuucaugucacaggcugcuccaccaacguaucuuuguucgugcuccuucacauacuuacccuccccuuccuuuagcuagccaugugauuauagucagaacaaguuugccaacuacuuauucuaagaaacguucauuuuucagaugcuaaaagucuagcaucuauuguuuuuuuuuucccaguugcugaauuaggaugguaagaauccuugugaccugccagauuuucaaaggcugauuuggaguucuggguggugucugugaggcaucggagaagucccugcagcaugcuggccauaggagacacucaauagccacuaauugaacugaguugaaguacugaaucaauauaacuuuagauaacaguguuaucuauauauccaaguucugcaagauauauauauauauauaugcauuguuuccuuagaacauucaugucaaaaacuuuacauggacagaaguaggauuguuaaagaugagguuucuaauucauauuuuucugaguauuguguuaaugcauauucuaucagauuaccuaguaaauauauugagugcaaggacgaugaaacuuuuuuccuauuuuuugaaauguaauuaaucuagauacacaggaacugcuauaaauuauaaguauagagcuugcugaacucacagacugucacuuuuaucaaguucuuaccuaccuggguaauacugucuugaugcuuuagagguuuuagagaaauagacauggaggacuggggagauguggcucaguagguaaggcgucuccugugccggcacgaggaccacaucuaaagccaggugugcggcacauacagagcugagaggugcugagacauggggcccaggcgguugcuggccauuagucuagcagaaauagaagcucuagguugagugacaggccuugucuaaaaaaugaggaagaugucagaagaugucaaaugucaacuucuggccuacaagcacacacaauuacaagcugugcacacacacaguauagaaaauauucuuccagacacugugacaaagcuuuuagaaacagaucuccgugugugugugugugugugugugugugugugugagagagagagagagagagggagagagagacagacagacagacagacagagagagagagagaggggagauguggaggucagaggacaucuugcaagaauugauucugucuuucuagcauggaggcucuguggacugaacccagguuaucaggcaaacaucuuuaccugcugagcuaucucauuaacccuugacacaaaaguuuuauuuucuaguaauuaauguauacugugaucauugaaauuaugguucccucaaauauucacagauauugaaaccacauuauauacuuggccuuauuaguaacauagugucacuuugcuuuauacaguuuuuaucaguaggguuugguuuuuuuguuuuuuuuuuuuuuuuuuuuuugguuuuuuuuuuuuugagacagauuaucauguauuaugggcuggucucagacuugcugucuagcagaaaaaccuugaauuccugauccuuaugccuccgcuucucaagugcugacguuacaagcuugugccacugccugcucguuauugcugcuuuugagauagugucucaugauacugcccaagcuguccucgaacuccugggcucaggugaucuucucccccacagcuuuccaagcagcagggaguacggguacaggccuccauucccagcuccucuacacgccuuucacugggauugagccaugggauuuucuuuggaaauuugguugagacuuccaguagguauucaagaaaaaacauugcccaucuuucugcucacaacaguucccaacagaguagacagcgacauuucuuauaaauagaacggaauguguaaaauuuuggagaaacuggauucagaacuuugucccucauucccuguuuugucucuguucaaggaugcuugcugaaauguuuucuaagaacaaacccauuugaaaccaccaugguaccaacacgagggcuuagauagaucaugguacuaucagacuguaugaacuauuaugaaaggcauuuuuuuaaaaaaaaaguuugauaacacaaauaauuuuuguuuccuuuaaagaaagaccauuuuuacugauguguaaauaugugugugucugugugugaguuugugcuugucuaugcuggaguuacggguguuuaugagccaucgggugugagggcuaaaauccagacucacauccuuugcaagagcagcaacuaagcagauaagccaucucgccaggccccucccucuucucucucuuuuuguuccccaaaccuagggaguucuauagccaaguacuguaccacugagauauaugccuaauccaaggacauuaaauuuuaauuaaaaaaugauugcacacaucacgguaucuauaacauagggacauuuuuauaaaaguauauaauguuugucaaguacaccucccccuucaccguauccuuucuugggaguuuuuuuuuuuuuuucuucuacaacaagauuucucaguauagccuggcuauagaacccacucuguaggccaagcuggccuagaacucagaaacccaucuaccucugccucccacguguugggauuagcuagguaguuggucuuggugcuuacuuuuaaucccagcauuugggaggcagaggcaggcagauuucugaguucgaggccagccuggucuacagagugaguuccaggacagccagggcaacacagagaaacccugucucgaaaaacaaaaacaaaacaaaacaaaacaaaaaguguucaccaccacaccuggagagaacuuccuaauaauagguaaacuagaaauaccaauuuaaaagacugugcacacauagaaaaaaaaaaaaagacugaacauucuuaacacuguuuguccccaaacgguaugcuugggagcaauuuagauuuucuuauuuuauaaauaucauuuucuauauuuucgaaauuaaaaagaauaacuacuuaggaucuauuuuugaagagccacuuaggauagauccuugauuuucuuccuuugugggauagugggguaggaucgaucagacuuggucaguacaugguuuacucaagagguaagcacaauuucuuaccauaguggucguauggcaaacauuauaaaugaucuuuuugaaauagugggguuuuaauuuuuuuauuuuucagauuuauuuuggauaaauuaauaaauuauauauuaacuuaguagauaaaaaucauccuauaauauaaacaucauacagguagauuaagguagcuacugaaacaucugcucaaucccacacucuuguagugaccuuguauuauggccauucggaagcuguggcucuucacuuaggguuuuaugcuuuuguuaucaauuacguuuuuauguacuguccaucauuuuaaaaagauuacuaugacaaauugaagcuagaagaacaguuagcuuuugucuugggguuucuauugcugcaauaaaacacucugaccagaagggacuuggggaaaaauagguugauuagguucacaaaucccaagacacaguccgcuaggggaagccaagacaggaacucaaaccagacaggagccuggaggcaggagcugcugcagaggcccugagggugcugcucacugccugcucugucugcuugcuucuagaacucaccacccacaaagggcugggcccucccacaucaaguaugaauuaagacaaugcccuacaggcuugccuuaggagugccuacaggccacucuuacggaagcuuuuuuuaaauggagguucucucuuauaguggaauuuucauugcaagagugguuacuucauccaacucucuguugacuauuaagugucaaagaaacucaggacagagggcugaggugccuacuuaacauggcacagaggacucuggcuucaugucucccucagucccuacucacaaguggcuguuacagagucauccuggguggcaugaggcacccccuacccuaaaccucuccagucccaggcuucacucucuuuucuccuguggagcccagcuauuuuauuuggcugugcacccuccugcuucucuuggcuucucuuggcucucgguuccucccuuggcuuccuccucucuccucucuucucuuccugucugcucucccaucucucacuccucuccuggccacacucagucuggacuuuucuagaugccucuggcugugcucuuccucaaagcuacaauaaaacuuucuccucaaccauaccuuggaguagucaugucucauuuuucauucauuuaugaauucccaaagacaaagcccuccgugcucccccaaauuuucugagccuguguuggaaacagacugguaaaguuaaucuuaugucccagagcuaugccagaguaguucugggccacccagacauaauauauuuccuuauauuugucucuaggaauucugucuuauucuucuaauucaaucaguuuguggccauauagaagagaguaacuauuuaaaugcauguguguguuuucauugagacauaacguaguaauaguagauugcaucuguguuaaguggcagguagcuauguuuugacagguguauauguccaugaaagucaccacaaucaaaaauacccaauauuugcauugcuacuggaagcccccuccugucccuuugcaugauauuccuaggugaucucuguguucugacaagggccacucugcugucggucaccccagguuaguuugcaugucuagaauuucacagcuauauaaaugaaauucuaaaagugcauaauagaaugugcuuuuauuuuaaagguaguuguaauuucaacauuacuuuuccuuucacuuaggaaagcucuuuuguaccguccacuuuuuauggaggcaucauaaaggauguucggaaugagccuuagccauuccauaaacaugacuguuaaguagauaaggagacuguacuugggccaguucagaaguacacuuggacucuaacccuugaggcuucacagugcuuaacgcugcauaaaugauacaguguugccaguuagcauuucaaguuaguccuuagacucuggaguuagaaauaguuucucuuucuuucuuucuuuuuuugucguaacacaauuucuuauuuuuuuucuaggaaacacaaauuaaugcuaguuaaugguuuuucacaugauuaaaaauauuguuggcauuuacaauuaaagggacaaagggauauuuauaaaaguaguaugggaauucauaacacagucccguuucacuccucccgggagaugaggucucauugugaauuuuaagugcucuaggcuguuguagauuagaaauggugaugacaucuacaguuuugccucuuaauauaguucuucaaaguuccaagccacacccauguuccagguuggccuuucuaccuaggccaaauucuuuugagauuaagaucuguaguaguaggcagaacauuuauuucagcauagagcaagcugcguguccgacuuuugcacaugaccauccaaggacaggcacggcucaagacagguuggauuuucaaguuucugaguuuguuucucaggaccccugacugccaggcgcuaaguaagaccugaggaagcagguauguaugcagagcguguaugcagacucuagccuucugauaggaucagugacucagacgcggcugcuggugguuucugugugauuguuaaauugaguuaaaacugccgcacagaauuucucagcaagcuguuccuugcucugggguuauuuugcauaaucaguccagagaauauuugauaugauggucacaccguucuuagguugauaagaaggagggcuuuggguuuuuucaggguuggauuuaaaaauuacacauaauucuugguuggauuuugacuuucuuuucaggaauggguaugaacuauuugagaaaggcagaaguaacuaaauauucacuuggugucgcccucuggaagguauauguacuguugcuuugaagccuaaggcuuucaggccagugaugucucguaaagucuauaguuguauuguggauaagaacaacucuuuuuuuuuuuuuccugaagagacucuauggcuauguuuuuaaaaaugcugagaacgugcagugcugggccgugguguugagucugggcaucuaggagugagaggguaucuguauuguaauaaauucuuuauuugcauuuggcuucucuaagucuugaaaagccaggauuaauaggagauagauuucaccauugcauugacuuggggacagcaguuuauguggguuuuuguuuuuuuuuuuuuuuuuuugaaagaguuuccuuuuaaacaguuucugugugagcaugucaccuuucacccugggugcgucgggcuguuuucuugcuaaagcagaaauugagcaguucccagcccacguaaggcugagcgggucuugaaugguguaugucaagcauaucaaggaaccuuggaaagcgauacagccggcggcaguuugaauagguccuaguguggaagaauggaggccuuguuccuucucaaagccgaggagccuuucagaagugaugcaugcucuuaugcgcagggaccgugaaggcugacaccucgggaugaaguuaggacccaccugcucugcuuugggaagcccucagacacuuagagcauuucuguaugaguuacaguguccaguuacucuguggcuccucuuagggagaccaaacacaucaugacaagcuaacccuggaaagugauucaccauagaaaaaugucacacaguuuaaaagaacguaacaaaaccaagccaagcccuccucggggcuuucuuuggaagccaaauugcuuuuccuaugucaugcccagacuucaacaaaggcuggauccuggugcagcuccucuaauaaugaaggagccagucgcucaauuguguucuuguggagcuggggggaauaacaucccuuuaugauccccaguuuagaucagcuuaccacgcagagcaugauauuugaugccccuuauuagguuacuuugaguagcuacaaauguuguucacgguguagccuuagcaagccuuuugaaaaaguucacauccuuacggggcgcaguccccgcuggaaaaggcucuggcgcugggauccugguaacaggagucugugagacucggcagcucuuggaccacaaaggugcugagaacgcucacauugucggcuagcaagugugcuuguugaggacuggccuguuuuuuccuuuuuaguguugacuuuuaaucucaaacuuaguguuucugggccugaauucuuuuuuuuuuuuuuuuaaagauuuauuuauuauuauaucuaaguacacuguagcugucuucagaugcaccagaagagggcaucccaucucauuacagaugguugugagccaccaugugguugcugggauuuggacucaggaccuuuggaagagcagucggugcucuuaaccacugagccaucucuccagccccugaauucuuaaaagaguggaagauuauggcuauuuuugagucuguccucaaaaaaaaaaacaaaaaaucaagguuucuauuuuuuccucuccuucuaaaugaucuucuggaucgguucuccccagcaacgcacagaagagcggaagaguccaguaaaccacaagaggcaaauggugaaaagaugcuuucuauuuuuuaggcucauuuauaaaguaggaagcugauuuguuucuuccaaaagucccucucuuuuuaaaaaaauuaauuuaaucuuauguucauuggugugaggaugucagaucccuggaaccggaguuagagauaauugugagaugccauguggguacugggaauugaaccuggguccccuagaagaacagucagugcucuuaaccacugagccaugucuuaagccccccccaaaagucccucuuacugauccucaggguuuuaaauguucuucucaucaguaaaagagugugggcaucuaccacuuccaagcagcaggcuguauggaacggccccgugcucucagugugaacuucuucugcgguacggauacauuucuuuuuaagaaugggaaugaggagcugcaaagaugacucagugguuaaacacacccagugcucuuguagaguaccuggguucaguucccagcacacacgugguggcucacagccaucuguaacuccagaucauggggcuguccaccaucuucuggcgucugugagcacugcauacauuauguaaugcaugcauacacgacggcaaaauaaucacacguguaaaauuaaauaaguaaauaaauaaauagauccaguauuuuuuuuuuuuaggaagaaccagaauuaaaauggagauagcauccuugcuuaaaaacuguuucaccauucauuggaucuaaggaaacaaccuauggauuuuagaaacuuuccuuaagaagcuagaguaguuugaaacaucuugauaauuuugagguuucuuuuuuucccaauacuuagucauauuugcuuauauuucauuuuauaguauagggaaaagggaaucuguuugcucaguuagugaggggagguuaggugucacccggauuguacaguguccuaacccacucaaaccagguguacauaaaaugcaaauuacaaauacugaaaguaaaaagaaggaagauaggccacuguacaacuauuuaaagauauuuuaaauaaauuguguguguguguguguguguguguguguguguguguguguguguguacaugcacacaagugcucacagaagccagaagagggcaccaaauccuuuggagccuguuauaggaaauuguaaccugcccaaagcggcacuuggaaacugaacuuuggucuccaguacugcgagaguagcaagcacugaaucaugucuccugcucccaacccuuucauuaugcaacaccucuacccuccucuggcaucccuuguggaacgccuucaccaucccuugcagaacaccccccuuggcaucccuuguggaacgccuuugccucucccuuuagcuguuuguaucauggaaucaucuaucacaagcacugagcucuacugagcuauugaaaacauaucuguuaaaaauucauaaagcuaaaccagaugccuucccugucucuaguuuuagaaguaaaccuaagcuguccuaauauuuaucucucgcucccugauagagacugucguucucggugaccauguuguguucuuaggaagcaagaguguggucucaguacucuuaucugugaaaagaacaggucagaguaauugaauugcaaggugccaaggcguuugcuguuguuccuugccuuaucugggaagaggaggugggguguuuaaccugcuuaauguacuauuuuaauucucuguagaaacuucuucuaggcagagggaguugcuagaggguagcaauaggcacagucagucuaaaagaaaauaguucagaaauaaagugacucaccaguaagauuugcuuuucaagucaagaccguagaauggugguuacaccaagucagaaauauagacgccuccccugcuccacggccacucaggaaagcauugucagaacucaugcuugaaauaucccucccuucaucugucuucccguaaagccacauguacauuagucaauagacuuguuacugugauuauguguggccauaccugccacuuacaaaccacgucugcuuacugauagggucauuacaccagugacucuugcugaucgacuuguucguuuaaaaugucgaagaggggcuguggggaugcuucaguggggaaagcgcuugcugccuaggcacaagaccugaauugugaucaccagcaucgauucaaagggcaggcaggcaggcauggcugcucauaccguggaggcagaggcaggggaauccuuccgguuuguuggcuaaccagcaaagccaaaucugagagcucaggguaccaugagagacccugccucaaaacaaaacaacaguagcaaaaacggacaagggaggcacucaguguuaccucugaccucugugugugcacacuuccacaaaugugugcagacacuugugcgcgcucaccuggacacgugugugcacacacauaagccguguauacacaugaauaugcgaaguuggggucacuaguucagaacugauggacccguggaaaggucaagagugggcuugugaaugaggugcccaccaagucccugaaauuauguguagaguuuggaucaauaaaucacuuuguggaaucuauguguaauuuacuaaaaauacaucaaaaccaucagaaaaugauaagaauuagcuguguagcagcuuuacauuuuaauucauuuaauuaaauuuuaauugacuuuaaagccuuuaauccaggcaauuaggggacagagcagguagaucucugaguuccaggccagccuggucuacagagugaguuccaagauagccagggcuacacagagaaacccuguuugcaaacaaacaaacaaacaaacaaacaaacaaacaaaagaaucggugcuauaggagagguacaggcaucuaaauuuaucuuuacuuaccaugaagaucagucguuuuauuaucaguacuuuauacaacuccccaacucugcugugcuuuaccccugcuaauauaugcagucaugacaguguuugacuuauugcugauaauaacugcuuacuuuaaaaaaaaaaaaucuguccuggaacuuacuaugcgguccaagcugaucggaaauuuggggauccucuugccuuggucucauggcugcugaccaugagcuauaaccacuuugcccaauccguuacuugauuccuguuauauauaauaaaaauaguaucuuaguucucuaaaaaaaaaaaaaaaaaaaaaaaaaggagaauuuaguuuuaaauuauaacugauaaaguacgaagaaccaugcagggaauuguuuuguaaaccucuguucugacucaucucauuuuaccgucuacacaaaagaggcucagaucucgcucuugaauaucauguagaaagaugauuccuuguuuccccugagaacccacugcaugacuucaucgcucuuggccacacaagaaucaugugguuuauugaaaggaacagaggacaaagacucagacacacugacaauaguccuagcuuugauacuuagcacuugaccugcucuguaaguuggccucucugacagucuucuuauguacaaauuaagaauaaguggguucacaaacauaguaguuuauguaguauaauaacaguaauauuuauuccuaucgugugugugugugugugcauguguguguuauaugaaauuucauuuuaguucugcuuucccuacaaggguauuugagaaucagaugcaauaauacauaucuuaucaauuaguaaacccuuaaguaugagucuuaaauucucuuucugucaaacuuauuuuucuuuauugagacaguaucuuaagccuugucuguccuugaauucacuauacagcugacuuugaacuucuguggauaguuucacauggccucaugcguguccugaucauccuuccaaggagggggaaaacagaagaaauacuugcagauaagagcugaaaaaaaaaaaaacagguugaaaacucuauaguuucagcuucauagaucugagaaacucaaugaucugcaauaaaaaagauagagaaaaaugauauuaaggcauacuguaauuaaauaacaucaaggcauaccauauucaaauuguuuaaaaccacugauaagaguaaaaucuuaaaauaacccaaugagaaaaggagaugcuuuguguagaagaagaaaggugacaaugaaacagaugugcuguuggggacagugcaggcaggccaugcaggagcgccauuaagagacaagcagucaacucauaucuauacccagcaaagacauauuccaaacaaugaugaaacauguggauauaaaacugucuuuuaauaguauaaguaauguuaagggaaggcuccaggccaauggacugagacacuauggaaacacaggucuguacaaagggaugaagaacaugaugcuacagcagugaccaauugucaccaauuauuaauaaacaauuguuuauuaauauuuuuuaagguuguugcuuuuuaaacuuagauuuauuuucaccagacacagcauauuaaaaguauuucuguuugauucugaaagauaauuaguuuaaaaugauaagauaugguauacaauuuauaauaaaaauuauaaauuuuuauuauaaauuuauauuauuuauuuauauauauuuauauuuauuuauaauaaaauuauaaauagcacacaggccaagaguuggggaaauagacaucuacauugaguauucuuuaccugaauuaucugaaaucggauguauuucauaacuuguaguuuuucagacauccaggcugucuaagcaggcucccucuugcagcuucgcagcuuuuccaguuggaauauuuuggauucagguuuucagacugaugauacccaacccuccuaguacuguggcauuuugaugcucuuuguggcauggaguaaaaccucuugaggauaagggguaacauguuuuaaaaaauguacuguaaagcugaaaguaaccacaaauuguuauaauuaauaaucaaaagaaauaaauuggaauuagaaauauucaaguaauuccaggaaagauaaaaugaagggagaauguaaccaguaagaaacagaagacacgacagaagaggcuuagcccaaccuuaucaguaaucacgugaaggaggagugaaggcauccgaaucaagaacagcucacuccaggaauggaagacuguuaacauuuuaaaucaguaauugcaauucaaaaugcuaacaagcagaaacguauaacaauuauagagacauagaaaaaguacuauaagucuaacauccauuggugacuacagaaacacacacacacacacaccucaaaccuuccagcugacuagaauagaugagagaugggagcuucaggguugagagcaaccuguaaaacccaguauuaaaaaaagcaauaauaaaaaaaucacauagcagaaugacaggcaggagauuugaauacuaugaaaauacucaugcugaaugaaaaaagccagaggaaauuauuguuaugauuuuaaagaaugcaaaagaaucuauggugacaguggucacugucuuagaguucccauugcugugauaaacaccacgacaaaaggcaacuuggaaagaaaggguuuaguuggcuuacacuuccacaucacagcccaucagugagggaagucaggguaggaacucaaggagaggccauggaggaacacugcuuacugauuuugccugcuuugguauagcucccaggacugccagcccaggguugguacugcucacagugagcugggcccucccacaucaguugucagucaaaaugcuaauagaggaaauccucagacuuaccugaguaaauaguacauuauguauugauuucucuguugggugaccuaugucuaauauuagaucauguguagggaucucgguggaagguaugaauuacuuguuaaauauaaagugugguuauaauuauuuuuuuauuguugagauucuagaguggagaaaguuccagaguuguuuagugaguacugcuuucuuuuauaaugggugacaaacaagaagacugcuucauaguuuuuggacaagucucugcuugucauggagaaucaggaagaaaacucaaaucugcuguuugguaaaauccuucacuaagggccugaugcuccuuaaaagaauaaugccaaaauauguuaaauuuauugugcuuuuaggaaaagugauaauaguuugagaauuguucauuguuauagccuuuguaauugauucuauauuuaaaauuuauuguauuuauauaaaauccuuauuuuucuuauccauaaccuuuuaaaacuugggauuuuaugugaguuuuuaaugaaucuuuaaaaaauauaugcauaugcugcaugaaaauuucuuccuuugccuuuuaauggggauaauuagaguuggagucauguguggcaaaauaucaucucaggaccuuaucuccugaaaacauuuuuaaaauguaaacacugaaaagcuuuacuuuggagucaagugcauuuugaagguuagaguuuauguucugacaugacaaccccgagaggauaucugcucuuugggcacuaguuagaauaggggcuugucugcauuccuuugaguccagugaauucugggcuagaacuggggaagggauucuaagcuaggaaguaauaacuugguuauuccagaggauucauaugggaaucgugagucaccaaucacuguuuccuguggccugacagcuaguuggugugguacucaagcauucauucagaggcauuuggcauuuauaggcaauuacaaucugggcacucaccuccccaguguauaauuuccugugacuacacaauacauaaaacaggagcgaaguacuuuuuuccagagaucagaaaaguguuguagaauaauucacaccauuccccgaagcuuaguuaaaucuuuccaucaauuuucccaguuucuggacagaucacacagugugcacacuugggucuaauaggucugcacugcccaguuagguucuaggccagcuuugaacaggaaaagaucacagggagcuugccgagcuguaggcguggaaggaagugaauaguaaccugcuaagaagguaguaaguggagcugugggcugggaaauggaguccagggaguggggugaggggggcaggagggaucuagucgggggaagauggagagagagagaguccugggauagagucaaggaggggggggggcaucucugggaugagcuagaaccuaggacaaauggaaacucccaggaaucuaugaggguggcuuuagcuaagacuccuaagagaguugccgugagaugaugauauguguagucccuaggagagggcuugguuuauggugagcacucacugguguuuguugcuaaaagaguaagauaaaaagauguuugugacuaggcacuaagcaccgauggcaacacuuuucggauggcgugccuaugugugcaugagucaaauuaaaaaggcggaggcaagugaaccucggcagagaccucuggaacugcaggucuuaucuaucuccuugcuaucgcuuggcugugggaauggggcauguggccaauggccucucauccacagacucagacuguaaugcgcaugugcugagugagggccaaccuugggcgcucccgggagcugcuccggacuugccuucugggcucagucuuuucagcuuucccuugggaagcaccugcacccaaagcuucccgguucgaucauuucaaguucugaaagauuuugacccaauaggcuuugccuuuuuuuuuuuuuuuuugaucccucucuuguuuuauuuacaaucggcuucuugguacagauaggcuaauuguuuucgucaucaguagaugaggggcgcaggugaagccagcaguccgggaggccauagaaaaaucuuuuuugcuguuguuuuuguuuuuccagcagcaaugaagaagaaaacgccaccguugguaggaaaauauauggaacugcaaauuguuaucacauuaagcuaaauaagccaaacucagaaaaacaacagcaaaaaccccauuuuugucuugugaaaucuagcuuaaaauuaaaagaugagaaaguagaaaggaggagcuauuuggucagaagaaggggcuagcaugacggaagcugaugaagagcuuuacugaauggagguguacggcccaucccauuccggcuacugggaagacaggacugguccgcuuugcugugcggagcaagcugccagguuaggaaggugaggugagcguaacggaucagaaugaggucacugcauguaacaugcauccuauguccaggaaugggugaauguaugugaacugaacaacacagaggauaugaauagcugacuaaagaaagcagagguggcgugccgugugucuuguaccucagcagaguguuaagcggggagggugcaggaaugggcauuaaugguggucaugcgggacaugguggaaucauaaagacaggaggggaaaaggcccgcuaugaaaugacucaggauuauuuuguuguuguuguugauuuuauuuuguagaaaacugccaggcuuccauuuaggagaugucuacauaagucucuuugaacucaggugucacucacccuuguccucauucuucacaguggggccuacgugaugcucucaaggucucuaauguuaauccaugcaccgaggccauucucaaacgagcaaaauacuuucuuuuucaauaguggagaauugacaaauccaggcuauugacaguaaaauugccuuuaaaagaagaguuucuauagcugcugcuuauugaacaaaagaaagagccaaccucaauucuuucggagcugaaggguugguucucugggaccuuuggagccuuuuaaauacccagugucucaguccaagggacaguugugcugguuaaguagcaaaggaaacucguauuuaaccaaguaaacaguauuccaauuccucuauucaagagugaguagacauuccaguuaacugguugaaagacacuaugauuauggggaauccugcugugaagugccacuguucuguaggaaaugggggggaggggagaauuggcccuugaaaauacucuccagguuugccuuacaguaggagggacgcucuucaguugcacuuuauuucuuagcuucuugugguuuuuauacauggugguggauucuggugacauggagaucuuuccauuugaaaauaggaaauggcaggaaaagggaagggcuguggugggcgauaagagaagcggaggagggugcacaguaccaguggggcugccccugaccagcaacccugagggucuguagacucugagucuagacuuuccucaagaucuuuuccauggauucccagaaggguugaacaauccuguuuuuuauguucuuagggcagcuuugucuucuucauuucaccauugcugucagaucuauuccaggaacuugggaucugccuucaguuuccuuugcccuggggucuuugacagaacaagaggcucagaucagacgaagcuuuucugccuucacaagucaguccucagcggcugcgcuguggaaagggcuccuuggcauagccugcaggcuuuugguggagguucucuguuccuggcuggcaucuacgaguucuucuucaggauaaucucugucgucuccaucugugccuuguucugcccacccucaaccagacccugaacacacaagcuagguaaaccucuuccuagauuuauuuucuccaaggccugaggggacccuagauuucuagcugaucuugucuucuguguuuccaggaccuuaaggcaacagaagacuuaaguggaauguaauauuucaauaaauucuuccauaauaguaacuugggauugcuggcgauugaaguacuugaagguuucucgugccuuggaaauguccccuguucaaaaagagauggccgagaggucaucuuuauauuuuccugauuacuuuagacuuugccuguuugccuugccuuuccaucuguuccccucucccauccuucucacucuccccccauuuccuuucccuguagggcuggaacccagagccucaugagcacuaagaccccccacaaaccacucugcuauacugcagccucuuucuuucuuugugugugcauauuuguuuguguguuggugcccauguaugcaugcauguguggaagacucaggacagcaucaaguguaguucuucaggugcuguccaacuucuuucuaaucaguuaaagugugugugugugugugugugugugugugugugugugugugugugugaacaugcaugugcauuugugagauugugcaugcacacuauguggaaaucaagucaaagggcaauuuugaagacuugguucucuccuucgaccauuaguccugggaacugaacucaggcccucaaggacucuaccaacugagccaucugcccagcccuuaacccauuucuuuaauuaguaguuccugacugguuuaagaaguaucuuuuuucuguauaagaaauuuuuuaacauuaugaauuauuuuuagagccuggaaaaauauaggcacaguguaaguaugucuguguacuagccccuaacccacugaauacacauuaaacuuuuugccauaaguccuuaaaacauaucuuuuuaaaaagagcgauaggcccaaccaaucuuacugcacgccuugaccccagcuucccucuccgauagcuacucuccugaacuuguuuguauuagucacauauguaagcuuucuuacauacauaugguguuauaagcagcacugacaguaugcauauguaugauuuacaguaaguggcacacucuaugcauccuucagcagcuucccuuuuccacuuauuauuuuuuaagaaacagaugggauucaucuagugagcgucagaguauuugcugacucucuacuggucaagcaacugucuuacuucucuuguugcuguuacaaaaucgcugacaaagcaagguaaggaagaagggcuguguucugggcuacaguguaggagauacaauucuucauaguagggagucauggugacagagcaagagguggccugucacagcacauccacaccaggaaggagagagcaaacaggaaguagggcuggccuuuacaaucucaauggaggcuaggccaucucugugggccucacacucacgucagggaucuugccugugcugucaguagauuaacgugugugaggagcucuguauaauaguagggcgguuggaagcucuuuguaaauauuugccauuguguuguagguuacuguggguggaggagucggggaaaggggacuuuaggaggguggaugagggaaaaaccuggcugagcugagucagaggacagucuuagaacucggaaucugaggaggcagaggggugaagaagauaaaggaucuagaaacucaggaagugaccgugcaucagaggaagcaguguuggucucugaugguuggagcuuuagggaugguagaaggcauacacauuuucuuguuucagggcaauucagggcucuuucuaauacccuuuccccucagacuguucaacgaagcccauuagaucuuuccaauuauaucagccgcuuuggcaaagcuuuaagagacucaaggaaguugaauauuugagggaguauaaagauuagauuaaauuucaacugaaauuuucuuuuuccaauuuuuuuuuuuaucuuucaaauauauauuuguuugggccaggaagcacuuaagauuagaggcgggugguggcuuuaauugguaaaugaauguuaggcuuaaaccauagguguuaaaaaugugugagaaaauguagcauugacuauugaagacauucaaggggcgagucaaggccugggacuaugucaggagugcagcacagccugccuacuguaggucucauggugagccugguaucucuucaauguccaucucaggcauucacucucaagugugugcuucagugcuggacuucaggcccugauucugggcaaguuccucacuucuaaaguuguaaagugacucugaguaacagugcggccacgcacguuucauagaagacaggcuaugucggcuugauaaauaaauauaaguugauacaucuagaguuucccccauacuuuacaugggcugacuucuuuuaaaauugcaaguucuaguuucacaagaauacaauauauaaggcaaacuauugcgcaguuaucauaugacuguacauuuaugugguugcuauccaguuacauuagggaggccugugugugugcaggcccagaggcaggaaggguacagaauaggcgcuccuguggagggaugaucaugccuuuggucuuuucucuuuuagcuuuauucuaaaggauguuuuguuucuugcaacuucauaucugauucuugguuugaaaauauauuucauuuuuaaauuagcgcacaaaggaguaggcuucauuauggcguuuucauacacucuucucccggccgucugucuuuccccuccuccuccacucucgcgcugucuccuucuuccuuaccagccccauuccgauuucacaucacacacacucuguucaccuccugaccugccuuaauaacccucuuuuucccucuuagcaucucuuuucuacuuucauagauuuuucucuacauaugcauguuuaaaaaugaaaauauaagguuuguuuaugagagaaaauauagcauuuuuuuucuucccaagucuggcuuauuucacuugcuauaauaauuucuggcugcauucaguuuucuacaagugacagugauuuccuuuaucuucagaauccuugcugaaguaucaaccgaggcggggacuacgucauagagugguguggaugaaaggagaauacacacagggcaucagagacauggaugucacaauguauacacuuagggguuuuuuuuuuuuuuguuuuguuuuuuguuuuuuuuuuguuuuguuuuguuuuuuuguuuuucgagacaggguuucucugaauaucccuggcuguccuggaacucacuuuguagaccaggcuggccucgaacucagaaauccgccugccucugccucccgagugcugggauuaaaggugagcgccaccacgcccggcuacauuuaguauuuuaaucacuguauuuugcauuguaagaaaugccaguguccuuuaaaacauucauauacagguaguagguuuauauauaacauugccacucucaguauuugaaaccuguguccagacuucucccguucacuguaugauaagcacagcuuucucacagcugccuuugcucuguggucuaaaagguacaggaaguguauaaggaagagaaagcuccuuuccaccaugcguccaccugcauuuccuccugagaagcacuuccugucuuuucuuuuuccucugucauuauuguugugccaacauuaaauacguguuaagugguaacagccguaaguuaggaaauucaggcuuggguuugaauuucaguuucaucauguaauugaagugucucgaagagggcuggggagauggcuuagugguucagagcgcuggcugcucuuccagagguacugaguucaguucccaucacccacaugguggcucacaaccaucuguaaugggauccaaugucuucuuguuacauguaggccuacaugcaggcagagcacucuuacacagaaaaugcauaaauaaaugagccuuuuaaagagaagagggggcagaggcagaggagucaucuugaagcaagccauaggcuucccgagcuuaccucuaguauauaccucuauagaaacagguuacaaaaauaacagcaugggugauuaaaguauuugaacaguacuuggcauuccauauuuaaaucuacaauuauuucccaaaauguguuuuacagcugcucgguccaagccgagcaccuaggagcauauucacguguggcuguguaucucgggccucuuuuaauuuaacucucucaguugucaugcagcacacucacuguuucaguuuuacacugacugggcucuggagaaaccagccugauggcccugaagaguagcuugucuucugauggcuaacucucagugguuagcgugcagcucuaaguccuuguaauuuuuuuaaaaauauuucuuuuguuuuuuugagauuauuuauaucauuuccuucuucccuuccucccugcaaagucuaccaucuaccucuccuuuaucucuuucaaauucauggcuuccuuuuuccacuaauuguuguuuacauacauguguguguguguauguguguguguuuguauauguauguguguaugcauguauguaugcguaugacagugcacaugugagauggugugcauguggagccagaggacagcuuuugagaguugcgguucuugucuuccgucuuguugaaacagggucucuuguuucugcucuucagcguacucuagcugggauucagcugguuguagacaugcacaacuguaaucccagggcagaagcagaggaauuuuugaguuugagaucagccugaccuaccuaccuuagcuuaucacacuucaaauguguaucuuaaagaucauucuaagcugggcaguaguggcgcaugccuuuaaucccagcacuggggaggcagaggcaggcggauuucugaguuugaggccagccuggucuacaaagugaguuccaggacagucagggcuacacagagaaacccugucucgaaaacccaaaacccaaaaaaaaaaaaaaaaaaaagaucauucuauuucuguuuguuucauuuaaaaaaagaugcaaagcaauaucuuuuauacuuauuagauauaaaagcaaaaaaaaaaaaaagaaaaagaaaaccgccuauggguaaaaugauuucuaauauaucgcaugcuaauauuuugcuugacugugggcaaauaaaauuauuauauaugauuaacaaauuacauaaaaucaaauagguucuccuaagcaucaagccccagcuuuauauuaaccauuuccaaugcaaagccaucagcacagcuaauuugcagccuuaaaucucuaggcaagugguagagaucauuuugaacaaggcgugcaaggugacccaaaccauauugauucaccacuggaauaguaguuugaaaaauuaggaaguuaugcaagauauccuacuaauugauuucuuucaacacaaaauaaaugugccuauaaagagucauaaaugucaggcaugguggcacacaccuuuacuccuagcacucagaggcugaagcagauggaguugaguucaaggccagccuggucuacagagucaauuaucuaggacagccagggauacacaaagaaacacuggcucaaacaaacaaacaaaccaaccaaccaaccaaccaaacuuauaacuguagaagaacuucuaaaagugagaacuuaauagaauggaugcuuaaggguaggauguaaggggcucuccugaaucaauaggcugacucaauugaccauugucuuuuccaaugauaaaucuaaagccauucuuaggauuuguaaaaacaaaucaaaacaaaacaaaaccccccaaaagugcaaaguuaaauaguaggcaauauaauauuuuaaaaacuauuuaauuauauuaaauuaggacuaaauaauauccuagaaaagaguguaaaacauagaaaucuaucauuuugagagaacaucaaagauuauuagaaguugauaugcagaucacuucagguuaguacaugugcagcugaggcaggcucuguguucagaucauaucacucuuugacuguuucauacgauuugacauauuacauugccaugaaaaauuuaagugaauagaugauucugauaauugguaugauuuugugaauauuugagaauuugaagcucauauacaugaaauuauacauaaguauaaaagcauuugaaauggguuucccacuuagcuucagucccuauucucuuauaggacacaacuacuuguuuauauucugugguacauauuaacugucuuguauaaauagguauacaugagcgaaacauaauauaauuuguauucaucgucuaugcuaaauauaaaaaucacuaagucaccuaagaauagguguugagcugggugugguaauguaugccguaaucucaacaguuaggaggagggaacaggauuaucuugacuuccaggcuagccugggcuacauaacaagaccuugucucaaaaauaaaaaaaaaggguaaacuguuguacaucagaagucuuaaacauauaaguaacauacauguuuagauuuguuuuaucauacagaagcaaacauggauaggaaacauggauauucuuugaggcauuguguguaagaauuggaaaccauguaaauaccauacagugaggauuucaucauguaaguaaugagauaguaauauguggccauuaaauguuguauugauaggaacaugaaagcauacaaauaaugaauuaauacuaaauaugagcacauuuuaaacuccacccccgagguaccuguguuuagaaaguggcucugagaaaauauaaagauauuagguacuauuucuggacaguaagauggguauaauuuaaauuuucuguguguauuuuauacaagcaacaacauuuuucauuuuugcgugccccuacuuguuuguaugugaaccauaugugugcaguacuugcagaggccagaagagggugguacguccccuggaacuguaauuaaaggcagaugugagccacuugaugugggaacugagaauugaaccuagggccucugcaagagcagcuaaugcucuuaaacauuggguccacuucuuacuuucucauagccuaauuuuuuuauucuucccuuuuuaguuugccuucccuguucugaaaagggguccacuaaucuggagugaccuuucacagggaaaggggaggaauguggcuauggucggauuauuuugaaggugaacauuucaggcaugaauucaucucugcaugaguagacgcuaacccuuuuguggcuauugugcaugucauuaaguuuacuuucuuuguccuuuacacguccaaaugcuauacuuccccuaaacugaaauacucagcucgaauauaaaugaaaaucuuagccucuguucagaagcucaugucuuauagaagcacuggguguggaaagccccaagccccaugcugagucuguuauuguuuccugacuugaucuggaugugucaccaggugaccuacuguuuguuccuugucagacagacuuucugggugacuucuugcacacugugcuuccugugugccuuaggcgcauuaccaaauauuucacgggagcuaauuuuuuuuuuuuuuugguaauauguucuuucuagauauaaagacuugaaguagcccuuccagucuaaagauggaaaacaguaccaccaccauuucucgggaggagcuugaagagcuacaagaagcguuuaauaaaauagguaagguuaaggaagcugugguaucugguucugcuugcugccuggcuucagggauggagcaguggccuugucuccugcugccucugagcucuccucaggccucagcucucacaggcagggcucagcucuccucaggcagggcucagcucuccucaggcagggcucagcucuccucaggcagggcucagcucuccucaggcagggcucagcucuucucaggcaagggcucagggcucagcucucuucagggcucagcucuccucagggcucagcucuccucagggcucagcucucuucagagcucagcucuucucagggcucagcucuccucaggcaaggcucagcucuccucaggguguucccuuucuuuuucuacccagguuucacuuaauucuuucugaaagauaagcuuucauuucuagguguauuggacuuuaguucuugaucacuaugcacagaggacaauccagguuaaugaaugacaguauaacugaaugcacuuugcaugguaugcuuguuacagaaaagagaauacagaaacauuuccuuguguauggacugaacucugucucaugccuuagucaccaacagaaguacucucugacucaauacagaaccuauaaaaauauaguuuuguuuuuaaaggcugcaugucuccuuuucccgccuauacauaauuuuuuuuuaaaguuauacuauucuuuucaaagacuguuucuucuuuuuuucccccuucguucucugaaaucccagguuucaauuugacauuaucggcuuagcagcuuuguacuuuccucuucuaaaacauuuuccucacuguuugucaaauuggucucacacuuuccuauuuaaaaacuucgggggcuggcgagauggcucagugguuaagagcgccgacugcucuucugaaggucccgaguucaaaucccagcaaccacaugguggcucacaaccauccauaacaaaaucugaugcccucuucuggagugucugaagacagcuacaguguacuuacauauaauaaauaaauaaaucuuuaaaaaaaaaaaaacuucgguaaacuaggagaaucccucccucccucccucccucccucccucccucccucccucccuucuuccuuugcuucaguuuguaaauguaugcagguagcaagugaacucugaacccugagcucagucagcagacacugagccugagcaagcucaccgcccuuccucagcggaguucuuggggaacaauccgcugcuuggaaagcaagagaugguggagcagggaggauguggccacagauggucggucucacgccugggccucucgccagccuccugagcaaugaccaaaacuuccauagggcuaaccuuacaguaugaugauaauaauaaugauuauuacuauuaauuauugucauuuuuaaaaauguaacuugucuugucuuuuaaaagcgacccacaaaucaccaguguguaaacaagcacugguaaaacuccccgagccuuccucgugggccuggagaggggaguggacuuguuccccuuugucacuguaacaucacgugaauguggcaugauuugcagaaagccaucagcaauaaaugucuuagaauauugucugcagugcucagcauuuuuuccaagccaagaauuggggaguuacugaaauguucucucuuauuuuagguacucggaaccagguaauaaagugguucugccagcuugcgcccuggucacuguacgggugccuggaaggagagcgccccuuucugggucucagugaaaugaguuagcaaccuguuuucuucgucgagcgugccaacuuuaaucuuucugacucacggaaacauaaucuugcaauauuuaauuaaugguauuuugaacagacaguccaccaauggaauaauuuugacaguaagaucguuugcucuuugagggagccgcuaacgcuggcagaacguggccuugcugaccuuuuacgagagaaacggggauucuucagcucaggaagcccagacaacuccuccagaggcagaacacaccgcacagccugacuggaagggguauuuucaggucacuguggaaagugggcaguuaaaaauaugucugcccuguuuucuuuuuaaaaccggguuaaaacacaccagagcauucugcucaucuugaguggccaguucagugggagcaaguccauucacuuacucuccuucaucuugucgcacuagaacgaccaucuagucauugccauaugcagggauccaucccauaaucagcuuccaaaugcugacaccauugcauacacuagcaagauuuugcugaaaggacccagauauagcucucucuugugagacuaugccggggccuagcaaacacagaaguggaugaucacagucagcuauuggaugggucacacggccccuaauggaggagcuagagaaauuacccaaggagcuaaagggaucugcaacccuauagguggaacaacaauaugaacuaaccaguaccugggagcucuugucuuuagcugcauauguaucaaaagauggccuagucggccaucacugcaaagagaggcccauuggacuugcaaacguuguaugccccaguacaggggaaagccagggccaaaaagggggaguggguggguaggggauuggggggguggguaugggggaccuuugggauagcauugaaaauguaaacgaggaaaauaccuaauuaaaaaaaaacaaaaaaacaaacaaacaaaaaaaagaacuccacaucuguuaaacagcugcucccaggucccucucccccagccccuggaaaccaccauuguccuuucugacugaaucuuccucuuguagggaccuugcccaaguggagucauccaguagcugugccuuuaugauguagcacgcgucacaacugccuuuccuuuuaaagccugaauaguguucuauugugugcacaacagcagcauuuugcucaccugugcugucauugguagccuuucgaguuccugguuguuuugaaucauguuguugugaacucaggugcacaaauaacugcucgagauccauugucaguucuggguguccuccguauguggacuuacagggugcucuugcauccacaaucgauugcugggguacagcuaacuccuuuucaaugugggggugcuccuuucuauccccaccaacaugguacaguuguucucacuucugcccauccuuaccacugucugcucuguugcuauagucugcuuuguaccaaccacccuuaugguuacaagcagaaucuuguuguaguuuuguguuucccaagcgaguacagagauggaacaaauuucuuacagugccugguaugcuuucucuagagagaaaucuauauucaagcccuuugccugucucaaauuguuguaccuuugucuccgucuagugauuucagucugcggucaaagcuugggagcuauagguguaugaguuuacuucuaggacccgaauuccauuucauuaguggguuugucagcuuuugggccaguucccguuucagauacuauggcucgguaguguaguuugagguaagcuacuguacggcccccagcacugcuccuucucuucaggacugauugggauauuaaaaguguuuuguguuuucauuugaguuuugagauuguucuuuuggcugggcagugguggcgcaugccuuuaaucccagcauuugggagguagaggcagguagauuucugaguucaaggccagccuggucuacagagugagcuccaggacagccagggcuacacagagaaacccugucucgaaaaaaaccaaaaaccaaccaaacaaaaaacaacaacaacaacaacaacaaaaaacccaaaaaagauuauucuuuugugguucuguaaagauugucauuggaauuuugauagagguugcacugaauacauagacuguuucugagugauucagucguuuuuauauuaauucugcuacccaugagcaugacccgucuuuccacuaucuccugucuucagacucauucuugauuguuuccagguuuucacuauagagaucuuugucuucuugguuagguuuauguauuuguucucucucucucucucucucucucucuauauauauauauauauauauauauauauauguauguauacauacauauauauguguguguguguauacauauauauacauaaaauuuauaauuuugauaaaugguucccuuuauuaauuuguagcuauauucuuuaucuuuucugaauaauuugguuugaaaucuacuuuaccagauguggaaguaguuaugccgguuuguauuugauuuccuauguguuugauagguugacauuuuuuuaucugucugacuguggaugcauuuuugccagugagcuaugaucuuuggaaauagcaaaugauuggauuuuggggugggggaaacuugguuaacuagacugcuuuuuuggaauuuggaaccauuuccuuuuaagauuauuuaaguuugauaauuccugugagccaguuguuucucaaguguuuuuucucucuccccccucuuuccuccccucucccucucccucacccccccucuucccacucccucucucuuuuugcccuauugguauuagggauuacuguguugggcuuccuaguucucuuuuguuauccuuagcucucacuaagcuucuuuuucugugcucagcccucaagacaggguuucucuguguagccccggcuguccuggaacucacucucuacaccaggcuguccauguagucggauccaccugucucugccuucgagugcugggauuaaaggugugcacuacugcuaggcuucucuuuucucucuuugcacagcaucccucgaaguguuuucugcacugcuggauugauggucagugaacugccuuaguuugugcuugucuugaaagguccuuauuucugcaucaguuuucauugauagauagcucugcuggagauagcauccuuaguuggcagugauuuacuuuacagacuugaaauaaugcuuccuagcuuuuagggguacaguaagaaauuucauguuauucugauguauuuuuuuuauagaugaguugcuauuuuuuccucacagauuuuaauauuucaauuuuaacaucuuggcugaaauauauuaaggagacauuuuuuuuaucauccugcuucuuuggggguucucaaugucucuugugauuggauguccauuucuuucuauagacuuagggaauugcuuguuagaauuuuguugauagauucuuucuuuaauucuuaucugagcuucuacucuguggguuauuggguuuacucuuuaaucuuaccuuagaguucuucgacguguggucauccgcucucccucucugcauuuguuaauguuugacugucauacuuuauugacgucauuauccauccuugguuuucuuccuucugcaugguugagucuauugccaaugggugcuuuauacuacauuuuuuauuugguucauaaaguuuucagauuccagaauuucuauucauuuagugucugccccauccauuaauauuuuugcgacuuucuuuccucucuguugccuuuuucuacauauugguaccuuacucuacugacuuggcccucaguguugagggguuuucuuuauguucggaauugauuuucuucguuuccuuuccuucccuuuccccucccuucccuuccccuucucccuccccuccccuccccuccccuccccuccccuccccucccucccucccucccucccucccucccuuccuuccuuccuuccuuccuuccucccuuucuucccuccuucuuuucccccucucuuucccuccauucuucccuuccucccuuccgguuuuccuccaccugcuuguuuauaauccuaucuaaggccacugaccguuuucuugccuaguaaacuuaggagauuuucaucuaaaauuaaucacccccacuucagcaccuuugaaugcaguaguuggguaguuaugaucuuuuagagacaccauguuaucuugcccccuuuuaacuguuucuuugaugcugugacauguguguuggguugaauaucucuucuucuuauuuggggauguuuuuacugagcauccuacaccugagggcucacgaugauacuccagcaucagccagagaaaacaaacugcuuuaacaacaaaaaccacaccaagcaauauaagggacagaaauauaguuagagcccaccagugcaucaguaaggaauaagauagaaaauggcaaaaccaauguguaguguuggaugaaguuaauauauuacucaaacguggaaauaguaaauuagugagcuaagggaaaggggacaggaaaaggaaaagcagaagacaaaugaaacuagacaggaggggagagaaugcuucagaaaagaggaaagugcaagaagugaaaaucaaacaagaagugggggcuguaaauggaugugcgcaggaugugugcacagcugaagucagcucacauccuucucucacucagccuggagaggcacuggccacagcuaggaugggccuucccuucucagguaagccuuugaggaaacacccuccaaggcacacccagagaugcacucccauuucuaaaucuagucaaggugacaugaagauggagcuucacguauguacuucucugguguaaugguggcacucuggacucugacaagauucugugugagcugacggccaugccauugccagaacacucaagauggcagcuugauguguugccaacuaagcagaauuguuuugugcucucuuuguuuggagcccagaggugcucccagucucuagggaacccugccaccugcccaaggccaccuuagugauaacaugaaaccauucagaaguguauuuccagaaguccaaauauaggggugaaauuucuuuaacaccugaucccaaaauguuaucaaacaugauuaaacauauguaacaguaugagaaauauauacaagcaauaaauuaucaacaaguaaaaugauuacauguguuuuauaugcaacagauagauauuauguaaggaauguggggccugugugugugugugugugugugugugugugcuugauauuucaagacaggguuucuuuguguagcccugguuguccuaaaacuccaucuguagacuaggauggccuuaaacucacagaaauccuccuuccucugccuccagaguggugggaauaaagauaugcacuauggcugggcuaacacucuuuuuuauuuacuuaaccuauuuauguaugugaaugucuugccugcaugcauguauaaguaccagauacaugccugguauccuugaaggucagaagagggcauuggaucuccuagaacuggaguuacagauaauuaugagcuaccaugugggugcugggaauugaaccccaguccucugcaagaacaacacauguucuuagccacugagccaucauuuuagcccccauuuuuuuuaaaagcauuuuuuuuuagauuuauuuauugguuauauguaaguacacuguagcugucuucagacacuccugaagagggagucagaucucguuacggauaguugugagccaccaugugguugcugggauuugaacuccgaaccuucggaagagcagucgggugcucuuacccacugagccaucucaccagcuccagcccccguuuuauaaauuuucucagcauaaagucugggugguuauuccaucuugaccuuugcugauauuuuucuuuuauauaucugacacucccccaagauuauuucucugaagcaaagauuucugucagagcucuguccaugccauauacuuaaaguacauaggugagcucuaaaucuaugaaaugaacucuauuuaagcaugagugcuuugauuaaguguauuguacaguaugauuauuuuaaugagaugccccauggucucuggcauuugaauacuuggcacccaguagguaacaguuugggaagguuuaggaggugugggcuugcuagaugaccgaaguugcuaggggugggcuuugagagguuaaugagucaggucacuuuuaguucacucuaucugcuucaugauugugcuucaggaugugagccccaggccucuuguuccugcccugauggacucuuagcccucggaacggucaguccaaauaagcuccuugcucuguaagucgucuuggacuuuaucguagcaacagagaaguaacuaaugccuacacacccuguaucguucagauuuaggaauaaagugcugauucucgcccuuccuaaugcuggggcccuucaguacaguuccucaugcaguggugacccccaaccaugaaagcugggacccuucaguacaguuccucaugcuguggugacccccaaccaugaaagcugggacccuucaauacaguuccucaugcuguggugaccccccccagccaugaaauuauuucuguuucuacuucauaacuguaacuugacuauuguuuugaaucauaauguaaacgucuguauuuuaugauggucuccgguguccccuaugaaagagucauuaacccacagguugagaacugccagaguaaaggcuccucccacuuuauaaaacaaacguuuagaguucugccuugccuucauuugacaguuuaccauguaucuuuacagauauugacaacaguggauauguuagugacuaugaacuucaggaccuauuuaaggaggcaagccuuccccuuccuggguacaaggugcgcgagauuguggagaaaauauuaguaguugccgacaacaacaaagaugguaaaaucaguuuugaggaguucgugucggugaguaguccaauacuuuccuaguuaugaaucaucuugucccgaguaggcucucaguaaugccuuuguuagguuugauaugaucuggcugcagagggcaggcaaaaccucacuuucaaaaugaugauggugaugauguucauaacauuguuguggaaauaauuucuacaaaucauacaacaaaggagaauauugaauggaaaucaaguucagauaacaaucauucaggcccuagaauaacuguacuuaaguugaauauuaucgaucaguaguauaauugaauaagauguaaauuuucugguuuugcauucuuuaucuauuaaguaaauauuugaguccugggcauuguaaacagcgugaugagcagaaagagaugugguccuugcauuuguggcauguccucauggcagggaaggcagcaucacagaagcagauagaaacgccagcuguggugacugcugugguagagcagcacaggccccgugagugagcggcuaggaugcuuggggcugagcuugaaguggguaauggagcacccggggaccuggggacccggggaagucaccuccaucugggaggaaagaaguuaaguaggaaaggggguggggccgauagugugggaagcaauuagaaguggcagugugucccgagacccuguaguccuggagaugcuggaucuuucaagcaaucagaaagaggguagagcugagggggugagcaguggggcaggaaucaggucuugugggccacagaggauuuuuuuuuuuauccugaccaccaggaggucacugaacuaggaagaggugaucugauuagaucacaaaagagucaucucgacuguuacauguggaaauuauuacuucauuuagccuugcugcucucuguggagcucagggaaugacagggagagggaguuuuuguuaaggcucuagauaguccgacaaaugcugacuuauuuacuugaacaccuauuuaucauggggacguucaggcagcaguuugccuucacuagaguauuuuaaugucuuuauuauagagugauuuuguggucuaaaguaguaaagacuuuggcuauacaauacuauugccaguguauucaguuucagcuuagcuguaauguguucuugugguugcguuacagacguuaguccauuuugugcgaucgguaaaauggcagaguuggcuguuuauacaggcgucgagcacgagagcaccugguucaugcuuacaugugugucauuucagauaaaugcaaaccuuagcugucguucaugucacuaaagugucucaauuuuaccuguacuccauuccagcugaugcaagagcuaaaaagcaaagauaucagcaaaacguuucgaaaaauaauuaacaaaagggaagggaucacugccaucggggggacgucauccaucuccagcgagggcacccagcauucguacucagguauguccccuccgagucuggccugucaguccaugaugccguuaguaaaugucuuccagccuaagcugccguugugauucaagccauuauuuuuccauaugguggcggagggagaggaaagcugcagaguuaauuauacugugauuuaaauauaucucgaguucagcgcugccaacaugaaaaaugccagcgucacuggaugcuugcguucacgucuccccacuguaugucucaaaccgaagccaucgaaaacaaaacggaugcugcuugcauucgcucuggguggguucugggugggagcauuguaaaggauuuuggggagugaucccugaggauuaaauccagggccucaggcacacuuggggagugcuguaccauagcuguauaccccagccuucgucaccacucuuugagugacuuucucaccauggugacaugcuuggcuuguagagcugaucugagaacgggauugggggugggguggggagauucuugcuuauuguaaggauuuuuuucccuuccauuuuucaagacugaugcaguuuuugaucaggccaccaagugcauaggggacauuucaccugaugugucugaucugauuggaucccugggucguuugcucaguuugaaacccgaaguagcagcaacucccuugaaaggcuuaugccuguuaggcaagagccuccucuggaaacacaucaacucaugugugugcacauguguguuuguuauuuuuugcuuauguuaacuuuauucaguacuggauuucauugugaucuucuuaugcacauguguaauguauuuggaccucccccacucuggcuggccaccuucuucccaacccuaacccaauacaucuuuuauaagccccagaucacagcaguuauauccuucuuaggugauagaguuuauuuccauugauuucuuuuuugccuuuuccucugauuuaaacaaucuauauguagguggguauaauuggccucucgugaguuguuucuaacucaggugauuucaguagcaguuuacaucugggaauauccagccaaaugcauuuucuacgaauguaagaugcaugcccuccuucuugucuaccgugcagcgaauccccuuucuccauccccgaagucuuugaucggaucucaguaguguucaacaguguugcucacucucucgcuuaacaggagcgaacaaguauguucuuguuagugugauaaauggugugaaugaaguuugccuacugagacucucuguuuucagaggaagaaaaaguggcuuuugugaacuggauaaacaaagcucuggagaaugaugcagacuguagccaccuccuacccaugaaccccaacgacggcagccuuuucaagucgcuggcagauggcauccuucucuggugagcugaacacgggagccgugcacuccuacugucccagcgcuggguguucccuggacacugcucuccagaggaugagucacgacuguccagaaacuuaaguguuguguggucuucagcaucuccccugggauguaguauuucguaucuguuaccauaacaacgcauggagcuucagaguccgucacuguguuguaaaauguugacaugguuuuucuuuccgcuucucugugagagugcugacaggggugggagcauggggcggggcguagaaggaagacacgccuucauuagacgcaaaugaagccgaauuucauuucagcuucugcucuucucugucuguuucgcacacacuuccuugugaacuuccuaggagcucaucugucuuugucauguuuaccacagguguauggucacagcauacuucuuuuuaaaaaacaaaaacaaaacaaaacaaaaaaaaccacuugaaauucaaccuguuuucuuuguguguguguguguguguguguguguguguguguguguuuugcuugcauguauauguacagcaccuaugcuugaugcccguggaggucagaagaggauaucaaaucccugaaacuacaguuucaagaugcuugugagccaccuugugggugcugggaguugaacucuguucuucuucaagaccaagaaaugcucucaacuucugagccaucucgcuaguaccaagucccagcacacaucuuuauacaaugcagugucuuuauuuuuuuuaauuaaaaaaaaauauauaguacaauuacaaagaaaaugcauaucacaaauacccagagcaccugugacuaacucagcaccuggcauguugucuucaggguuguuuuguguguguguguguguguguguguguguguguguuguguauuuauuuaaaaaggaaauaaaaucccugaaccuuccuauaaauauaggaaaucaguaucuauaaaauauacuuuaguuuucauuuauauuuuuuucucuucccccaacuuuuagagaaugucugacuaugagccaaaacuacuuucuuauuuuuauauucugaaacauagagacaaaaauccauauuuuuucuuuuuaaaauguguaaauuucuuuuuccuuuuugauuuuucaagauaguuucccuguguagcccugacugucuuagaacuugauacauagaccaggcuggccucaaagucagagauccaccugccucugccucccuacugcugaaauuuaaggguauguggcaccacugucccgcuaaaaugucuaaauuauugaaguccucaaccaaggcguuugcuccuucaccuucugagacaacacaauucauaguguguugacguccauggaagccggaaguuucaggauuugucuuggguaguuaaucuguuuccaucugaggaaacaguggagauuccgaugcagcgaguggaggcgggccacuguagaaggcagugaugggcucagacagacagcugucugaaguuuucuaaugacguaccugacacgaacggcugcucaguaagauagaaaggcuauucuuuucuaaaguaaccaaucggauugcuuugccacgaugaauuaaaaacauuucuagaaaguuucggcuaaaugguuccuguucucucuucagcaaaaugaucaacuuauccgagccagauacgauugacgagagagccaucaauaagaagaagcucacuccguucacggugucggugaguaccugccucuugcuggcaaugugugacugugcucaaagcuguccguggugcuggggauuuaaacacaaccugucauuuaaaaaaaugugaaaagaauuccagugucucgaauugaaaccaagcuacauuuuauaauagaauccauuaagguuuuaaguacuuuggauaaaucucuguauuaaaggccguagugcuaguuuacauuacaguugcucuuuuauugaugaucuuuggaugccaguguccauuuguccucuucccuuccuccuucccucccccuccuucccuuuuccuuccauccccgucucuucuuccucuuuacaucauacacucugccucuuuugucuucucucucuuuuuuucuuucacacagggcacguggcaggcuagcccaaugaagaguugggggucaaagagagcaccgugcaguuaggccauauuucacuaguucacaaaguguuuauucuuucuguguuaaucuuuccuuagaggcuaaccagagucugaauuuagaguccucaauuuucccuuuuacaccugcugagcaaaugcagagcaauuaauacucaccaaguuuuuuaaagcauaagugagcugaacaugguggugcacacgccuaaucccgguaccuggggagcagagacaaggggaucucugugaauuucagguccaccggggacugaaaaccaaacagcuaaacaaaccauugugcgaauuauuccccgacucuucccagaaauuuuauaaugagguauauacuuugagaucaggaaugugcaauucuugauuuugcuaaaauuauacugccuuccuucuaaagcaaacugugaccuuagaaagugauacaggacugguuuugaacugggaaaaagguguccuuuuuuauugucguccuugagaaauggaaaaccuggugcugagcacaggacuuucuugccccuuccuugauaacagccccaugauguugcguccgccccguagaaauaccauugucaaaggccguuuccaacacagucccccaaagauuauucucucucucauuuugugauaggcuuuucaguaaaugagugugaauacugaaaauuuacaucugccuuccuuuuuagaaauacacaggucguaaguguuuauggcacugaacaugaaauccagcauuuccuguggacuuuauaaacuuacuguugaugaacuguuagacuuccuuuaacaugccuguggagugcauuaaauaacauaaaguaucuugugauuaauucacaguagcuacagaaaggagcugaggggcucaauaucauacaguucuguuuuuagagacaacacuuuuccuaugcgauuauuaacccaagccuuuuggaugcuugagaggauucguguggggauuuugagaaagcgucaccauggguguuaacucugucuuaguuguuuaagacuuuagggucuagagcagaagauauagucuagacaguuacuguuacgaugcuggcgccugcuggagugugaagcaagggggagaagagcuuugaggguugucuggguaacacugagaccaacuucaacagacaaaugcacuaccaguuccgaugagacguuuuaauuguuacagacgacaagauuguggauucccguuccccaccguaugacaguaggguccugugaugccaugcuacagagagcugaauggggaugaaugacauguggagguuauaaaacuaagggaaaugggcagaucaagagaagaggagucuccugugauuuuguuuuuuuaccagagcuggggacugaacacagaggucggucacugagcgaaauccccagccucagggcuccuuuacgacccugaaaugucugaucgagggaagaugaggaagguuugggagaaggcucggcugguaaagcaguggccuugggagcgucagggccuggguucaguguccagaaugcacauuuuuaaaagcuaaaucuuggugaugagagcuaaugaucugugguaagagaaguggagacaggcggaggcuccauggcgggcagcucugccuaccugaugaggcgcaggccaauaugagccucuguuucaauauaaaaguggauggcuccugagggacgacaccucagguuguucgcuggccuccauauacacguaccugcacaaacaugcacaaucauacacacgaacacacguguccacauaaacaugcacacauacacagaaaggugaugugagaguuggcaagguggcucagcagguaccaagucaaauaaucugaguucagucccugggacccauauacugagcaucaaccuggccauuuacuuguucuuaacaugucuagaaauugucuuauucucuacuaaccuauagagcaguaaugcuggcuuuaucaaaugcaaaguacuauuuacuuggauacacaggacaacuucuccaguuauaugccauguaagacauuuucuauacuuguauuacaaacaucaacaaaacaagacaacaaaaaaauagcaaccauauaaacaauaaaccuuaaaagcugauauuuaaugcagcucauauugcccucauauugcaaccaaaacuuguugauaagacaaagcuggaauuauagcuuauugaaauaagaggagacccucaucuacaaagccuuaaucaugccuuggaccugggaagguaaaggcuggaucugaggaucugaggaugguuuaagacauggaaagggaugcagucaauaauccugauucagacuggguaaggagaguaacacaauaugagaccaguauguagaagcaauggggguugccuuugagcugaggaagugacagauucuuaggucauaaaaagaucuuuuuaaugggucuuuuaggccauaccuauagaaaagacucuuggggggggggagacacguauuaaugaagacaaaguacuaauuaauucaugucaguggagacaagagaagcaacacaugucaccccuguauagacaguaguggggugggucgguguccagacugagaacagugguaacgucguggcucuuaugauuacaaucaguuuagugcccuugcauccuucuuuugaacacaacuccauggugucagcaaauaggaaaugggucauuguaaaaucaaguuuguuguaauccuuauuaccaagcucguccccuuugcuggugucuucuggggaagucccaaguauccaagcauucuuuauacucuggaaggaaaagcuaggaaacuguuaguggucaagccuaaauuuucagagaggcuaucucuuuaaaauuguauugauuuggcuuuggguauuuaaaagcaucagaggcuauuaaauauuuuauaaguguuugcuuacaguauuugccagguacugauagcacuucuguauuugaagugaauuaugagguuauaaagauguugaaggucuucuuguucugcugcuaccgguggggagagcuacacagacaagaagguucaucacuaaaaaugcaaucccagacucugacuucaaucacuuuuucuggauccccaggagauacaauggcuuacauggagcagcaaggucuauuguguccauacauuguaacaagaagccacugagcuacuccaguaagaucucuacaguguugcucuuguuaccagcacaugaggcaguuguuauguccuuacgauccaagaguaucugaccuagcagaccugcuugcucauucuaaaguccaccuuaggaguccaugaguuugaaagcugcuugugcaucauccuuugugaaagaauugcuuuugagacuuuacacagauaaagauuuuuuuuuacccaacaucaauaaaccaguaguacugaaauuucuagaggaaaauaucuguagaauauguuuaaaaaggaaacauuguauauuaauaacuuccuuuguuugugcauaugcaguauaauccaugagaauccaggugguggucaguugcaggagacagugccagagcuaguuccugaagcuuccuauugccccacaaaacaugugagcuccacccucuccugacccucuaugccuagcccaccuuuccccauccauccauuuauucaggaaauguuuauugggcacauaccucaugccugagugccugaggaaagccaccagcagcucagagcuuuugcuguuagagggcuccuauguagcuggcacagggguugggguaugggauucugagguagacuguugggcuaguaugaaugaggcccggugcuuagucccuagugcgaacaaaaaauaaaaucauaacuggagggauauagcaagaacaaagcaaguauauuaauauugcauugccuuguuugugucugaggauuguuuuguccuuuuuguuuguugguugcuuugguuucugagaaaaauucucaugucacucaacaggcccugaccuugcuuuguagccaaggcugaccuugaauuccuguugccuuuugcucccacgaguuagauaacaggcauguacuaccuggcuuggcuggugauauguaauauuuuagagagaggaguaggaucaggggaguacuguguaugugaggugaugcugucuuaugauguaggauauuuggagaagaaugcagauuagguaugugugaggagaguuuggaagcagcuggguaggcuaacaagguggcucagggguaaaggugcuugcugcuaagccugacuaauugaauugugaaaucccacauaguggaaggagggaacugacucaaaaaaugaaaagaccugugugguuugagcagagagaacgagagaaguaagaggacaugggagaaggagagagugugaguagcaguggugacaggaagggugugaacgguuuuaaaccugaugccuagcucagucugugcgccugcaggacaucugacauaggguguuccugugcgccugcaggacaucugacauaggguguuccugugcgccugcaggacaucugacauaggguguuccugugcgccugcaggacaucugacauaggguguuccuggcaacagguugcacagaggaaugugggaauggucugaguuaggaacccacuggagaaagacauguuuucagagguauuuggagcauggcauuggaauaaacuagugacuggauuuggaagggcagagaaaggagcaagauuaaagcuuguuccuaacaacugagacagaaagugggugagaagugguuuuaguagggauggaggaagaugggggaagaauggcaagacaagccgauugucuuggacaugcuggacuuacggugcuuuuagaacauagcaaacauaagcaagggguuuauacagucuuagagcuugaggagacacaaaucugaaguucauugcccuguguacaugacaguugaagcuauugaguuuuacuacuaguagcuuagccguguaaggcuauguuuaaaaaucugaaaaauuuuuuacaaucaguuguuacagauaacuuugugguuacgauuuuagaaauauucccucacucgugcauuucuuuuggcaaaucaggaaaaucugaaccuagcacugaacucugccucggccaucgguugcaccguggucaacauuggugcucaggaccucaaggaaggaaagccucacuuggucuuggggcuucucuggcagaucaucaaagugggucuuuuugcugauaucgagauuuccaggaaugaaggugagaacaucaaaaccaccccauugcagcugaaggagccccacgaaggaagagcuuaccucucuguguuucccgcucagccuugaucgcguugcuaaaagauggcgaggaccuggaggagcugaugaagcucucuccugaggaacugcugcuccgaugggugaacuaccaucugaccaaugcgggcuggcgcaccaucaacaacuucagccaggacaucaagguggagaguuuugaaaaauuacagugcucuuucuuucuuucuuucuuucuuucuuucuuucuuucuuucuuucuuucuuucuuucuuucuuucuuucuuccuuccuuccuuccuuccuuccuuccuuccuucuuccuucuuccuuucuccuccuccucuucuucuuccuccuccuccucuuccuccuccuccuccuccucuucuuccuccucuuccuccucuucuuccuccuccucuuccucuuuuuccuccuccucuucuuccucuuccuccucuuccuccuccuccucuuccucuucuuccucuuccuccuuuucuucuucuuccccucccccuucuuccucuuuuccuccucuuccuccucuucuucaucauugucauugcuauucauuauuauuagugguguagguauaugcuacaauaugcauggcuacucugggcuuccucgcagucugauaauaccagauagucagagauuuuagauagagguugacuucaagagagaaaaaccagaggcucccugggguuuggagcuugagagcccaaaaacauucagcucauuuuguuggucagagcgaauggccagggggaacagaaaacaaccuuugcuuucugcugggaagagcugcaugcauguuuagagaaaaacuauaguagccaucuuuggagauggcuacauuagaugacuuaaucuagugaggucacggcuuaugauagagacuggagagggaggcaccgguucauucuagagaugccaggaaagccuucccggagugugacuugagccuuagaugacacugauguuucaagauguaaacacgugagaaagguaagcggaggggcuuccagguauaggcagcaacauugcuagaaguucuggggugucaaagagcagugccagacacccugaaguacaguguuguguguucaggggccucuaggcaguggugcacuaaguuguuuaauauaccauuuuguuuugacaugggaacacauuuuucccuaaaauuauuuauuauuuuacacauuuaaaagugcuguuucuucucuguuuuuuugaaggauucaaaagccuauuuccaccuucuuaaucagauugcuccuaaaggcgaccgagaugaugggccugccguagccauugaucuuucaggauuuaauguaagugaauuucuaaacuuguuuuauguacuguaguaagaguaaacaugacauaaaauuuaucaguuuugaguacauacuucaguggcauucuguuuauuuuucgcucugugcagccaucacuacugucucuuuuuaaaauuguacccuuuucuugaucucauggugacacugagauccagcagugaccacccacuuccccaauggugacauuguauccauccaacaguggccacccacucucccaauggugacauuguauccauccagcaguggccacccacucccccaguggugacauuguauccauccaacaguggccauccacucccccaauggugacauuauauccauccagcagugcacacccauuccaccaauggcgacacuguauccauccagcagugaccacccacuccaccaauggugacaggguauccauccagcagugaccacccacuccaccaauggugacaggcuauccauuuuggugccugcauugguaacuuuucauugcuuacuagaagugacuaucacuuucuaugaucucacuguuuguugcuuauugcuucuuguuuguuugagacauuuuuaauauguagcccaggcuggccuaggacucacuuuguaguccugcuugagccccugagugccggggauuauaggaucaccaggauacccugcauguuuuccuucuuuucaacugcagguucagaggaugagacagguugcccuugcuuuuaaugcucucaugaugguccacagagccagcuuauuguuuguuacuguugaaacuguaacaaacuuccuaucacucaaugcaacaguagcuucagcuaugauggugacauuuucaucuaaugcauuaguucccugcucacuggucugccuuaccucagcaugcaagccccauguuccucgcucacuggcuucucuuuaauaccuucccuuuaacaucuucccuuccacuggacauuuuccucacaggucugaaauccucgcuuccucuuuaacuuuguaugaagcucaucauuuugaauauuacuccuaggaccugcuucauaccugagaucucuuggcucacauugucaucugucgucauacggacacuuguccuucauuugcucuucuguuuggucauuuggcucauuuucuuuccaggaauuugcaguuuugaggggugcuauucuuuuagcuaucucuuuaaaaaauuauuuuuauuuuaucuguggauguuuaucugcauguaugucugugcaccauguaaguuccugguaucuguggaugccagaagagagcaucggagcccauggaacuggaguuacagauaguuuugaaccuccauguaggugcugggaaucaaacacaggcugcagaugaacagcuauugcucuuaacgacugagucauuucuccagugccccaagagacuuuaaaauauuuaaaacaaauaaggaaguugauuagugguucuuucagagucugcuauuacuugauguauuuguggaaaugaaauugcuuguaaguauuauauuuauaaaauucuaucaauaaaaguuuaauauugaccacucuuguuguauuucuugguuuaggagaaaaacgaccugaagcgugcuggauuuaugcuccaggaagcggauaaacuuggcugcagacaguuugucacuccugcagaugugguuucagggaacccuaagcuaaacuuagccuuuguagcgaaucuuuuuaacacauacccaugccuacacaagccugacaauaaugacauugaucucaacuuacuggaagguauguucuuucugcuuugaguugacucgugcauuucuuacugugguaauguccuacuucaccguccugggugggggacucuggugggaaaugugaugauguguguguccagaagugaagucacaaaaaguucaaaugaucaaaguaugcuugccgguaagaaaagccuggaauaaauuguacuuagcugccauuucuccauuagaguuaaggggaaacugccagacaguuaaaggauucuccugaaugauucuguaauguaacucuaccaccgauguagagaaugaguuaucuguuagaagaaguaauccuugcuagcauguuccgugugaacgcaggucuggcuucauuguugcucuuuuuaauguuuguagaguacaugaaagaugaucauauugguuacuuguguauaggugguuguuaucugucugauaauauaauacuuuccuguuuugcuucaugaaaugcagauuugaccccuccuaauguagguacuguauuuaguacuuuucuauauccuauaaauauauccauucugcguuuugcuuuuacuaguggcauuuauucuucccaccuggguugauaguuacugcuuugcauucucaugcucuguugucuuacuaugccuacagaaugaaugacugcaagcaagaaaugcaaaugggauuuaaucacauagagcaaggccuugauuauguucacucuaccuaauuugccuucuagaaugaugggauauugcgccaaacauauuagaagccaguuuuagcaauuagacuucaugguuugaugugaagucuuugucucucuccugugacaaaucuuagcuuuuuaucaugugucuucgaaagaauuuaugggucacaacacauuucauuucauacugucguuacauauucuaaaugucauugaagcuuacgaucuaugaauugucuuaauggcaaaagcguucucaauaaccaguucuuucuccucaucucugcuaccuagauugucucccacucuccuccauucucauauccucacccacacaaacaccauucauucauauugaaaugaagagugaaagcagugguccugagaacugugggagggagagccaacccugagacuuaguucccccauuuaggaagcuaggaggauuuuacauugcagugugugcucuccacaacccauuccuacuguucucccugugagauggagugaggcuucguagucuuaccuugggcugucccauuagaguuccaguggccuaucacugugugauuucaguaucacaacuaaugacauuucagauuuuaaaaaauuauauuuuaaucauaaugauaaaaaguuaaauauauaauuauguaauuaaucuaauacacuguuucugagagucuugucauauaacuacuauauucucuacaaaauacauaacugaguaaaaaugacagaaacacagauuucauuuuuuuaagcagagaaaaaaauuagaguuaaaaaaccagaacuaaaaaauucagccaaaaggaagacucuuuuuuucugagucuggaaaauuucaaaaucccugugugucuuacagcagaaggcauuguuuagaguggcauaugagaaaugaucugcuuuuuauaguuacugaacucuuugcuaaauacccuucccaacuugcucgcucuccucuuugucauguguggguuucuuggcugguguucagcaugcuuuugagaguuuuuagugugaacaugguugcuacauauuuccacuaguauuuccuauaccugauaaaauacuguggggaauaucuaucaacccucucucuuuagaacauauguauguccugaugaagcuaccaaagaugacucgacuuggaugagucauuggauuauuuucuucuguaaauuuguuuugacagaucuuuaugaaaguuugaccuuaucacaucccaaauucauaugcuaguaugucucauuggcagagaauuuuugccucuagggaacuacugaaguuuaaaagcccaaucaagucuuccuucauaucaaauugcgccaaacacauaugcugcauacagggagacuaccugagacuucagcugugaugaaagaaaaugcaugcaccguauaguuaggaagacuuuguucaaaucauguuucuaccauauaauaucugaguaacaucugcgagccuuggucugguuuucauauaauauauaucauaaguaauaauauuuauucugaagaaugacagaggaagcuugaugugaucaugaauaaaaguauuuacucggcagcaugugcuuaguaauggucaggaugggagaagaaaaacacauuccaaugaguguggaguauggcauuucuucuucugucuucuuaauaacauacuuuaaaaauauauacuuguauugaaacuuuugccaauuugacuuggaaauuaaaacgaauauuuuauauugcuuucaggaaccuuagaaauuaagauuuuuagcuacacaguugccuugguugucuaacgaucuaaaagcauuuuuagucugcaauacauauguuuuugcaaugcuuuacuguggcuccugcaccaaugcauagugcuuguagcuuugagcaucuguuuaccaagaugacuuaaguggcacuagguaaauaaaugcucacuuagagaagucuauuuuacuuuccauguguuaaaaauaaaaacaacauaauuaguugagaacagggaaaaaaauacaaaacuccaaaacuuauaauaguuuccaaacuuuagaaauguaagcuuaaugucuuuuuaaauaucuauugcaucaacaguuucaauggacuuugaguaucuuaaucaaaauuguaacauuccaucuuuuguaguuuagaaacauaacuuggauuuuccuaacuagaaacaauguaaacguuuucuacuuacugaagaagaauguaucuuaauagcauaucaguaaguuagagaaagaaccaaaaggcacaugcaagucaugugagucaagcauggaacauaauguguuuaugcuaugucauguaggaaacaguucagggauuuuaauuuguacaacucagcuucacuuggcucuucgagaauaguuuuccccuguagacuguuuauuauaaaguaguguagcagguaagacagacagaucaguugauuuuugagaccagaaggacaauuuaaaugagaaauuauuugauuaagaaaacuagaauuacugauuuugcuaaguguuagauaauagcgguaaggaucuacauggaaauagagugaagaguuuacuuccugaauagucaauagaaauaacagaauccuuuacauuguacagggcuuugguccuuuguggacaugcagguucauauccugugacacuuaguuugaaguugacuauagaggugacuaagagucauggaguccaggugguuauaaaugucuaugccaaguggcacugcaagucucuugcagaccaaacucuagagugacccacaguggccuguguguagaagugaugagguuuuagccuuggggaguuuaggaauaagauagugucuaaguuauuuuauugucccccagcuuugugaaagacuaagaagaaaucuaguuacguaggaccauuuacucucaguagauuucucuaagucagagauggcaaggagagcucccaucucucuccagguuguguaugccauacucaugguugugguuuuguuuuguuuugaaaucuaugguguauacccagggagacaggcucaaccauugagguucucuaugggguccaggaacuuacugugaugaaauguaucucagaacaaaaugacaugccguggguggucuguguuccucgugaauuuucaacgaucaugaucuuaaauaacucagaaagcuggaaaagguugauaccccucacugcauagcuuuuacaucacccaaaaucuucucucugcuucacuacuggguguaaaguguagauccgugugcccaggaaguuuccugucuaacauaaucuucucaaaugcggaagguggcgucuuccaggccauuuacugugcccacuaaaagauugguuuuauguucagccaaaccaagucccuacucuauucuacuuuaguugccuuuauacuaucuguuacaucccuggacagaaaccccaugacucaauaguaguucacaaaccucaaauaagggaaccuagauggagagagaacaaacagagacuuccuagauaguugggaugagaaaaaaaaaaucuccccuuaaagaaauuguaugucagacaaagaggcuaguuuaccccuacgagaaugcuuuaagacuaauugcuaauuauuuuggccugcaucaucaguguagcuucugucuccucuaggcgagagcaaggaggagaggacauuccgcaacuggaugaacucgcugggcgugaacccguacaucaaucaccuguacagguaaacauggggccgccuuagcccugccuucacggccugaugucuucaguuucaacucgacuuccaaccugaggauauuuucucgaaucacaaggauuuagccaacguuuggagugcugggaaauuucagcagucuguuuuuuccuuuuuuaauuuuuaaguguuguguaaaaaaaaaaaaaaagaguaugauaauaguauuugauuauguuacaagaguaaauuuccaaauguaguugaucaugaauauaagaauuuauuucaucaauaagguuuagaauaacaguaauaucuaauaaauuauucucaucuauacaccuuuauuuuucacuaugacuaauaguuuuuauuauuauaccuuauuuauacuauaauuuuuacacaugacucuucuuauagaaauaauucuuuuucccuggauaauuauuuuaguuuugucuuauuguuugaaauuuuuaaaauuaauuucauuguuuucaaaaauguuguuauucuucauuguaaaucuccccacucucacuccacccuccucccccuucugcuugucccgcuugcuucucuccagucccuccaucauuuccaucacggcuuucugugaucauguccuacacgcguauccaugauagauauaaguuuagaucugcacuugagagaaaugugcagugugucuuccugagucugcucacuucauggaacaccacacucuccaucugccccuauuucccauguguguccuauuuucaugcaagguagcucuuggggcacaacaccugaugucuucuggguggccccgugcacaugcaucuguucaccugcacacauauguccacucgcacauaaaacauuuacaugaaugaauaugcaugcacgcacacuaaaguuaaaagagcauuaauauuugcugagacucaagguaacuuacaaauuucaaaaacacuaaaguuuucaaugguuaaaagaagagaauugaccaaaauuuuaguuaaaauauguuugauuauuauuaugauauucuucuuaaaauauuaguaaagggcuucaaggcauaugcauuuugucauagcucacuuucagaagaucuucaaaaguaaucgucaagggagcccuuggagauagaaaagcaguagccaagcaucuaguuaacgccaacagcaugugccugugauuuuagguuuggauuguauuccuaguucaccccugagcacuggguuccccaccuacaguguacucagucgguaccaaagcaacuagacuaacgcugaucuuaacuaaauauccuucucuuuaaauaaacuaugaaauuugcuuucagaacuauuagcccuugaacucuucuguuaucaauugguucuggaauuuauugugaaaccccuggaaauuacucagcucuuugggcuucagguuuccauuguuuagaguaauaauaauaauaauaauaauaauaauaauaauaauaucauagucuauaaggaggguacaugcauuuaaacuugaaaaaagaaaaacucaugaaauggcgagauucuggaacuucaagacauuagugauuucuuuuugcauacagagugcucacgcacuuuuccagucagacugaaaugacauugugugcaggugucuuaauacauuagaugucuccaucacucagcacagagcugagcuucaaccauucacugcugcauggugcaugcucagcgaaggggcagaaacugagcgagccaguacagaagcuacugggggagaaaaggcacgcguucaguccuucacagaacggcugcugcuuuauuucuuucacagcaggacccgaaaacaagacuccacagacagacugcaagcuucucagagaacuuauuuuuaugauuccagaguagcgguauucuuuaguauuuuuacauucagaacucuuacuuccuuguaaauucuuuccucugaacuuuuauuauuaaacaggaagagcuacccacugaguggcugugauuuuccuaugauugauuuuaaaguuaguaaaaaccuuauauauaaaacacacgaacucauucuauuguacaggcuucaaacaauaaaguauauggaauaaaauaaaaauguaauuaccccuuguucccucucauagucccccuuuuucugcucacaaguaaucacuuuuagcaauccaaacacacacacacacacacacacacacacacacacacauacacauguauauauggcuaauuuuucauuaaacaagaacaaacuauaucugccacuuacaauuuaaacacuuaauguaucuuguagaacauuuuauaucagucuuuucagaccaaauuuaauagcccaggaguuuauaguaagguuaguugacucaauacuauauuuuuauaauacugggcauuuacguuguuucuggguuuauaaaaacaguggcaacacaaaucuucauaugugugcauguguauuagugcauacaaaucuucaugugugugcauguguauuagugcauacaaaucuucaugugugugcauguguauuagugcauacaaaucuucauaugugugcauguguauuagugaauacaaaucuucaugugugugcauguguauuagugcauacaaaucuucaugugugugcauguguauuagugcauacaaaucuucauaugugugcauguguauuagugcauacaaaucuucauauguaugcauguguauuagugcauacaaaucuuauaugugugcauguguauuagugcauacaaaucuucauaugugugcauguguauuagugcauacaaaucuucaugugugugcauguguauuagugcauacaaaucuucaugugugugcauguguauuagugcauacaaaucuucauaugugugcauguguauuagugcauacaaaucuucaugugugugcauguguauuagugcauacaaaucuucaugugugugcauguguauuagugcauacaaaucuucaugugugugcauguguauuagugcauacaaaucuucaugugugugcauguguauuagugcauacaaaucuucauaugugugcauguguauuagugcauacaaaucuucaugugugugcauguguauuagugcauacaaaugccucagaaacauggaaaagauuggacagauucuuagguugaaaguuggaggucaaaugaagugucuugucaucgcuaagcuucaaaugacucuuguguguuuaaggacacguauccaucugcagugcguuuaacaguaauagcaccgacuacuuccccuuccugauauguguuucccuccugcuucagugaccuugcagacgcuuuggugaucuuucagcucuacgagaugauccgcgugccagucaacuggagccaggugaacaagccuccguacccugcucugggaggaaacaugaagaaggugagcggagcgacugugguuaggucgcuguggugcugauggaaagccaacggcuuaguuucuuaaaugucagugcgugcuuugugccuguagauuuauuucaacucaaaauggucuaaacuuaacgggugcuuuauaagcucgguuauuaaguguuuagaaagaugaaggcaguccuuccaggcagacacuucauuacacuguuuucaucuuuaacagguugugguacuuauguucuuugagaugugcccugagugcacucuucugcuguaaucgcuaagucuuaacagcgugcuccuucauuuaggcagcagauacgcuuuugauuuccuacuaccugcacagcacagugcaugacggagaaaagugcaugccgugagauggugcuuaggaaacccugcauaaacgauggugauauguauaccagcgacugugagcgaaaugagaacaaagagggguuuuaagagacaagggccaccuguuagccuaugcuaauggcaucacguagggaguuggacaaaaggaagggaacggauaguggugggaagguauguggcugagaaaugaacucuuagaaacagcacucauguuuaugacacuucuagaaucgcuuugguaauauauagcaagacuauuuaauacaauccucugaccguauaauuucagcuuauugacucauggaaaccuagaaagucaggcugggaagauggcugagucaggacagugcuugcugugcaaacauaaaaaccugaguuccgucccuacgaccuguauaacaagccggugugcugcuguguacccaacuuaaagccacacgcuaccccagacgccucuacccgcccuguacauuagcucugauuugugguuuccuauuugucacugguuauauuggcaccaucuuggacucuacacagcaaccccgucuccuuucuuaccaccaucucuccuuuccauguuucacacaggagccaugagcguagguuaauuugaaagguuuccuauucaucuucacugucccacuuccuguucauacuguugcauguguuauuuucauaaacuagaaauucauuuaacuuaucuacauccccauaaugguuauuucuacuaaauaugcuaaacagggauaacuaugaguacuagaauuguuuuagcuuuuuaguuaaaaaaauuauuauauuaauuuugagugugaauguguguguguguguguguguauguguaucagugcaucacuggcucaacuauuuugaaugaauccuugacuaacuguugaaagcaaagcaauuauacuauuuuccuuaguguucauuccaaaguguaucuaauaaacaccuuuuuccuaguaguauaauaagauuuuaagagcuggggcuguacagaugacccaucaguugggagcucuggcuacucuuccagaggaccuggguucaguccuagaaccugcauacuggcucagaaccaugucucauuccaguuucagaagauccgaugugccuccagacacuguaugcauguggcaaagcacccaaguacuaaaguaaaaagaggaaauaaaaaagauuuuagagcuuacaguuucaccagagcagaaauaucucaggcagggcuguggugaugguuuaguggguaaaaguccuuucuacaggcccgagguccugacuucaaaucccaggcauucacauacaaacuggacaguuagaaccagugucuauaaucccaguacuccuauagagaaguggggguggggaaucacuucaagcuuuaggauauguagaaaaacaagcuggaaggcaaggacuggugccugagguucucugaccuccacaugugugcuguagugugcauaugccccauucauacacaugugcacacacacacacacacacacacacacacacacacacacacacacacaccuacaacuguaaucacaaagaaauaaucguaaagugaaaaaaaugaaaagcauaccucuguacauagguguacauagaaguacuagaugaugauagauaagaaaccucuguagagacuggaccaaaacauguagagagggcuuaauggagcccuaugacuagaaguucagugaguagguggggaaaugauuuauguggugugggccauaguuauguucuguuacugugaagggacaccaugaccaaggcaacucuuaucaaugaaagcaugcuuacagcuucagggagcagccaguuaucacggcaggaagcaaacggacaugggcuggagcagcagccgagagcuucacauacugauugacagacagcagggagaaagggaggcacugggcuugcugcgggcuuuugaaaaccucaguacccaccuccaguggcacaucuccucuaaccaggccaccuccaguggcacaucuccucuaaccaggccaccuccaguggcacaucuccucuaaccagcuccucuaaccagaccaccuccaguggcacaucuccucuaaccaggcccccuccaguggcacaucuccucuaaccagaccaccuccaguggcacaucuccucuaaccaggccacaccuccuaaugcuuccaaacaguccaucaacuagggacucagcaugaucauauaugcgcuuaugggugacaagccaccacaguguuuacaaaucagauuuuugcuguaguagaugagaaagaagcugaagugugguuccgcuaagguuauuuaguuuugcuuuguggugcuugggauugaaccgaggccuuucugauaguaggaaagcacgcccccaccgugcucccacucugugcucccaccgugcucccacucugugcucccaccaugcucccacugugacacuagucauuccuggggcgacuugaacaagugagcaucuucccacucuagauagagaauugaugacaagccaaggugaggauaccaccaaaguccagauuggugaaccaacgaguuuuauuuauuggggucacuuacaggauuacgggugaggguucuuuauacaggugugggggagggguuacuuacaggagcagaaucgcugaggcccaccucagcuucagugacagcucaugaaaccccaaacuuagagcucacugcacaaccugaagggugcuuagcagguuggagaguaccuuuuucagauggcucggcuggucucaggcucaccuaagcagcccaguuacucugagaacaucucucagcaguccguauggauuguauaagcuugggagggagaagcccccaggaauguuucacuucccuuuagaacacccuaagucuuaagagacuucccucccuggcacaaacuguuacaccacagccacaucccagacagagccuuugcugaucauguggacaaggaccugaaugucaaagaaugcacaaaaucaaagguuuuagccguagacuuuucauuaguagacuguguaagcugcagucaggacuccaggguucagccauuuuuauaaucuaggucaaucccagccuugugaaaggggugucauugauucauuugguuacuaugaaauaaaauuuggucauugcuguugcaggcgguugaccuaguuagagcagucuggggaugguuuugaaggccugcuuugauacuaaguuagcucucugugcuuucagauugaaaacuguaacuacgcgguggagcuugggaagaaugaggccaaguucucuuugguuggcaucgccgggcaggacuuaaaugaagggaacgcaacacuuacccuggcacugguguggcaguugaugagaaggugaaggcucgugucuuuaaaguaacacagauuccuccaacagaucaucugagccaaaccuguagcuauuuucagagacuugugaacauaaguaacagacauugugaaaugaguuaaucccauagaagauuuguuauugguuaauauauuuucaaaauuagagugggcuaaucucuagcaauauagucacuuaacaucaauaccucuuagauggcuuuguaaggaguuguuuuaaaauuuuaagacacuaucugguagugucuggcuuugguuagugagcguuuuaaccuuugaacguaacaaaguacgaaugccaggcuaaaguuaggaauauuaacuucuggagacgggaacuugccauccugcagcuucaguugcacggguguugggguuccaggugggaggaccgcuuggcuguuccuuggguguugauaucugauaugugugagaacaaaucccaucaucccuuugucucaaguucaucguuucuguugcagauacacgcugaaaguguuaucagaccuuggagaaggugaaaaagucacugaugauaucauuauuaaaugggucaaccagacccuuaaaagugcaaacaagagcacuucuauuuccagcuucaagguaaucaagaaauuaaauaaaaacaaguuauuaucuaagucucauggaaaggggguuuuaaugagaauuaucuuagugagguucagaguuauauuaguaugagaccccagaaacauaugaccuaggaauuuaggcauguacaaccuagugauaauuagaauucuuguaguuuuuuuuuugauugguuaucuguugaacacaaaugcagauuagugcauuuaauaugguaaucugauguuagaaauagaauugagcaaaaaaauccaguuguuaaauguaaagaaaaaagaauguggaaagcguugguuguuuauauaggaccuguaauguuuugugcccccuagcagcggucucugaguugcaugggcaucauguucaaggcauacagagccggccaaaccgaugcaaguggggauugagagaacggguaggaaccaguucuucccauccggcuucauggugcacuuaacaauguccucugagcauuugcagaugauccauaaagcacgggaaugcggccugcacacacguacacauccacuaacccaugcaucuucauuguguguugcuguugcaugcaaguugguauuagcuacaaauaagcaugucugcuugaacauguucauccagugacccuuguguuugugauuuuuuaauuauauguuuuuuuaaagauuuauuuauuauuauacauaaguacacuguagaugucuucagaugcaccagaagagggcaucaaaucucaugacuggugguugagagccaccaugugguugcuggaauuugaacucaggauuuuaggauuugaacucgggaccuuuggaagaacaguuagugcucuuaccugcugagccaucucgccagcccuacuauauguuuuuaaaaagcccagcauugccuauuuuaaaauuaucuuuaaaagugccaguagacaaagcccuaagcuguauuuaaagauauuuacccaucuuuauuguuuucucugccuuugcucuauguauuuaacaguguuugagaguagcagaaaugucagguauugaugaauucagucacuuuauaaaaaugaaggcuccaugugguuuuaacagaguagaucuugggagagauacucccuggguccuaauucaaguauaucauuuucucuucucuuauagcuucuaagucacuagugacacuauuguuuguugaucacuagugacacuauuguuuguugauuuauuuuuaaacuagcuuucagucugugauuugucuccaugauuuagauaugaaguauauuuuaaauguaaaauaggaaugugguauauuauaacauucucuaguuggucuucuuugaaaauauuaugcuaauguuauacauaccugccuacuuacuaauacuuaucaacaaauaaggaugguaggaugcuuggccagcaugcacgaggacccagguuugauuccugguaacaagaagcaaauaaauauauaaguaaguaaguaaguaaagugaucagauacagugaagaaacauauagggacacaguaauauagcgaaguauuacuauuaguuggcuuagaucuagcuaaagaaaaagccauaaaguguaagaagguuuauuuagccuucaguguuuagcauuuacauuaaaggcaaaacuuauaaaaugaaugugauacuacuauggaguaaaugauaaaauaaaccaguacaaaugaucugacugaucuucccaacucagcggucagugaggagugggcagagaaagcagauuugaugguggaagaugagcuugaaguacauuauauacccucaugaauauaauagauccuuaaacaccgagagagagagagagagagagagagagagagagagagagagagagagagaauguacaaguugauuugaacauuagauggaggagggauuugaauugguggacaaaaaaagggagcuagcaagcuagaagcuuccaucuuaaauaaaggcaagguugagaggaugguuucuacggugguguauuguacaagacagauugagucaagaugggggagaaauuuguccuaaauaaaggauacugaguaaaaggaguaaugugaagaaggagauuguuucagaaagaaaagucccaaguaugcagacaggacgggccggaagccuggugugucugaagagcauaggccucccagcagagcuauugugagaugggacuuggcuucucgauuuggagaagcaggggaaagagcagccaguuauggauauuugggguaauuugagaaaacagacaacagguuaaaacugagaauucagacuuugugauccccugagugaaggauguaguugaaaguggguauauauuauacaaacccugugauggagaagguucgcagagaauacacgacuugagaguguggccuuacuuguaacagagauaagauagaaacguagaagaggcgugauaaccaaaggcaagagguuaagaacagggcagcaaauggcuuuucccuguuacaggaggcauuuggcugaagguuaucaagugauacuaguaagaaauuguuaaccacauucaagacagaugaugugauuaggcacuuuagagaagacauauuuaacccuuuuauuuguaaagaauuuuccccucaccaagaagauagacaaguaguaccucagcgaugaguaauaauuacagugagacucuuugucaccacacugagcacucugcacaacccuaggagggaaaggugagcauuagagacauuaauaaccugcugccaccaugcaccuuucaaagggaagaaagaacuggcuuucuuagcaacgucugucuacuugcagauucaaaaccaaacucugcaguuguauggugcuggguuucaccugcuaccuaugugacugacauguuauuaauucuguuaauaucaaagcuauuaggugucuuguuaugguggcuaccaguguuuucaaagagcuuaguguucaagaaguacacaaauaagaaaaggagcaguguggucugagguguccgcaguccuuuguaaaucagcuaaggggguggcaaauggcagugccugaagacaucuguuuuucagagaccuuggcaguuugcacuaguaccuagccuacaucuauuggugaaagaaacaacugaauaucuggcuuuucauuuaguacuuguguuuucucagacaaguucuauuaaucucucuguuucaguuuccugaaaucugagauggugauaaugucuguccuauagcgucauuguaaaacuaaauaagcuaacaaauagaaaacaacuuuagcauguucuguacacaguaaaggcucaauaaugccucuugcuacacuaauggcccugccuguauauaaaggucauuuuaugugaagggacuccuguuaauaagucuuuuagaaaacucucuuggucacauccuuguuucuuuuacuuuuauuuuuaaaaacaacaucaacaucaauaguaaaauauaguaucaaaucaaaggaaaaaguuuauuaucuuagaaaucaagauuauagagacuauuuuuuucuuuucuuuuuuuuuuuuuucuuuugguuuucgagacaagguuucucuguauagcccuggcuguccuggaucucacuuuguagaccaggcuggccucgaacucagaaauccaccugucucugccucccgagugcugggauuaaaggcgugcgccaccacacccggcauagacacuauuugugcuuauauaauuucuuugugcuuaacuuaaaggaaagugcuauacaugucuuuagauauguaacuaaggauggccacacuauccucuaccccuuugcaauaaaauaaugucuuaaaugauaacgugcaagucagagaagucagaagauaggucuguuguuuaaggaucugguauaaccuuuagaaacuuaaacuuuucauuuaauucaguacaaacuuuucccaugguaaaacaugaaaaauagaaggaaaaaacccauuauuuucgaaaccuaaaucaagauauacuuaaaaugccacaaguacguaacaaucaaaauaaaguccaauuaggucauuugucuguauuugaaucauagaaauguaugaaaagugagccagggaaaauuuaaaauuauccuaaagugacauaaccaguaaguuucuuuuuagaaaguaucacacccuagauuccagcuucauggacggauuaacagacucauuaucggugagggagacuaggccuguccuuaguuuucuuugccgugcugaggaugaagcuguacccucaggccauuaccagggcucuaauccucggugcuagccagcacuccagcugauuuccagacagguagucugcagaguacacacagagaaaaagggaauggguugcuuuucagaaucaggaaggauacuacacgccaaguaccagcaucauuuagaugugagaggcuuaauuuuuuuuuuuuuaaucucccauuuguaucccaaaaccuguuuucuucuagaauaaauaaacuaaguuuuuggcuucucaaaugucacaaaacauucuucaaauuauuuucggucauuuauuaugaagcuguauuuggccagaaacuguauuuguacuuucauuauacucaaguaaaaaucaagaauccuguggcguucccauccccgaguuuagguaaaaacguguuccuggcuuccaugguaagaauguaaauuggcuuaaguuaaagagaaggguacuaauuacaauaacggaagugcagaggucccgucggcuucagaaccauuugagccagcgcuuucccuccacacucacuacuguguugguauccaacaugccaccuuuaccccaaagcugcugcucuucuugguuguguugcugauuaugaaagagugcucaucuccucauucacauucagaaaaaaguuguugauuucugaaagcugaauucacuuaggcucaaauaaaguuauugugguaaacaggauagaaccguuguucaucuuagacgaggagcuuuccauguuauugcugccccuggacaagggcuucuagguacuuuucuuucuccucuuccucuuucuccucauccuccucuucuuccuccuuuuccuccucuucuccuccucuuccauuuucuccuccucuucuccuccuucuuccucccccaccucaguuuucuagauaggguuuguuuuuuguuuguuuguuuuuugguguaguucuggcuguccuggaacuagcucucuagaccaggcuggccucaaacucagagauucaucugccucugcuuccugauugcugggauucugggauuaaagagguuggcuaccuacaccaauacuuuucuuaauuaccccuucccugucaguuguuuguuauuauagauauuuugccuacauguaagucuguguaccauguucagaucuagugacuguggaggucagaagugggcuucagaucuccuggaacuggaauuacagauaguuauaagccauuacaugggugcugggaauugaacccagguccucuggaagagcagucaauguucuuaacugcugagcugucucuccagccuuuucaugugaauuuuaaaugcagaccuauguuguacaucugcuucuguacuguaugcuuuauacauaaaguuuguuuagaguacaugaccuauaccaguucaguuucauuccuagaucacuggaugccaagagcuucccuugaagcucauguccacauaaaagauauggacagcaaaaauauggguucuguuagaauccagagagauauggagugagcagguguugcauaggcaagcaagagaggcuauuuuuuuucaaccugagaacaaccauuuuucauaugcaggcaaguugcaaaaucaguucggauuaggauuuuuuaaaaauuuuaacuacaguacucuauugccuagaguaguuguccauuuuuaauucacucuugaaguaacugcaaaauggaaugucuuggauauuagugcuagacuaucacagcucagauacuuuguauuuaucggcuauguuagccauuugaucuuucuggacuuacauacuucauuguuaaaagaaguauaguucauuuauuuccugggauguaggauuaagaaauagcaagauauuuaagucaccaagaauaccaucuuuuguaaaugccagguuccuuucacuaguuuacuuuccuuucugaaaauccuuuguugaaacuugugguuuacaaauaugaaauuauuaauuuaaaaugcaucaacuccaucaugaaaguuauuuuucacagaauggauguaacaguugccaaaaguaggacuuaccauaaccauaaaucuuauucagguaugggguaacucucucuacaguauaauuuacaugaagacuaaaggaaaaucauauuuuaaauugcauauuguauguguugguugcagaaaagcuuacuauuaaguacaaagauaaucuguagauugguuucaguuacaugacuaugaccagaagaggcugacguuugugaaaauuaaagguaagcuguucaugcaugucuaucuuuauuuccuaggauaaaucuauuaguacaaguuugccugucuuagaucuaauagaugccauugcaccaaaugcaguccgucaagaaaugaucaagagagagcacuugacugaugaggacaaacugaacaaugcuaaguaagccccucuggucucugagaccacagcgaucugcucgugucccuugcagggacacucuuaccuuuuaaaguacaauuucuguggggaauaugguuuuaaaaaguccuuagccuuuuuuauuaaguuaaucauauauauauauauauauauauauaaaucugcuguuaaaagaacaaaaggaagauaacagaugcuaagaugucuuccuuuucuuuuuaagauacgccauuucaguugcucggaagaucggugcccggauauacgcgcugccugacgaccucguggaagugaagccgaagauggugaugacuguguuugccugcuuaauggggaaaggauugaacagacugaaauaaugaagcguuuacugugaucugccacacuguacgcaccaaacgucucaguuuacagaauuuugaaauguaguggguauaaaauccgaauaucuguaugcucaaaauaguucuguauccagcaaugaagaauaucuuguccauaccaguuagaauuugucaaucuuuuuuuuuuuuuuuuggauaacacaauuaccuuaacaaucaauaccaaugcaggaaugucuuaucaagcugcuauuucauaauuaaauuauuuuauuuccuaagagucuuaaccaaaauaagacuaaucauucuuuuucauggcucaaaaaagaccuguauaaaguuuugucagguccuucuauuaaauguguuuggauuuuuuuuuuuuuugauguguuguuuaaauuuugauuaaaaaaaaaauguaccuaaagucauaaucucacuuaauccuuuugguuuuucucccuuuagcuguguaaagugaucuaaaauuuucuguaaauuucuauaugacauaaaaauuuaaagggauaaauauaauccaucaacauuaaacuuuuuuaauacgagaacuaacucuugaauaacccccacguucacucucuuguuuaagcuguaggagauuuuuacuuacaguuuguuuguagcuccauuguuacuucacaugugcuagucugauaacacagcuuugucuccagcaucacaugugcuagucugauaacacagcuuugucuccaccaucaagcauaauacuauauguugguaggauguuacacauauguauuucucuaagucaucugaguuacccaccuuuucuaaaaugguauguauuaaguggucagccagccguuaaguauuuauuuugcccccacaaugugugugacacuuuucaauuguggauaaucugaucuguggagaucuguuuugcaaauauuaauucugaaugugaauaucguuauuuuucaccuaacugcuuucaaauacuuuucagccaaacauuggauagaauguccuaacugacaccaauccuauccugcuagaaucacaucacacuuacuacucucaggcuacagggaaaccuacaucacuggacaugcccaccaaauggcuucuguagagaucuguguauauaaaagcuaauguccgucguaguuuuucauggucuccuggaaacaguugagguuuguguuccucuuuuccccagaaguuuuagcaguagagaaauucuguugcucauaguugaagccaggaaugagcuccccggcccuccacuuuagugccagugagcaauagugcuaugcaaggaaagugcugucaccucucuccgugugaauggguuguccgccuccuccuuguccacugaucagaacauacagcaggagggagagugucuguguguuuaggguagacuuuuauaaaugaaguacugacaggugggauucugaaauauauucuucuacaugaaaugucuucgccuuuuauauuuuggugauuguuuucuuauaugaagacacaaugcuuccgcuccuuuccugagauuauuuaaaucaaaccucucugauuuuucccgcugucauauuuacuaaaacaaucugaauuacauggaauuuagcacuuuaagguguucuuuuucucacgaaauauauuuaauaaaaaugcuguguauguagaa

SEQ ID NO: 5248 - RNA, 17347 nt, Mus musculus
uagacuaauagaacucauuuuuuauuagaaaguuuggcaagcaagacccagucucagaauaaaagauuaauuaugucuauuuauacacagacuuacauacagcacaggauuggggauuuggggguggggggauagauaguaugauuccuuaugaugaggaaaguaaaauaacaauucuuagauaaaauuaaacauuauagucucugugcuuaaguacuuauuauuaaucauuaucucuaaugcuguagaaaagaaaacaauaguguuuuguuguugauauggcuauaaauacugcuuuuucaaauguaguauucuguuacaugcauaguagagaacuaaagagaagcuacuccaaggcaucuuaagguuuagaaguaggauagcgaugaucccauagcuucuucuucuaacuuucagaacuaugcauuacaggcugccaucagcacuuuuacuaggaaaugaacaauauuuagauauauuugacauaauaggaaucugaauccuauuuuauuuuuauuucugucuuuguuuuccauagagcuuaagaaaagaugcagaaucacgucgaagagaacuucauauccgaacauaugcaguuauuccacugaaugaugaaugugggauuauugaaugggugaacaauacugcuggcuugagaccuauucugaccaaaauauauaaagaaaaggguauuauauuuauucuuaugauagaaguauauacugugagguuguuaucuauaugauguaaaauauguauauaauaauguuuaucauaucaauguacauauuuuaccuaagccuagugaaauuuauauucuauauacagaagcaugcaaggucuuccuucccuuccuuccuuugaacccuuucuuuuuguuuucggcgcaaaaaacuuuugagguagcuuaccagaaaaaaaaaaaaaucugaacauuuacuuuucugaaauauuuguuagcgauuaugaaauuacuucauccgucuauagcaaagaagcaaauauucuaugaauaacaaaaguuaguuuucugucagaaaauuagaaagcuguccuagcuuuggauaaucuuagaaaaaugauguuggucauaauuaauuauaacccaugaaauaaaacaaauguaccuucauacuuauauaaucaaaucuuuucaaaaaaaguaaguaggaaaaggucuucauuguaguaaaauuggaaugaauaaugcaagauugaggaaauagaauauuacaaacuagcaaacgucauaggcaauuauuauaaacagguucuaauaguaauagacccagguaguuaaagguggugaugcuugccugugaucccagcacucaggaaguccaagacaggaggaacaugaguucagugucagucauggcugcaaaugauaucaugucccaaauuuuuaaaaagaaaaaauuaaggcaaaaguaugguaagaaacaggucauuuguaguaucaaauccuuuuucaugaauuagucaggauucucuaaagucacaggacuuagggaauguauauauuaagggaauuuauuguaaugacuuaagucuccaguucaaccaacccaauaggcagcugugaaugggaaguccaagagucuaguaguugcucaguccugugaggcuaggagauucagcuugccuucuguauaagcuggaguccugaagaaguauguuccaacagaugugcuggcaagaaagugcaagcagaugaaaaacaaaacuuccuauuuccauuguccuuauguaggccuccagcagauggcauggcccagauuaaagguguguaccaccacaccuggaccuaagcuguucuuuacuuggaacauccucugucccaggcuggccuugaacucagagaucugcuuggcucugucuccugggauuaaggcaugugccaccuuaccuaggccuaagcuuuccauagccacuaugcuucaagaucuggaucaaaugcaugugacaucacaugucaagauccagagaucagggcuggagagauggcucagugguuaagagcacugacagcucuuccagagguccugguucaaaucccagcaaccacaugguggcuuacaaacaucuguaaugagaacugcugaucucuacuggugugucacagcuacaguguacuuacauauaauaaauaaguaaaucuuuaaaaaaaaaaaaaguagaccacuaaggucuggcuuuaaaaaaaaaaaaaaaaagauccagagaucaaaagccugugucuuccagccucaagaucuuggucacaggugugcccuccauuucuggauuguaguucauugcagauguggccaaguugacaaccaagaguagccaucacaaugagauaacuguucauugugaagagaaaguaacuguauaauagaaaaaaauaacugaccauaugucuauguuguuacauaccuauuuuuuguugcugguuuuguuuguauguuuuugauacaaaggcucuuacuauguagacuaggauggcgucaaacucaacaauaagaggcugucuuggguuuuacugcugugaacagacacugugaccauggcaagucuuagagaaaacaacauuuaauugggggcuggcuuacagguucagagguucagucuauuauccgggcaggaacauggcaauguccaggcaggcauggugcaguagaugcugagaguucuacaucaucugaagucggcuagcagaauacugacuuccaggcagcuaggacaagggucuuaaagcccaugcccacagugacacaccuguuccaacaggccacaccuccaaguaguaccacucccugggccaagcauauucaaaccaugacagaggcuguacuuauuaaaaguauuaaagaaaaauaauaggguucauucuuguuauacugucaaguuauaaccauuaguauauauaauugguauuuuuucauucuugcuuuucaguuguagcaaaaguugauacuuuaauauuuuaacaaaauuauucuugcuucuuuucucauuuggcuguacaaacaauuaaaaucauucugcuuuguaggaguguauaugacaggaaaggagcuucgccaguguaugcuaccaaagucagcagcuuuaucugaaaaacucaaaguauuccaagaauuacuccugcccaggcauccuccuguuuuucaugagugguuucugagaacauucccugauccuacaucauggcaaguuaacaagaauauuguuauaguuugauguuucuuucuaaauuuuuuuguacuuaaccuggcacagaguauuugacaagcauuguacugcuuuagguacaguagcagaucugcauauugccgcucuacugcagucaugucaaugguuggcuacauccuggggcuuggagaccgucauggugaaaacauucuuuuugacucuuucacuggugaauguguacauguagauuucaacugucuuuuuaauaagguaugaugugacuuauuggauauauuacuuugaguuuucuuuccccaacaacuguucucccucgcuauacauuuuagucauaguugcauaacacagagugucuugacugguuuucaucagugaauuccucagaaaagcuauuuaggauacagagaaguuagaaaaaugguacauggaagguaugaacuuuaaucgugaguuaguuacuagcuaugugaacaugggcagaucaguucauuuuacagagacuuaguuucaugaaauuggaguuguuuaacauuucuaaauuugacaauauauuuaagucugaucuagauuaaagaaaaagucaaucuaagguauaguucaguaguagaguacuuacccuguauguucuaggucuugauuucaaguccuagcaacuaaauaacagcuacaacaaauaguaccagaguggguccuugagaguaaauuaaggcuaauggauccaucuuuaagaacaucaaaauuuuucuccuuuuacaauucuggaggaagauuagaagguaauuucgguuucgaugaccuaucuucuuuggguugcuaucagcuaucacaggaagaugaaaaaguccauagauucagcugaaaagaaaucaaagauaaauaaaugguauagaucaaaccauacaaaaggagaauuuaggacaauagacaugagaauaguugaacauuauguuauugagagggaauacugaaugugcuauaacaauauucaguauacuaaacuggacaaagugaauccauucacuugaucuuuuguuugagauuuauuuauuauaaauaaguacacuguagcugucuucagacacgccagaagagggcaucagaucucauuacagaugguugugagccaucaugugguugugggauuugaacucaggaucuuaggaagagcagucagugcucuuaaccacugagccaucucuccagccucuuucacuugaucuuauaucuaagauuaagccaugguuuuauauugcccaaaagcaaaggcagcauuauauggcucuuuucaacagaugcuucuauguaauuacauaaauauuugaaggauauuuuucucuuuccuaagaauccaaacaugaaguuccaaacucuuugagcaaagguuuuguaaguuuauuauuaccauauaauaaaacucuucucuugugagacuaugccagggccuagcaaacacagaaguggaugcucacagucagcuauuggauggaucacagggcccccaauggagaagcuagagaaaguacucaaggagcuaaagggaucugcaagccuauagguggaacaacaauaugaacuaaccaguaccccccggagcucuugacucuagcugcauauguaucagaagauggccuaguuggccaucaauggaaagagaggcccauuggucuugcaaacuuuauaugccccaguacaggggaaugccagggccaaaaagugggaguggguggguaggggagugggggggaggguacgggggacuuuugggauagcguuggaaauguaaaugaggaaaauaccuaauaaaaaauauaaaaaauaaauaaauaaaacucuuuguuuuuaagggagaaacguuugaaguuccggaaauuguaccauuucgacugacucauaauaugguuaauggaauggguccuaugggaacagagggucuauuucgaagagcaugugaaguuacacugagacugaugagggaucagagagaaccuuuaaugagguaauuauauauacuuuguaaauaaucuacuaguggccucgaauguaaauacuggucuauuaauacauuuucuuuacauagaaaccacucuguuaaaguauauuuuuagaaauaguaacauaaggcuuggcauaaugguccauguuugucaucccagcacucaagacagaagcaaaagaaucauguaagcucuaggccauccuggucuacauacugaguucugguccaaucagugcuacauagugagaucucuuaccucccaccccagaaaaaaguuuuucugagaguuucaguauagcgccaugauuacucauucauuacauucucuaauuuuaagauauguucagcaccuaacacagagcucuucuguggguauuaccaauucucaauuccuuccuccuuuccacuuccacuaaucuacucucuaucucuggauuuccuaucgugggcauuuaaugucaguuugaucauaugaccuuuugugucuaucuucuuucauguagcauagugguuucaaaguucaucauauguaaguacuucacucauuucaguuaccaaguaguguucuauuuuauuaaugagucuguguuuuauuuacucaacuaucagguaguaggcauuuauaguaauuccaccuuugaccuauuauggauaauauguugugaacuuuauguacaacuccuauauggauaaguauuuucaguucuuuuguguaugccuaugaguggaacuuuugagucaugauacuuugaauagccuucaaauuguuuucaaaagcaguuauaaaaacuauaauuccaauaguaauguguaugaguuuccauuccuccaugucuucaccaacacugaaaauguuauuauuuuugccauccuaugagauaugaaguaauauuucauugugguuuuaauuugccuuuucauaaugaccaggaauauugaccauuggcuuuuuuguucccuuauuagcauuuguauaucuucuuugcauaaaugucuauucaaaucauuagcauauuauuuuggugugggugugucuuacuguauuaucuggcuugcccuuaaagccaggacucaaucuauccuccugauccagcaucucuaguagcuggaaguauacguguaugcuacuuugcauacacaccuucuuugccuguuuuuugauuggguuggguugucuuuuauccuugaauuguaagaauuguuuucuuuguuuuguuuuuuguuguuguuguuguuguuuugguuuuuucaagacaggguuucucuguguagccuggcuguccuggaacucaaucuguagaccaggcuggccucaaacucagagauccgccugccucugccucccaagucuugggauuaaaggugugcgccaccacugcccagcgaauucuauaaauuuuuaauaugaauacaagagccuucugacacauugaucaacaaauauuuucucauuucuuuaauuuaaaaaauuauauucauggguguuugacuaaauauaugucugugcaccacauguaugccuugguaccuuugaaggccagaaaaguguguuugaucccuuaaaacuggagucagggacaauuaugagcugccaugaugguacuggguuuuauccucuagaagaacaaccaaugcucuuauccacugggccaucuugccagccccucuuuucucccacauugacccuuucagucauaagaguuuguuuugguucugcagguugaacuuagggccuucaguguauuagauauacacuuaagcacacacuaccaccugucuauaucucuagccaaagucuuuaauuuugauaaagucauaauuuauuuacauuucauucugguuauucuugaugucauguguaaauuaauaauaauaaaaaaaagcugucuuaaccagauuugugaggcuuucugugguuuuuguuuuuuucuaaucauuuauagacuuagcgccuuuuugucuuugaucugauuuauggguauuuuuuuugguauggugugaaauagaaguuuacuuucauucuuuuuucuauacaaacucacuugucuugacaacuuuuguuucagacaaggugcuaguuacuacguagcucugacugaacuggaacucacuguguagaccaggcuagucuugaacuugcagagauccucugccucccuaagugcugaggaauaugucaccacacuuggccauccuuugccgauaagacucuuuccaacauuuaauugugcuuuuuauugagauggucaguugguuuucaguacuucuaauaaguuauauguuaauaugccaauuacccauccacugucuugaugacuaucuuuauaaaaauuuucgaaaucaggaagagcauucuaauuacuuuuuuuaaucaagauuuuucgacuugccugaaucccucacauuuccuugugaauuuuaaaaccaccaauuaccgcaggaagccgucuuggauuuugauaggaaugaccaugaauuuguaguuauauuuguaguguaguaccaucuuaacaacauuguuuucugaacuauaaauguuuuucuacuuaauuaaauauucauuaauuucuugagacaauguuuuguaguuuuaaauguacaagucuuaacuuuaaaguuacuuuccugaagauagagcgauaguucagugguuaagaaccugaauggaguagugguagcagagauggaugagugaggggacucugaacugguuuuguauguaaacuggauggcagaugaacaccaauuaaggaugauaguguauauuuuguuuagggcaagaguaaaaauuauguuuguuacuaauuuaggaauauagaaaaauagcucaaaaaagacaaugaauuuuguuuugaagauaauuugagauguuuguaguauauccaaacaaguuucccaaggcaguuagaguugaugucuagagcauagaaagaugugagauuaaucuguaugguaacugaagguauuguauauuccucgaacaugauagagaauaaguuaauacucauuuaacaggugacaguauacaucuugagagguuacacagaauucaucuuacucuccccaaaacaucugagucccuucaacauuaccucucuacuuuuuuucccuuaccuugucccuccuccccccaaauaauuucauauaauuuaucugaaaauguaguauacuccuauaucuuauaauaauacuuuaucuuccuauucuucccuuauucuacuuuuuaaguauugauuuaaguaagauuucucuucugcaaaaggaaugaauguaucauuacuauauucuauguuucaauuuuagugucuuaaagacuuuucuacacgauccucuaguggaguggaguaaaccagugaaaggacacuccaaagcaccacugaaugaaaccggggaaguugucaaugagaagguuaguaagagcugcagccuggcaugagccaauagugucucucuguguaagcgagagcugauuccagauauuaucagugaccaaaauaacugauuacccugaaaucuaaaauugguuaaaaccugaguuaaccaacauacacugaagauuccuuuucuucugcaacuuuuuuuccugcuugaaacucaacccaaggccuugcauaugcuaaguauauaauuaauguuaacaaccccagacuucaucccacaauccgaaauuauuuuucuaguaacaucauucucaauuuugcauucuguuauguuuuuucuugagauguaaagaaucccaaguaguuacuuaaaauuccauuugcaugcacuaauguaaacuuacucgccaccauuguuagaaucuucccuaaacuauuuaagaacuaacauuucaaaauagguugcuuucuguuugcauuauucuguuugauaguggaagggaauagaacccagggucuccugccuacuaaacaggcaauuuacugcugaacuauaccucuugcccucaaaacaaauguuuuaauuuauuacuuugcuggaauuaugauaugcagaguuaccuagugguuuuuauauuucagaaaccuguccaauuaguacauguucagcuauuguacacaucaaagugcgaucucaaguuaauuggauuuguuucauugcuacagugggauauuguuuagucaaacacugcuaacauuaagugagaaaaguugaaauuccaaauuguauugggucuguagccuuaaugacuuucuguaucuuuuuuaggccaagacccauguucuugacauugaacaacgacuacaaggugugaucaaaacccgaaauagaguaacagggcugccauuaucuauugaaggacaugugcauuaccucauacaagaagcuacugaugaaaacuuacucugucagauguaccuugguuggaccccauauauguaaaauaaaauuauuucaaagaauauauuaguaaucugaaauccauguuacuaaucagugguuugccuuuaauucuaaaguacagcauacauuuacuuacauucucagagaaacuaguauuucucugugauuuuuaaaaguauuuaaaauaaugaauucaauuauuaaacacugcuuucuucauacauauuguuuaguccaacuagagaaauaauacauguauucucaugaucaaaaaauaauguaauugcaaagaaccagccaacuuaauuucauuuuauacuuuauaucaacuuccuuuucaaaguguuagcauaagguuucauuugaauagcaaugaagcuauauugaauucauguugugggcagguauuggacugccucuucugcccugucgaaagugauagguuaucauuaaauucacuucauaaagcgcuagugugugugaaaaugugaucaaagaauagaaacucaagaaauaugcaugugaaaacuaaucaacuguguaguuguuggugauacugaagacugaaccaugcucugcauacguccuaccauugagccacauccuaaccaccaaucuguacauuuaaaacaccacacugcugaugggccauaacacccaguacagcagucgcagaaaacacuaauauuuacaauugucuaugauuuuuuaaaaucuaaaguuuuuaauguguuuagauguuuucugcauauuuucuaauagauuaaaaagaaaagaauuguaaaguaauacauuuauuauagucagaugggaaacugcugaauuuuuucuccauaagacucugucuuauuuuuuccuauaaguaaaaguauaaugagguaaacuguaguaagucagaagacauaaaugugaaaacugaacauacaauuuccuacucagauuugauguaaagcaguuaaggacaggauaauuagaaaaucuuuuuuuacauacucuguguguuagggggcgugcaugugugugcuuuuuauccauuucaauuuuuuggcaucuuauucauauaaacauguuuaauuaauuagcauugauguauuuugguuguacuugguacuagauuacauaggaucauuucaaacaaauacaucauauacuuuuaacaaauuccuuccacaauuccuuuguuccccugccucagucucuuuuguuucuuucaacacuuuaguguugucucugcuaucaucucacauauacauauaugauuuuaaguagcuauauaaaaucuaggaaccauauaugaaagaaaauguuaucuuucugagacuaaguuaauuuacuuaauaugaucacuugcagcuauuuuccuacaaaagauauauaacuucuucauugaugaaaaauguauacauauauauuacauuuuauauauccauuccauauauauauauauauauauauauauauacacacacacacauaauuauauauauauggaagguucucuugacuaaagaugaauguuguccaagcgcuaaucauggaagacaagcagugccaaaggaaagaauccaauaacuucugaaguauuuauuguaaggaaagucacaugauaauaaaaaacaaaacagaaauguuuauaguggcuuuuguccuguuugguugagacaguucucauguagggcaaaugcgucuggaacuuaaguaagugaggaugcccuugaacuccugaucuuccagccuccauccuucaagugcugagauucaaacuuucaugccacacagguuugaguuuugggguugaaaugggcuuucuuaucaacuaggaucucccugaacuuacaauguaccugaggauggccuuuaacuucugaucuuccuaugccuccuaaguaaccacaaccggcuuuuugaauuuuguugguuucuuuguuuugaaacaggguaucaaaaauuguggaugaggggaguaacccagagucuugaaauggugggaaauuacucuuucccacaauacaacucacagacuuuaacaagaaggaaggcccaaguguggauaccugaaauccaccucgaagaggaauaauaaucaugggaggcagagggaggaaauugggucggagaggugagaggaaggggaaaagaaggggcgggaucagguauggaaaggagggaugcccagagggccaggagaauuaaucaacaugcagcaguggagguuagggcccauggggaaccucuagaaagucccagagaucugggaugugagaggcuacuaggacucaauggggaugaccuaagcggaaaugugagguggaagcagaugggggagcacccucucagaguugggaggagggcuuaaagaacuccgggagggggagucaggauggggggggggguuggaauguaaauaaaguaauuuaauaaaagauauaaagaggaaaacuauaaaacucuuuaaaauauuagaaaauuaaaacucuucuguagguuuacauuacucagagaauuacuccucucacaagcuaaccagacuuuuucaaguccacauugaaaaauaguaaauuuaacgaucccacgagggacaagcccacaguacaaaaagcaaguguccaauaccuuucuuacuaggguuucuauuacuguuauaagcaccaugaccaaaagcaacuuaggaaggaaagaguuuacuuggcuuacacuuccacaucacagcccaucaucaaaggaacuugaggcaggaacugaagaagcucugaaggaauguugcuuucuggcuaguucacucagccuuuuucacauaccgaaagaccaccggcccagggguggcagcagcacacauucagaugggcccucccgcauugaucaguaaucaaaauauucccacaggccaauuuggaagcagcguuuuucucaguugagguuucucuuucuaacgacucugccauguuucaaguuaacauaaagcuaaccaacugucucuuaaacguucuuauaccauccgcaaguccacaccucaaucaacuggcauuuuaaaccugagcucaccuaaugcgcaaaucacaccucuugcgcugucaccaacgaguauggaagagcgaggcagcgggauagacaggacccaccgcccaccagcgccguccugccccucuaggcccacgguuugcucuauggucuggcggaccuuguguugucauccuccgagcgacggccggaggcggcggcggaggcccgggcgggguguuugguuucguuucugcaccgacuggaauuagugucgacggucaaaaugggaguccccaaguuuuaccgauggaucucggagcgguaccccugccucagcgaaguggugaaggagcaucaggugggugagcucaggccgcggcgcagaaagcgggcccgcgggccucucugcgcugugggaccccggccuuccagcugcccgcggugcaggucagcggccgaacggggggaagagaaggggaacggaggcuuggcggcccccggguagccgcaccagguagaggcaggucagaacagaguggcuugcggcaggucugagcucccccugggaaggcacuccaggacuugcaaaggagcccuuggugggaaggcuuuuaaggagcccucucuguccuccugggaaccggaccuggagcuucgcuuuaggcugcgaagcugugugggacgacuucucgggucccucaucccaagcaaagcaacagacgguauacaagcacuaacguccccgugguggaaucgcggagcacuccagcugugaagagcugcauuuaaccucaaugccuggaccgguugcuguagcuagcuagugucuuggguuugugauacuuuuucaugcucccguuagcccccagacaggaccgaccccccuauugucuaaacgaacaaaacguuuagauggagcgcagggauggggcggggagguggggggaauggugcuuaaaggcuuuaguauggcagaaagaucucgaaacauuauuacuaacacuuaguguauaaugacccuacagcagcggguuuuuuuuuuuuuugaguucuaaaaguguguauuuguauauuuauauauacuauauacuagaauauaucugcauguuugaaugacggaggagagaaaccaaauguucuaauagguaaacuagacuuugaaugauaauguaguaugucacauuuaaugacuuugguuuacagaaaaaaaaaacucguuuuugaaauuuguauacuuaauaaauuauuugugauaaguagcacuguauuaauacuggaaguugucaauuaugugggguuuuuuuuuuguuuguuuguuuuaagguacuuauaagguuaaagauagaauccagccucuggaaaggauucuuuugauauuaacuucuaaugaaaguuggcauauaaaagaaaccuuauaaaaaguucgaaaaugcugacuugucuuccccuuauuuuaguuaagauuagaugguaugaauuugguugacuuaaauuuagaugguauuuauuuucagggagaaaagugaaaauggaggcauuguuuuucuuuuucaggaucuuuaaucaauaaauauuuucuagccuaauguguucaauaacauuuuuauucuaugcucuuugaucacagacauuuauuugguaaaaauaucuuggguucaccauccuggggaauuucauuguaaaaacaaaacagucuuuuaaagcaacaucaugacaugggaagcaagauagauuuugugaaaguuuuacaguagauugaaaguaaggauugcuuuaaaauuacacugaaaauaaacuuuaaaacuuguuggugugucagcggggcaugguguccuacaccuucaaucccagcacugagcaggcagagguagguagauaaacugacagccauggaacacagaccugacaaaacaagaaacucgauguaucaaaguuaggccuuucacaaauauuuuauuuaacagaagaccaaaaaaggaagacuaggagggaaggacccaagcacccacauaaaagccgggagcagcauagagcaccuguaaccagcacuagagagcagggacaggugaagccugagggcucucaggccaacucguccaacugaucagugagcuucagguucacugagagacccugccucaaaaaacagacaaaaaaaacuaaaugaagaacauuuaguuuccugugugguugccagggugaacagaagcacacccagagggagaggauggggagcgauguguuuuagaacgagagugaggaugguaucagcacaguuauucauccuuugaaccacugaaugaaaauagauagaauucaugugauucaguagccccauguuacugaguccaaacacuacuagaugagggcaaacuaccaagagacucuagacaguuugagaggaaaagaagaacuagcugaugaacuugugaacagaacuccagaauacccuguaggcuucaaaggacuagccaauuagauaacaguaccuaaagcugggggagggaggcuuuauuuuauuuuauuuuuuaagacugacugagugaagaagaaaaagcaguaucccaccuagacauucaaagcugaccuaccaaaggaucguuauguggcacaguaugcccuaaggagaaauggcugagaauaaaauaaauguuaccauggaaggcauacuggaaacagaagaaacugauccugaugaaaggaagaauuggagucaagggaucuuuaaaaauacacuaccauguuuuaaaacauuauugaaaaacugcaaaagaaagagacuugugaaguuaaggcuuuucugagcccacucauucuaaagcuuaaggaauuucaguucauauagaaacaaaaaacaacaaaaaaguauugcggccaagugacauacauuuauuuguuuacuuacuuauuucagcuucuuucauuuuuauguguaugaauguguguauauauauauaugucugugcaucaccuccgugccuggugccccuaacggucagaagagaguccuggacccugcgaacuggagucacagaugauugugaaucaccauguugauacugcggaccaaacauagguccucugcaagaauaacaagugcucuuaaccauggagccaucucuccagcccugaauacaagcuuuuguuuacuucccucagccagcuguggugauacacagguguaaucuuagcaccagggcagcuaaggcaggaagacggccauuucaaagcuagcauaaacuacaaaguaagacuuuaucucaaaaaaagcaaagacugagcuaggcagugguggcauauggaucucugaguuagaggcuauccuggacuacaaagcaagugugaggguuacacagagaaaccuugcccccaaccccaaaauaaaacaaagcaaagcaaagacuugaaugccauaucuaucauaugugucacccccaccucaagaccuagacgugacauuccagcuacucaagaggcaggguugcaaaaugaguucaagaacaguuugaguaacucaggcuauuuuacaguaaaaccuuucagagcagcgugacguucuaagguuuaauuccucagcaccacagaaaaaggggagagagaggcagaggcugggauuguggcucagauacagcacuugcacaacauaaaggugcagaguuuaaugucccaaaacugcugggggcaaaacaaguuuuuauuaguacauguuuauuaugaaugaugcaugugugggaugugggagccugucagggugcauacuguaaaggcuagaggacaaugcucaggagugagguuuucccuucuacuguggcuuccgugaaucuaacuuggauugucaggcaugagccauuuuauaggccaaauuaacuagguuuugacuagggccaaaagaucauucagacaggagacaagaggcaggaaguaugaacaagaacagagcaauaagagugcgggaaggggcucagcgaacacagcugagagacugccucagcagaagccuacagccaugcacuguauagaugucuccaagucucuagcacuaagccacaaguaggaucucaaaagccccgaaguccuauauaaaagcuggacuuccuuuucuaagaagcaucacuaucgggacuguuaaaaauggcuaaugaacuauucaagucuagccuccuugugacccaguugugaggcuaguuguuuaagcuggucuucuguagaaguagguuccaacagaugugcuggcagagugaaucuuccuucuuccaguguccuuauguaggccuccagcagaagguguggcccagauuaaaggugcguacccacgccuagaucuggaauuugcuuuguuccaggcugaccuugaauuuaguaaccugcuugccucagucuccuggaauuaaaggccuauacuaccuugccuggaccuaagcuuuucauggccacugugccucaagaucuccacaucaagaucuaagucaaaaaccugugucuuccaaccucaagaucugggucacaggugugcccuccauuucuagauuguagcucguuccagauguagucacauugauaaccaggaauagccaucacaaucccuaaaauauuuuucuacgcuagacuggcuauuucucaguguguuccccaaguuacuuacuguuugagucucgcccgggcuaacuuggucuaucagucuguccucagggggcacuucucuuggccgcaugcuucuggucaauuccgucuaauggagacccccugcccuuucugucuuuucuuuguguguucucucugaguguguucguucucucucucacucucucu

SEQ ID NO: 5249 - RNA, 6809 nt, Mus musculus
gcagucucucagggcuacauaguaagaccccgcucugaaaacagagaacucacagacaucaacaugugaaaggugucaagcauuccuuagaguacacggcucucuucuguucagcccuuagagcagcagcauggagucauuccugaucgggaugccgaguuccggcucuuugaucgcguugugaacgugagagagagcuucuccgugccagucggccuucgaggcaccgucauuggaauuaaaggggguaagaccucagcacuggaugucuucagcugcguuccgauugugaaggagaacguagauuuguguguugugugcaucuaagcagaaaauaagucagagaaaaggcugagucuuuuuguguuuucacuguuucuacucuuuugguuguacuuuccagagaaaauuuuccuaucucacaugaucaucugagaagugguugacaggaggacagguugcaaagaacgguuugaugguuuacaagcaucacacuaaaaucauucagggccuuacaggguggacuuauauguuugugacacugaaagaaaaauaccaucacaucccuuuuuuuuuuuuuaagauuuauuuauucuagacacuguagcugucuucagacacuccagaagagggcaucagaucucguuacagagugagccaccauaugguugcugggauuugaacccuggaccuucggaagagcagucggugcucuuacucacugagccaucucaccagcccauaccauucacaucuuaaacuuugucuaaucuuacucauaguuuuaccuuaauuugcauuguaauauauagguuugaauaagucuuguaaucuagaaaucucucagaauaaagaugauguuauuuaagguggaaagauuuuaguuaauuauuaauuugacuuuuaugagcacaacuacauuauagccaguccuaguggucuacacuuguacucacaacacuuacagagcuaaagcagggggauuacuacaagugcaaggcuaaccuuggauacauagagaauuuuaggccagugucggauacagaauaagacuugcugugaacuuuuuuaaaguggggcuagggagauaaugucuaagugcuugcucagaagcauaaggacccaagugccaccccacgacuucauauacgccugggugcuuagggaggauuucuaucccugugaugggcaccguaacgaaagcaacguggagacaaagggguuuauuugacucaccuaucccagguguacuccacuaagggaagccaagacaggaacucagacugggcaggaaccuggggcagcagcauggagaggcuuacuggcuugcccccauguauacacuauauauaggugcauauggaggucagaagacaacuuggaggagucaguucucaccuuuuaucaucugggguuccauggauuccauuagggucaucaggcuugucgucaucccucagcuguucuuuuuaaauauacacaaucgucaagcagacguuucaccacaggacauaugugcaggaaaaaagauacugccagacaccagcuagacuaacugaaaugaaugaauggggguguugugggcacaguuagauugcuugccaguaugccuugaagcugugguucagugucuagugccacaggcaacccagguagaaacagaacuucauucacauacugagucagggacagccugggcuacgucaggcuuuaccucagaagagaaagaaaggucaaaaggaaaggaaauaaaaaaguguccaggugccaauacugccauggagggaauagaacucuccuacauuuucaguaagaauucaaaaaugauacagccacuuuggaaaguaguuugguagauccuuuuauuuuuuucagagcugaggaccgaacccagggccuugcacuugcuaggcaagcgcucuaccaccgagcuaaauccccaacccuuugguagguccuuuuaauuuuuuuuuuuuuacauagccuaggcuauguauuagacacaugaucuuucuccauuugcaaccggaaaccggaguauugaaauuaguuugugcacuaacacgucuggcuugcuuuguuaaguuuguuuguggcaugcccuugcuguguggccaagacuuuccuggaacuuaauauguugcauaggcugaccucaaacucagaguccuccugccucaaccucccaagugcuaggaucauaguuucucuaguaguuacguuuucuccuuagguuuucuuuauugugugugugugugucaggccaugaguguguacauggaguggguguguauaugcucacuuggguuaguguuaguuucacagugugcauguggaggccagaggauuacuacagagucauucucucugccaacuguccugaggacugucaucucaccagccccacaccagcaaagcaaagacauuccaucccuagaugcugauccagaacaaaauaagacaugaauuuacauuaagccucaugugauaacaaaaaacuagaaaauugcaaaugcuugccaguaaaugaaugaauaaauuguuggauaauaugugaugaaaugcuucucaacaauauaaaaagaaaagaaaaugauacauucaaaauggaugacucucaaaauaauuaugcugauagaagccagaccaaaaaagaauagagcuguauaaucuuauuuacuuuaaauuugauguaugcaauaaucuauaaugacaauauuuuaauagcuuccugguuacuaaggauaugcauugcaaaaugacacaggagacuuugggaauaacugucuuauuuauuauggcuuuuugacuaauugcaugugguaaaauauacuaaauuauauacuuuauguauaaccuaucauaucaguuuuauauuaaaauuuuuuaaaugagccugggaauugauggcacaugccuuuaaucccagcacgugggagacacaggcaggcagaucucugugaguucaaggccagccugaucuauagagcaaguuccaggacagccaaggcuacacaaagaaacccugucucaaaaacaaacgaaauuuuuaaugcauuccuuaauacccaguaauuucacuuuuagggaaggauuagcauacauagaggagacauuuacaugauauucauaauagcauuguuauaauuguuauaauuguuaaaauuauaaacuaaguuuuuauaguagaggaaagagauaaaugaugguauauucauggauagaauacaagauauacugagauauauucaggaaacaggaccgagucucaucauuuugaaacaagcacaaguguguuacaagaguacaucccuggugguagguagauaauagacagagauagaaauggauaaugagggcuggagagaaggcucaaugguuaagaggaccaauggcucuuccgaagguccugaguucaaaucccagcaaccacaugguggcucacaaccaucuguaaugagaucugacauccacuucuguugcaucugaagacagcuacaguguacuuagauauaauaauaaauaaaucuuuaaaaaaagaaaaagaaaugaauaaugaacuugucaaacacuauauacauuauuucagguaugucuauagcuaguaaaaauguaaaggaguauauaagaggccagauugccaagguaagguuaugguugccuuuuagggauaaggacaugcugggcuuguaaggccuuuguguuguuuauugcccuggacgacaguuggggugcugguguggcuuucuucauaguuaaacaauuuuuguaaacuuuuaaaauaaaacaagugcuuccgagcaucuuuacaauugacugcugcuuucccauugugugauuuccccaucugauuccuuucuucaucuuuaacagcuagcagagaagcugauguacuauuugaaguauuauuugaugaggaauuucccggaggcuuaacaauaagguuuguauuuccaaauacuaguuguccuucaugaauguccaugcagccucucucuguucuuuuuguuuuuguuuuuuuguuuuguuuuucaagacaggguuucucuauauagcccuagcuguccuggaacucacuuuguagaccaggcuguccucgaacucagaaauccaccugucauugccucccaagugcugggacuaaaggcgugcgcgaccacuacccaguuuagccucucucugauuuuguauuacuuguagauaugugugcccaguuugacaucauaguugcuauagaguuaaaacagugaguaccugucuacccuccugauuuuucacuuuagccaaggcgguucagcaacugacucuaaugguaacuauuuaauuaaaugugacgaaugcaugaacagugguuaacugggcagagaggaaagaagagagugagaaauacucaagaacacaggauagaacaugugacaaaggacauuuucugguuaaaugacuucaggaauagagcuggcugaguucaaagacauguuaagucuucaucaucuaauguaguggaguuauaggugcuuaacaagaucacaguagcuugaggauugaauggcagguuaguaaugagacaggaaacuugacucugaaggauaaaagcaacagcuggaaguuaucagauuuaaaacaguagaguugaguugcuuucauuugaaaguauaugaaacaugauaucauuuugagagagcucuaguacaaaguuuaaaguuacaggaaauaauagcaaggaugcgcucuuucacuuauacuuuguaauaucuucauuuguaauaaaagauuacuagaguauuaggaggaagaaaugaaucauuuuccagcuuuucuuucuaauuuaacuacaaagcugacaugaacuuaacuuccuuugcaucuguguuuugguuaauagguaauuauaauuuuaaauuacucuuguuuggccuccugacauaaagucuuagucuguacugaguggcuccuacuacaugccauuauugagccagcuagaugauacagagcuguaggugacuacugcacaaaccugacagccagacacaaguaaaggucgcaggaaggaaacagcugaucgcguaaaguuguccucugaccuccugcccaugugcacucaguaauauaaaaguucuauuauuuugaaacuugaauaugcuuguuccucuaagaccuucccaguguguacucuuaaaugcagccacagaauuuugaucuuuuauuuaauuauuuaguuuuaauaacucgcauuugcacaauaacuacaguauauaucuaacauauauauuacaugacuuuuuucuuuuguguguuuguuuugagacaaggucuugaucaaagcuggccucaaacccaaggucuuccuuccucuacauuccaagugcagggcugacagacagguucagggaugugcaggcacacagucaacauacaccauuaugauguaugcuuuaggacuuguuuucuuuuucauuguccuaauuucuuugacagaggguuucaucuaaacagacuaguuucagauuugaaacguagccaaggcuggcuuugaacaucugauauuccugccucagccucucuaauacugugauuacaggcaugcauuaccaggcauggcuuaguuuuuugucuguuugucuuggugacauuuuuuucuucuacuccuaguuaagggcaucuuagagagagcuuugugaaagauuacugucacacauauucauuuuuuauaauauaagucucaugaaaauacauguuuuguagcaaacuggaacucauaaaagaacucuacuuuuuuagugucaucaauaugagaagaugguauuuuugaaagaggaaaagguauuauuagaguuuaaaaaguugacaaaagacucccccacccccacccccuuuucuuaaguucagggaucuaacccugaguuaauuuccaguauguuuuguuuuguuuuucucacauuuuuugaggcaaggcuguacucuguaccacaguguggccuagucugucugaccuacauugaauuccugaccuucccacuccugccucccagcugcccacaucauaggaaugcacaagcagucccuccacugagaugaugucuccauuguaggugcucaccugguaggggauaccgacugccaacaagugccuuggugaaccuuucucaugggagucggugugaaacuggaaaccagaaguugacagccauugugaaaccacaaccuucugugagucacuguagugcagcucccuccgggcacuugggaggccucaaccacucuccucagucaccuuuucuuccuacucagguaaguuccucaucuugacaacuuguaaguggagacuuaauuugacuuaguuuucuuuuuugauuuaaaaaaaaaaaaaagugguacagaucaugauguaaagacacagaccuuuuggguugguuugguuuuuguuuucccagacaggguuucucucuguagcccuaaccguccuguaucucacgguguagagcaggcuguccuggaacucacagagauccaccugccucugccuuaucagcacuuggauuaaaggccugugccgccaccaccacccagcuagauccacacaccuuuacucccagcacuuggaaagaugaaguaggaugcuauccuggaccauguaugucaugucccuagucagcuacauauggaugucuguauuagucaggguucucuagagucacagaacuuauggauagucucuagauaguaaaggaauuuauugaugacuuacagucggcagcccaauucccaacaauuguucagucgcagcugugaauggaaguccaaggaucuag

SEQ ID NO: 5250 - RNA, 13575 nt, Mus musculus
ucaauuuuggcauaauuuuuacucguucacaaaauuguaaugauuacauuaaggcaaaggccuuaguggcauaauuugcuuauuucccccacugaauaugcaguauuaugcugguagaggguuuucuuaaauaugaacaaacauugacagagauuaaaaagagcucuggggcuguaggcagugauacaaagcuccuuagccuaccugaguuuaaccccggcccuucaacaccagacagaagaggcccugggaagcuggcuggguuggcuaagugccauggugaaagcaugaggaccugaguccaauccucagcagccacagaaagcagccaggcgcagugcaucagugccugccugcugucccaaugcuacagugcaccagugccugcaugccaucccgaugcugcagagcaccagugccugcaugccaucccgaugcugcagagcaccagugccugcaugccaucccgaugcugcagagcaccagugccagcaugccaucccaaugcugcagagcaccagugccugcaugccaucccgaugcugcagagccagcuauaggaggaccucuggagcuugcugcucagccaagccagcugaauccaugugcucagguucaacaaaagacccuguucaaaacauaaaguaggaggcaaaacaccuagagcacauguacaacacaagccagcacacauucaugugcaugcacaagcgcaugcauagacacagacacacacaagagugucuguacaugcauacaggcauaaaagaaugaagccuaccauucauggugguauaugucucaucccaacagaugaagaggcaacaggaucaguuacauggggaauuugaggucagccucugcugcucugaaaccuugcucucccccuccccgccaaaaaaaacccuaaaaaauucauuagccugaggagaaaauugcucagugugguaguuugaauaagaauggcccguaagcugauauguuuaaauacuuugucaccagggaguagaacuuccugauaggauuagaaggauuaggaccuguugccuuguugggggaagucacugggauugagcuuugagguuuucagaaguccucagaaagccuggcccaccccguguuccugucuuucucucugccuguggaucaggauguagcucucagcugcugcuccagcaccaugugugcugcugugcucuccaccacagugaugguggauuaaccaucugaaaggagaguuaacccuacaacuaacuaaaacauaacugcaguguauggugguguacacuuuuuauccaaauacuugggaagcagaggcagcuguauuucugugaauucaaggccagucugguccugaaucaaguugucuauguaucaagugccaggucagccagagcuacauagugagaccugucuaaguaauaauaauaaccuuaaagauuauuuaugauaacuuaguggauaaaugcaccugcuaccaagcauuaccauaggaguucaguccccaggaccgccuaggacagaaggaaagaaucaacaucagcaggcuggccucugccuccauacgcaugccacagcaaguauguacaagcacauagaaauaaagaugauuuuuuaauuuaaugcucguugaauaaugaagcuggaaacuaaagauuuuguuccugucuaccuaggaccuggguuuaauucccagcaccaaaaagcugagaauugaccauagauuuuagcauguaaauguccaguuucaccacauugauaggaguaaaagacuaauugaguaggguuaggagagaaaggaaaggggcugcaaagauggcucagugguuaagaacgugugcugcucuuccagaggacuugaguuccauuccagcaccaugucucacaguugccuguaagaucagcugcagaggacaugaugcccucugcuggucucuucaggcaugacacauguagcaaacauuuaugucuuauuaaaaggaaagaagaauuggaaguaacaaauauaggugacuuuuacaggcauguuuaaauuccugaccccugucuugccucccaaguguugggauuauaggucugcagcacuauacuggcuguaaaaguaugugcacagugauacacacuuguagucccagcuacucucugaagcucagaaggcuaagacagaaagaagaaccauuuaacccaggaguucaaggccaacuuacauaacacagcaagaccuugcuucauaaaaugaaugaguggguggguaagugaguggaaauguuucccugguucuugcauguacaucuucuauaguaacucuugcuuuuccagcaguucacuagaaaccauuccacuaaacugaacagcucccuuucucuuaugccugacuaaugucuuccacucucaccugucugucaaguauaacuaaucuauacucuaugguucugaccucuuaaucaaguauuuaauccaguauugccagucuguagaggaagagcguaugugucacaucgaccucaagaugucccaaaauuaacccuagcuaaagccucuccucuuguucuguuucuacaccaucacugcccaggccuacagucucaagagcuuggaaucaggaaauuauguccccagaucugguugagacccugucugccuuguucuguucguacugagauauaguugagacccugccugccuugucuguccacacuggcuuucugcugcugcuucgguaugcugucaccacuaaagaaaguuuuaguugucuucuucuuguuaucuuuuuguaacaagauucuaaaucauuggacuucucuguucaccccaucagaccuuagauuuucuucccaggacuaaccuggccucuucucaauguucuccucgauguuaucuuucgcuuggaguucuugguguauaauguuguguaauuucucuuaauaauccuuucacccgaauuagccugaaggcguaauuggguaagguauguuguggguugaaaaccgcuuuaugccauguagcaguagauuguagcagugcuggaccuuaaguuuuggaaugcaggcuucaggacacaagguauacaaauguacuacucuguacugcugugaucacacauagaaaaugaagcaauuggagacugcagaggucuuugccaggcagagauuccugcucaguaccauuggauuccagccugacuccucccacucauaaggucuuuuguaaucuauaacugauauggaagauagguaaggaguuuuaaaauaacuggccaaaaacagugguguagaaauuggccuuuaaaaguauacucuguccugugacuucaguaccaugcaucuaaccaugugguaugacagucccuguggcaucguucaugauaaaaacaguccccuacuagauguauggaaagaucugaagauacauggacaagacccgaagaaaaacccaggcuaagaaaaacaucaggacagacacugacuccugagccugccuucugcgucuugagaguacacuggugcugugcucugacaaaccuguuauuguugaguuucuucugugucuuugaauucuuucucuaagaucaaaaaccucugggaacucugguccaauaacaugaccguacuaagucgcauaaaaaaguauguccggcuguuugauaagauaaucagauugcacuccuugcuuuccauuucccacaagucauuuccauuuggguuguguguucuucuguucuuuccacuuaaaauaugcuuucuucacugccaaaucuuucuagauacaacuuaguucagcuaagcacagcaauguuugucuauuuccuguauauuccaagaagugaaagcuacguaagucaacauuuuuaauaucaugaaacauuaauauuaagaagcugaguuuguuugggcauggugguggcccaagcacucaggaggcagaggcaggcugaccucugaguuuaagaccauccuggucuauagagcaaguucuaggacagccagaccagcucagagaaacccugucucagaaaaaaaagggggggaggaggaagaaaaaaaaggggugaaggagcaggaagaagaaaaaggagagggagaggaggaaggagagaaaggaagaaaagaaagugaaaaaaaaguccaagcauucauugguaaaauacagcaguauacccaacaugcauuucuuuacagaaacaucagagcgggugcuagagcaacagcuuagcaguuaaaguggaugcuccuguuacagagcacccaaguuuguuucccagugcccaugucaggcagcucacagccaccuacaguuccaccacaugcacauaaagaauaaguuggcuuuuucacgacccagagagcuaugcacagcucuucuagcucuguguucuguuggugaugcuugaucugugacuccugaucucuuuccuagguuuucuaacuccaggguugucucccuuugugauuucuuuauuguuucuaguuccauuuuuagaucuuggaugguuuugaucauuuccuucaccuguuugauuguuuuccuguaauucuuuaagggauucuuguguuuccucuuuaaggacuucuagcuguuuaccuguguucucuuggauuucuuuaagggaguuauauauguccuucuuaaaguccucuaacaccaucaugagaagugauuuuuagauccaaaucuugcuuuuccugugugaugguguauccaggacuugcuauggugggacaauuggguucugaugauggcaaguaaccuugguuucuguugcuuauguucuuaacgcuugcuucccgccaucugauuaucucuagugcuaucugcccuggcuguaucugacuggaaccuguccuuccugugauccugguugugucagaacuccugaguucagcugccucugugauccugugauucugggauccugugauccuaagauccugguugugucagagcuccuaggagucaagcugccucugggcccuugagauccuggugugaccaagcuccugagauccugagauccugugguccugggcguguuagagccccugggaguggagcuuccuuuggguguugugagacuggcuacggaguuugcacccaaggucugcucauggcaccagcccagaccagauggaaccugugccacuugaaaauuaccuuuuauuaaaucucuccagccucugcuuuuacuuccucuugcagauucaacuauagcaaguuguuucuuuuugcccucuggcuuucucuuccuuucaucaaagaaucuugagguuggagggguuacucaauggguaaagugcuuggauaugaacuuggguccucaguacucaaggcauaaugucacaugucuguagccacagcgcugguguuuuggagacaggcacauccucggggcuugcuggucaggcacaugucacugaagcggggaacuccagggucagugaagaaccuugacaaaaaaguuagauugagaaguauucgaggaaggcaugaggacaugaguguguaagcgugcacaugugugcauccacagagaaaagaaacaaucuuacguuuuacuauugugcccauuuauaaacugucuuaauuacugugggcuugugggucuugcuggaaaauuguguuucauuugaaaauauaaacauuaauuuuaaaauccacuauggaggaaagaaccuagaaaggaauguaaaugaguuaauauccucaccuuucauaaaauacaagaaaguauucauuuuagagccuuuuuaauggaaguuguuaacaucagugugucaagauaauggagggggugaaugagcggguccagccacguucuucuguuacguguccuuaucuccacuuacacuaaaaguguguuugucuugaaguaagccuagagaaaguuagagaaauuucuaggggccccgaaagagaaaguucagcaguuaggagcacugguugcucuuguagaggaccuagguuugguugccaguguccauauggcggcucacaaccaucugcaacccagugccaggggagcagaugcccucugcugaccucaaccaccaggcacauauaugguacacagacauacauguaggcaaaacacccauucacauaaaauaauggaaaucuuuuuaaaagauuuaaagaagguucuauuaaugaacaaacauucaaaguuuagcgcuuucuuuaguuucuguauuuguuaacuuuaaacaaaguuagauugaauuguuucuauugaaaagaggauuuggggaagguucuugucuuucauuuaccuugcuuucuaacuaacacauaggggaauucuggagugugauggccauuauauuaaugauucuuauuuccaagagugguuuuugaguaguuuuuuaaauucuauauaguuuucuguguguuuuuauaaaaaucuguguaauuuuuauuaaauuaacuuuaaaauuuuuuuguuauauuaagguuuuguuuaauugauuuuugagaauuuuaacuuucagggugcaguucuaccucaagaaauaagucaaguaacugaaggucauaaaucuggcuuuacugaccacagugucagacaucagcagagaaaacaugacucgcaacgaaaauguaaguuuuaagguagaaaaguguuuguaugcuaucuucuuuuuguugguuguuuuuuguuuuuuuuguuuuugguugcuguugguagguugguugguugguuguuucauuguuuuuuaaacaaacagcuuuguugaaauauaacucauacuuuaagaauucaucaggcaagugaaauggcccagcagguaaaugcucuugccauucaagcuuagcaacuugaguucaauccccaagacacaugguggaaggagagaaacaaccucuagaguuagccugugagcuacauguaugccauggcgugcauaugcccacacauacagaggcagagagagacaaguaaaccaaccccaucacuguaaagucugcacugaugaagacagggaagguuauuaaugccccugcagguggaugcccauucuccugguaccuuuccuaaaaaucaguugaccagacaucuuuguggugaguuccagccuccauuccaaucugcugaucuauacacaucuauacacaaaacaugcugucuuccuuacuguagcguuuaguacagaaaucaaacaguuuugagucccccaacuuugucugcccuuuuucaggauaguuccauuuauucugagucuuguauuuccauaugaauuuuucauaauuuaucuauuucugcaaaaacugugccuggaauuuucauagaucacauuggaugugaucuucaacacucugacauuuuccugcccuugaacacagaggccuuuucauuuauuuaguuuucucuaauuuuuucuacuaauaucuuaccauuuacaguacacgauucuuacacuguuuauguugaauuuauuccuacauuauuuguuuugauacuauuauugaugagguuauguuaauuguuuuuaaagaagagcaguccuaaccuugccuaaccucgaucuuagagguaaccuuucugucuuuuacaaucacauguuauuuuuagcuauggguuucaguguucccuauuuggugaggaaacacucuauuuuuuucuauucuuauuuuuaccuaggaagagcuaaauuuuguuaaauauuucuuauuuucuuucuuuuuucccucccucccucccucucuuuuuuucuuucuuucuguucuaaggauuaguaccucauauccaccaggcaaauaguauaccacugagcuaaauaucuacagccuuagauucuuuuaugagggcguacaugcucaccuaggcucuucugcaagugcuuguagacacaugugggucugauaucaaguauuuuccucauucuuucuucaucucuuuccuuaacuuuuuuguuauauuuauuugguggauauauguagaagucaagaaggacagcuuacaggaguugguucuuuuuuccaucauggcagcaagggcauuuacccacugagccaucuuacugggucaucuaccuuuuguuguuguuguuuuuguuguuggauuuguuuucuuuuguuuuguuuuucaagacaggguuucucuuuguggcccuggcuguccuagaacuugcucuguaagccaggcuggccucaaacucaaaaauccacuugccucugcauccugaaugcugggauuaaaggccuguaccaccacccagcugucugccuuauuuuuuaagacagggucucuaacaaaauccagaggucacugguugugacuggccaaugcacuccagagaccucccugucuucgcccuuccuucccccagguagagcacuuuccuagaauugccagcaccuagauuugaucccagcauuggcagcagggagaagggaugaggagagggaggcacagacacgggaggaaaccacccaccuugaaauccuuuaaaugcuguuucacuguagugaauacuugaugaauauaguugguguuuaguaagcacuuucacuucccgaauucuguuuucuuguuucuaguuaaggaagaauauaaaaguccuaaagcugagugucagagucaaaaguuguccaguaaacagguaauuuuucuuugauauuuuuaauaacuggauuuuuuuuuaugcacuugguuguuguauagcaucuagugaauuuugcagccuucuccacaguccauaaggacugcaguaaaagccauagucauuuggauggaugguuauacagcuggaguccacaguucagaauagagacaucugucauccuuguuuuaacacuuaaagaguugaguggucuugagcaauucuuaaugaccucaacuucuuuaucucuaaaauagaaacaaacuacugggggcuggagagauagcucagugguuaagugcacugacugcucuuccagagguccugaguuaauuucuagcaaccacaugguggccacagccaucuggaauaggauccaacacccucuucuggugugucugaagacaacaacauuguacucacauacauaaaauaaauaaaucuuuuuuuaaaaaaagaaauaaacuauugguuacuuagagcuuuucucauguauuauaaaauaugugggaguaucuauuuguacauaaugauagguuaauucuccaccagugaaaugagccaauucgagccagauuagaauauauuaaaggcagguaaguuuguugggaauuugcucucaggcaggcagguucguuggccccggggauugaggccagggaaguuaccauggggaguggggaggagaaagagggaaagcccgagcagagagcgaagagaaagaggaggaggggcggggucagagaccaaaaugucugaauucuacaggaaagagucucugagagaaggacaacccagccucugggcuggaaaauucaggggcaggggcaggggcagggugugcuggguagggacugagggauguugagagaaccaggaagccaggucuacucauaauaaaauuugcaccugggucccuugucccaguccuaaaccaaacaucccagcguuuuguuaauuauaaauaaauaagguacucugugauuggccaugacuacuucuugcugacauugggguacauuuuuguuuaugggguaugggcaaaaaucuugaaaguuggucaaguccaggaagggcugguugguuuacugcuguccagguugaagcagucuaugaaguuaggccaaaguaccuauggguaacugggagcuuuccuagauggaguucugagagaacaucuggagcagaagauaggaauuuuagggagaaaaaaaauuugugugguguauauuugaaauucuuaggccuauggucuugagaguugggggggggggggagugcugucccaggaccagggaaagggaaauaggucccacccucaggaaugggcagguggggaaggaaacagccuguuaauuaacaguacuuaucuugaguccauuugucugugggagguggauucuaguagagucccugaagcuuacaagaaucuaaguuaauacauacacugguagcaaagucaagcuguauggaguuagaguggggagagccgaggucauacaucuuauuuguuuuacugucuaggcuuuaauaaggaacauguaaauguguuagauaagaaucaaagaguuuggcaugcauaauuauguauaucuguaugcauacauuccauacuuuaacaaacauuuuuaauggcucucuuggauugggaacaucccucugugaugagcacuucugugugaaaaguccugguuuucugccauuguagaaaacaaaaaguggccagacuugggaccaaauauuuuuuagaaaaguugucauguagcacaagcuggccucuuaacucacuuaggccagccuugaauucauccuucugccucugccuucaaaacaguccugagguuagaggugugugccacuauacccagccaaaauaacggggguuuuuguuguuuguuuguuuuaaauauguuuauuuauuuuauguauaugaguacacuguagcuucagacacaccagaagagggcgucagauccuguuacagaugguugcugggaauugaacucaggaccuuuggaagagcagucagugcucuuaaccucugagccaucucuccagccccaaaauaacguuuuuaagaguaaaauaagauauguaaguuugagagaaauaacaguacugaaacacaguuaggaucugguaagauucauuguccuguuuucuuccugaccuuuagguagaggcuccugucuuaaauucugauccguuagaaagaaagggcuguuuucuuucuccauucauucauucauucauucauuaugugcagugcucugccggcauauaugcccgcaugccagaagagggcacaagaccccacucacuauagaugguugugaggcaccacgugguugcugggaauugaacucaggaccucuggaagagcagucagugcucuuaaccacugagccaucucuccagcgccuuuuuccuuuuaagauugcucaucccaucaugagaguuccucuucaugagcucaucugaagcugguuaucucuguugaggugggauauacaaauauacaaaccauaucagugauuacagucuauaucaaaauugaaagaaauguaaaucuuacagguuaaugaaaaugaucauuuucccuauucaaguuaucagucccucucaucccuuuucuccuuauggcauuaauagaaagcaguucuuggggcuggagaguuggcucacuugguaagagcguucccugcucuuccacaggaccuggguucaguucccagcaccuacgugacugcucauuuacauggcauguacagacaugcaugcagguaaaacacacaagaacaaguaaaucgagagaaagagagagagaaugcaguacauagaauauuuugcugaauuuauauagaauauuguuaaauaguaccuauaaauuuacuaacacaagaaacuuauuuuuucauauagacuucuggagggucugccagauguaguauuaaacuauugaagagaaaugaaaguccaggaacuucagaagcccagaagguuguaacuaguuacccaaaugcagugcauaagguaagugaauaaagaagucaguccuccauccacugccucuccucaaacuuccaucuaagaaaaugcuugacuaacagcugaguuuuuagaguaaaaucuagcuuuuuacuacuuuccacuuuuaucuuuacacguauuuauucuuuuagccucccucugggauugagaacuuuuuagcaucuuugaaucucucuaaggagaaugaagcacagcuaccucaucauggagagccuccagaugaggcggauuuguccccgcaguccuuugcuaugguucguauguucagcugcuacaugggcacacacuaugcucaaacccucugucuccucuuggguggcaccuuacaucacuuuagucguccugagaggaaagccgggguugcuuggagcaguuuagccauccuuuuauguuguuuuucugggguuuuguuuuuguuuucccauuagaccacagaguccugcuuuuuaaacacugcuauuguuaaauaggcuagaaaguaaguaggguaacuauuacuuagaaaucugacuauauucagccuuugaccaucuaauugccucagaugaauucaguaagcaucuuaauuuuuuuaaaagaauuguuuuuuuaugaguacacuguagcuguccucagacacaccagaagagggcauuggauccuaucacagaugguugugauccaugggaauugaacucaggacuucuagaauagcugcccaagcucuuaaccacugagccaucucuccagcccaagcaucuuaauuuuuaacagcgggaacucuucaaaagaaagagcagaggcuggagagagagcccaguacuagauggaguucuugucuagcugcacuaggacaaaccucaaaagaagagaaaaaaaacucagaaaaucaagaagaaaaaugaauaagccaccuaagucuaacguuuguucuccucucaccccucuaccuaugaaucauuuccuaaaaaagaaaggaacacggaugcuuaaagaaauucugaaaauugauagcccugacacaagagacagcaagaaugauaugaagaaaucugauaaugaagccacuguuucuucuagaagagaugagcguggagugucagcacauccuaagccaaguaagaagcugaguaaguuaacucccguugccaauagucagggucauguccaaaagcucaguucauaugguucccuugaaaaauguuuauuuguuuaguguguguguguguguguguguguguguguguguguguguguguguguguguguagagcacacauguggugaugaccagaggauaacuuggaggagucaguucucuccuuccaguguuugugucccagacagggauugaacucaggucaugaggcuugacagcaagcaccuuuaccaauuaagccaucucaccaaauccauuuguucuuuuuaaaacuagaggcuuaggaaguagcucaacaaguuaaaaauacuuaccauggggcugaagagagagcucagugguuaagggcacugacugcucuuccagagguccugaauucaauucccagcaaccacaugauggcucacacccaucuguacuggcauccgauacccucuacuggugugucugaagacagcuacaguguacucagaaaaaucaauaaauguuuaaaaaaagaauacuugccacaugaagaccagcauucacauacauagcacacauguaacaagccagguagcccaugaguaccuguuauuccagcuacaggagaagcaaugagaggauugcugggucuugcugucuuccagucgauccaagaaaaucaagcccaguuuaagggaagacaguugccgcaggcccucugguccccugugccugcguagaaaagagucucuaggguagaugggcaagauuaggauguagugacagacagucgaacacgcaagagagguguuggaucugaaugua

SEQ ID NO: 5251 - RNA, 86656 nt, Mus musculus
caugaacuaucuggucagagguaaaguuuuuuuuuuuuuuacuacaacuccgagaaauaaaaugaaggacaauguggccaccuuccacacgcuuuagaacauuuuuuauggguaguuaaaauguuccuuuuaaugaacuaguugcaauuugacaugaguagacacuggagacugaaaggccagcucucaaaaaaaaauuuuuuuuuaaaaauuuacugacucguguaauuucaaaaugaacuccuucaguggagugaccuugaaccacauuacaauuauagggaaacauuugugcuugaacagaaaacaaugcauggucuucuagaaacuucagagcacuuuucuauaaaaggcagguuaguagggcuggggagaugguuuauuugguagaaugauugcugguacgaggaucugaguuuuauccugagcacccaugugaaaagccagugccaugacaugguggcccaugccaucaaucucaguagacagagagaguuggagacaaaggcaggugggucucugaguucaagaugagccugguuuaccgccaagguacauagagaaacccuguuuucaaaaaacaaaccaaagcuaaacauccagcuauagcagccugggccaccaugugguugcuggaaauugaacucaggaccucuggaagagcagucagugcucuuaacugcugagccaucgcuccagcccaacauucuuuuuuaauauuuccugaaacagagagugauugaggaagauaguggaugucauucucuggccucugcuugugugagugcacacacacacacacucacacacauacacgcucacacauauacacauauacugacacauuuacacauacacacacucacacauaaauacacacacauaaacacacacacacacacucacacacauacacgcucacacauauacacauauacugacacauuuacacauacacacacucacacauaaauacacacacacacacacacacacacacacacacgcgcgcgcgcggacacacggacacacggacacacucacacucacaagaccagauaguaaauaucugagacuuuuuaaaugacaaguucuuaucucuauuucuguagcaugaaauggccaugagcgauguuugaaggacugaguauggcuggguuccaguaaaacuuuacagaacaaggcaguguagcuggaguugauccacacaguagcuuucuacuucuaguuagaaauuaaccuguauugggaugugcuuuaguuugugauagauuaccuagcauaggugaggcucugggcucaauuuccagcaugagagagagagagagagagagaacucuuauuauuaaccugacugggauaucugguucuuugggugauguucuacagccaauagaaacacaagugagucucaucgaaaacccgccucuguguuggucagccugggcuuucacagacuggguugcuuaaacaacagaaauuaggaggcaggcauggugguacaugcccgaguccuaguuucauucuguugcugugauuuaaaaaagaaucugaccaagagcaacuuaagagaggaaaagguuauuucaucucacccuuccaggcacaacccaucacagacagaagucagagcaggcgcucuagacaggaauagaaaccaugaagggauuuuacuugcugacuuucucaggcucauggucagcuagcccagggaauaguucugcucacaguggacuaggcccucuuacaucuaaugucaaucaagacaauuccucauacauaugccuaccaacugauaaagacaauucacccauccuggcuuuccugucagacaacuuuaggcuguaucaaguugucaguuaaagcuaacuaggaugguuucuaaucccagcuccugggaagugaaagcagaaagaacaagaguuggagguccuucucaacuuuguagggaguuugaggcuagucugagcuacaugagaccugaucucaaaaacaaaagguggagagaugacucagcaguuaagagggcuuaugguucauucagaaaucgaguucagaucccugcaacaccagugagacagagagagagagagagcgagggagagagagagaacagacacgcacaaaaaaaaucuuuaaacaaaccauagacgccuuagcaaggcccuaggaaugagccuggcuugagagacuugacaucugagauuagggcuggcuucugaggccuggcuccuugcuuggucuucucccugugucugcucaggaucuucuuguucugugcagccuaaucuccucgcuuacguuggguuaggccucacuguacugacauuacuuaauuaccucuucgagauucuagcuucaagugcagccauuucugaaguaccuaggauugcaacgucaacccugggauuuugagaaacacaguuugaccucaagacaucaccaagccaauuucaggucaauuuacucaugcauuucaucauuguuuuucaugauuguuuacuuuuacauuuucgagguuauuguagcacucuacaauuggcuucuauauugaguuaagccaagccuuuaguauauguucacuucaauuucuguauagcagucaugacuguaucucuauuugaaggauagcuaggcacaacagccuaacauaucccuaugaggucacagaagccacggcuuacuuuugaaaucuuauuccaaagcagaaguucuuagcucucucuuucuguucucaugagacacacagcaaaaacaagagcccuucaacagaaggguagagguuggggauaguuggugaccacagaagacagucagcauuucccagaggucuugggugaggugcauguggccagcugacaguuguauauuuuuaaacuggccugccccucugccuugccagcugucuaguccuuuccugcugcuagucccuacacguagcaagaaaagcaguuggggugaagaaagcaaggggggagaaagccaggagccaaaaauacaaggaagaugucaguggcucauccacuaggagugcaaagugugcagagccccagggccgugguguaagcugcauuccaggcacacccaaggcaggugugguuccugggucugcuaagcuucaaacaaaaaaaccgcagggcgaccagcuaaaguagaguagcaaggaaacaaugaaugaggcuuuucugugugugugaaauguugcaugggucacacuuagagaaaaaaaaaagcccuucauacauagaucaaguaagauucaaguucagugcaaaugcagaggacguuaauccaguucuggcacugugcccugugggaagccaguccuugcaugcaguuucucaguguuaugguaguguguguguguguguguguguguguguguguguguguaugugugugauguaguuauccauucaucugugcaugugagugggcacaugcagaguucagaggugauccuuugagagcaguuucuuuccuucuggggauugaacucuggucaccauguuuggcagcaagcaccuuuaccugcugugccauuacgccacccccaugccccccagcuucuggcuauuuuaacggcaaauccacuggcaugguuucuuucuuucuuuuuuuuuuccuaaaggaaguugucugguuggugcgacugaccucuccuacugccaaugcuuugggcagagcccgucuaagagcgcaugcuucaugguaggugugacacuuggucuaagagcacacgcuucaugguaggcagggacucggagcuuuugaggacaccaccuccaugcuuccagccacacugcaaagaccugcugccagcauuuucacagaggaagagugcaaugcuacagaaguuugcuaccugccccaagacugagaaagagcuaaaauaaagccaagucuuucugacagggcuugggcacccuaagucugugcaucuuucuuaaaauaucuuccauggaggaaggggcggggcucagcuuauagggugccugccuggcaugcucaaggcucugggcucaacccccaggaccaccuaaucuggucacggugggacaugauaacuuaggagguggaagcaggaagaggauuauaagguucucgccugauucacagaaaauuagacaccuguuucuugggcugagaccaugucuaaacaaacaaaauaacaacaacgacaacaacacaucuucuacagaucagacuuauugggcuaagagcaaauaaaugcuuguuuugagacaaggucccguguacuugcuauccagugugaauaaucuugaacuguguugaguuuaauccaucccaggcuggccugggaaucacuauagagcugagaaugaccuugaacguccaaccuacccaucuuugcaaguguuuguauuacaggcuuccaccacugugccuagcuucuccaucgcuggaaagaacucccgccguaaacucagcugcauucucaguccuuguuccuggacuuccaauucuucuguuuccagcucccaaguacuggugugccacuguguauccuuuacucagugucgggaauugaacucagggcuuugggcagccuaggaagacacuagcguaaccgagcgauagccucagccucugguuuuuguuuuuguuguuugagacaggguuucgugaaaucagaacuagccuggaauaccugagccaccuguuuccuuuuuccaagugcugcuauuaaaggucugcacagccaaucacagcuuuacugcauuaaaaacaacaacaacaacaacaacaaaaaccaacaaaacaaaacauuaauuuaucuucucacaguuccucuucccaguuuuaauaauuugaggauuuuauauaugaauacuauauuuacaccuuuuccaccuucucuuguccuccugugucuuuccuguacccucucaaacucaugagaccuucuauaauuuaaaaguaguuucucacacacacacacacacacacacacacacacacacacacacuacugaaucaaguuacuguugccuacauauagggcuguuuagggcugacugggaacccuaucauagggcucauuccuuaaaacacccuauucuuccccucuuucaacagccauuuacuaccuccagcucuuuuucuaagcauggagccuugugagauuccccaccaccaccacccccgccccccccaacgugcccccucuaccuuggcauguugacuggcauguguggucuuguguaagcaaccaugucauuggaguucaugggugcagcuucccugccacacccaaaagucgccaucuuacaggagacguccugguccucuggcucuuucaaucuuucuguccccuccucugagauguuccgcgagguuuaagcaaaggaguuguguucuagauguucccguuggggcugagcgcccagugagcauuuacuuugugucguuuggucagcuguggaucucagccguagcccccaucuacugcaaaagauguuccuugaaugagggauggaagcugcacuugggugaaugggucugugugugugugugugugugugugugugugugugcaugugcgcguguacgugcuuacacaugcggguucguguauacacaaacucacacacuuacaaaagaacagcuuuggggaucugauucuuuuuuucugccaugugccuccagggauggagcuccgucuguccguguuuguuuguuuguuuguuuuuguuuuuguuuuuccgagacaguguuucucuguauagcccuggcuguccuggaacucacucuguagaccaggcuggccucgaacucagaaauccaccugccucugccucccgagugcugggauuaaaggcgugcgccaccacgcccggcacgcaccacgcaugucuguccgucuuguauucacugggcuaucucucaggccacuuccuguaauuuuuuuaucuaacgcuuguuauguuuuaguuggugccaaauccaguuuccucuuuagaagaauuucuugaagcuucugauguagaguauuugucagauucaggcuuguaaacccucacaacacccccucgaaaguggaaaguuacagccaggcugagagacacaauccagacuggggcuggcaagcguuggucuaacggaugccggaaggaggaggcugaugccacacaagucgugaccagucaggcggcagacaauggugagaacagcucaagcaggaaugccaugcccuugucugcaccccacuccuggagggggugcccuccaggccuggccucuuugccugcuggaguucuugugccaggcuuauaaaggcgagcugacucaguauaaggcauugucucaaccuguggguuuucagcaucguuagacugcaagucuucuucagcaacauuuaacccccugcuuucauguccuaucaaugcucugucccuccagacugguauguggccuggagucuaucaucaggucuuucucucuagcuacaucacucacucuuggucauuuugcucacagcacucaucuacuauguguaaggaugacaaaaaggagagagagagacacagcuguuugacuuuggagcaggaacuuagaaagaucaaaucugggauucgcugagaagugaguccuagacuaaucagcucaagugauuggccacagaugucucacuaaguucuuuguacacaacacuggagacauacagaagguacagacauccuugauugggggaauugcugucugcaccccuuaaugaagaagccagcaauacuucacagaguuaggagacagaacagggggaaaaguagaaaugaaaacauaggcccaaauccaagccuugcacgaaggcaaaaauucauaaucucagaacaaauaccugggaggcagccacaggaggaccacauuuugagggcuucuuuggcugcauacgaguucaaggccaaccugaacuaccaaacaacaacaaauccaaccaaaaggaagcaaauuccaagucccaggggagauaugaggguaguuuccucuggagaagauugcaggauguuuaacuagagcuucgauguguggagaaagcaguaugucugacacuuggccacucuagacacugugcugcccuuuucccucaggugcaccgugucagggcauggaccauucuaaagggaagauguggguagacuuguaccaugaaacgcaaauccuacaccagcuuuuguuuuccuggagaaguagguuauuugguugguuuuguuuuuaauuucuuguggugugugugugugugugugugugugugcaccacagcacacaugccagagaaaaaccucguggagaugacuugcuuuccaccacgugagccucagucucagguggcgucugcccuggcagcaggcaccuuugcccacuccaaggcccuguuuguuuucaagacguggucucccauacccuuggcuggcucaaacuccuauacagcaagggugaucuuggacuucuuuuuccccucccuucaccuccccauugugaacuaccaugcccacuguaagggaugcuagggauccaacccagggucccacucacgcuaggcuacugggacguauacaucccagcccaagaggcagccuucgaaauaugcacugauuugucaguugugccucuguucagauucuaccucaugcuuugauuuuuaucagcagaucacccaccggugauccaggccuaggagagaaaacagauaaggaguuguaagcuauugaccacagcuauugguuuccaagcaucaaggcagacauguccuagggauguccauagaagugcaaggggaucaauaaacacaagacagaguaaggcaugaaagccuuggggcaagacacggcuggaggaaaacaggccccagcaucaguagcuucgccacgaaaccauucuaggaaaccauggugguacccagcugcaaucccagaguucaggagguuaaagcugaaagagcacagguuucaagccagcuuaggccacaucuuaagaugcuggcaccaaaacccaaaacaaaaacagucuaucuccuguccaggagugcuagaaagcaccuuuagucaguccucggcaauacagagacuaaaacacucacccugaacuugagaugauccuaagcuguucagugaauuccugggcuauaccgugagacucugucuuaaacguaugaaggaacacgggccuggagaagaugggccagugacuaggagcacuucuaggagcacuucuggcucuucccggggccugacccuuccccagcacccacauuagguucacaacugcccaugacuccaaccccaggggauuugacacucucuucuggccucuucaggcacauaugcacccauggcauacucucacacuaacacauacacauguaaaaucaugugaaacuuuuauuuaaugccaagaacuugaaugauuguuugguaggcugggcucacuaaaugagaugaguuuuuguuuuguuuugcuuuuguugcgauuguuuuguuucguuuuguuuucgagacaauucucgcucuacaggccuggaacucauaguaagccucuggccucagccucccugggcugggacuacaggcgugcaucaccacaggaggcuucagugugugcuuugcuggaagucgcuuugucuuagguggaucuggggucuuacccauuuauuucuccacaguuauuccucuauuucuuugguuauucuguaaagaaaaacuauggauuuuaccucagagcaaaccaucuccccuguuuccugacccugaauuugaucuugacccuggccuagcccaaguacuuuggugugggaaggaacgacaaagagaauugaaaggguucuaugacagcugccacuuccuccugccaugcaggugacacacuauggcaggcaguguggacuugccuauagggugaauuucugccuuacugugggauuauuguaacaaugaauguccuaagcccacuauuccccuuuaucagugauuggucuggguguagucauggugucuuaguuaggauuuuguuguuauaaagagacacugugaccacaugaccacagcaacucuuuuuuuuuuuuuuuuuuuuuuugguuuuucgagacaggguuucucuguguagcccuggcuguccuggaaccucacuuuguagaccaggcuggccucgaacucagaaaucugccugcccucugccuccugagugcugggauuaaaggcguucaccaccaugcccggcuccacagcaacucuuuuuuuuuuuuuuuuaauuagguauuuuccucauuuacauuucuaaugcuaucccaaaagucccccauacccucccccccacucccacuuuuuggcccuccacagcaacucuuauagaggcaaauauuucauugaggcuggcuugaaguuucagagguuuuaaucuaguaucaucauggcaaaaaacccugugguugcaugcaggcagucaugguguuggagaaggagcugagacuuauauaaauugagcagcagguguaagggucugaaaauugcugaagggagacuccagggucagacaguauucaaagaccaagaguguucguucugcagaaacaacccacguaugggggucaacccuuuuccaaaauggcgaccccagaugaaggcacacaagcauucuuauagggaaccaggggaaguuucuagaaggauuagauaaucuaaaauuucacuggugggugcuagaccacgaguggucuguggugugcaguccuaugucacgaacauuuaaccauaggaugacauagggcugcccagcacagauggaccauucugagauaagauaucuccccauuuuugugacuaucuccaggcuguucuuugggaggggguuuuauaaccuuuucuggauuuuauggucuguuccuggagcuggugccuuacagccguuuuuuuuucaaaaucaggccuggcccuuaaauggagacaaaugggguccuuaaauggagacaaauggggcguaugcuguucuucacaggcagcagaaggagacucugagccacacuggguguagcuugaaccuaugagaccuccaagccugccucaacggugacacacuucuccaacaagaccucaccuacuucagcaaggccacaucuccuaguagugccacucccuaagggccaaguauucagcaugaguuuuuggggaccacacccauucagaccaccacacauggcaaaggaugcucaucagaugcuauugagaugcuuucugaaugguuuuugcuguauuuuguuuuucuuaaucuggcauacagauagguggcagccacuucuucuuccuucuaaaugcauuuucauaagaggucaaugaugccuggcccugcagacauucaagaucacaagcgacguaccugcagauaagaccaguaugcaaggaaggaagcagguaggcagcauggaccagccuggauuucagauuccauuccugaccuaccaaacccacuuaagccaagaaaauucuuacccucuucauacuucugaacacuauaagcuuuaauauuuguaaguguuaucuagcccagguuuacucuaaucuuccaucaucuuuccuuuucuagcaaauuuggggauugcaggcaugucucacacccagugucuuuacaguuuaaaugaacacugguagcuaaaucucugagucuuugaggucauuuaaagaauaaaaguggguuaugguauagcucaggguaggauguacacacacacacacacaccucagcacucaugagucugagauaggagauagauggauggauggagagauacguaaauagauagucuuaaagggucuuuuuaauuuuauugcaugaguaaguguguguguguguguguguguguguguguguguguguguacauguauucagauguguaugccagaggucaacuucaggcaucuuuccucaggcucuagccuccuuguuuugugagacagggucucuuacugagauuugcuaauuagccaaagcugucugucuagcaagccccagagaucugccuccccagcgcuggauuaggaacacaugccaccagacuuauuuuguuucuugguaguuuuuuuuguuuguuuguuuuugguuuuggcuuuuucgagacaggguuucucuuguauagcccugauuguccuagaacucacuuuguagaccaggcuggccucgaucuuagaaaucugccugccucugccucccgagugcugggacuaaaggcaugcaccaccaccgccuggcuucuugguaguuuuguuuguuuguuuguuuuguuuugucuguuuuguuucaagauaggguuuaucuaugcaguccggguuguccuggaacuugcuguauagaccaugcuguucucaaacccagagauccaccugccucugcuucccuaaagcugggauuaaaagugugugcuugcuaacacugccccauuaucucacucauuucuuuccuuuccuuuauuuuuuuuuuuaaacuauuuauuuauuuaugaauacacuguuccucucuucagccauaacagaagaaggcaucagaucccauuacagauggcugugagccaccaugugguugcugggaaucgaacucaggaccucuggaggaacagccagugcucuuaacugcuaagccaucuuccagucacccucauuaauuucuuagugagugcuuacaacagucaugggugugcccaugugugcaugcuuuagcuucugcagagguccgagaauaauuuaacugucauucaccuccuuugagacaggguuucucauugccuuggaguacaccaguugggcuagccuggcugcuggccucagugaucuuccuuucucucucucccugguccugaguuuguaaacacgcacuccugugcccaaccuguaugugacggcugggaaucaaacccaagcccuugcuccuccaaggcaagggcuucauuggcuuuauucauuuuuaacaggaaaaugcaaacuguguaacucuagacuuuaaaagucagcuuggaucuuauauguuccgacucucuccuuucauagaccagaaaauuuagaccuuagagcacacagauaacuaaaagcuacaauucuggcugauuucugcuacaggagaguuguuucgccuucccggucuugacagucuguaccuaauauuuguugagaguuucuuccuugaugucuacgagcugaccguuugaucucuccccaccccaggccccaggccuauaacauugguacaguccuagucucauuucacauacaaguuaaggggcacugagaguaugggagugaguuauccaaagggcacaaacacauugagaaucccauacuauguucugggcaguuuuccaaagccagauguaguauugucauuuuuacuuguuugcgacaggacucauguagcccagccggccuugaacuugugacuccgcuucagucuccuaacuugcugggauucccagugugugccaauacucccggcccaucccuuaguuuuuaauuguugacagguuuccucccaacaguucugaggacacaaaugaggaccucguauguucugagaaaugucuauugcugagcccugcccuuagccccugaaagaaaaauauccucuuagguuccuuucaggccaggcugguucccacccaguuuuccaguaacacaugugugacuggagucuugugccuuuuuacaccgcccaccccaacaccuacccgcuaggcccuaauggaaagauuccagucuaacucggugaauagaaaacugucauucucugagcaaacuauguccugggcaccuuugagaagcguucaaguccucucugcugaaucuggucagaguugaacaucuagacugauggcccuacaaaugacaagacacccacucauuuuguguugugaacagugcggguugacugcucuuccuggggucuuccugucuggagcgaagcaccuggguuauuauugguuaagacaaugaaagugcccuccauagcagcaaguuguugcugggcuuuggaauaauucaauugcaauggguccucuaagucucucagagcaaaccaaagcagguuuuaaaaaaacuucuuccauccugaugucccuaaagguugcaacacauacugacccacauggcugcccaggggccacuguggcugagcuaccgagcuggccaaggggucauggcugugauccuccagggaagggcuggcagagacacugcuuauaacaaaggccuuucauugcugcuccugccucgguccaggccuaaccuacacuuaaaauucugaaagagaauacggucauuaaagaauaagacagccucaggcagauugcaaucuuggaauaauuguaugugugugugagaaaggagaaccccaccucgugaaucauccaacaauuguucuuuguugguuuguuuuuuucuuagcuuguuuccuuaguuuuuucaauuaccugguguuuuguuuuguuuuguuuuucccugcaugaagaaaaacucuucaaauuaaucuccucugaugccaaagccugaacagcagcauaagcccugagcugggaccagcaaggaaccaccaugauguguucugugaugucugagacugagcuggagacagagaucaggaacaaccuggacuuucuccccagcccugguggaccugccacaugguucccuggccacaaguucaggcaauucagucaugucuaagggccaccaaaaaggaaaucuaagaaggguguuagaaaagaaaggaaaggaaaggaaaggaaaggaaaggaaaggaaaggaaaggaaaggaaaggaaaggaaaggaaaggaaagggaaagggaaaggaaaggaaaggaaaggaaaggaaaggaaaggaaaggaaaaggaaaggaaaaaugggacagagaaaacccugaacacaccaauaccaaauacauuuucucucucucuuagauucuaacaggacagcucagccuccugucacccuaaguagccuaggcuaaccugcauagcccaauugguaaauucuccuuaccuaggugugcauuugaaggacuauuuguucauuuguuuguuuucaaaacagaguuugucugcauaguccugaccguccuggaacucagcucauaggcucagagauccacuugccucugccucccaagugcuaggauuaaaggugugcgccaccaccaguuuaguggcuuuuuggcagaucuugugauauuaaacauuauuguuccaucucuaugugcaaugcuagucuuuagcacccugauuucuggggaauugggccuguugcaugauuacagcuugcucacgcuuuuguucccugaggccugugccuaucaauguuucucuuucuucagcuuuccacaggcuucgccaccccacggcuguuaaacaaaaaccuauacacgacuguuugauuuggacucaguucccaaacuaggccucagcagguaaacuaaaaauggagucacucgugccccacuuacuuucccagcaagcagaaacuacgcuauuuauucaaccuucagagaagucaggauuagagagaucugagccaaauuucccggccaggccaguuuuaagagucaggacagugaaguucccucugccuuaauccugacaccagacaagcaaccugagguaacuugcugcuuacccaccugucacuuuuccauuguuccccuccgugucccugacuuauaaggaaagcaaguuucaagugaccagucuacuuccugcuuucuuuaggcauuuucugacuuuacacaacucaccugucagggcugggguugcgacacacuuggcggaguucuuacccagcauaagagaggcuaaguucacaccugacacuccauuaacugcaugagaugguccaagccugcaaccccagcccuucagagagagacaggaagacaggaauaucaaggcuauccuuagcuacacagcuacuuggaggccaaccugggguauuuuaaaaugaacaacuucuucuacuagccuugccggaacacuuaauuguauuuuauguaaugaaauguugcccgauuccagacucaaaaccaaagcuccguaggcuuguaaaaguaaacuauaacuguguccuuugaaacuccauuuucucccuggggacagagcaggggccuugacuuucugcaggccucugccucccgguucuguuuuggaagguuacaauguugcaucugcuggaaucuuuccaucauuuucacaagugcaaucgguagaacauuugucaccaauauuugagggccaagugugucucugaaauguguucugaaaacuaacuugcucauacauuuagaacucuggaaaauauaaauauggcuggccuguguucuggagcuuugaaaaaaaaguaauuaaaucagagagagagagagagagagagagagagagagaggagaaugggcaugcagaauuuaaauaauggaucauguugcuacuuuuugugccagaggcuuaugcauacccagaggcgaaugagcuaggugguuguaggcuuauguuuuuccaaaaccuacuuuaauaagugugcuuaaaugcuuuaaccucccuucuagcucaccacccacuggagauagcggaagggaaagguuaauagggcaaaggaggauaggaugugggccugcucagaaauagcucuuuggagcaaauccaaucuauauugucaggguaccagcggcucaguucucacaaauuagcagugagugguagcuggauccucuugcucacaccauuuaggaaucagcaauggcaauucaauccagaagaaacugcgaggcucugccagaggaauuggcaagaagcugccagaacacaccagaaguucuuugguguauuucucucuaugaaguccugaccaacaaugaucagcagagaguagcaaggcagaccaaugccguagcacuguccacggucuguuggguaacauuuauagccuacccaaacaucccauguucucuugagcaucugcucuagcaaaacaucgcaugccccuuuccaggcggcuuccagaaaaacaccaccugucuguucccagcaaaacauccucucauaagacaguuuccagaaaaacgucaggcgacacaacugagucuccaaagagaucagaaauuuccacuucaggugguggcaugcaucuguaaucccaguuaaucgggagcuagaggcaggaggauuguaaauucaaggccagucugagcaguuuagugagacccucuuuucuuucuuucuuucuuucuuucuuucuuucuuucucucucucucucucucucucucucucucucucucuuucuuucuucgauuuauuuauuuuauguauaugaguacacuauagcuguacagaugguugugagccaucaugugguugcugggcauugaauucaggaccucuguucgcucuagucagcccugcucucuccggcccaaagauuuauuauuguaucuaagcacacuguagcugucuucagauacaccagaagagggcaucagaucucacuacggaugguugugagggcaccaugugguuggucagggauuugaacucaguaccuucggaagaucagucaguguucuuaaccacugagccaucucuccagccccugagacccuguuucauaauaaaacaagcuaaugauguaacucacuaauagcuuagcauguguaagagacuugauuuaacccccaauaaacacacauguacacacacacacacacacacacacacucacacauacacuccucacacacagcacauccugcgcgcauaugcuccguuggcuuuugucuguaggcaauuauauucauccuucuucuuaucuucuaccagcucuguaaaccccugccauucucaacauagaaacacccacuucccuucccuuccugacacacuaacuuagcaucauuugaaccugugucucccaaauuucuguucccaagugccaaauaaaguuguuuauguuugaaaucucuuaacuucuaacucaucuauacaagucauucaaagauaaaaguuuuggcuuauucucuacauuuauucaguuaguuaauuauuuggaagggauacauaugucuagguggaggacagagcauauaucuccugagaacuggcucuuucugcauagcaugugggcucaugucggcagacuuggcagcaaacuccuuuacccacagagccaccucaaaaucccuaaaagcuugcuuuugaaaaguuuagauauuccaggcuacauuuccagaaggucaggagucuugcaaacagcccuuauccuugguaaguaacccagcugguuggagggaaggauagugggaagugggaagcacacagccuuaagaaucagaaguuaagccgggcaguggugucauacuccuuuaaucccagcacuuaagagggagaagcaggcggauuucugaguucgaggccagccuggucuacagagugaguuccacagccagggcuacacagagaaacccugucucaaaacuccccugcccccccccccaaaaaaaaagauucagaaguuaaaaucccaccuuuuaccagcugugcacucuuggccuuguuacuuuguggcucuuaaucugcauggaaguggaagaaacacacacuauugcuagauuauuguggguuuuuguauguguacauguaugaauguaccgcuguguguacaugcauguggaggucaaaagacaaucuugggucccucaggggccauccacuuuuuggauggauuugaacacaaugguacuguugggagauacugggagacaggaagugggcagagcuggaggaagaagcacacagcccuggauggaaggaaggacugauuacuaaacucaguuuuccagcauccucagguuccguccacucuauuugcuuccaacacaugggaaaaucuguucaauagagcauccucugccccucuccgacaugccuuuuuuuuuuuuuuuuaauuuauuuucugcugggcuuagauuucuggggucaaaugaucaauccauuucaaccucccgaauggcugagagcacagguuugcacccccagagcuggguguccucuuuaagcuggaacaguucucuuuggucuuugcugcccuguguauuuauccuuuauuaucggcuucacccuuaucagagcuugaagccaaaugcaggaccucccccaugccaggcaagugcuguucugcugacccacaccucugacccugaguguaagugcccugagguggcccagugcuguaaugauguuguguuguccgggucuuucuguuuuucuuugaccuuccuucugugacuugacacagauuuacugucaucagccacagugaacaacaaggggagaccuggagguguuguagccugagaaugugccaaugugugacuugccugccccagaaaauacucaccuuuucuagacauauauggacacaagaauauaagcuuaugaugagacauauagcuucucugaacucugaggcaggaggaucaacugagaauccuaagacucacccaggaauucaaguucagucucagcagugugaagagauugcuguauaaaaaggagaaaaaacccacaaagauauauguauauauaauauaucauacauaucaguauauaucauauauuacuauaaaaauaaaaauacacaaaguuuaagcuacaauauaucauauaucacaauaucacacacauauauauguauauguauauguauauguauauauauauauauauauauauauauuacaaaauguaagaaaaaaaggauugaaauauuuuaaauuaaaaauugcauguaggugggcuucaguggcacaugccuuuaaucccagcacgcagaaggcagaggcaggcugaucucugaguucaaggucagcaugaucuacagugcaaguuucagaacagccagggauacauacagaaacccugucucaaaaaaaaccaaaccuugcugggcaugguggcacaugccuuuaaucccagcacuugggaggcagaggcagguggauuucugaguucaaggccagccgggucuacagagugaguuccaggacagccagggcuacacagagaaaccuugucucgaaaaaccaaaaccaaaaccaaaaaaaaaacaaaacaaacaaacaaaaaacccaaaccagggcuggugagauggcucagcugauaagagcacugacuguucuuuugaagguccugaguucaaaucccagcaaccacaugguggcucacaaccauccguaaugagaucuaacacccucuucuggugugucugaagacagauauaguguacauagauguaguaauacauaaaucuuuuaaaaacaaaaacaagacaaaacaaaacaaauugcacauaauuuacucccaggucaaaaaauggcucaucguguucucaaaaaaaaaaaaaaaaaaaguuuuucuguaugaaaaggggaagggcagacacagaaagaggcaggaaaugaaggagucacagcugcaugccucugccaccacccagagccaccagaccuucccucuacagcgaacuguacuuccucagagagggagccacagcaaguccuuccuccuuuaaguugccuuggcaaguauuuggucacagcaacaaaaagaguaguuucgcaauacacuccccaggaaaagagaaagaggaagaacggaaaggacaagaagaggaacugagaaggggaagcaagaaggagaagugagaagaggacacgagaagggggaaaugagaagaggaagugaggagaagaaagaaggaagaggaaagcaagcaagcugauuguggugucucgugucugcaacccaacaccagagacugaagcaggaagaucgcugaaagucugaggccagccugagccacuuuguuccaggccacauggagauacagugagagagagacagugaggaggggcuugccgauagcacucagaagcccucucaugacccugucugcuccucuauggaauucacucucuuuuuauacugcacaaucaugucugugcccuguagcugcuucuugccggcuccugaaaucuugcauaaacgguggcauucaauaggccaccuucugagucaggccuuuuucagcuaaugauguauuugcaacagcuuccacguuuggagcaaggguagcuugggguuuucaucucuguacgguaaucuauggugugaaggagccacagaagauuuccuuguucugggacaacacagagcuuccaguugagaccgugaugggaaauggugcuuuggcaguuccuccugugcucaagcagaggucauuuuuuuuuuuuuuauacaaacccacagguguuuucuaucucucuacuucccagaaacaauguuuucccuccaaacacacccuuccccauuccuuaccaccuugucugugguuccgcuggaaauauuaaaacccugcugcacaagccagggaccuuggcuaaguagagaaggagggggucaaagccuucccggaggccucccuuccucucugcuucugauuucacuuacaauaacaauagcaacacacacacacuacuuaaaagcgcgauaagagucuuauucacuuccuucagguuugugggaaauggaggggaaagugcuggguuuugugguaucccugauaauugggccugggcuuuuagaaaccuggagcugggagagagggguccagauuggcagaggggaggggccaggagaggcggugagcagcccauauccaggaccuaaucuauuuagguaauuuuagagaagaucauggagcugcagcccaugcaagacagggagcugggugggcgggcagcuugcuugcugcacggcugggcuccuaaaaacugugucugaaggagcugcaggcagggugcccgagcuaacugagccacaguguguguggcgggcucucugaccugccggcuguuuguugcugagcuacugauuaaggcuggguagaguaagaccucccuguagggacugagccagcccccucacccgcucaccccgacucucucuguagccacaggcuuccgggggucacccaagaaaggaaccacccaaccacuagggcuuguuuuguguuugcagugagugccacuccuggguggguggucuugggacguauaaaauagccagcagagcaacuaggaguugccagucgucaguguuccuccauggucugucuguauuucaguuccugcuuccagguuccugucuugaguuaauacccagacuccccuccgugauggacgguugucugcauauguaagaugagauaaacccuuucuuucccaagaugcuuauggacgguguuucaucagagucauaggaagcuaauuagaacaucuuuugaccuccacacacccauaguggcuagcacagcacucauaaggccucuguuucauccuuguacugcacacacacacacacacacacacacacacacgaaagaggagagagacuuuaaaaauuaaacaaagcaaacauuaccuuuuauauucucuuggccggaccgguucacaggaacacagaccccccaucuaugcucaauaugaggaaugucacauaacuuaacuugcagccaucugaaauacaccauaaguaguaaaagguaaacuguguauucauaugacacaacaauacacagccaaaacaacaacagaaaaugauuguguaaucugauggggcugguuguguggcaagaggagagccguuuccuaugugagcuguuuucucccugggaaccugcagcuaggccaaaagcuaugagggagaacuggaggacuaaagggucagagguggccagaguagcuuaugggagguccuucgccagaacucggcaaagucugaccugaggugucauuuggucauucauuucaagagcggcaggucugucuggaugcuuaucugguccaccuuuggcugaguacagaagggacuucagcccccacccccucaccucccaccccguccccaccccuggcuuugccagauuuggaaagagggcaggggguagggguggcaaagaacugaaagcaugguaaacaaacaaaagaaaacucagagaauaaagguaguaacgucugagacaaagaagggaguguggucaccacagagcuaaggguuagaaaaggggagcuggaaauacacagagagcaaggaguuaguugaggagggugaggccgagguaacagaguggggaagguuuccugguugucauagugucugauagugggauggcuuacuagguacacauccauagaagcugaucgauguacagagaaccgcuccagcuuaggcacacagcagcacacggguuuauuucuggcuuuccaguugguguugugugaguuuuccacugaugcugcuccagggccucagcacacaccucuggcacucuccaucuggcuagcagaaaaugugugggcaggcaggggacagccuauuuccuuguccagaacucagccacgcggccacaccuaaccaacgaaggaagaagagagaggaacagauccagugagcaguguggccucugacacaggugagaggucaagauugggggcagggggcagcagcaugcagucacagccaaagcaguggcaagccugcuuguguagauuguggaguuaccaugaacuugcaacaagugaaauccagagaagugaccucagaguuaacaaagagaaguacuucauaaagagccacaauuaagagucucucucuacucucccucucccuuucccccucucucucccucucccucuccuccucccuuuccuccccccugccucaccccugggguguguguguguguguguguguguguguguguguguguguguugcuggggaugaagcccaggccuugugaguguugaguaaguccucuaccauggaucuacaccccaagauccaaaugagaucuuuggaucaggaaauauggauagcaccccacuuuuaagagaggagagaguucaggcugugcaguggcuucuggggaaguguguccucaccaaaggguggggugcacugggcaaugucagacagguuacucacucauucuaucugggguucacuguuuuacaauagggauaacaacaauacuguccuuagaugguugcauaaaauauggaaauaccugaaaaguguuuggcaugcaugccauaacaucuuaguguuguacuaaagcaugcugggucaggugagauggcacaguggguaaagaugauugccaccaagccuaacaaguagaauuuggucucuaggacccaaugguagaagaagaaaagacuagauaucacaaucauacuguggcauacacacacacacacacacacacacacacacacacacugaaacagagagcaagggguggggacagauucuccuuuucuguuuuuguugaaaaagggccuuuaaaaaaaaaaaagaaaugauuuauuuaucuuauguauaugaguaguacucuguagcuuuacagaugguugugagccaccaugugguugcugggauuugaacucggaccuucggaagaguagucagugcucuuaaccccugagccaucucuccagcccuugaaaagggucuuguguagcccggcacggccuuaaacuugcuagcagcccaggaugcccuugaacgccugauccuccugccucucaucacagugcugggacuguagguaucguaaccaugccagcucuccuucaccugucgucuuauucuaucuacguacuuuccucuguacgagccuucacugggccuuccccucagaaaaaugaaagcuguguuagcccugccugcacuuuaggacaugauucacaagugagcaugucacuuccaccuaaacuugggcugcuacucagagcaaagguucaguuuugacauccuguagagaaguucauugaauuuuagacuuuaguuuuuaaaaaaaagaagccuauaucuucuauaaauaaaacgggaaucucauuguaaaagggcaggaggaaaaaaacgcuuuguguuagaacagggaaguucuggacggggugugguuacuuuccagauuauaguucuugaagcuguuccccccgccccccacugccuaacauggacgugugugugugugugugugugugugugugugugugugugugugugugcguguguuuaugagcaaaggaagagugagcuugggcguguucuccagugugcuguguuguuuaaagccaucuccugagagguacccaggcuaucaaaggcuuccugugauaaaggagaccuuagcacuaaguggcagcaagggaccuccuuccaguagagguucaauuagcacucgcugugacugucgcuaugcagaggggacagugugcacaccacucuucagcuucauccagccacugcggagcucaucagaacuccuggugccauggggcuguguuaugcagagagcugcugguucaaguccagccccggagaggagacagaugaaucuucugccgcaggcuaaauaaaaaccaggggaagggaggugacaggagaaaaagcaacgcaugguaaguaugcaaaaggcccuggauuucacccccaguaccacauuaaaagcaaaacagcagggcuggguguggugguucaugccugcaauuccagaaugugggaggcagaagcaggaggaucaugcaagcucaaagccagccugcgcuacauaguaaaacccaaacaaggggcuggagagaugccucagcaaauaaggccacugucugcucuuccaaaggacccggguucaauucccaacacccucacacagagauacaggcagacaaaacaucaaugcacauaaaaauaauuaauuaaaaagguuuuaaaaaacaaaccaacaguaaauaaaaagaaacaaagcaacagcaaaauagcuugguagaaaucuucauuaucacauuguuaaaacaaacaaacaaaaaaaccaaaacaacucuugugagggccagauggcucaguggguagaggugcuugcuacccagccugacuaccugagccucagucccaggauccaugugguaggagagaacugacuccugcuaguugcccucugaccuccacaaacgcuuugugccccaagaauacccucccauuuuaucauuaaaauaaauaaaaaugaaauaacagcauaggugguaugaaguggucaggggaggagguaguugggggagggagguuuuagugagcagagggaugggaggguagaucagaggaagugggaggggagggauaccuuacacuaaggauguuugaaaaggucacaugguugcaucugaagucagcuacaguguacuuauagggaagccuccuauuuuauauuacacaguagaguuugauuggaguuaaacuacacagggugagcuauguuccucccagcagucuuuaguugcuaaauaaaaagcccaguaucuuucugaguuguugaucagaggcauuuuggacacccccagaacaguacaggcuaucgccauugcuccuggcugccuaaaacaacuugauaguaagguguuauugcuggagacaucagacacauugcucacaggauauggagaaaucaaguugguauggaccaggaagcuccuucccugcucgcuguacugggagauucuguguaggccauugugagggaaagacaucaagucuuaccuagcugugaacucuaugaauuacaauaaugacagugcaguaagaugugcccauaggcacacaguggcacaaauauuacagggggcauccaaccacuuucugguuggauguaaguccugacuacaggaagaagcacacacuauuuucuacuauauggacauaguauaauuucaucuuucucuguucguggacuagggcagcacucagaccucaucugaggcguugcuuuguacaguacaggaagguuagcaagggaacuccuaaguggucagaguggaaagagugagucagcggacuugaguucagucucaauugggacaucuguaucacacacaugccagcacugaggaaggagacuguuagaauuagaggucaggaaggaccagaugaaacgguaucuucugaacaagcaggacugcugcagucuuggaccauggcagccuuguugccuaugcuagaucaagccaguggagagauucuagcguggaguggaaaaugguucacaaguggcaccacccacacugaggagcuauggacgguugauggcuucugggagagggaaagucuguuuucuuuaagagugugacccccauagguugauuaugcuccaguggguagccacacauccaggaguauaugggcagcacaaauagaacaccguggguuguuuagaaaaaaaaaagagagaaaacaaagcaaacaaaaauggggacauggcguugggaguggaggugggguagaacugggaagaguuagggugaggaauggagaugaauaaauaugauuauuaugauaugauauuguauugggggcuggagagauggcucacauguuaagagcacuggcugcucuuuuagagguccugaguucaauucccagcaaccacaucguggcucccaaccaucugucaugggaucugaugccuucuucuuggauguagguuauacacagagauagagcacucauauacaauauacauaaaauaaaucuuuaaaaauauauugcaugagauuuucaaagaauuaauacaaagauauuuuaaaaauuaaaaucucuuauaagugaguuacuagguugccaaucgggguauuugacccuucgugaugauuuaaguguuuccguuauccaucaagucuaguaugcugagagaucugacaaacagaagggcaggguaggauugcucagcaucucccacuuaaaaaagaagugagaauggagucuaaagaauucuuggcaucuucugaacaugaagugucuuaacauucugugguacuucauagcaccuccauguaaauucccuucaaaccaugucaggaagguguucuuauuuauagaugacagagagauguguugcuguggguugguuugguuugauuugaguggguagguccuccuuaggucacauaguucugagagguuggcaggggcuggcucagagaggucuccuugaugucauauccuguguucuugcacaaugccuacccuguccuguuauuaaaaacuaaaccaaaaggacacuaaacacugcuuccucuucuuucucaucuuaugauggaacuugugugaccagugauuugucccaaauaguacccaguugcucaacuaagaagaagccacagccuccaguggcucuggguaucauugggcuugugagucuaacgcagauagaagcaaacugcuuuucuguggcuuuuaugguucaauauuauuucaguauaauccugguauauucaucaucacugacuuagaacauaagaagacagguuuccggagccugggcacuuacuuaauuugaacuuaaauuuaagaacuuggcagggagguagaggcaggaggauuaacgaagugaaguccuggacagccuggcguacagagcaagacugucucaaaaagcaaagcaagucaaacacuuauuauaugcccauaaccccauaauuggauauggaggaggagggagcaguuucucauccuucgcuacauagugggggcuuuuguugguuugauuuguuuuuugcuuuuugguuguuugguuguguuuuuguuuauuuguuuuuguuuguuuuugaggcuauccuggagugugugugccucaaaaggggaaaaaaaaaagaggaauaagaagcuggcauuaaucgcuuccuccuccuccuuuucugagaaagcaguaguucuuauuuacaaagucccauuuuacuguuuagccugaaguucaagagcccaccucauccagccuugagccacuauucaaaguuuuauuucuucuuuucuucuucuucuucuucuucuucuucuucuucuucuucuucuucuucuucuucuucuucuucuucuucuucuucuucuucauguuuuucgagacagcguuucucuguauagcccuagcuuuccuggaacucacucuguagaccaggcuggacucgaacucagaaauccaccugccucugccucccaagugcugggauuaaaggcaugugccaccacugcucaguucuucuuuuaaagauuuauuuuauuuauauaaguacauuguagcuguuucgagacacaccagaagagggcaucagaucccuuuacagaugguugugaaccaccaugugguugcugggaauugaacucaggaccuuuggaagagcagucagugcucuuaaccacugagccgucucuucagcccuuguuuguuuuucaaaacagaguuuuacuccauagcccuggcuguccuggaacucacuaugcagaccaguuuggccucgaccucacggagaucuacuugccucugccuccugagugcugggauuaaagguaugugccaccaccaccuggccaaaguccuaaauaggucucugcccucuccugcagguacagccccuugggcugggugcuauccuuucaccuucaaacaauaaacuucaucugggugcgguggcacacuucugugaucccauucaucacuuagaaaauugaggaguuggacggauugcaagcccaagacugccaugggcuacgacguagugaguucugggccaaccugauuauaucagugacuuuucuaauggugacugugacaaaacaccaaggccacuuauuaaaaagaaaaaagauuuuacucaggcucugguuccauaagguugggaucuacaauggcagggacaucaugaccauaggcagcagacaugguagacaggacuggaagcugagggcucacauucugauccaaagcaugaagcagagggugaaccaggaaugauguggggcuuugaacccucaaagccuacaccccagugaugcaucuuccugcaaggccccacucccuaaaccuacuccaacagcaccagaccaagcuuugcggucucugagccaauggcgugauucucauucaaaccaccacacuggucuacagagcagacugucucaaaauacccaaacuccuaccagccuacagagcuuuaauccagcuacagcucuagagcucaagcccucuacagaaaggaaggauuccuccuuccugaccuuggugguaccaaagguuucauuuacugucuuauuguguuuaguaacuaaaugacuauucccaaaggguuguaagucccuggagguguguagcuagucuuuuguuuguuuguuuugagaugcuggggauuggaccuaggcaccugauaggcaaccacucuaccaccaggacagucuuauugugucagucaggcuggccuugaagccaucaucugccugccugucucuguuuccccagcuugugacuaacuggcucugugugucaccuaagaagccuuucugcuggaaggggauauuaucuguguuaucuaugguugugugccugauuuuuccccccuguggugucaugucuauacuccagagaucagcccauuaucccugacucaaggauaacaccuggugaaacagauuggcuguuugagaggagugauaacagugguggcuuuuucugagagcgaagagggcagguggcccuccauucuuuaggaguuaggcagcugugagcugcugggugagucuguuggaaccaaaucccugugcucuggaagagcagccagugcucuuaacuuugcagcaaucucuuaaauccuagguauucuggcuuguuuuuguuuuugacagccucaugaagaccaggcugcccacaaacugaccuugaacuucugacacuccagccugcaccacccaaaugcugugauuauagauauucauuaccaaaccugguguaggagauacugagaguuaaacuuaaggcugcaugauagacaaggacucugucaguugaucaucauuccagccuacaguuuugguuuuugagacugagucucauguagcccagauugguuuugaauuugcuguguaguggggccaaccuugaguuccugauccucuggccucuagcucccagugcugagcuaauaggccuaugucauuaugacugccucaaugcaauuauuggcuuaagccaggauuaucaaaugacguuaaaaccuauauggauggcuuucuaaggaagccagaccaauuuuccugaagaauccugaauauccucuuuuaggcuugucuguuucuccacauagauguuaagcuaaauccucuauuucauuucaauaauaucuuaauaauaauuuaguuacaaccaaauucaguaguuuugguuaaaacacaaaugcaugauggugugcacuuuacacugcauggcucaagcaagaucuaauggauaacacuaauaaaggugcugaggccaucagcugucacaggugccauacuugcuguauagaccaggcuggccucagacucacagaggucuaccugccucugccuugaauguuggucuacacagcaaguuccagggcaaucagggccuaguaagacccccgucaaugaaggaagaugccauuauagguaaaaugauaguuuaaagccauaauuaggaggaaugccuuguucauagccugcagaaaccaauuauaaaugacauuugacacuuaaggggcuggagagauggcuuagugguuaugaucacuuguucuucuuuuagaggacccagguucaauccccagcacccacauggugguucacaagcauccauaauugcaguuccagaggauccaaugacuucuucuagcccucacagauaacaaguaugcauauuguauauauacacacacaaaacacauaaaauaaaaauaaauacaucuugaaacauucuuuuuuuuuuuuuuuuuuuuuuuuuuugguuuuucgagacaggguuucucuguauagcccuggcuguccuggaacucacuuuguagaccaggcuggccucgaacucagaaaucugccugccucugucucccaagugcuuggauuaaaggcaugcgccacuacacccagcugaaacauucuuaaauaaauaaauaaacaagacaguugaaguuaggcguuguggugcucaccuuuaaucccagcacucuggagacagagguagguggauuucuggucuacauaacaaguuacaaaccagccaugaauaagugagaccuugucucaaaaaaaaaaggacaaaauagaaguauuaaguauguauuaaaaguauuagauagggcugaagagguggaucagugguuaagagcacugacugaucuucuagagguccggaguucaauucccagcaaccacaugguggcucacaaccaucuguaaugggauccgauguccucuucuggugugucugaagacagcuacaguguacucauauaaauaaaaauaaaucuuuuuuuuaaaguauuagauaauuuuuaaaaauaguauuaauuuuauuagaugaaaaaaauggcacccauugcugagcauuaaaaccuaaaaaaauaaagaaaaaauguuauuuugacuguauuggaagauauuuuuugcuugguuugguuuuaauuuauuauuguaucuuuuaugugcagggguguuuugaaugcauauuugucugugcccacauguaugcagugcccaucgaggccagccagaagagggugucagauccccuggaacuagagguacagauaacugugagucaccaugugggggugcuggaaacugaccucugguccucugcaagagcgggcaaugcucauaacuguugagucaucucucuaguuagccccauuauucuuauuuagaaaugcauauuggauaggaggaugaggcaggaggauugacauuaaaaaccugccuuggcuauacaguguuaugcugccuuuuuuaaaaagugaaggaaagaaagaccuguagacaggaagguuggggguguggucagugggucuguacuuuuccagugcacucaagaccugguuucaucuccaauaccccuccccaccccaaaacagagaaacacacauacguguguuuaaggcucuguaagaagugugcaauaaaaguuacuucuuacauuucauuuauuuauuuauugguagacacgugccaaguuugcguguggacaaaggacaaccuaugggcgugaguucucuucuuucaccaugggggacccagagaucaaacuggaucaccagcaccuuuaccugccaaaccaucuuacuggaccuaagugaguucuuauucaauagaucuuaggcaagcugccacccucacugcugcguauaucauguggaaugcgggccgaagggauagccaugucuggaacaugcugguguggagcggaagggaaauggaagaugauuagaucuggggagaaggcuugaucaauaaaguuccugcuaugugagcaugaagaccugaguucagguccccaggacucauuugcaggcguggcugaaugugucaguguguuggucacccuggcucugagcaggagagugagaaacuguuuucaaaaagucagcaccgugugcucagggucacacucagccugugcugagacccugucucaaaauuuuuuuuuaauuuuaauuuuuaguaauuaucucauuuauuuugagacaggguuucucucuguagucccggcuauccuggaacuuucuauguuucuauuucuauugaacucagagaucugccuaccucuaagugcugggauuuaaggugccugccacuacacccagcuuuuuaaaauuuuuaagguggagagcugucacaaaaguccccuaacaucuccuucugccacccacaugugcacaggcaaaccccuucauuuuguccuucaaaaggcaaugaaagauaauggagccccacuuuauuuuuuuaggguuuuacugguuaaagccaggcacacggugaagucuagcaucggugaaguaaagaaguguaagcuucccacagggaggggcaguagaauuaucuggaaaucaacgacaagcagaacaaagcaucccaaacucagacauagcaacauuguuuauuagggagaaaauugcaauguuaaauccagauguuggaaagcagcgaagacuaaaaaguaaaugaacuuggcuuuaaccccuggacccggaauagcaaacaggagaaggaaggaauuaauagagcaaaauagauaauaucaaacagaaaacccaaagcagaaggucuagguuguguguucugauaagaucagaauguagaaagccuuuggcaacuauaagccagaaagaaaaaaggcacacuggcaugccaaacaaaaacagcaugccaagauauccagccccuugagauacugugccccccguauuuaucccagugaacuuaaaguuuuggaucaccaagaaaaauauaaacuaccaaaaaggauucaggaaaggcugaauuuaccagcaagaaacaaauaauccaaaauguaucuucaaagaaaggaauuccuuccccccacccccacccugguugggggggauggggggagguagcgugccuguaauccaacugcuccggaggugaaggggagcgggucagaagucuaagaucaucuuuguuuacaaagugagaucaagaccaagcggggcuuugauaagauacucaaguuucaccacuguuuaaggaaggcauggaccucaucugauaggaaaugucucuuagugagggauugucucauuacugaaugucucauuagugagagauggaacgcuccuuaaggguaggaauagcucuuaccucaagcugccacaggaccaggagcugucagugcgcugaaaguaaucagcaaaauccagcuaggcaguugccuuugcgagggcuuccuguagcuuuccuggucauuuccucucuguccccucacguaaauuugccuuuuacaugcuggugacccucauaggcggagucucgccccuggguaccuuucauaccaggaagggaagagauuucuccauaacaguuacagacgcuuugcuggcacauucuaucuguccguacuuuagcauuugcuugccuugcuagacaucacacaccugagccguaugcuauaugaaaauuuucuccaucaaagaaacuagcccaucacuccuguauucaguucucaaguucucacucugccaugggcagaaugcuaacacauccucccccccccccuuuuuuuuagagggucucacuaugaggcucucugcuggccuugaacucacagagaucugccugcgucucuaccucccaagugcugaguauaaagucaugcgccaccaugccgagcuugcaaauagauuucucuuuucuuuucuuuuuaaaacuagaacacaacaugaacggccucuagcccagcucccagcagagucguuguucugcauaugaaaccucuggaguccaaccuuaaccuggacugucaaacacuucucucugccuucuugucuuccaaguuccuaucggaauggcccguuaagcuugauuuuuagcacuuuggggcuuuuuuauuuuauguaugugcauacacuguagcugucuucagacacaccagaagagggcaucagaucccauuacggaugguugugagccaccaugugguugcugggaauugaacucaggaccucuggaagagcagucagugcucuuaaccacugagccaucucuccagcccacuuuaggggcuuuuguugcgcaugacuggaaacucuuguaccccacacagaccccaacaccagccuaauaaccacaugaucagguuuacugcagcaacggcccaacuucucagcaacgguaauuuguauuaacugucugguugccagaagaaaauucaugacagaagccgucuacaggacagaguguuuagccuggcucacaguuugagcaggcaguuccuggugggagccguggcugaaggaguuugaggcagcuagucacacggugucuccucaugcagcgagagcagccagcaguucuggcugguucacuuucuccuuuucggucugaauagggcuccagcccaugggacggugccucccaugguuaaagugguacgacaucaacacacuucaucuauuuaguuucucacaggcaugccagcuuuugcuugcagugauucuagaucuuaucggguugacccgucaacauuaaacaucaguuaaccgugcagauguggaguuuucugcuuacuaaacauuucaaagugacgcuuaaguaaucacuugcuacaugccccaagugaagagauuagugcugaaaugccuuuuggggguggguggguggaugggagccgcuaaguggcuccaggcccaggaaguauggcgugugaggaggugaugacaaaucuauuuaauaaaccagagaaaacagccaccuuccuggggaacugggagggcauuauaaucccuggggauuuagaaacuaagccagggugagccaaagauugggaaaugaagcaggcgcuuacuugcucggaaucuugaagucaaggucagaaauaaugagacgcaaaagucgccaucccuagaguuguguggaguuggaggcaguaggacugagccugggggguaagcaauagaguucaguuaagagccagaaacggucccaagacaaguucauuacccgagauacacugacugcuuuucuuuccaaucaaucugaauugcggucagaaaaggcuggcaagauacgccaagagacgaagucagcucuggagaacacgccugcccucccagcacgaagaauuggaggcaggaagacccggagcuccaggucacccuuggcuacauagugagcguuaggucagccugggcuccaugagauaugaaaaagagaaaagaagggagagagagagagacacuugacuuccugagguaggagggacugauccuuggaagaacuuaagaagaggcuaagucuugggucugguggguacacccacuggccagccucccguuuaaauccagaaaucaaaaggcacucgcuuuagaaagcugguucaucagggaaauccagagugucugaggauaucaccuagccagcccuucucccaaagacuaggcuaguagaugagccccaaaggcuggugagcacagaggguacaggggcaucagaugcagaaagaccuuccgagagaugggcuggaagccucuuacuggagaucagcccuguuuguaaacggaggaacauagaaggaaguuaaucuuggcuggcacuccguucucaagagaccgcaucccuaaaggccagaaccaucagaaguggucagcuccugggaaaagcccugcagugugcacauggcccaaggccaagcuggggguuuggauuuccucuaggcagauuuacauuugccuuagaaauagucaggggacuagagagauggcucagagguuaaggacacuggcugggcuuucaagggacagagguucaguucccagcauuccacauggcagcucacaaccaucugcaacuccaguuccuaaggguccaaagcucucucuccuaucauugugggcaaugcauggacuugguauacagaugcauauucaggcaaacccccauacacauaagauaauaaaagaccugcggugacaagccauaaaaugcuugguuuuuuuuuuuguuuuuuuuuuuuuuguuuguuuguuuuuuguuuuuuuuaagcaugaggaccugaguuugauucccggaagcccacauuaaacaguuagguugguguuggucucaggaccuccgaaagcugugauaucacaauaggcgggacccggagaccuguugccaaggcaacagucaccauauucccagaauccacuuggcucaccucccacauuuaccgguguuacaucaucacccauaaauaaaggccccucugaucucuuucucucucuucccccuucucuuucuaccuccaacuugccucucucucucccaauaaaccucuuacacguggaacugcuuuagccuggugugcuguuuagaugcaagccucuauucuaacacaucaguugguauugggugcuugcaaucccagugcucaggagacagagacagacaggucccuggggcucaugcccuccaguguagccucauuggcaaguaccaggucaaugagagacccugucuuaaaaacaaggugagcaacuuaugagcaacggguccuuagguugucccucuggcuuucacacauacuacacacacauacacaccacaagcacacacacacaaaauaauuagacuuuucuccuagguggccauuuucucccuccacaucaucuaaaggauuucugagacaacguuuaucacagaccagauggucuaaccuugguaggaaucacaagagaguuuucuucccagcguuuugccagccugcuauuguauuccggcuugucuuucauucuguuacacuuauucccaacuuugcuucagguguguggucccuaaaugacauuagagcagaggccaaagccugcaguggguuucucaucggacaccaaggaaaggaaaacauacgaggauccacagauacagcgagcuaagacagauaccgggcacaggcacgcacaggcacgggcucuccccucuucacagcugugaggcaacuacuugggccuuucagaaugcuguuaaacaggccaggcaccguccaggcgugguuucagaagagcggcucuugccuucucuguguuuucccacagggagccugaggagagaucuuagucaucccuuaucgccuggcagcuuccugcucaggcagcggcaauguccaacauguaugaguaacucuugugccuuguuuuauuuaacacacgcaguagauuuagcuugcuuucuuuucucgagcaaggucuuacuauuaaguucuggcugcuguggaacucaccguguagcccaggcuucgccuuaaccucaccgaguuccacuuggaacucugccugccaaaugcugagauuaaaagcguggacaacacuaaguugaaccuuaguuuucugaucuaacuccaagcggggcucaguggaccagggugggaaugggggauggagaccccuaaauccaccugcuaaguaauguaaccacuuuauuacucaauccaaaagugauuucucccaagaaguagaaugugggagcuuuccuuggugguucaaaacacagugcuguuucaaguaucaaugucaaaguacaauaucaucaauacuuugcauccagaaaagauuugucccuucaccuucuuuucaaguguugggaaccgaauacaagccuugcauagauuaggcaggcacucuacccucaagcuacaccgccacucgcaggaagaaucuaagagggcuuaaguugugaaaggcauucacagugguucuaaaccugaggguggccucccuuuugggagguuaaacaauccuuucacaagagucaccgaaggccaucgaaaaacacggauauuuacauuacgauucaaaaccguagcaaaaugacaaaaugacaguuaugaaguagcaaugaaauaauuuuauggcugggggucagcacaacaugaggaacuguauuaaaggggcacagcauaggaagggcgagagccccugcuguagaggaguccaacagcgaaugaugcacuaggacgagccuggugugguaugugggugcuggcggguugcuucuuuuccuuucccccaagagcugaagauguggggagccagccuaaaaauaaggccauuccuggaagucuaguuucccuagucucuuucaugacacugccccucuuuuuuuuuuuuuuuuuuuuuuuuuuaauugguuuuugagacaggguuucucuguguagcccuggcuguccuggaacucacucuguagaccaggcuggccucgaacucagaaauccaccugccucugccucccaagugcugggauuaaagaugugcaccaccacugcccagccuaagguccacuucuugcugcuuacucucacacagaaaugagugaucucaaggcagagaccggagagagacucaggaguucagugcuuugccuaacaugucugaggcccuggguuugagccugagguagagggauagcuucgagacauuguauguugugagacuuaaagaaaagguugccuuaaugggucugcaaauacgcaagugacucuggguucaagugcugcucucucucucucucucucucucccucccucccuucuucccuccucccucuccccguccuccccccucccgcccauguguguuuguguuugugugugugugugugugugugugugugugcgcguguguguguguguguaugugugugugugcuggggauuaagcugggguaagcacucuacuauugagcaacaacgucccagucccugaggcauuuaaauagauuauaggauuccucucuccuuucuucuuaacacuauuucaaagcucugaagcauccuacaggagucaagaguaaacucucucaggcuuucccauuagcacuccucccccacucugguguccucaagugcuguacaugaacacaggaccuuagucagggcgaccgaggucaaugacaggacacgugggaguuuugagaguuugucuuuucugugugaaauccugcaggccuacagacuucuggaaauaaaugaugaggcaauggaacaaucaauggaaagcaagauuccaggauuuguuuagagcgccuggaccucgaaccaaaccuuucuugaagcccgugaccucuggacuuuccagcuguguucaccuguaaguucccuuucaauucaauucaauuucauugucuuuccuguuucuuuuucaguuucuuucaguuuauuuucucuuccuuccuuccuuccuuccuuccuuccuuccuuccuuucuuucuuucuuucuuucuuucuuucuuucuuucuuucuuucuuucucucuuugcuccuuucuuucuuuacuccuuucuuucuuucuuucuuucuuucuuuacuccuuucuuucuuucuuuuuacuuuuuaugauuucauacuuguuugucaugacguaaaauauuuugauuguuauucccaauuauccugucuugcccaacacacuuguguguguguguguguguguguauguguuuuaaaccucugaagcaucucuccacauccuaggguuguuuucauaagcacauuuaaggaguuauucuccuuugcagggcuggggaaaaaauauccccacccccaccaaacauuaauuccaccccucccuaacaguuccuuugggagggguggagucucgugugccccaccucuguccucacacaguacugacaggcccagucacacucgagcauguagcaugugcagaguugcagcugcugggaguuaugaauguagcagccgugucagguugggaagacagcauuccauagcaccccuucucuaucucucuuacagucgucucucugcugccucuuugacauucucagaacccgggaacaggugaugcagacuucucauguauggcugagcccucaacagacccuugggccaguuaugagucuuugcaguaacuguugccacgacaaaagaaaugucuguggccaaaaccaagagcagcacuauggaguauggacauggcugugguuugcauaaggugucccaucaucuugggcauuugaauacuuagucccaguuaguggugcuguuuggggacacaggaagaguggccuuauuagaggaaguaugccguuggaaguucagagauucgugccauuucuaguuugcucucuguuucuugcuugugguucaagguguuagcucccauaucaguuucuagcuccagccucccugugugccuacccgcugucaugccuccccaucuuuauggaccauaacucaccaggaccauacgcccagauaaauccuucuucuauaaguugucuugcucaugguauuuuaucaaaacaauuaauacaaauagaaauauauagaaagcaguuucaccggaacuugaucuugauugcccgccagaauugggugacaaaacccaauuguugaagacagcacacacgucgguugcagaacguagagaaagcaagcuggaggcuuccuucuugcugucuggcucucauaguacugggaguggggagcucccaguacuaugagaucuuuuuuuuuaaucaaaccaacaucaucaucuccuaagccgugaacaauuuaaauucacuuaaacagggccuggagagauggcucgccagcuaagagugcugucugggguuccaaagguacuuaguucaauucccagcaaccacaugguagcucacaaccaucuguaaugagaucugaugcccucuucuggugugucugaagucagauuacucauauacauauaaauaaauacauacauacauacauacauacauacauacauacauacauacuuuuaaaaccuuuacuuaaacaguaaguggaauuaucaccuuguuuacgucaucaggcacacauuccuuccugugaagcaggucacaaguuccauaggaaagcaguuguuugccuccauaacaguggugccaccauugugcuaguguguauacacaccuuucccggaaagucauuagugcaaccugcagagucccaguugaauaagacuguugaugacuccccucgagcuccccacucccaguacuaugagagccagacagcaagaaggaagccuccagcuugcuuucucuacguucugcaaccgacgugugugcugucuucaacaauuggguuuugucacccaauucuggcgggcaaucaagaucaacgcugucuuggugucuguucuauugcugugaagggacaccaugacaauggcaacucuuuuaaaagaaagcauuuaauuggggcuggcuuacaauuucagagguucaguccauugucaucauagcagggagcacggugcuagacagguagauguggugcuggagaaggagcugagaguucuacauugggauccacaggcaggagaaagagagagccacuaggacuggcuuuggcuuuugagacuucaaaguccacucccagugauacauuuccucuaacaaagccauaccuucuccaacaagggcacaaauuucauaauccuuuucaaguaguucuguuuccugaugacuaaacauucaaaucuaugagccugugggggacuuucuuauucaaaccaucaccagucucaauggccgucuuacuucgguaaggguagaagauacaggggacaacucauagguugguaccucacccaugguacugggauguucaagaaucugugguuuauguacucucugugucuuguuagggaaagauaaauaacaaauacauauuaguuaggguuuuagugcuauugacagacaccaugaccaaugcaagucuaauaaaggacauuuaauuggggcuggcuuacagguucagagguucaauccauuaucaucaaggugggaacauggcagcagccaggcaggcuuggugcaggaggagcugagaguucuacaucuucaucugaaggcugcuaguggaagacugacuuccaggcagcuagggugaaggucuuaaguccaugcccaccacgacacaccuacuccaacaaggcugcaccuccuaauagugucaccuccuaauagugucacuccuugggccaaguauguacaacccaucacagaauacaacuuuauaugauucuuaagaacauaaaacacaguauauuuuuauggaguuuuuuuuuguuuuagcuuccaaaucaacacuuaaccaaaagacauuuuuuuucccauuaauuuugcuuguaagguaaaguuacauauuuauaggugggguauugaaaaccaguggcuauguauaaaaguaauaaagcaugugacuucagcaugugacuacaaaauaauuagaaucuaggaacuggaauuucccacucaagucucuuagaaaauaacauguuggccagguaguaguggcacacaccuucaauccuagcacagggagguguuugaggccagcuugaucuauagagugaauucuaggacagccagggcuacgcagagaaaccccaucucaaacaacaaaucaagaaaacaaacagaaaagaaaagaauaugcugauauugccuaaaguguuauuuaaaucuucccgaauguuccucuuacugagauugugacaacuuccuguguaaaaugacagagucacuucuaugucauaauuauuuuucacugaaaacaaaacaucaaacuaauaggaagugauacagauuacacaaucaccuggcaaccuccuggcaacugaaaaauuggacucaaacuucggcuugcuccagcuucccucuagucuaacaaaccagaaaccuguggcuuauuugaacaagaagaaaaggacccucaccaccugaaaccgucaucucugcuugcuagcuuuccugguacuggaagguucuaugcacacucccaggggagaaaaacuaucaguagacuuacccaguugugaacccugcaagccacacuaacgacuagcaagaugugcagucgagguucacuugguggcacagaugguuuuggaguaggcaaccacucccuggauuuaaagccugccccaugagauggaacuuucguccuugguaucauuaacuguggcugguccuagacccuaggggagaaucuaguacuauauuacucugccaaucaauaguaaaauuccuuguaaguuccuaucuuuuuuuuuuuuuuuuuauguuuaaggucguuuaggccagaucugucauguaccacauguuugcagugcuagaaaaagauaucagaucccaugugucuuagucaggguuucuauuccuggacaaaacaucaugaccaagaagcaaguuggggaggaaaggguuuauucagcuuacauuuccacauugcuuuucaucacuaaaggaagucaggacuggaacucaggcaggucaggaggcaggagcugaugcagaggccauggagggauguucuuuacuggcuugcuuccccuggcuugcucagccugcucucuuauagaacccaagacuaccagcccagagauggucccacccacaaggggccuuucccccuugaucacuaauugagaaaauaccccacaguaucucauggaggcauuuccucaacugaagcuccuuucucugugauaacuccagcugugucaaguugacacaaaacuagccaguacacccuguaacugggguuacagauauuugugaagugcuaugugagaauugaaccuggguacucuggaagaguagcacguacucucuuauugcugagccagcuuucuuuuuacauaccuaccuuccuuccuuccuuccuuccuuccuuccuuccuuccuuccuuccuuccuuccuuccuuccucucucccucccucccucccucccucccucccucccucccucccucccucccucccucccuuccuuccuuccuucuucccuuccuuccuuccuuucuuccuuccuuccuuccuuccuuccuuccuuccuuccuuccuucccucccucccucccucccucccucccuccuucucucccucccuuccucccuccuucucucucucuuucuuucuugcacaauugauuaguuguguguaugcacacacacacacacacacacacacacacacacacacacaugccugaaucaugccugaguuuauggacaccauuguuuaugcagaggcuggaggucguuggauacuguggaucuggagugauagcagcuguaaacucccuaacaugggugcuuggaacugaucucaggcuucuggaagagcagcaagcacucucaaucacugagccaugugucugcguacccucuuuguaguuuuuguacuauaaaauuacaaaauugagccaguaaguagcucaguagguaaagguguuauaaccaagccugacaaccuaaguuuagucccugggaccuauaugguggcaggagagaaucaauccugaacguugucuuugacuuccauauguuugagccgggaguggcacuauuagaagguguggcccuguuggagugggugugucacugugggggugggcuuuaagacucucauccuagcugccuagaagccaguauucugcuagcagccuucagaugaagauguggaacuuucagcucugccuacaccaugccugccuggauacugucauguuccuaccuuaaugauaauggacugaaccucugaaccuguaagccagccccaaauauauauuguccuuuauaagacuugccuuggucauggugucuguucacagcaguaaaaccccagcuaagacagaccguauccauauaagaauauaaaguagcagauaaaaaauuuuuuucaagacaggguuucucuguguagcccuggcuguccuggaacucacucuguagaccaggcuggccuccagcucagaaaucugccugccucugccucccaagugcugggauaaaugugauauuuaaaaguuacaaaguuaaaguuauguaugggugcacuuucauuucuuuugcugggcacuucaguuccuuuagucugaaaauuccuguauguuccugugcuucaggaaauuuucuuguuauuuuucucuuucauuuccuuuucuuuuucauuauaauggcgcacgccuuuaaucccagcacuugggaggcagaggcaggcggauuucugaguuggaggccagccuggucuacagagugaguuccaggacagccaaggcuacacagaaaaacucugucucaccccccccaccaaaucaaauuuacuaagaguauuuuuuuucagccuuuuaaaauuuuuuuuauuuuuacuuuguacuucauuuuuuuuuaauuagguauuuuccucguuuacauuuucaaugcuaucccaaaggucccccauacccaccccccccaauccccuaccuacccacucccccuuuuuggcccugguguuccccuguacuggggcauauaaaguuugcaaguccaaugggccucucuuugcagugauggccgacuaggccaucuuuugauacauaugcagcuaaagacaagagcucccugguacugguuaguucauauuguuguuccaccuauaggguugcaguucccuuuagcuccuuggguaauuucucuagcuccuccauugggggccgugugacccauccaauagcugacugugaucauccacuucuguguuugcuaggccccggcauagucucacaagagagagcuauaucuggguccuuucagcaaaaucuugcuaguguaugcgauggugucagcauuuggaagcugauuaugggauggaucccugcauauggcaaucacuagaugguccauccuuucgucacagcuccaaauuuugucucuguaacuccuuccauggguguuuuguucccauuucuaagaaaggguaaaguguccacacuuuggucuucguucuucuugaauuucaugcguuuggcaaguuguaucuuauaucuuggguauccuaaguuucugggcuaauauccacuuaucagugaguacauauugugcgaguuccuuugugauuggguuacuucacucaggaugauacccuccagguccauccauuugccuaggaauuucauaaauucauuuuuuuaauagcugaguaguauuuuuuuaaacauuuuuuuaagauuuauuuauuuauuauauguaaguacauuguagcugucuucagacacuccagaagagggagucagaucucguuacagaugguugugagccaccaugugguugcugggauuugaacucuggaccuucggaagagcaaucgggugcucuuacccacugagccaucucaccagcccuuaaauuuuuuauuuuguuuuuguucaagacaggguuucucuggguaauccugacuauccuggaauuuaucacucuguagaccaggcuggccuugaauuuauagagauaugccugccucugcuuccugagugcugggaccaaagguguccaccaccacugcauggcuuggauuuuauuuuauuauuauuauuauuuuuuaaagauuuggugguuuuguuuuuuauaauguuuuuguuguuguuguuguuuuuugagacaggguuucucuggguagccuuggcuguccuggaagucacucuguagaccaggcuggccuccaacucagagaucuaccugccucugccucccaagugcugggauuaaaggcgcgugccaccacgcccagcaggauuuuauuuuuuaaauaaaagccuccccuacugcuauucccugaugggagucuucaggcucugccccacuguccuuaccccauccauuccuauugucuugacuccucugguccuuuuaguugacuagugucuugcgaauuaagcgugucucuggacuuaugacauuucuuuugucuuuucaccucaccuuuaggaguccuaugaguuuuucuuucaguccuuaaguuuguuuuucuuucuuucauuuuuuuuagguaaagguuucuugguagcccuaguugaccuugaauguguggcuaucauuuuguuucugucuccugaguacugagaccaaagaugugcaccccuguaccugaccuguuguuuuuggaacuagucuccugcccauguuggcuugggacaguauauggccuugaacuccugacccuccuccaucuaccucccaaguguugaagcuaaaggugugugacaccuauguggugcuggggauuaaaccagaagccucaugcaggcuaugguagcauccuauaaacuaagcuacauccccagccucacaguagagucucacaauagaggguuauguuuuagcuuagugguagggugucuagcaguugcuaaggccccuuccauuuuuaguaccauauucaugcgcacacacuauuggcagcuguuaacuacccauggcuucuugacuagugaugggaucucgugcucccuuuaaaacaacaaccaccaccaggaaaaaaaaaagccuuuaacuuuauagcuccuucuggcuauuuuucaacuaagugaaccgaaaaaugcauauuugggagguugccuguuucagcccauauaugguccuagguuuaaacucaagauauuaugcaugcuacuuagcacuaguaaucucugaguacugcaaugcuuuaaaagggucuacuaagggacauuucaguaauacacgaagcaaauauuauccuuuauuuaccccgagacucucucacauuuauucaggcuugcuuuaaaccugaaauccuccugccucaaccuccuauguagaugcuauuccaggccuuuauuaccaggcccaacuagagguuacauuauucuaaaauuaaaaagaaaaucagggcuggggcuguagcuugguuuguagggugcuacucuagugggugugaggcauguuuaccuguguaaaauauaacaaccaaauucacaggacccuuauauccauccaccccuucaguaaaccaacacccgugguuuaccaccccuuagugcuguaaauaaccucccacauguggugggucagucauuugggcuuauuucuuguuuguuaaguuaugucugauuauaucaugaaccuguugguuuuguugcuguuuguuuguuuguguguuugagacaggauuucccucuauagcccuggcuggccugggcuuugcuaugucaaucaggcuuagcuucaaauccagacagauccuucugcuccucuucucaagugcugggauuuccagcgugugcuaccauaccuggccuauaucaugacuuuuuuuuuuuuucuugugagacagcaaacacagugguuacauguaaucugauuuaaguugcuguaaacaaagcccugaagcuggcuacuuuauaaagaaauuagguuuauucagcucacacaguucuggugcucaggagcagaacacggacacuugacacuucuugugauauucuggcugcauuguguggcaaagauaagacuuuguucacuugcaaagggggucgccuuaccuuaaaguacuugcuucugaaagaacuaaacuuggccacguggaaaaggcaucaggccugcaagguaggcaugcauaugagcuaauaccuuccccuuccucugugcccaccccuccccccuuccucuccucuccuccucuuucaacuccuuuuuggcuguguuguguuugagcaucaggcaucugugugcuaaaugcucuaccacugagcuaccacuccauacuugggcucuguuucuucuuuuccuuuaaaaagacuuuauuaauuccuugagaauuucagacgaacauaugauaaugaucauagucaccccuccccccuuccccuaacuccucccaggucuucaauauucucacagcuucauguuuucuugccucuuguuuucugcuuugaaacuaauccaccccuauacuccugggugucagacuauucacuggaguguggucacccuacuggggcccacacccuuaaaggaaauggacucccucccuuccagaagccaccaacugucaacagcucaucauccucagcuaggguggaggucuugugagccucucucaaugcuggauuguugacuagauucaaccacgggggcuuccaguccacaagugcccagaagacacuuccacucuggcccucccugaccuuugccucuuacauucuuucucuuccuccuccuccaaggucccuaaguucuggaagaagggacugugguauagagguuuuaaguguggcugcuugcucuauagacaugcauucucuguguuuuggccagguguucguuucuguacugccauucaugcacaaagaaucucugaugaggucucaaaguugugccaauccacaaauagagauaccaacuuagagggauagauacuauggccaucuagcacaguggguugugaccccuuugugggucaaucgaccuuucauggagguacauaccagauauccugcauauuggauauuuagguuauaauucauaacaguagcaaaauuacaguugugaagaagaaacaaagauaauuuuauacuuuggggucaccacaccaugaggaacuguauuacagggucacagcauuaggaaggcugagaagcacugcucuuguugaauagguaguaggcuagucccagggcuagccucuguuucuuaaaaguucuacuaccucaacaacgcugcuguaccaggaacacgguccugugagagaaacccucugaccacaucuucaccaugccagcagcugacaaucauaacaaugaugcugggaugugauccagugaaggggacugccugccaugugugaagcccugggcuccauucuccacaauaugguguggugaguagagguaacauggcaugugcguacgugcacacacauaaaagacaaauuaaugugauaugagaaacacaagaaacccaacucuagaacugcaaauaauaacucucauuuuuaggguacuuuacaaaccagauacuguacucaugccugaguggcuggaggauuuguggccucacacgcaugcaaaggucagaaacuuuauggggcugguuaucuccauuuuuaagaggcuuuaccaggauuggacauggguuucagauuugugcaacaaguaccuuuaucugcugagccaugugcauuuuaaaaauuuuauguugagccaugugcauuuuuaaaauuuuauguuuugugaauagguucuuacuauggcuguccuggaacuugcuuuauagccuaggcuggcuuggaacauaguauguaucccauacugcccucaaauaugcagcaaucguucuguaugguaaucugaaugggaacggccccccacagguucauguguuugaauguuaugucccagcugguggaacuguuugggaaggauuaggaauaagggguggucuuauuggaggagguauggugcuguucgcucucuuucuguccugugcuugcugaucagguaaacucucaggcugggccccagcaccaugccuggcugccuguugcuauguuccuuuccaugauggucguuucucacccucugaaacuuuaagcuucuacauccugauucuuucuuuuguaaauugccuuggguccugguguuuugucaccacaauagaaaaguuaaguaaccaagacucuuuccaacugcugggauuaggaguucaagucaccauucccugcugcagcacaugccuuuauuuuauuuuuuauuuuuuuaauuuugagacagggucuuacaacauggcuagggcuggcuuugaacucaccauggagcucaggcuauucuugaacuuauaaucuuccuaucuuuaccucccaaaugcuuggcuuacaggcucugcuuaagaucaugaacauugcaagucucuguccuguaaucuguaagaaugcagagaggucaucugcaaaagguuuauuuaaaagcacccgguguuaaaaaucagucaaguagaaaaugccuuuucgggggcuggugagauggcucaguggguuagagcacccgacugcucuuccgaaggugcagaguucaaaucccagcaaccacaugguggcucacaaccauccguaacgagaucugacccccucuucuggagugucugaagacagcuacaauguacuuacauauaauaaauaaauaaauuaaaaaaaaaaaaaaaaaaaaaaaaaaaagaaaaugccuuugcucuguggaaaccauauaugaacguugacugucggaaauaguaagaugucagcuccguguuguaaggaaaucuuguucuguuguccagccucuguagccaaggcugaccuugaacuccuccugaugcuccugcccgccuugugaugagaauagaggcaaaugccucugagcauggcucaggacauuuuaauauccauucucuuccagcaacucacuuccaacauccugucaguuauaaaguugaugugguuagaagauggcaaccccaucuucuauacaugcuucuaaaauucaggaauggacuuaagauuuucagcaaaucaagggccaauugauccuauuggcauucauagaaaacaggcaaugaacuuugcaacccaguaaguggccugcaacugggucuuucuuccaauuccuucaacguggugacuuuuccccagguuccuuccuugggcagcagaagagaggcuuuuugaccauaggggaauugguuuucucauuuauaaaauuaggcaaauacuucuagauuuaguugguuuuugugugugaaaauuaugaaauaaaucacacuugccaccuagcccagggcgaggaucucagugaucuacucgagaucauuauuacagugagagucauauggguagguagggcugucagauucagcaaauaaaaauacugaauaaugagcuaaaguugaauuuuaccuuccauccauaauuaaucaaucauaaaaacaaaaugaaaauaaggagcuggcucagcaguuaagagcacuugcugcucuuccagaacccacguucaauucccacugcuuaaaugacagcucacaacuguaacuccaauuccaggagaugcccucuucugucccccaugggcacuguacacguguuacacagacagugcagggaaaacaucuacacauauauaaaaaaaaaggggggggggaauuaacaauacaagauguucaucucucaaauucaaauuuauguaucuugcuuuuuuaucuugguaaagcaauuucucuuguaaagcuaccuacaaggaauauaacugaccaaauuugauauuccaucugcucauauuuggcaggcuaauaucccaagauaaucaguguuuacucuuccaggccaugcucaauuaucucggaacacagaaacaaagaggucccauauuguucgaguauaguauuuuugccaaauugaaauccguugaaacugacugccauacugacuaaacuagccaugaguuuucaaaguguuuacugaauuauauuuguauuuaaacccuuauuuagaaaaaccacagaacacuaaguauaaaagcuguauuuauggcuauuaaaaacacagagacugaaacucucagcuggccacuaacaucuuugaaaugucauuucauaacauuguuuucuauguauuagguaauuauuucuuaaagcaugcuuguuauacaugcacacacacaaaauaagcagauauauuuuuauauuuuaucccagauagaugauguaucuuucaucgguuugcauauauaaaaagcucauaguuaauccuaucaguauucuagcuacccuagugugcaguucagguuuugagguaaaauuauuuccauuccuuagcuuuuagccuuaccuauaaucuagagaagcauucuaggcuucuuguguaauauuuugguauuucuaaaaucagcuucaugucaaacucuacaaauugcuucugaaaauuuuuuugguguuauuagaccaaaaaaguaaccggaggcagagagaggugagugcaggccuuuaagucacagcacuccagaggcagaggcagcacucugugaucuggaaacuagccuggucugcagagugaguuccaaggcagccagggcaacacagagaaacccugucuuggaaaacaaacaaauaacuggagggcggaggauguaguucaguuggugacaugcuugucaugugcaugguccuugguucccuccucucccaauaacccuaaccccagaaaaacaacaguugaaaacaaacaaaaauccccuguaaaucaggcaugguagcacaugccugugaucucaguacccaggaagucgaggcaggaggacaagagugugggauacacaaugucaagucagcugaagcuacacagcaagauucugucacaaacaaaaccaaacuggauuuuggauagucauaaacguaugggugggcgugguuaaugaaauuauugcaaacaaaaugggauugcauuuauucauucauuauugcuauuuaacagagguuauuuaacaucucuuuuccggaaacaaaaacaaaaaaucaaaauaaccucaccuucuguucaaacuuccauuuugagucuuuuaaaaucccauuuaugguguuucagaauuucagaaugcagccugaauuccuggcuccgccuaggcguagcggccaccaguggcaaagaaaacaccagccgagugguucaggcaucuaucccuaacucuaacaaccuuaaccuuguacuccaucaaguauuguaguuaacaauuggagugaccgagccagaaaagaaaaaaaaaaaaaaaagcaaggcuuuagugagcggaaaucuugggaaaauauuuauauugauuucauugauaugcucgacugaaucuggagaaaaaguauacuguacuccauuugguuaacgauagcauauuuagaauaaaacugccaugacccucaggcaacccaaaagcagcuaguccacacuagacgcuacaaacgcugcccgaggcccugcagcaggugccguuuaaagacgucacagagccccaaggagaacgcgccacggcguauugcagaaggcuccggggccaaguaugugcuccaggcuuugaccacuaagucucaggcugggcuuccacuaagcccagccacggccugggcuuccaguggagagcgcuguagccuccuacgcccaccuuccucgggccaccacccugccggucagugugcccggcagacuuccgcccgcagccccgccgcgcuggcuuccucgcaccugggcgggggcuacaggggcaaguagcccggcuggggcguggcuuggcugggggcguggcucuggcgucaagggcggaccuuggagaugugggcguggcguguugucgggggcggggucauccgggcggcucugggccuuugggccgcgcccagccgggcgggaggcagcggccgcggugcgcgccagcggcgcggggauuggcugcggcgggcggagacgucaggcucccggggccccugcggccgcccggcgcggcgcggcgcagucggcucuaguggucucguaacgaagaguuguucccggccgugccguccuccgcuguugucgcugggcugcgccgccgccgucgccaggacgcgccgccgagccccucgucgccuccagccccgcggccuccguucaccucgacuuccacacgcccaucaugacgaagacugagaagaaauccuuccaccagagccuggccgaguggaagcuguucaucuacaacccgagcagcggagaguuucuggggcgcaccuccaagagcuggggugagcgcgcggcggggcgggcggcgcggcggacggccccauucauugcgggcggcccggcgguccggcuccgaggcugggcggccgcuuggccagcccgagcggggcacacgugcugccgguucccgccgcgagcggcgccggaagcgggaccggccggccgggccgggccuccuuuguagggcgcgcgcccuggaggcgcgggccgcgcggacuggggaagccggaccugccccucgccugccuggggagaggaaauuuccacugcccgcuaucuugugacucggcggcgcugccacccagacggccgggacagugcgggcgagcuccgggcguguguggguugcagggacgugugacggggaguuaaucacuggggcacauuguccgcgaaaaagcacuugaauuccgacugagaaaggccggcuccgagagggcuucuuccuccuccuccuucuccuccuccucggagaucacagcgcuuuucugccuugcagauuuugcuuuggggaaagacgguccuauuaaacacccccuccucccguaccuucaaaacauccgaguggugguugaauguuaacagauuuucucugugcgaacucauuguuuuaaaacgaaauagugaauccgaguugaucggucuucuggguuuugugcugcuuuuaaggugaggggucaaaaaaaauguuagugaagguggacaaguguauuccauuuauugccuuucuauuuagacaauuuuaccuuuuugaaauccuuuuuuaagaguauuuuguuaauggguaaggacagauuuuuuuuuuuccauucugaguaagaauggauuuuuagagcugagagccguuggggcauggcauuuuuaagagaagcauugaagaccauaagugagauauggcucacaaaaugacuuguucacugaagugagcuccucuagggugcaaggcucuuugacacucuaucacaagcugaaaggagccauggaagguuugggggguuuuguuuuguuuucuuaaauuccaaccucuaguucagaaaugaaacccagagguugugauucuuuguaaaauuacauauuccauggggccaagaaaagagcccagucuccuuuaaucccaguccagugguuguauuauuuuacguaugccuugccugacugcccaguaaucaugcacaauuuuuauuuaaauugcugucuuuucuugagagcucuguaugugcucaagaaauaaaucuuccaccgcgguuaaagggagaaggaugaagauaauugcuuguuuccagagagcacuuugaacugaagagauuuuugggugguggagagagguucauuuuuguaagcugccuuuugccuuucucucuugccuucucacuucuagaguccauuaucuuuacuucgacgguagggcuucuccugcaggaucuuccuguggccucgacugaccucugauuaacuaauuguugguggcccucuugccucagucacuuacaugaguggaccaucauggcagcuccaacagugcuguuuuaaccuuuguguuaggauauagguuuccuugguaauaugcauuuaagcagagaaccuguacaaagugggaguaaggauaaaguugagguuagccuaggaagaacuaagcaagaccucuuuauagaaucaguacuuauccuugugcucacauaguaaauuuugaguucauuauaguaauccuaaaccagugcagaagaucccaccccgcacagagacauuaagaaugugugugagaggaagacaaacuaaauccucagccuugaaggcugugucucuagacauguagggucugccauugagaggccgccuacaugcagacucaacaucaguuuggacaucuaugugccuguggggcguucugccgagacgggcgcuuuuuacuuaaaaucgucaaggcccuggaagaggcaacugccugacccaccgcuagcauuccaguaugucuuucugcaaucuguauaauguuucuuuuuuuaagcaagaaggaaucauagccauauaaguauguuacaaacaccaucccauguuaauaaaggucuauauccccauuauuauuaauaguuuacuugacuacugucccacugcauauauaccgcuuuccccuucauuauugugugcacuggcccuuuccuucaccuccucuuccuguguauauauacauuuucccaaauuuauuuccuugggaucuguuugcacuuguaggauagcuaggcagcauacagaccuuuuagaguucaaagcauguugucauggugccuugcuggagauuucucaguauauucccaccagcaaggcugugaugguguuuugccuucaacacugaagcuauacuuugugacugcuuuuauauuuucuggcuuuuuucucccuuggaaaaaaacucuuuagauggguagauauuuauuucuaguuguguccccacuccuccaacauaaauuuaauguugggugguaguaaagaguuacaacuuuuuuuuuuuuaaacuuuguaaaguugcucagucuguuuuguauaaaggccucccaagauucuauaaagauguccacauugucugguuuuauuauacuuaggucugcaguauguuccaucuugaucugagguguuucccuuauuuaagugcacuaaauacguuaaaucuuaguuuuugcuguaaacauuuuagagaauggaaauucugccugucacaucacauuacuguauugaaaacagcugucugaagcucucaaguagccucugccauauaguuugucuucauaguauagcacaauggguuacaguagucucagaaugccuacgugcaccuuauuuggcuucucuaacaguccuuaaguuaagcaagacagucagggauugaagcagaccuagaguuaguuucucaagaugaacaguaaacacaacaccagaaauagguaguugccauuucugacaaauaaacaaaaaauuuagugccugguggcuguuuuugcaaucauuaagccugugcauuaaauacaauuagagccaauguaaugagguuuggauaucaucuaguauuaagguaggcagugugccauguguuccaguuaaauuuuauugguuguuuugaguccagcugguuuuaaacucaaggucucccaccucugcuuccugagugcugagauuauaggcauucucuaccacaucuagcuuacaauuaacauuuaaaugauggcguuuaauagcaaaaaagugcgaggaagaauauuguuucuuauucuguauuuuguauguauagauaaaaaauagauuuacaucagcuaucaaauacuuuuccagcagagacuguacacaagauguaggugagaaaagucacugggugagcuagugaggugaacagaguuuuuuuuuuuuuuguaauuugugccacaguauggugucauugaagauaaacacuugggaaucuuuggagauuauuaucuuaucuaggaugucuauuggauagacaucauagauuaauauuaacauacaauucaagauucugauuucuaagcauaacuucuaauccauuucuaguagcugacugcaucuuguucaugugccucuucuuucauuguagguccauggagugccaguuugacggucacuugcuuccauucugggccaugcuuuagcaaaaugcucuuuccaggagaauuguuucugucucaugguaguuguguagguguagaggagaaggcaaauaugugguuaucauuccaguguuauguugcuuuuuaagaugguggguuuugcccaguaaguaggacaccugugaaacuuuacaaauaugagcgcuuuugaaaacguuucagacuugccuuaacuuaugugcagguuauaaguguaggacagugggggagggguggccccagagcagggcaugucacccagcaguaguaagacauaacuccuaaauuguccaggagacaguuuagaccuaaaggugaugauagggaaggauaucauaggaaccauucaauagucgauuauauguguucuaauauuguuaaagaaccucacucccaaaaugguuuguuagaguuuucuuuuuccccuucccccaggguugauuucugaaauuuuuaccagaauuaaaguuguacuaaagggugacuuuuuaaaauuugucuuuuuucccccauuuuaucuuauuuuuaaaagcuguuuauaggucaguguggcaacccacaucugcaguuccauuacuuggggaugcaauugcagaggcaggaggauaguaauccuuauaguaauaagugccaggccugccuaguuuacauuuugaguucauggacaguuagagcuacauaguaagacccugucaaaacaaaacagaggccuaaagaccuaccuacaauaacgacuuugccaugguuuaucauuacauguggugaaggacuaguuaaacacugauuguauuaaagaaaaacauuacauuuuuuuacauuugcuauuuaaaaaaaauuuagauuauguguauuuugucugcauauguguguguguauguauguguaugucugugaccuugugugugcuuauuagccuguguguaaauucugaauucuguguguaaauaucuaaacuauuguuagcugauuuucucauuuccauauuuaaggagaaugacauagugugucuuuucaaaccuuagcuaguauauuuuaauauauuaaguauucucaucuacuaccuuuuuucuuauuuuuuaaauuacaguugugugugcucauuuguucauucaugcgugccugugcgccugugcacagguagaagaauaagaaaacuuguuaauguugauucucuccuaccauugaucaaacucaggucaugaagcuugguggcaggugcuuuuuaaagacgguuuuacugugaagacuugaacuugguaguccuacugccuuagcuuccaaaguacuaggauuacaggcacgaaugaccgugucccgcuuuuuguuaaaguuaccaccuauguaguugaccuugugauagucacccuccucuggcucaucucucuccugucagcucuucagugcucccaguuguucucuccaaccccuccauuccauccugggcuggcuacuuagaugucagcuuugauagccuggucuccagaggcaaaaauaagcucuuuaaccucccagaccauguuaaguuccugugucucuccuaacacuguaguagccuuguguggccaucaccuaccucccagaacugucuuguacuugauaagcaagcacucuaccaauaccccgcaacuucuucacuggccuuugacccuuuauaugucauugcugcuagguagcuagaccaugugcugacuuccccccccccaccuccccccuuccagugccggagccccaauccagggcauugaguacuccuaugacggugcaccccuagcccugcuauaaaacuacuugauuauuuauuauuauuuuauuuuaucuuauuguuuuacauguugcuugaguuggguggguggguuugggugguggguguauacucgugcacaggccuaagugugugcucacuugugaaagucagaggacagcuggugaguugcuucuuucaccgaguggguucuggggauugaacucaauuugucaagcuugguggcaggcauaguuaccucugagauagcuguuggcuccuuguaaggauuuguuagagagagagacagacgagaacgaaagaacgagaacacgugcgagcacacauacaugcagaggcuaaaaguuggauuccccuggaguugggucaguugguugugaaccuaauguucugaauguuggauuguuuagaugucccaugguauaauuguacuaccaguguuuggacauuuuucucucuuauuucugcuguacugauggucuuuucuagaacuucaguucaguguuuuuaguuuuuuguuuuuguuuuuguuuuuuuuaaaaacaauaacaaaacaaccuuagagcugaggguauaauagcccagugcugagcuaugagacccagccagggguccgucucuaucagugggguaagaggcaacucuuaaaauuuuacuuaacucuuuguuguuuuugaggcaaggacucauagcucaagcuagucucaaaccuugaucuaucuaucuauacuucccaaaugccaggacuagagacauaaaucacaacuucacucuugaagggaagccuagcuaacuuugugacuuguguugaguugugugucugguuaaaaggaauagaaacaguuauuauccagggcucuugcuucucagcgucugcugacuuucacugacuuucauaagucucuuccaccccagguuaucuaccuggggguuuauuuaauggagcuuuguuuaaaaggugggagccuucucuagcuuccaugugcuuauuugaacuugaaaguuaguuaucagugaagcuaauuuaucacuagcucuuaauaucacccuguccucaguuuugaggaguuaugcaaacuccauguaccucuaacuuauaauuuuucaaauaauucuaguuuaagaagauaacugcuuuccaaugucugcccagugguagaaugccugccugguauuuuuauuaguguaccuggguuaacguucaucacuuagggugugagggaaaggacagaauccagcagcaaaaccagcugugaugcguguccaggaagagccaagcagucagcucccugccggcauugugaucuaaaucaccuuggccuuacugcuaccagaucaucuccucucugcagccucauugacugcuaccgucauugauuggccgccaccaccacgaggaagcucuagguagcauggcauuccagacuucucuauugaugcuauuuccagccuuauauccugugauuucuaccuuauucccuucccaucacaacaccccauguaguagccagcgugauguaucuggggcuccuggucggaauggccaguuuauuccuugccauguccauucucugcauacauucuccuuuauaacauuucuuuugugugucagaucugccacaaaccugaugcccucugaucagugaaaacaagaccacuuauuucuaauaauaucuaaacccguuuuuacacaugcauuuauguccauauagcaucuacuauguugucaggacuuuuuugagcaaauaaaguuucagcuugugauuuauuuaguccuugaggcaaaauugagaauauugaguuauuuguuuuagcuuuauacucuuaguuuuguggcauucauuguacuagaaggcauaauucagucugcuagauuacugugugugccacugaauucugcacugauuuugagguuuccagcaucauaauaaaggugaaccugugcacaggugugcuauuugaugucuuugagaaguuccccaagaugagcagacuggaacagaaugcagaccugaauuccagugucuaagcuuagauuucucuuuggaaagccucuuggccuuaguuuccccuauaaagggaaaggguauguaauuucagaugucacuuaggaaauuguccaaaugcauucagcuagaaagcagcaacccucgaaggaccaggugaauaguguaggcuuuguccaaguggaugauaguuauaugagcuucucaguuuuuuauuuacaaaagugaguuccaacuguugacacuagacagacauuaaagucggaggucauuguauagacugacuugggaauauugagaugugucaggcucaguaguguacaccuguaaauguagcaacugggagguggaagcaggagaauuagaaguuuaagaccauccuuuguuucacagcagaguuugaagccaaccugggcuacaugagacuaaagaagaccaggaaggaaaggggggaaaaaaaaauccugaacuggucugaauggcauguagacucuuuaacagaaauagcaacauuguuuacauacaguuuugcaaacacaguuaucuaucaguagaucuguugcuuccaucagcuucucugggcaaucacuauuagcuguguuagugcuuuuaaacaugugauacuugguguaucuauuuuggguagaagucaggcagcuucuuauaacagcacuucuccuauguguuuacccaagagaaaugaaaacauguucacagaaacacuuguagaagaaugugcauaguggaugcugcucuaaucuggaagcagcccagguguccaucaguaggagaauagacaaacacgugucugcacaguggaauacaacucggcuguaagaagaaauguauuacaagcauagaaaacaaggauguugcagagugugguggcacaugccuuugaccccagcaguuggcaguuugaagcuacccuggcauacauagggacuucagaccaaccacagcuacacugugagaacuuuuaauuaaacaaacaaaaacauaaaugucuuuaaucccagcaggcaggaggcagaggcaaguagaugucuaugugauaaaggccaacucaguuuacagauaaaguucugggauagccaaggcuacuacacauagaaaccuugucucaaaccacaaccaaaauaaaauucauaauuugguugggaaagaaagcuuaccugaagaaaguacauacuaaaugauuucauuuguauguuguaaaagugugcagaaugcgggcuggugagauggcucaguggguuagagcacccgacugcucuuccgaagguccagaguucaaaucccagcaaccacaugguggcucacaaccauccguaacgagaucugacucccucuucugguguaucugaagacagcuacaguguacuuacauauaauaaauaaauaaaucuuuaaaaaaaaaaaaaaaaaaaaaaaaaaaagugugcagaaugcaucuauaccagugggcauggaggucuaugggaaggcugucuccaguaggacuugggaucauauauauagaugcaugauuuuuuugucaaaucugaugaucuguuggaggcuuauguauuuucuugaauauaaacuuuguccucaacuuuagcuaguaggaugcugaauuguuugagggaagaaggacauugacaccuccuauuugaacuacauucaggaaccagacauaggacaguacauuugguaauacagacucuggguuucuggguguucucuguuaaauuucauucaauuugccugugcauuuguaaauaauguugauugaaaugucaucaccaguuguuuaaaggaauuucaguuuucccaccggccuguuauuuucuacuuuuauaugacuugauagagcuggaguuuugcuuauuuuuucccucuuuacuaugucuuuccuguguuucaaugcuaguauauguaaauuugguuaaauccuuugaauaaaauuccauaguguagagauuuuauagauugcuuuuucuuuucuuuuuucuuucuuucuuuuuuuuuugguuuuucgagacaggguuucucuguauagcccugguuguccuggaacucacuuuguagaccaggcuggccucgaacucagaaauccgccugccucugccucccgaguggugggauuaaaggcgugugccaccacauccggcagauugcuuuuucuauguuuuauuuaguauuuguguucugcaugugaagguuagaggauuccuuuauugaguugguucugaggauugaacucaguaagacuugcuuagcaaguguuuaacccacggagccacuugccagcccccagcuuguuuuuugugagccagucucucacugacuuggagcucaacaaguaaauaugaugaccaggugugagcuccaagguucugccuggcugccucucugcagaacugggauuucagacccccacggcuccugugacagacagccuuuauaugugugcuguaugcaugugagcauagaguccgcacuccugugaggcggggugcauuuggaagcuagagcagaaugcugggugucuuccucuguuacucagccccuuacugccuugagauggugccugugaugaacgagucgcucauguuuuggcuagguugacuggcuggcuaccggccagugagcuccgggugucugcuuaucucugccuccaaugcuggggucauaggcaagagcaacacccagcaagcuggaggcuugaacaacggauuaucaccugaugaacagcugauugauaaucaccugaugaacagcucuuaacugauugagcugccgcuuuauguuauugcuguacauuugauuuuucuuuuuuuagcuauuugcgcuuuucuuuuuuuaauauuuaaauucuacuuuuuaguuuaguguguguguuuucauucguugauuguuggaaauuaaauucagaguuucgugcauucaggguaagugcuguacuacugagcucuauccccacuggcucugaagaccaggugacagcacgggccggcuaccgugcccaccugcacacauuugcgcaucacgugggugucagugcucagcacugcugcuucucuucaguuucucauugaguguuuuggagacaggguuuccugugcagcucaggcuuuacuccuguguuccuaccccagaagucucaacuaaugucuauuuuauuuuuaaccuaagugcaaucuuguagcccaggcugucuggaacugaaaauaaccuaggaugacuuugaacuccuccugccuuuaccuccagaggcuuuugcugcuacgacuggcuucgugcugugcuaggagcugagcccugggcuucaugcugugcuaggagcugagcccugggcuucaugcgugcuaggcaggcacucuacaaauuaagcuguauuacauccccagucggauuuacucucccacugagaaccugacaguuguucaucuuacuuuucuuacucaguauguuuuuacguuuugcuuuguuuuguuucuaaucauuuuuaaugugugugugggggugggaauauacacgagugaaggugucaggacagaucccaggcaucagauacuccuggaacuggaguugcaagugguugugacugacuguugugggugcugggaacugagccugggcucucuggaagaguagugcaugcggaggcaucucuccagcuccacugaauacauuuagacuauagauuuuacuguggcuugugauuugacuacauaguuuugauuuucuauuauuucaguauucugcaguuuuuuguuuuguuuuguuuuuacauuuauuugugggaaagugcacguguaccauaacauacuuguggaagugagaggacuugauuuccuucuuccaccauacagguuuuagggauugaucuuagguggucaggcuugaugggaggcgccuuuuaacugcuggccuccccugccagcccuucuagguuuuguuuaaugauagugguauugaacuuagggcacauuaagcauaugcuuugccauagaguuauauucacagcccaguuuuucaaaauauguacuuuagccuaaugguuauuucaagagaccacuuuuuaaacuuuuauugauaguaccuaauucaauuuagaugaaaaguuuccuuguuuuguuuuuugcuuguuuuguuuuauuuuuuucuuuugaaacaggaucauuuguagccuuggguagccucaaacuuuguagccaaggauaacauugagcuucugccacagucccuuaaauacugggauuacagacuguuaugcuaccaugccuuuguuguuugguuugguuuggcuugguuugguuuggcuugguuugggguuuugguuuuuccagauagaguucucuguauaacaccccuggcuguccuggaagccacugcaccugacugguacuuaacuuuuuuuauauauauauuacuuuuuuuuuuuuuuuuaauuuuuuuucgaaacaggguuucucuguauagcccuggcuguccuggaacucacucuguagaccaggaacucagacaucuguagaccucaaacucagaaaaacgccugccucugucucccaagugcuggauuaaaagcgugcgccaccaccgccugccuggugauuuauuuauuauuauacguaagugcacuguagcugucuucagacucaucagaagagggcgacagaucucauuaugggugguugugagucaccaugugguugcugggauuugaacucaggggcuuuggaagagcagucagugcucuuaccugcugagccaucuugccagcccuuaacucuguuuuuuaauuagaauguuuaaaaauaguuuucuuugggguacaagagaugccaggguugaacccagggccucacaucugcugagcugaaguuuaucacugagcuacacucuuugucccuaggacugcaaaucaguaaaucaaaaugcuaaacaggauugaagguaugcucagcuagagagugcuuaccacaccacagggcccuugguuggaucuugaaugggggcaggaggugggagguggggaagacaccuuacuaaguauagaagcacauaugacccagcaguuggacuuggugaaaugaaacagugauacccaucauagcaugugggaacauucuagcuauuuuguagugguaguucaaaggucagugaaauguacaucguacaauagaauaauagccacagaaaagacugaaaugcucauagauguuuagauguauaugaaccuaaagucugaucuguagguaaguuuauauaagaauuuaugcgguagauuagugauugcaggggccuggaaugguagaggauagagaaaaaugaguauggagggggugggauauagaucuuguugaaaauaaaaugucuuaggguaaagauugcaugaaucuggucauacuagaaacaguuaaacuacauaguacauuugaauguaagcgguaaacuagauccugauaacauuuuugucuuaguuuuagauuuuuuucauuuuuccauuuuuguuguuuaaagucuaauagcuugcauaaaaccucacaaaucagugggucagcauucuaguagcugcccuacaauaacguaaacaagugaaaggagagggugggggauaggauaaugugacggguacauguaggaaacucagacuaaaagauuaaaauuuuugauacacuaaacauuuuaaacauaaugugaucuuuauaauuacuuuuaaaaaaacaaauuaaguauacaugccucugccuuuaaaacauuuuaaacuauaaacagaauguuuauuuaccaagaaaaguuucugggcccagaaucaugugaagaaaacuuucaugucagguuccuguggguaacuagaacauuuacaaagaugagucaaaccacaaggcucaaaaugugcuaagggcgugugcccaagucugcuuuuguuuuguuuuugucuuuuugcgggcuccauugcccagcccacuagaugcuggcaccacaggcaguguguauccaggguuugaagaagcuguauuuugauuucugacauaaaauguaaacucugggguuuucugggagauagucuuuguuaagcugaugaggaaauuaaguuagguuccuggcuucagagugagagggcugguucccugcguguauagggacuuguaguaaaggaacuguguguaaacaagagucccucauugagcagcuaggauucaaccaagccucacuaaaagaugaaacccuggauaaacuaagcggcuuaguggucuccagggaauggccugauagaaacacuguaucucuuccuguguuucuuuuaugacucaaaaucccaaguacagcucuccuaguucuguuggggcuuucgagugagggauggaagcugagggcugaggagaaaagugcuuccacauaguagaggcccagcugccuccuguggaugcauucugauggagcuccugaugccuguauccaccuaguggcgggacuaaauuuuacaguuagagcugacccugaguugcaggaccggacugucuuuucuguuuguuuguuuguuuguuuguuuguuuguuuguuucuuucuuucuuucuuucuuucuuucuuucuuucuuucuuucuuucuuucuuucuuuuucuuuugagacaggguuucucugucugucuuuucuguuucuuugcagauagagauaucuugcuucuuaguuauaggcaacacaugaacuagaccucaagugagccuuuuuuuuuuuuuuaaagaguagauguaguugauuaaguuaaacuugaaacuguguuugcuaugaggccucauugcaguuccauuccaaacauguuucuaguuuguuguuggcccucuucccucaggaguuuuguauuuaaucuuaucaauucagcagcugaaggcauccccugaguuugaaccugagacccacaugcuggacaagagacagacuucuagaaguuguucugccagucauagacaugacuugacacaugcacacaauaguaaauaagaauguaaaaacaaaucccuuggcuuucugauuuuuuuuuuucuuuucuguaaaauaaauacugauaacuucuuuuugugggauguggggugggaguggaggucagaacacuagugcaagaucaaaaguaggcaaagcaagaccuguguuuacagccaucuacccuugcucgcugguucucuccugcuugaccucugaccuagcucugucuuuucaucagaaugaagggaggggcaguuugaaaacuggacuucuccagaagaaaaggaaaaaucuagccugguagugaaguacuggccaguuaucucugaggccacucugggcucaauccccagugugacaggaaaauagaaaaagcaggggcgacucaguaccuacggaagaggggcacguuucuagcuguacauacaugaugacgagcagagaucacagaauagaaucagcagguauuagaagggaacauuugugggacugcuguauguagcaagaguggcuuuuacagagaaugcugcuuaguaauaagguuuaccccuccccccucucucuggcagguccugcuauuguaaccuugguuguccuagauagaacucuauggaguucagcuagccuccguucugugacuagcucccugcugcaguccuugugcugagaucacaggugugaguuaccaggccuggugucacaguucuucagaguuuuaaaacauguguguuucuagaaaaagaagcuaaggaaggcugugaaccaccuauguagguauugugacucaaaccuggaucuuuuuauaagaguaacaagugguuuuaacuacugagccguaucuguagccccauuucuucagaauuuuuaaguccauguuucuuuugguuguuguuuuuuguuggugauggugauuugugcuuuugagggaguguugugcuauguguucuggguaguguccacuugucauccugccucagucucaggugcugguguuacagaugugcaccuuuauggucaacaguguuaguuucuuccauuggauaaugacuuaaaaaucucugaaggauuuuaaaccagugaaugcuuaucuguaaugugauauaauaguuuauuauucccugcuauguuacaugaccaagcagguagcacucugcaaaggucccacacagugccuauuaacugauuuggaugcucuaaguagagcccccucuuuuaauuuuagcccaucuguagacuuaacucaaucacuaguuuaacuacgucuguccuaagacacgaagaguaaguuacaacuuacguuucugucuccugccguucucuucuucauagaagagagaaggugggguggguuguggagcaggguggggugguuggagggguagcggacuuuugggauagcauuugaacugcaaaugaagaaaauaucuaauaaaaaaauuaaaaaagagagagagaaggugguuacauugagagugucaggacccuugcugaguagucuuagaugauauuuauaagaggguaacuuuacuuuuuaaguucuggguuuggguuuugguaaauaagcacuaaaaauaacucauuuccuaguacaggguggggugggguaugcuuuaagacagagucucauguauccuggguugguucuaacuaccuugaguuagaagcaugaaccaccacacccaguguuuguggugcugagauggaacccccuaggaauuugugcauguuagacaagcacucugcugcugcgcuauauccccgacccuuauccuguguauauauuuuauuaaucuaacucucugugaaguuuuaacacuuacuuuuuauuguguaaugauucuuuagaaaguagauugggauaguuuguucauauuuguaaguuucauguacacuguuuuuccuggaaauuugaaaauguaagaacauuuugagaugauuuuuaagcacuuuucuugcagugccuucaguuucauacauacuccccaacaagcuugucuggcagaagccuguugcuuuugucaguauguguacuagaauacagacucuccuuaggcuaaguguuugacucuacaggugguuuuaggauuucaugcgaucaccugggucugaacaucacucugcugucucucuggaggccguggguucucuuuucccacugcagcacauggcacacccugggagauuggugguuguugguuuuuuguuuuguuuuguuuuguuuuuccuucucuuuuuucuuuuucugcagcaggaccgaaguggguagugggaaguaaugcuaccuggaggugacaucugucucuuuuccucuaucuccugguaacugggaaaagggugugaucuaguuucaauuguugguuagacuaucuuccuuuggaugauuccuggccugcagcugaaaauuuaucuaucuaagcuuuggguauaaucuguuuugggaucuuguucauugauaauuagaagaaaguuaugcaucaacuugggguguggguaaauauguucaaaauuuuuuuuuauugcagaaauuuauaccuccuuugaauuuguuucugugagaguccucuuaggaguccuggccugucucuauuaggucgggauuuagaugagaguaaagcuggaaagauguuaacucaguggaguugaauauuccuuaguauuuccuuagcauccccaucacuuauuaaaacauuuaaguauaaauaaaagacuucagcuauauucugagguauaauuuugaggauauucauuucugauguuagaaguuugaauguagaugaugagggaaaaaaguacugauuauuuuugguguucccaaaacaaaucguuggcuugggauagaccuaaguguuucccaguuaugggggagggauuaagucuggguguugaagccugccugucacuagugcuuugugccuggcugcagagcugugcccuggagcgcaaugcuugcuucucuuguccuuuuugcauguuugcaugagcccuucuacuuaaccaguguuuuaaaguuuuuauugcauaucaucuuuaugauuuuuuuuacuucugcacauuucuugguuauuuuuaaaucaacucacccuuuaaaaucuacauaucaagacuuuagucucaaaaaggcuaaaaaaacaaaaccacaacaacuuuaauguguauaaauugucugaaauacagguauaguggaggauguuuuuuuaacuugcuacuuaaagaaacauguaaguauguccagggaggcuuucccaccuaaaaucaucuuaguuuugaggguauaaaauucuucuugaaugaaauacuuccccaugugcuggauauuuaaagcucugacuuuagccgggcgugguggcgcacgccuuuaaucccagcacuugggaggcagaggcaggcggauuucugaguucgaggucagccuggucuacaaagugaguuccaggacagccagaacugcacagagaaucccugucucgaaaaaccaaaccaaccaaccaaccaacaaacaaacaaaagaguuuuuaaaaagcucugacuuugaaugggaguaugaaguagugaaaacuuugcuggaagaacaagaugaaaggaggauuggugggagcugccugccagaacaacccuuacuuacuuagguaaugugagggaacuuggcugugcauggcaaagcgugggcuccuagccuugcagugaauaguugguuugcucuuuaccaacagugagucuguguguaugucuacaucucacucuguucaucucuucugcaggucugaucuugcucuucuaccuaguuuuuuauggguucuuggcugcacucuucacauucacaaugugggccaugcuccagacucugaaugaugaaguuccgaaauaucgagaccagauuccuaguccagguaauuguguugaaguuaucauagcuuuuaaaacaacuuggguuacugcuugucuuuaccacagagcaguuuuauaucacagcagaugaagaaaguuaaacuuuagaguuggguaaugccaaugguuuauuucauauuuagauucaagaccuuuaaaucauuuacugguaaguuuuggguccuuugacaggaauaagcagaaaugaacauuggaaccguucuaaagagguggaaugguuuugugaaacugaagcacguuggcucugguuugaguuacaccguuagucuuauaaaauagauugccugugguuuuaauugguugguaugaaagugguaaaaauauugcaucauuagagaauaaaaucaauguguucucucuugucauuuuaaaaaaaaaucuguuauacuagagaauacacuuuuagcaaaaaaacucuuaccugaaauguugguacauuuuccacgcgugauuuuacuuucuuaaaacaaucugaaugccaacucugccucaggaggugaacauggucauggccucaugguacuggcagugcuuauuugguaacacuggaaaucagacccagggccccugcagugcuaauaagcaagugcuuuagcaccaagcuccauaccuagccugguccuggucucugcagcacacuaaauacuuauuaggaaaagugaaaaaagaauuccaaaaaguaagaaugauugugaggggugaguaccuggucuuggaggcauuuagagaguaaaaguaacacaagggauucccaaguguaagcaaguguuguagagacagcaagagagcagggaagcggcaaggagaaugagaggccggccggcagcuggggacauggaggcuguucccuagagcacuugggcuuuagccacgucugaggugucuuccagggaccaccugcaaaugucuggagucauuguuagcuauuagaacuugagagguacuguugccaguguaagccaacgaugcugcugagcaggacaggccuuccuucccacagaauuaaccgguuccaacucaccaugcugaggcuaaggaacccuagccuauauucugcucgaugcgcagacuucugagccacacugacuuucccgucacuuuuucacagaaccagucuaaucauuucuuuuuugauuuuucuuguuucuuuuguuuauaccuaauuauuccuuuuugcccucugccuauacuaauuuaaaguucauuuucuugucaucuaaguuauacaugacuuuguuuuuaucaaccguagucugaucuacuucagaaaugcuaagcugucuguaaaauaucuauguuuuagauauguuuuguauaagccaucuaaacaguaaaguguguucaaaacuaaguucuauauaaaauuguaguuuuauaguauaaauaaguaaauauauaaacauacauauguguauuacaaaguuuuuagcuaugagaaauguuugcauuaaaguugggagccagauucuucuauguagagaaguauauuugccuuuucuuugcucuguuacauggguaucaacuccugcuaugaaauuguuacugauuguaauuuaguugguauaucagaaacauauuugggugguggagcgaugcuuagugaagggaagguguuuaucauaggguucggaauggaaugaaacucuucaguugaacacaguugacuaucuuuucuauguuuccacacaguuguauuuuugagugaaaaagcgauuagaccgagcaggugggcuccugucugguggcuuuuacuuacagucuuaguauucugguaugcucaaguuuuuuggauuuuguuuuguugcuuaaucuguagcagcaagcauacagaaacaacaaaaccacaaccaaccaaccaaccaaacaaacaaaaauccccaaaccucuaaaauguuauugauaagaaccugaguuuagaaaguccaaguaagagccagagagauagcccagugauaagagaacucacugaguaaacacgaggacuugaguuuagauuccuaguauccacguaaaauaagccaagcagugccacuugggccuguaaguccagugaggagggcgaggcucgcugagcagccuccuuagcagaaaagccaccaguuccaaauucacuguguggcacacacagaauucagaguaaggagugaugguuauaauuaacugauaaucaucaaguuuggagacuguuucuaacuugauacugucuaaaaggucuuaaagauuugaguucuuuuaggugucuuuccaaauuggauccaaauagagaguuguugauaacugcaacaucugugaacacacggcccuuaaggaauaaaaguaaggggcgaggaggacuucuuacugucacuaacacucccugucugcuuuuaggacuuaugguuuuucccaaaccgcagacugccuuggaauauacauucagcaugucugagccacagacuuacaaaaaguugguugaagaccuggagaguuuccuaaagcguaagugugcaggccuagaagguggaggagagcuugugcuuacacagagcccagugccaugccaugccaugacugccuuuagaaguagcauuuuuagagucuguuuuaccuuuuuguuuuuccccuuucaagcacagacagcugggaagaucugcaaguaaacucaguuagauguaagaaugaagccaaaucugugucguauaaaacagugccucugaguaucagcacuuugcugggugcuggggauggggcaggauguccagugcucgaagguacucugccacgccugugccacagcucauuugggauuuuuuuuauauccaggauaguaccuaaguggggauggcauaguugccauuucugaaaguuggccuaugucauuuuuuaaauguauucgucuuuuuuaagagugaccaguauguagugcuuuuaauaagcauuguagccacguccuccuuguuguggcuggcauaaccauucauagaaaugaugcuaccagucaaaugagugcuaaaagcuucgguuuacugugaucaccuuguccccuucucaaucguauuauaccacgauuguucucuaaagaugccaaagccaccaaauaaacuuucccagcaccacggucugucugucugucugucugucugucugucuaucuugcuuauucagcuuucuucgaauauucugugcuaguggcucuugcuguuugcugaugguuuccuaaccaccucagccucguuccucaguauucuuccucaucuaguuuauuaacaugauuuuuuuacuuuuacaggacucuaaaauuccuugucuuuaagugugccaaauacuugugcagaacccugcucuggauaaaagcacauaguuccuggauuaggcuccuucuucucucccugcuuagagcagccacagggugaagacagaacuaggugguaguagaccccaccucgcucagugggcacgagccauugccuuccucuggugacucugaugguaugguugcuggccuuugcucaagccucugaccuuucuccuuccccuauaauucaccuucauauagcacaguaucuuccuucaaacacuaaaaggaaacugggcuguagcugagucaguagagugcuugccuagcaugagggcacuggggguuccaccuccuucucugcuaaaucuggccugaugccuccuuaaaaccucagcacuugggaaguggaggcaggaggaucaaaaguccaaauuauucaagaucaucuuaguuaaacaaugaauucaaggccgccuugggcaacaugagacccagucuucaagaaugaaugaaugaagaaaggaagagagagagagagagagagagagagagagagagagagagagagagagagaagagauaauagaaguccuuaguucauucauugcuaguaaacacccacacuagccaccauguugcuggucuuguuucuucaugugaggccacuugcacgucugcucuuuggcucugauccuucucugucucagaaacaucauccuuggucuacucccuuuauugaauucuugucaacuuagacacucuaauuucucucugucuugagaaaaauccuccugaucucucccacacugucuauaucuaucuucuuaaaucgcuuugccuuacuaguuaauguguuuauuaauuaaauaauuucaaacauuuuaugaacauauuuucuguguuuuaaaaaauauaaugguaagagccugcagugaaggcaguaguaauuuuucgcuguauuccuuuuagcugagcuguuguuugucaggguuauaggaguguaguugggccaggcacuugccaucuagcaauaaacaaaucugucuuacagaacuuuuagucuaguaauacguuaggagggaguugcugaggugagaaacacaguagagaaagggugggggagguuucucuauucuggaacucacucuauagaccaggcuagccucagaacucugccugccccugccucugagugcugggauuaaagguguguaccaucacugcccuggcugggcuguugguuuuuaaagggugcucugagaaugucuaaaaguuggugcgugagagggagaagggcgcugcauacacuagagcaggcuccuggagggggguacccaucagaccuccuuuccuuccugccccugaaugcccauagugcacuggcacaugcauuucucuccuuucuuccuuucugguuucuaaacauguuauuucuuuguuguuuaacuguaucuucuagucuccaucugccaacacacuguuugcagcuggcaucuucucugugcugcaccaggagucugugccacuuccuccaucucuuuauucuucucucuguagcauaaauguacuccuaacauacgugcagucacaugaccacuuugacugguauaaagucuuuuagugaguggaucaucauggugguuuuggcaacccuucuccucaguuccuaacacaguuuuuacaaaauguacaugguucagauucugcccccuuuauccuagcagccacuguagcucacacauccccucagcuuucaggucacuagagccccuugucauacccugcagcauucaacccaugcuguuuucccuacuagacugagcuccacaggacaggagccauagggcacgcuuuugcuguugucucugagguugggcacaugaaguguuuucaaauaguucuguaguuguggcuugcgccgggugcucuuggaagcaggaugccucaaagcucugcuaccaaguuauucucauugcuguuuuaucuuugaaaaauacuuguuuggugaaugcuuugacuuguuucuugcuggguuugguauccuuucuuggcugauguggugcacauuuguuuccuuuuuagcauauucuguggaagaacagaagaaccucacaaguuguccugauggagcgccuuuuauucagcaugguccugacuauagggcaugucaguuuccagucuccuugcuugaagaauguaguggugugacugaugcuaauuuuggcuauuccaaaggacagccuugcauccuugugaaaaugaacagaguacguacuugcuuucucucugcugcugcgugucugacaggcuguacaugcggugcugcugcuuuucuuugcugugcuuguggugaggccugccuuagugucaucucauuggggcaacuuaaaagacuagcagugcuacuuaaugcuaugacaaaaagauucauaguucagugguagacuauauauaaucuaaauaaugcuaacgcauauggugugauauguaaucaaguacugggaauagaaauaaaccuacauacuaaugagcacaguacaguguuguaguuauagccaaagcuaaugggauguuuuaacaagacauaacuaagaauuaagcccaaaaaaguaagccagaaggaauguggaacuugaucuaugcuuuaaagugagcucauauguucauuuuaaugggggaugucuucaguuacacuggccugcaaggucuguccucacuguaucugcuguaguugcugaaaauguacucuagucaaagggccaccuucuggguuuauuagaaaugggccuuuacaugaugggacagggauacuaugcuugcuuuauaggcaggcuuuggggguggagggcgggggugggauaagcccggaugaggacaggccagcgacagauucgacuggcaggguuuucaucugugggcaccuagagcuuuccacgggugggagacuaggggcugcuguacguaccacucugugggcuucagcucucuaccuguaggcaucuauagguuuaggcagccugacuuuugggggccucuccucuguacauccuggaaaccuggacccagaacugcaucuggauucaaaauguaaaacaacaacaagaagaaaaaaaacuuagaagacagggccagugguaagggaccuggccaccgccggagcugaguuugaucccaggacccacgugcuggaagaagagcaguuugucuuccauauuccacauaccucccccuaugcgcacgcacacgcacacgcacacgcacaugcacgcacacacgagaauaguuuuuaaguagacaggugaccacaaauaagauaguagauggaaaggcugagguuagagcucagauuuagugcuuuguuaccaccagaagaccacgagugugggggagaacaucauuuagaauucuucuuaauacuugacuagggggagagauagcugugaacguauuuucauaaugaauauuuuauuauagaugggaguggugaugcacagcugugaucccagcguuugagaggcuggacuguccccaaggcuagccugggcugugagcaggacccuagcacacauaaugguuuauuacauuauguaacugaaggguguguuguuuuaaauguggcaaguguggcugaguugaauauauagaguaguuauugaucucagcugcugugccccugauccccagcaacacauaagguugguuaauggagaagguuccauugcauucugugugcugacuuacccguguucuuaaccuuagauaaucgauuuaaucccagacggauauccacaaauaucguguuugccaaagguuaguauucaagucacucaaccuuucauguuucuuaaauacuuaaaauaucacuaggcuuucuagggugauccugucuuuccuaauagagaauugaaaaaggacauuuucuguuuguuuuguauacacuuuuuucauauacacugcauuucaucaauuuuaggauauauguuuuccauaguuuaguaaugaaguuagcauuacaaccccaggugucguccugauguauaucaggauuuuuuuauuuccaguguaaaauuaguugugcuuauuaucaguuucaccugagaaacuguuaaugaacuaugcuguuuuuccuuaauauacaggcauucuuccucuuuccucuccucucucccucagagugcuaugcauuucauccuauaguuucuguucgcuuugcaugcugaaaauagaauuaagagaaaugugcuaacaauggguaagacuuguaaagagacacaaucucuaacugugucauugugcuggauacuagcacuuacuuccagggugaugcagagugggcugccuaaaauguugccuugaacucuuuuuuuuugaagguauauuuauuuuauacaaaugaguacacuguaacuaucuucagacacaccagaagagggcaucagaucccauuacaaaugguugugagccaccaugugguugcugggaauugaacucaggaccucuggaagagcagucagugcucuuacccacugagccaucucuccagcccagcccagcccauaauuaaguuucuuacuuggcaguaacuucuuacuugggcugaaacuuuugcaaaugucacucuuuacaaucacuucaguuucuuguccccugcuccuauccuuucugccuuaauaggucuuugggaagguccagcauuugugcuccugugagcugcugcuuuggagcugccuuuucaauuguuagaguauuguccaguauuuagagugaugggaacagucuauagcuucucucccaggugggugugaacaugcgcacguucgaggcacuaccuccuugugcuacacucacuuuuccaagcaacaaaaauagaaaaccagaauuuuagcugagcaugguguugcacccgggaagaugaggcagaggauuaagauuuuggagcuaaccugagcuacauaguuaugauccuacuuuaagcaggguguggagguucuugccuuuaaucccaggacucgagugaucaaggcaggcaaaucaguuuggggcuagcauggucugcauaggacagccagaccuauauagugagaucuugucucaaaaaggagguugauuuuaaaauacaacuaaaugcaugucacauguaagcagauuuuguuguuuguuugauguuuguauuuauuucuuuauuuugguuuuucgagacaggguuucuguguagcccuggcuguccuggaacucacucuguagaccagacuggccuugaacucagaaauccgccugccucugccucccgagugcugggauuaaaggcgugcgcaccacugcccggcuuugauguuuguauuuauguuuguguguguacacuuguguaauagcacacgugugagguuagggacgagugauuuucuuuacuguacggguucuaggcgucaaacucuaguuuagucagucuaggcaacgagcagcuuuauccacugggccaucgcauuugcccaguagguggauguuucuugauaaauuauucuaaaaauccaguuaacauacacuuuucagcucuuaacaugaaaacauacuguuucuuguuaagucacauuagcaacauauuuaaaguaaaaauagguucagugaacaauuaauauauuaauguagcaaaacauucaucggugugacuuuuuuccuucauguuaaauguaagauuuuaaguguuuucugugcuagagauugagccguuugcacugccgcauagcacacaaugcuggagcaucccuuucaggguggccauucuuaacuguggccaucgauucugagguauuaucuacugcuuucccauaccauuucaucuggaucauuagagcuuggguuuucuugucuuuuguuguuacuguuauuauuugguugguuugcuauauggcgauaaaggucuauaauccaaucagaacuacauagccaagacagaacccaacagaacaacagcagaacugaacaguucauuggugugccugaugccuucucugucugccucuucugaguggcgauugcgucccacauacauggucucccagccaugacauaaagaaagcagagagcaaggagagcaagcugguuagucagugugauucugccuugucuucugugugcugggcuggaauccccagcacacacggaugucuguuaguucauccagguugaauaccugcccccagucccuuucuucccuauguuuagugaugcucaucaguuuggguuggcuucugaggauuuguguuugcugcagugcuagggauccacucagaguuccuaugcacugaaugugucuaugcagauauuuagugguuggcauagaguuuuggugcuuuuuuuacuccuguuuauucaugggaacuaugaauguuuuuucuguuuguugcauuacaguuuauccugauuacaguucuuaugguucugaagaguaaccucuaccuaccucugaguguggcugcugcuuucuugacuggugacuguggaagcacauugcuucacucaucuugggaaaaaaaccucagcccacacuuaacugcugguguauuuuugcuuucauuggucaaacagcuggcuuuguacagauagagggcaaauaggcagugguuccuaggcaguggaaccagcugugacugagaagagacuccuaggauguauccggaaauggaagaagaaccaggauagcuuauauaaacauuuaaucauguaauauuuauaauccagaugaacagccagguaugugcugaaaucccagcacuugggagacugauaugggcagauuaccauaguuaagacaaggcuggacuacacugugagaccuguuugaacagugacgacaaacauuucucagaaacacaguuguaauucaugaggcugaagaaucaucucagccucugcaguuucaucauaaucaauaacugucaguaauuguaacauucuugaaaaaucuuuaccuuggccuaaaaaggauuucuuuugcuuuuaacucuaggaagaaaacgcaacuauagcaacuuauccugaauuuggaguuuuagacuuaaaguauuuuccauauuaugggaaaaaacggcauguaaguauuuagggucgucucuuaugaaacugcguaucgagauagccuguguaugguaggugcacacugucuuuugccguuuguacaucgcccacaugguugaguuuauaccaaguggggcaggggauggagacuccgugaggacagcggagcaggugcucagcaggcuaacuggaugcuuauuuucagaacacuggcuuugcuuuuuggaaagcaguaaguacucuguuagauguaaaaacucauuauuuagauacaauaguauuuugugauuuuaaacuuuugaaguguauguguguauauggauauauguacauauauauacauauuuuauaaaauucugucauacuaaacuuucaaaaaaauuuucccaacucaaaaugacaagaguagaguauuuucugaaagcacauuaccacauacuauuaucuuuaccaucuauguauuuuuuuuuuuacuugugcguguaaacucgccccuaaugaugccuuuauucuaaagcuugcaauauucauuuccuagaaacaaggguacuaaugccuggugcgugugccaucagugggugguaacacuacgcuguccacuuaccuggucuacauucuugaaaucuauccaguugucccagcaguauccuucauagcacaauaagaagugucuuccaugugugcaaggccuugcugcggcagcucacagccuguggucuggaguaacucccccaccgcagcccccucucuuugguguucuuuacgcuuuagaaugagucugggacuuugggggacuuaacaggaguuuguauauauggcacaguuuuuuguucuuggaauuauuuuucucauaauuaauucauucauauuuuuggaggcgagugagcguauucuucucagaauucuguaggaagggcuuuacugacugauucuauugucuuguugaccguuaucuuuuaggauggucagccaagcuuccaugcuguaaaauuacauuuuguuguuguucaucaggaggacauaaacugugucuuagcuuuucugcaaagcuucagcauuuguucuugccagaaucaguugucaguagaccuguuccuugacugcauauauccucauuauccuauguaaaggguguguguuaaguggaauagucagagucaaaugugguaauauguaaccgagcccauagcaaauggacaucgugaacauauauggagcaguuagacauucuuaaguguaauacauuaaucaguauguuaggaucagaauacagcagugcuguaacuuuagggggggggggcuacacugcaggggcaguggaaacauuaaacaacugggaaagaaacagggaauugccacgaaucaguacauccagaggaugaggcaaguggcugagucaccaaaccagauaccccucaaagccgugcuaagggaggagccauagcaagaaggaaggugaagacuauaaaauaauaagcuaaguucaaagacuuaaucuuacacaguagaucaggugcuucggggcauguuuauuaacccugaccuuggaaggaagcuaaagccagagguuugagaaaugugagaucagccugggcuacaaauuaagacugcuucaaaaaaaggaaaguugaaacugacuuccugagugcaggcaaaguuaccaaagaauuggaacuaauguuuguucguccauuugcuagguuggauaucgacagccccuaguugccguacaggucaaauuugacucuggucuuaacaagaaagaaguaacaguugagugccauauugcuggaaccaggaaccuaaaaaacaagaaugagcgugacaaguucuugggacguguuucguucaaagucacagcacgagccuaggaauaggaugucuccacagaauucauguuguguugucgccauuuuguaucagcuggaccugccauucuaggauuaugaggccaccuuggaggaggaaguggugugguacacacuugggugacaucauaacaugcuuccagaucauaguguucaguguccucugaaguaacugccugcugccucugcugcccuugaacccauguacggucgccagacagggaccagugagcucccgaccccaaacaugcagagugggggcccugucuucuuuguguguaauugccaaacgucuaaagcuucaugugcugggcuguguacauauuuuauggauuuaacacugguaacugcauauuuugaugccaacaaaguuuuagggauacaaugguaccuugccaacaucgagugacuuuagcuggaagaaaugucugagaagcucuguaugugaggagggaaaaggaaaauaaaguggaucugaaaguagacucugcuucugcgcaugugugaguggugccuguccguaugcuccagacuguuucuuacaaggugaacuagaccauaucugauuuugcugagaggacaaacuuucuguuguaguacauauuuaaaaauacuauugggcugacuuugaguguuggaaucaagucuuccacauucggguaucuuagacacagggaugaaacagcauuuaaauuaggugaaugugcaccgauuuuuguuguuguuguuguuuuguuuuuugaaugaaugaaauucccaagauauaaauuguauaguuuuucaaacugucuuguuaagugcuuuuauuuaguagacuguggacccuaauaaaaacaaauugugaaauacaaaaacuucaaacugauuuaaaacuugga

SEQ ID NO: 5252 - RNA, 2551 nt, Mus musculus
uaguuuaaaugcuuguaugagucuuguuuuuauuuauucuucguaaugacccuacaagacaguugcccuccccaccucugccgcuccaucuugcagcuuagaaaacagaaucaaaagacauuaaagauugccugaggucacccuccuaaguuuccaacagaagaaugcauuuuauuuguuuucuuuuuaagggucucauguagcccaggcuuguuuuaaaauuuugauccucuggcuccugcuuuccaaaugccgaaaugcgccaccaugccugucugccuuguuaauacgcuucugggaaucaaaggcaagccuuaacacaugcuuuaacacacagcuacagcccaucccaacagaccuacaucaucuuccucuuccuucuuccuccuccuccuccuccuccucuucuucaacagcaacagcugccucggccuccgccacagcagcugcagcagcucugggccuuaaacccguguugcuagauauguguuuuacuauugaguuuuaucccugcucagccugagccuguauguuuaccucugacaucuucauaccucuaucaacauggaugcaguaguuuuucuccaguuccagguccuguuggcuguuauguuaauacacuucccugcaugguuccccccuuccucagccaccccccccccuuuaagacaggguuucucuguguggcccuagcuguucuagaacucacucuaucaaccagaguaggccuagaacucagacaucaaccagccccagccuccggagugcuaggauuaaaggugugcaccccguccccagggcuucucugcauccuauccaguaaauucuuuaugcucugcuugccuuuguucaccagguuggcuggccugguccaacccaacagagguucuggggacuuggaaucuagacccugagguauauucuaagacgaccuuucucucucuccaaggaaagucaugacgaacuguccccucaguuacacacaccuguaaccccaacaagaaggaggaucagaaguccaaggccagccuuguccacauagugaguuugaggccagccuaaacuacaugaaaccuuggguuagaaaacaaaaacaaacaaaccaaaaccacaaauaaacgaaugggccugucgucugugcaguccuugggcucuugguauaguggacacaagacccauuccgacugauuuuucaggacugaauuacauauugguccuaaagggcagaugaggaauuugaagggcccuccgggagguauuucccugaggagacuggagacagaggugcaugccaaacacccacauuccaucagucuccagcugaaaaaauuaauugccugcccuuuaugccauuugucuucggcaugugaacugcagucucagagugggaggggaggagagaacggcaggcagcuuagagcggggguucaaccacgcugaucucuuggcugcuccuuuaacuccuguggugacggaucggaucggagcauuagucucuggcaucaaaacagucucucgguccaugugaccagcacugccguugccgcacuguaaagcccacaagaaucggcagcccacagacccaucaguggaagcuuuguguuugcuucguguggguuugcugguggccuuuggcauagccacacguucaacaccugcuggagcaaaacaaaccaugcccagcauugcugucgcaucuuggccugucccuguccugagacuauggauuaggacacugacaaggucugcccacucccucaccgcucacacccgggaguacaaagucucugcguucaucaugcucaggggauugcuuagacccaccugucacuuacuggugaccuugaaggcggacagaccgggauucggaccccgauccuccaggaaccugacaucuauugccauugccuugacccaugggauaaagguggcaccagucccaguguggcccugcacagcagcgggcugugaccuuggcugagauaauagcggggacagggcaucuccauggaacaaggguuccuaucuuaacaguuuuuaaggccuacgcugcagguccuucaaugccaaggucacgagucaacggguagaaaucucgacaucucaucccuugaucuagagcaaugcccucguggggcuccuggcuggggacaggcaaggcggacagcguugccaucaagcggcaggucgagccagaagcuacccucagcucuucacaaagcagauccagucugcggccgcaauccaaacaccgaagggaaucagaacguacgucuuuuguuugccguggcaggagaacuguugagcagaggaaaaaacaagcugagcuuagcgcuaucagcugcuuccuggggcucgcuccuuccuuccuccgaggggggucuggccgcuuuguucucguucccagcugcacuucugcgccuuuaagcaguggccuccgcagaccucagaggaauguagcccugggaccccaggggacuuggcucagggcuccgcccgauacggccccaagcucucaacccgggugcuccugcccuugcuacguaucgcu

SEQ ID NO: 5253 - RNA, 92321 nt, Mus musculus
cggggcgagucagcccgaggccgaggcggggcuacagcgaggcucgauccggccuaggccucgcuccggcuccgccuugcccggcuacgcaggcgguagggcugggguaggggccgggcggcaccauggcggcggcagcgccugcugcggcggcuucucccgaggcgccggccgucucgggcagcgcagacccggagacgggagacgaggacagucgugagguccgagugcugcagagccugcgcggcaggaucuguaagcggggccggggcugaggggacccccggggcggcgcggagggugggcggcgggcacgcgcggggguggcggcaccggcggccgcccgggacuggugagacuggauggggguguguuggggggaggcgccgcgucgaccgacugcccggcgcgggucggggcucccccucggagcgagcggggugaggaccugcacgcgcggaccggaccggcgcggcgcgaggggcgcugccuggagcgcggccuggacgcgggagcccggggcgcggccgggggcgcgcggaguuuccggccucccuccgacgcaggccugcgggcggccgcggacgacgggagcggcccgaggugggagccccgugguaauuacaagggaggcgcggcuggaggagggagggaggccggcugcggcggggcggggccgggccgggccgggccgggcggcgggcugaggagggggugugagcucccuggggcuccucugccagugcgagguugaggcgggcgcuggggacugcgggagccgguggcgggggcuccggugggcgaggcugcgcgggcgagcggggcgcccggggagcucgggcgggacaccugugcccgccccaccuugccgcggcggggacuugaaucgagagccggcgugacugacggugacuuggggcaggauguaguggcuuccugugagcaggucucaaaacucagucauccaguccgcgcucaacccacuugauucucucccgugcauuugugagagccgcaccgaugaguguagacucuuacucagagacgggccaguucguuugucauugcuauccuuccucuuuaaaacgacccuuugauauuagaucgacuucccccagcuuauugagauggucccuuuucacuguaugacuggcgaaucaguagaguuuauuguuacuuuaguugaaaaccuuuuuuaauucagauuauuuuauccccagaaugaaaucggucuccuaaauaaugccuggcuauaagagauauuuuauauguugaaaauucaauuguguuagaauggcugauacugcucuuucuuuggcagaguauaaacuuuaauucuuaaaucucgaugcuucuuuuggauucucccacuugaguuuuugauguuacuccccuuucaaggauuuggaauuuuauuaaaaccccaggagcaagcauguuaaauguuacuuuucaauucccugacgucauccugggacucccaauucagacacuuuuaaguauuaaaacuugggaaauuacaccagagcaguggguguuuugugcgucuuaaguucccaguauuuuaaguuacuuucuuaggguguaaacuuuucacaaauuagcuuucuuacaguuaauauuugcauguauguaauguuugggaaaagccaaauacacuagaauuuucuuccccuacuaauuagguuuuucaaauuuuuacuacuuuauauuuuucugugacuugaugcuagacacuguugaagccuugcgaaucuauaaaagcagauuguguugugggaagacagugugcucuguuggaguugagauuuaggguugggcuguuuuuaggaguaaguuaccuucugcuuugaccugaugcauagcaaagguucugugaacagugugguaaaaauaucacuccaagugaaauucgggucugcagauuaaaacacacacacacacacacacacacaagcacacaaaacuugguuucuguggcuuaggcaaucucacucccagaaauugaccauuaauuuccugggaauauuuuuauuuuaacccuaguuaaacuaaaccacuuguuucuacccuagacaguuuauuuauuuuuuauugcucaucuuauagcucaggucauguugugacuguuucacaaggauacauacugaaaucaagaacaccccucccauuucuugcccuucuuuuagcugguaugaucaagguugguugcccuccggauccuuguaaggaaaugcccuucuguguuuccugaaacugacacgugggcuuuguaaggugaugagaaguggcggaaacauuagcaggugcugaagucacagaaaugggaugauggcaguuugacaaugaagaaucuaagcaguuugcgaguguugaagucaccaguccuuucuaccacacugagaaaccuuggggagaaccugguagcucccuguuagccuggagaugagcuguuaagcucagaacugcucuuugggagccucucaucugauccaccugagaggaagcacuccuggguaguguaguccgaaucauccuuaagaagagcgaggguggcccgauguuuauauuguggaaguucuagagguuagauaaugguccacacuuucuucaguguuucauuucuaacuuauuugugucccauagauuucacaagguauaaauaguaucaaguugacagaucagaaaaccagcggguggggagauggcucaguugguaaagugccugcuuagcaagcaggaucaccagagcccaaguagaaaggcaugggugggggaggaggggucaccgcgcuuuccucuaacccagcacuaguggaguguuuggacaggcagagccuugaaccucagggacuggguagcuugcuuggguagagcuucugguucauagagaaaccuugucucagaugauaaaggugagagagagagagagagagaucaaaacaccagauguuggucucaggcacccacacccaugggcaugcacaugcacacacagcuagugcacacagucaguacauuaacaaguacacacaccacacaaacacacacacacacacacacacacagagaccaucauauagcuguuuucacacaaccaguuuaaagaaaucuauuaucgcagacaguauuuuguguuauagacugauuaguacccaguuucuuagggcauuuuaguguccuagauauccugaggguuuugaauguucagcuuccuuaccugaauucacgacacaaaguuguuagauaucuuagaauuuucaucugaaccuuuaguaaacaaaauuaggaguauuuuuggucugaacuacuuugauauaaguagcauaccuaaagguaguuuguaugcaccccccuccauuauacccuauauucaggugaaaaaaaaguuuuagauuuauauguguguguguguguuuaugucugucugucugucuucaggcuugauauggccucguuuuugguuacccccuuuucuaauuaagucaacuguaaacauuuugaaaggcucuacacuaccuuacacagggcuuuucucucagggauaccagguuauaaaggcaccagccugcgaagauuugugggaaguguuugauauauuguucagugagaucugugagacagugauguggcccaagaacuacucacuuaggauuuugacauuuucagaccaagaaugacuuccggcuguuugacaaaggagauagauuaaguacuuaagcuuaggaggccugguguagucaguaccuucagccccagcccccuaaaaaaaaaucugggucagccaugggccaucucuuaggaaggaguuaaguaggagauaagccuuaucugaugcucuuguccagccugcacuaacguuuccugguguagacagcaaauuggaagcagaaagcccguguucugcuucauacuguguuagguaauauuccugugacuucaggcagcuguuuacucuugagcuugugguuguuuuuaucuuucucaucuuuagaguggacuagugcuuugucaccagacacuuggcucacguuguuuccucugccugagauugugucccccccuccccuuauuuaugucagagagccacauauccuuccaaugcaauccaagucuccucugaccagauuugcccuuguuucuagccauauggcuuugaugccuaaaaaaagaaaaacguaauucaugaccauuuucuucuuauaaaaaucauuuguauauguccccuguuauguuaauuuuagaauucauucuuguuuuuaauauuuguugcugcugguggugugugugucucagucucacuagaucagggcaggccuuuagaaaauacccuaucucucaguguuauagauacuuucagagcacuguguaucuggauaagaaagaauuuccauaucucuggacagauuagcaggguuagcuuuaguaaaggaaagcuuccugagucucucuggaaguucuuuauucuuuuucuugaaaaguuguaaugucugcuaaucuuagguuugaacugaggccaaacuugccuccuuaggaaaaggauuacauuuuuucuaaaugcuggcuuauuaauuagaauauuaauuguuuccugacuguguccauuaguuuuguuacuaauugguccccagagcuuggaaaagaaaauauuaaacucauacuuuaccuagaauuguuuuuauuugacaugacagguuuaaauguuuugguacuaagauguaaaucaagauguuuuauugacuacccaaggguugagaggaagagauuuaaaagggauuauucaugcuaauaauucauuauuaucagauguuugaaaugagaugaugaauacuuaguagaggaauuuaaaaggguuuacucaugcuaauaauucauuauugucagauguuugaaaugagaugaugaguucuuuaggacggaagaagaauccaucuuugagauggauagaaacagaggaaaaagggaccuuuguaaaaguucacagagcauucagcuaaucauuugcucugugcaggacaggaauaaaccucagggaguucauagaguuuuuguaacugagaacucuuugaauagcccuggacugacugggaaguaauguagcuagaauaaaaccaccauuuuuauccuuuaauuauaaacccuaauccuauuuccuuguuaacgugcuuugugaaauuauuugauaauaucagauucugugcuuuaccuacugauauauuuauacccuuuuauacccuaguaacaguuuuguuguauagucauguguuauuguuaaauuaggaacauuuuguguauguuaaauuuuuaugacaucuaguuuuguguaauguuuguuuuuugauuuuuuuuguuuuguuuuucgagacaggguuucucuguguagcccuggcuguccuggaacucacucuguagaccaggcuggccucaaacucagaacucgccugccucugccucccaagugcugggauuaaaggcgugcgccaccacgcccagcuuugugugauguuuuaaucaucaaaaaucucuagcuagauuggcuucauucucuuugugugugugugugugugugugugugugugugugugugugugcgcgcgcgcagguacauaugcauguguguauauguagaugccagaggaugaucucagacauuguccucaggaaacacuguccaccucucuuauggcuuggagcccuacuaauuagucuagacuggcuggccagcaaacuccauggaucccucugucucuaccaucucugugcuggguuacaugcaggacccuucacacccagcauuuuugccuaguuuccagggauuaaacucagguccucagguuugaggcaaccaaacaugacuuacugacugaucucucccccuagccccaaaauggcccauuauaagguuauaucaaauaugagccagguggugcugacauaggccuuuaaucccagcacuugggaggcagagacaggcagauaucugaguucaaggccagccuggucuacaaaccaaguucuaguacagcuaggguuacacagagaaacagagucuccauugccacccccaccaaaggaaagaagaaaacauuuuuauuauugagugugguuucuuuuucuuuuuuuucuuuuauuggguauuuucuuuucuuuuuuuuaaaaagauuuauuuauuauuuauaugaguacacuacagcugucuucaguacauuucagaaaagugcaucggaucccauuacagaugguugugagccaccaugugguugcugggaauugaacucaggaacucuggaagagcagucagugcucuuaaccacugagccaucucuccagcccaagccuucucuccagcccggguauuuucuuuauuuacauuucaauuguuacccuguuccucccccaaauguuaucauccccccucccucugcuucuaugaggguguucccccacccaccacuccugucuccccacccucgaauuccccugcacuggggcaucaagccuucacaggaccaagggccucuccucccacugaagacagagaaggccauccucugcuacauauguaacugaagccauagguccuccauguguacuccuugguugguaguuuagucccugggagcugggggggggggggauauuguucuuccuauggaguugcaaaccccuucaguucucucaguccuuucucuaacuccuccauuggggaccccaugcucaguccaaugguuggcuguauuugucaggcucuggcagagccucucaggagccugccauaucaggcuccugucagcaugccucuuggcuuccacaauagugucuggguuuggugacuguauaugggauggauccccagguggggcagucucuggauggccuuuccuucagucucugcuccacacuuugucucaguauuugcucccgugaguauuuucuucccuucuaagaaagaugaagcacccacacuuuggucuuccuucuucuugagcuucauguggucugugaauuguaucuuggguauucugagcuuuugggcuaauauccacuuaucagugagugcauagcauguguguucuuuugugauuggguuaacuuacuuaggaugauauuuucuagucccauccauuugccuacgaauuucaugaagucaugguuuuuagcugaguaauacuccauuguguaaauguaccacauuuucuguauccauuccucuguucuuuccagcuucuggcuauuauaaauaaggcugcuaugaacauagaggaucauguguccuuguuauacacuggagcaucuucuggguauaugcccaggaguaguagagccgaguccucagguaauacuauguccaauuuugugaggaaccaccagacugauuuccagagugguuguaccagcuuacaaucccacuaacaauggagaaguguuccucacauauguacagcuuuccucuuucuccacauccacaccagcagcugcugucaccugaguuucugaucuuagccauucuaacugguguaaggugaaaucucaggguuguuuugauuugcauuucccugaugacuaaggauguugaauauuucuuuagcugccauuuuagccauucgauauucucaguugagaauucuuuauuuagcucuguuccccauuuucuaauaggguuauuugguucucuggagucucacuucuugaguucuuuguauauauuggauauuagcccuccaugggauguaggguugguaaagaucuuuucccaaucuguugguugccauuuaguucuguugacuguauccuuugccuuacagaagcuucacaauuuuaugaggucccauuugucgauucuugaucuuagagcauaagccauugguguucuguucaggaaauuuuccccugugcccaugugagaucucagaagaagauggaaagaucuuucaugcucauggauuggcaggauuaauauaguauaaauggccaucuugcugaaagcaagcuacagauucaacgaaauccccaucaaaauuccaacucaauucuucauagaguuggaaagagcaauuugcaaguucauuuggauuaacaggacagugaaaacuauucucaacaguaaaagaacugggggaauaaccaucucugacuucaaacuguauuacagagcaauagugauaaaaacuguaugguacugguguacagagacaagcaggaagaucaaaugaauaaaauugaagacccagaaaugaacccacacaccuaugguuacuugaucuuugacaaaggagcuaaaacaaucuagugcaaaaaagacagcauuuucaacaaauggugcugucucaacuggaggucaucaugcaaaagaaugcaaauugauccauucauaucuccuuguacaaagcugaaguccaaguggaucaaggaccuccacauaaaaccagauacacugaaacuaauagaagagaaaguggggaagagccucgaacacuugagugugguuucuuauagugcuauuaaugauagacuaaccgugcauauugaggagccccuacuuuaccucaaaaaugaggacuugggugugucuuucagaagauaccccucaaauuauuuaauaguugcuuuacgaagugcaccauuugucuuaagauaauacaucagagcccuuugcuuuagacuugaguuuguuuaauauacuuguuuuguauuuaaugcaguacuuuuaagaaauucgccuaagauuuauuaagguuguuugaauccuaaacauuuuccagugggcaguaguuaauucaguaguuguauaugauacauaguugaguaucugauaggguauaucaaccccuggugcugagaaauaggucuaagcugugagugggaugagaaagucuuuacucagcguuuuacucugaaauuuauacuaagcaguagcguucauucauucucugcuuagagaguuagaaagcuuuagaacuggaaggaaaagaacacuguuguucuguucauguguacgugaagacuagaggacccaaguggcacacguuaaucacuuguuggacacuagugcacuguuuuuucuagagugcuguugauuuauuacuauggauguugaaaaugcacuagauuuaagcuaugaagacugcuuuaccuccccgaugguuuuuagagcggugcaguugagguuuguacccaugcucaucugcuccugcuaagaacuuagugaggugauuaggaccagcaaugccgugagcucuguggagauaaucuggauguuuacuguuugugucaaaucccaccuuaacuuuuugcaguccaucagugucucuugaauacuuaaaaacguuugauauccagacucuaaauaaaaucaucauuuugagggucuaccagcuuaguuuguaucuuuuuagagguaguuuaagcauaaacaaauaauugcuuguguauuguagcuuuuccacuucagagaaauagaagcaaaauaugcaguguucugcaucuuuuuaaauauaacuuaaagauguuuuuauauccucacuuaaaaauaauauaguauguauaauaccucaucucacaucaucuagauguauugcauuuuagguaaccagucaccuguugauugcaauuuaaguugucucuugucuuugcaauaacaaacauugccaccauaaauagcccuguuuaucauguauauguguaaggugugugugugaguguggaugugugcuacuagggagaaaauucagggucuuauuugcacucuaccaucaagccaagcuguaggccaugugugugugugucugugugugugucugugugugugugugugucuguaugugugucuguguguguguguguauguuuuuggaagcagaguuucucuguguaguucuaacugcccuaaaacucacucuguagaccuggcuggcuggccuugaacucagagauccaccugucucugccucccacgggcugagauuaccauugccuggcugcuacauguuauuuuaaaugugagcucuugcuaugcagcccauguugacccugaauuugggauaauauucuugacucuugcacuggcugagugugcugggauuacagcugugcaccaccaugucugggcuucauacagauuuuuaaauuaaagagguuaauagaaaaaugaaugcaaagacacuccacagaagaaaauaaauuaucuaguaaauauaugaaaaugcuggugaaauugaccagaaaugaaucagagaaauaaaaguauaaauaccucaacacuuaaaaaaauggaaaccuuguauauuucaguauugaaugaaugcuuaaggaaacagauacuguucguacuuucauugugauuuuacguuuauaaaaccauguuagagcauuugguaguaucuaauaaaaaccuagauguauuuuucuuaugcuuuuacuuuugccaucucauccugcagacacaaagauauuuuguguugaccuuguuuguuuuuuaaaaaggcacauugaaguucuaguaacaggaaacugguuaaagugguuuguucauaaauauauucuauagcaguuaaacagaauaaacuacaucuauauuaugaugaccccaagguguauuauugagugaaaaaaagcaaauuguuagaguaguauguauguuuauuaucugucauccaucuauccgucuguccaucuaucccuuuauucugucucuaugaugcccaaggaucaagccugggacaucacaaaugcuaauuaaauuuucuaucacugagcuacaagccagccccuuaauguaugcuuuuaaacucuuggaacaguggguuuuuccccccuauaaauuagauaaauuuuauuuaaaaaugucuagaaagauguauauugauuuuuuccccaaugaugggcaacaggaauuagucuucuguaaugacuugauuuucaauagggaguauaguauguauuugagauguuauuucaauuuucuauuuguacaaaugaauuugauagugucagauauugugagacucaauuuaacuuuugauugaauacuauauccaaaaucagacuuaguaacauuuuaagcauacauugaaaugaauaauaucaaauuuucuguuuucaauuucuacuuacuaguuuguauauaaauguauguaauugugugggaagguguguguguguguaugugugugcauguauaguggacuacuuguaggaguugauucucuucuuccagcuccaccaggucaucagcauuaacagcaagugccugcaccugcugaguuaucucaccagcccuccuuuuaugucuuuugggcaauuuuaacgaugccuauuuaaucaugaaugugugagugcaggugccuaugggagcuaggggaguuagaggugguucggaccacccuguauggaugccuggaacugaacucaggucuucuucaagagaaacauguguuagccccauaauuuuauuuugagguuaaagaaaaugaaacucagaaaaauucaauggauuccuauguacuuugccuguuugaccaguugcuuaugcuaagaagauugacuuuucgaaaaguuaauacuuuucaaaggaguguuauauaaagguccugaauaauuuugaaccuguguauuuggacagucuuauuuauauaaaaauugcucaguauauaaggggaaugaagcaguguuuacugaauauuugcugcuuucccgauauugggcuaggauacuuugcuucauuucguuacaggauugcuguucuuuaagaaggagcagcagagaggcucuuuagcaacaccagauuucagcaggcuuguugacaaggcucauguccguucccuacaccagguuuucugucuuguaguguacuggcaugaauucauuuuuguugucaagacauggugauuucucuaaauuaacaguggccuaaugaauagagauuaaagcuagauuguugucaaacacaguaaaaaugaguccagggauuuguaaaacuauucuuugguuuuccuaacccugcuuuuguugguuuuucucuucuaccuccucccucccucugccccucccucccucccucugccccucccucccucccucggucccucucucccuuccccuuccuuucuuccuuucuuucucuacuuccuuguuuuuugacaugaaaucucucucacuauguaguucuggcuggccucaaacccucagccuagugagagugcuagagcucaggugugugccacugaucucucuguucuuuaaugcacuuucuugcuuuugaguggucccccuaauauguacacaccuuuuauaaaugggaguuggguauguguaucuucuuugauaagaguuccauuaucaaagauaacacucacaucccauguaaggccugucuacaugccccgagacucucccagcaucagcuuuuagcuuuuugcuuggcauuucaggcucuuuagguugccuuaugagccuugcuaaguaucauggagcuguagggaccaauggccuagcucagcagagauuacaccauaaucucugauugcuuucucaccaugcacaggggccuuuagggaccuuuagggaccugcucgaagcugacaccagaagugagcaaggcagaccacaggaagaucuuccugcacuugguaacauacgucuauaaccuauggacauuuccuggcaauaccuugugaaacuagccuuuucacguacaguaguuuccuaacuucuuguucuagacuaagcuucagucagaggugaguagcaugaucacaauauagauaacuggaacaguuauuaugcauuaucuuugaucugaacgugguggcuugaauaagggaauuuuauauagaugcuaacuuuuaagaaccucuagcccagcaagaguacuaguucuuguuuugauuugcuaaguacuuacuuuguuuuagauauugugccaagugcuuuaccacaguuaauguucacaacaguccuaaguauuaccuccuuuacacaggaaguugaaacuaaggacauaacagauucuaaaguacaaagcuuauauugaaacucagaugucugucuuaaaaugcacucauuuaacuugcuguauugucaguacuacuuguuuuagaauucccuggugcagaaguugaaauuaaaauuaggagaacauuuugaagacuuuacuauauauuaucauaucauaccuaggguugucugauguauaguuagguagcauuuuaauuuuaucuaagcuuaucaaccugaguccguauuuucaaauauuuuaaaguuuuuuaaagauuuauuuuuuuaucgucaguguaugaaagcuuugucugcauguccguguuuacauguguaccucauagccucaaggaacaccauauccccuagacuuggaguuagggguuauugugagccaucauccggcuguuaggaaccaaacuuaguucucugcaguagcaacaaguacuuuaaacugcugagccaucucucuugcucccacaguauauuuuuaaguauguaugauccuucuuuguuuuuuguuguuagugugaauauauggugacguuuacauacugucauagcucucacuauguaaaagcuaaaagcuucuguuuagguugacaucucugaggacaucauguuuugugucacuugagccaguuuauaccagauucuaugaauucucucucuguaguuucucuucaguuuuuucuuucaucucuuuccuuuucauuaccucagucuaaguuagaacucuguagccuuccauuuuagguucucuguuggccuccauccuguauccuccuguucucccuuaaucccccugccuuaguuugugauauucacugcugccuugaagaugcuucuuguucccaccuccauuaccaaagaugacaucacaucccauguaaggccuguccgugugguaggccuucuauuggaacauugaucuucugguguuaauuucuguauuuuuuuuuuuuuuuuuuuuuuuuuuuuacaguuggaugaucuuuuuuuuuuuuuuuuuuuucuuguacaaagaaaauuuauuucucuauguuaacauuuuucuuaaaaugccuaggcuuacuuuucuuuuuuuuuuuuuuuuuucuccauuuuuuauuagguauuuagcucauuuacauuuccaaugcuauaccaaaagucccccuuacccacccacccccacuccccuacccacccacucccccccuuuggcccuggcuuuccccuguaccggggcacacaaagucugcguguccaaugggccucucuuuccagugauggccgccuaggccaucuuuugauacauaugcagcuagagucaagagcucagggguacugguuaguucauaauguuguucuaccuauaggguugaagaucccuuuagcuccuuggguacuuucucuagcuccuccauugggagcccugugauccauccauuagcugacugugagcauccacuucuguguaauuucuguauuuugaaaaaaaaaugcaccauugaaagauuuuaaguaaaauaacaugacauucuuuaaaaaucugcuauguguaacauauuaacuuauuaaguaagugguagcuuuuuauuaugguuuggcuugacuuuuuccugcuccaaauagucuuuauuauuauuauuauuauuauuauuauuauuauuauuauuacuuuguucaggacccugaccuauuaugauuuccucugaggcuugaucccuuuaggaucuauguuugguccuuuucuucuuuguuuuaaagguaugcuuugaaguagggcuggguuuaccaagucucuuucagacaaggauagucucagaacuacuauuuucgaaaaucuuuaagaauagaguggaaagauagauaaucaugcuauuggcuuuugacuaugauuuauucauugaugcucuugcugcugcagauuuacuuuauaaaaaggaacagaauugcuuaccuaauaggguuguuguacaaaucaaaggagacauuugagaaaauccuuaguugugggucauccagauauuuaagagauaguguauccaguacuaugcucaccuagcacauucuuaaacaacaauaaaacccacugauaaguauauauacagaaucuucccuaaaacaucuacauaaacacguguacacacacagguguacaaaccacacuuaucaaaguaagugugagcagcuuugauguaaguauucuagugccagguacaauuuauaugguagacuaggaagauggcucaguugguaaaauguuugcugcaaaaucaugagaaucuuaguuugauuccugcaacucacauaaaaaaaaaaaaaacccaaauaugaugagaugcacuuguaauucucucuugggggagaugggacaggaggacuccugggacuuguggguuaguuaaucuaggcaaacuuguuagcuccagguucagugggaggcucuguucccuaaaaauuuacaugauaggcucuaaacagaagcaugcccgcauggaguuacuguauaaucuacacagagaggacaagcaucaagacaaauaacgucggggcuggaguggaggcuaagcaguuuuaugagcauauauacuccucuuagaggggaugugaguuuaaaauucucuuagagaggaugugaguuuuuaaauuaauuuaauauaaaaacugauaauagcugagaauggugauaacccagcacuugggaagaagagguaggagggggaagagugcaggguuaucucugucuguccaaggccaacguggaagcucugucucaacaaaaaagggaaaaauugugugugugugugugugugugugugugugugugugaugaagaaaagcuauaucuuauuggucagcuaaaacugcugucauauaaugugaagguguuuuggccaacuuacacugcaucuaugaaagaagaaauaucuaaugaagaguuuauuuuguucaucucugaaaauuugugguuucauaaaagggacaaugggugccccguggauuucuucuuuuuuguuuguuuguuuguuuugguuuugggguuuuuuguuuguuuguuuguuugguuugguuuuucgagacaggguuucucuguauaccccuggcuguccuggaacucacucuguagaccaccaggcuggccucgaacucagagauccaccugccucugccucccaagugcuaggauuaaaggcgugagccacuacgcccggcggauuucuucuuaauacauacgaaaccuguaacugguacugcuugcuaccagaaacuaccaaaacucaguguccuucuguuuuccaguuuucuagugaaugacucugauuaguggaacuuaaauuaguagaacuuagaaacauaaacauagcggcaagauagguuaggagaauuucuagcuuuagagucuccauaauaccagaaagcacacaaguaaugcuguaccgcuaacucaccauaucuuguaugaguauaaaguugauucuucuuaagaauagaacucaguaugcagacuggaguugccuugaacucagagauccauucacaaaacuuccugagugcuaggauuaaaggugugugccaccaugcauggagagucuuuuuauuuuauaauggcauguuuuaaaaauaccuaacaguggccuuccucugaugaauuaaauagucuauuccaaguuuccucccauuuaaauaugcucuguagauaaaagccuaaaugagggguaaaacaaagaccguuuagcaggagcugccaaacagaggguggguuagugcuaagauacuagagaguggccacauacucugguauugacaggcaguaauucgauucggaagugcuuaguguuacuaguguucguaaagguucuaggcaaaggaaggucugaagcuaauuguagaaggcuaggguaugagugaaagaggaggguuagaggaugggugauuuugacucagucaugugaguuauagccuaaacuugccuggaagugguaggaccaucugugggaaaaugcaggcuucaaaugugcuucacuuuguacuuuauguacuugaugguggagggugcgcuggcaacaccuucuucugcuuagagaugcagagaggcggcagugcuuucguucgaaccaucgccuagggugcuuuaucagugagcaguaaucucuacuguaguuuggaauuacaguuuaaaacuccucauaacugauaaacauuacugugauuauuuuggagaacuggguuugaugggaugaauuuucaaaacagcuuauuugaaugucaaccagugguaaauagugaaaaaaaaaaaaaaacaucaggaaaacuacuuuuauaaaaaguggugcugggugcauuucuuacacuaucugagacuuggccuuugauuauuuuaaguaaauaucuggcaauucaguuucauuaaauucuacagacaaaguaacccuuguuucucucuuguggggugggacugguagauuauuuacacauuaugccccauuauuuucuaaccagugcuuagcaugaauaaaacagggacacguccuaggguaaugauuuaauuuucuaaacucucuuuuacauauggagcguauuuauuguagucauauguguauguauguauauauauauauauauauauauauauauguauguauguauguauguauguaacuaggugguguauuauggacucuauaaacuuugguuuuaaaacaaauccauuguguuauucagaggcaaaggaaauucugaagaaguuugacagcagugaaaauagaauuguuaagcaagguccuauguagggagagaggagggacaggggagagaaccucaaacucacagggauccuccugccucugacuccaguggcugguaucacaggcaugaccaccauuccagccaguucauuuuguuuuugaaaugugguuucucucucccuguuuguuuuguuuuguuguuuuguuuucccuuaagauaguuucucugaauagcuuugguugucuuggaacucacucuguagaccagccuggccucagucucacagagaucuaccugucuuugucuccugagugcugggauuaaaggcauguaccacuacuaccuggcugcagguuuuaucuuguugacgccagagcuucugggugggucuccugugucaccucccaucgucuuacuguagaaacacuggaaacauuaugugcacuccagcuuccagcuagucaggauugcacacaaauguucccacccacuuaggcuucuuacuggccccuuccucacugucuuagauuuguacauugguaugggauuucaguauacacaucaaguagacacuugggugucguccuuuugguacacaaauagcucaugagaccuucaaagcuugacuugcuggguucuuuauuccuucaacaaacauaucaccagaguuuuccuguuuuagaucuugggcauuagcaaguucucagaccuuguacaggagcugcagaaacccuuaacagaaguucagcccauuacaaauucucucaaggaaaccaaaccuaagacuaauuagggaaaaggucaagugucauuugaggucaggacugaaugauaagaaugucccagccguguaaagaguagagagauccgggaagaaauaaacuugauaauaaacuugacauggcugaugaauggagaaaagugaaccaagggaagaacaaaagaaggagucagaagggauacuuagggucaugcagagugugauuuagagauuagacuuuauucucagacaagugggaugagcugagaagugacugaguucaaucuuaugagaagaucaugcuuggucuggauuauggcucagcaauagagcauucgucuacucugcauucaugcagacggcuugggucugauccccagcaugggaaaggagagaaaagaucacaucuccuggugaagaacagguuggugaagaguagcagaaacagaagauacugccaugcuccucugcagugauccuguuugggugauucuagugaaggggagacguagcuggguuuuagauguugucuuuuugaagaucuucuggaugugcuaaugagcuggauugugugagggagaggcaggaagacgauaagugagaaggaaguggugguagaccaagggaagagcuuauagaagaggaaauaagauugguuuuggggacuugcuaaauaugagauaccugccagauaucuagugguaugaaugagggaaggucaggccugcaaacacagaacugggagcuccuagcauuaacaguguguacugcaguaguuuauagaaaaaggaagggauggucuagaacagagcccugaggcaguuacagcauuucgaugaggagaugaguggaagacauaggagaaaggccagaaaccgugugcuguggaauccaggaacagggagcuuguuacauguccacucuguuagaugcugcaaagguguggauguaguaagaauacauuggacaugggugagccaacauccuuugacauugguggccuugacuaagcaguuucauugucacuuuggaaccggaagcugauuagagaggaucacagcgugaaugggaagugagcaagugaggggcaguacuuagaagaaauucuccuuugacagaggagucuggaaguggagguguggcacgggagagaagccggaccgaggauaacggucugcugcuuuuguuugucuuaauuguggaguguuguuuauaugcugcugagagcaaacgguagaagggaaauuaaugcugacucaggagagauucauugcaggaaaauucuugagaugguucuggugagacaggagggagagaaacugcccuuucauagaggaaggaugcagugaugugucuauacauagcuccucuggucuuuuuacuuuuaaacacuuagguuuuuucuuguaauaaaaaauacucauuuuuauagacuucucaggaaaguucaccaccuuuuagcucaucccccagucuucacuagucuccuuuagacccccugaccucucugagcacaaguugcuuuuuuucccuguacuccauauuaugccuucuuccagacugaauucauuuauaagcuuugggugauguaaauaaaaaauuuaacaucaauuuaaacuuuugugucaacagaugaagcaaaaaauuuauugccauaucuuggacccaacaaaaugcgcgauuguuucugcacuauaaauuuggaccaggaagaaguuuaucgcacccagguuguugaaaagucuuuaagguugguagaaaaauuagaaauuauucauuugauguauauucaugguuuuauguauuuuccagauuuuuaucaacaaauugaguuucuugauauugaagcuaauauuuuuuauuuaaagguuuuguauucuauuaugaauuuauuuuuuagauuuauagaauguaagcauuuaaagaggccuugaaugucaguaagcugcacugacaacauugaucuccuuagcaguaguucugggaaguggucauggggcaucuacuucauaaugguucagucaccaagaaguucacaccuccuaaguaggcugcuuggucuuugaacucuucugacucagaaagugcuuauguuuaauugguuagugauuauuaaagugacauccagucacgugcccagcgcuugcucaguucuggguucuguucacucaugucucuaagagugaccccagugaagugcuugcucucucauguggccuuucauugccuuaggaaguaguuuuucuuaguuguccuagcucugucccuuagauuucuggggaacaauuuuaguccaucuuuuaugugacagcauuaaauguuugaaaacaacuauuauaagcguucaaugugcucucuaggcuaaauagugccuauuuguuugagcuuuccucaaagcacaucauuuuuacuucuccagagaacauauuagcucaaaguucacacaaguugaagcuagagaggucgauggcuuucuugguaaaguacuugcugcacaaauaggaggucaaguguuacauccccaguaccuauguaagaaagccagguacaguggcucccauauaguucccagugcuggggacauggagggaggagggucccaggaaccugcuggccagccaguguagacaaaccguuuaacaagaguccugucucaaagaauaagguagaaaaugauugagaaaggugauggauguuaaccucugggcuacacaaacacacccuuucuccgcaucugcauagauacaaguuacuuacuaauggauuaucagggaauaagcucuuggauuguuuuuaucugugaaaguguaauuauucuuugaaaguacugcauacagcaaauucuuugccuccucugccuuguagcaguguuuguguuuguaauuuugauauagaacugugcuaaaaccaggugucaugauacaggcuuuaaaucccagcauuugugaggcagagcuggucaggucucugcugagguugaggccagacugguucacauagcaagucccaggccagucgggcuacauaaggagagucuaucuuuaaaaaaaaaaagaaccgaaccaaaccaaaccaaaccaccaccaaacugcugaaagaaagucuucagagacaaagcauggaggauucugggacuuguugggacaagcauggugaaugaaacaguugucgaacuguauuuuaucccauuggauucuggaggaugcuaugguaccuuguuacccucucccacacacuugccuguguuuuccugugacauuugccugugucucuuuccuguucuuucuuugucuuuucuccucugcccuuccuucccuuuuccuuuccucuucucuaugcggggucuagccuuguagcccagguuggcauugaacucuuacuccuacuucagccucacauauuggugguguaggcaggccccucugcauagcucuuugucauuggguucuuacaauuuugaucucuucauaagaaaacuauauagaacuaaaaguaacccuuguaguggcuccgucagugggugaaggaaccagcugucaagcuugaaacuugaggucaguacccagagcccacaugguggaaagagaggaccaacucccacagguugcucucugacuucacaugagcgcccuccucaaaaaaugagaauaguacauaauuaaaaacaaaacaaacaacuaaaggugccuuaguagcccaaaaauauugagaguaaugaauuucaaagauuuugucacaagccuuaugcccauauuuagaaucuuaauuauuuuucacacuugugcauucagagucacagauggccuuuuucuuuguuuaugaaugaugaaaugucacgggaaggcugcaugaugugucauauaaugaaggaagguaaaagcacagcugggauuugagaccugaaaauauuuaaauuucaguuuguuacaauuuuauaucacaagguaaucagugauuacaaaauucaauaguaauuuuguaaauugaguccauaaauugaguacuuauaguuuguaauaucuagccauauaugagaaaauaacccuuaaccuuucugaacguuuguauaguggaaaaaugaugaaaccaguuuucuuuauuucuuuccaccuuuaaaaagaaaaucauuugaaagauaauuucaagcuagcugugucacugccuuagaucguaaggguauagcuagcuaaacuagauaauucuugcauucugaaugccuccaaucuuacuuucuagaauagggcaaaaauaauccuucuucaacuugauuuuauuauaacguucuuaauacuugucuaaauuuugaucaaccauuaaauuggaaguaucuacauuguaggucuuucuaacuuuuuccaccuuuggaauuuuuucuucaguuuuuauaacucugaauuauaaaacaggaaauacuuuagaauuguaaaaagauuuaagagauuuugcuucuaaauaucucuaaaucagagcaagugcuuaauaauuaaggauuuuaaauuuuaagaagauucagauauuucauaaaggaagauauacaaguaucuccaagacacauggaaagagauccaguuccaugagccaccaggaaaauacaguuuaaaaccauuuuugucacuauuaggacauaaucuguaaugauagaacuuuccccaguugacuggcugucugaagggugauugcagaggguacagggaaauuucugggggauaggugauagguuuuauguuuaauucuuucucugaaaauuccauacguaaauguuuuguuuguaacucguacccacuccguuacccucccucaucugauucccaugcacacucucugaauuccuucuagcaagcucuccugcucucauguguuuguggguauguaugggacccacugaguuuaauuagggcugcuugcauacggguagguggagcaugaugcacuggggcaugggcaacaaacaaauggcuacaccacugaggaaaaugauuuccccuuuccaguagccacuaacuuccccagccaugauaggucagucagugaagugcuugucgugaaagcauugagaacuucaguuuggacaguuagcacucauguagagagccagacauuagugguguaaucccagagcugagguguggagcuaagaagauccuugggacuugcuggccaguccauauagccacguacaucagugguucagcuagaaacccugugguuugguuugguuugguuugguuuuuuaaaauaagguaaagauagaugaaggaagaugcuuaauauccacuucugaucucuauacugaugcacacaugggaguaugcacacccacacacaggucacacaggugcacacacaggugcacacaagucaaaucacugagacugaaaaauuagcucagucuuguuagacaagcaugaagaccugaguuugguuccucggcacacauaaaacuguauugcaguuguuugaaaugagcugggcuuauaugaacaggaaggucccuggaacuagguagccagcaguguggccagacagggacuuucagauucagggaaagacccuguaucaaaaaauuaggugaugacacucaacuaggugauugaccucuggccuuuauacucaaaacagucacacuuguacacauauguauacauauacaaagaaaucauaucacugggcuaagaauauaacucaguaaaagagcacuaguguuauaaaaguuaaaauguauacaguauuuagcuuaaucagaauggggggagauguaaaagaauuuuaauccagcaucaugccuguucuggcaagggaucacauccaaagccuucuaggacucugugaucuggcuggaguacaggcucacccuuagcacacaacuuuaauccuaaacaacgaagguaaaguuaauuuguagaaggaagcagccgugaggggcagacaaaaugacaagucagagaaagauuugacagaaugagucagugauggcauaugcucagcucucacaacaugagaaagagaggugacuuaagagagcagcauagagggguggggagaauuuuaccaagguagguugcagauaaaagacagagaauaagaaggagccagaagauuagaacagauugccagaguuaguuugaggccaagcagagcaauucagucagaugcuaagaggagccagugugaaucagucagcuuggagaggaguuugguucagaacagcugaguugaaccagccagccagaguugaaagagcugaacagaugagauuauucaauaguaagccucugaaacaacaacuguaucuggcaaauaaaagauacauuuacauacuugcauagcauacacaagcucccuggcucaaaccucuggaacccacccccacugcucagcuaucuaaggugcuaacaguauucuauauuuugauugagguagaagcuacacagguuuguaauuuuaucaaagaccaccagccucuauagaucagauuugauauuauauaauucaaaauuaacuccggaaagauaauaaaaaugcuuaauggucuauuucuaauauaauuaaauauuuuauauagcauuauucauuuuagauauucaguauuauacagcuguugccgguuauaucuuucuaagauaauaauacgaauggcuuugucuugacucucauucaugucagcuuugggugagcauggcuaggcagguacuaacucuucuguucacaggaccuucugcaaagcuguauguuuagaauucauuuggcaccuaaagucuccucaguucaccucgauuuguauagaauuuguuugaaauucucaagaauuuuaguuuauaauuucauggauguuuguugaaaguaaaauuugaaugugauuuuauuauugguaccauuuuaauagugauaauaaauauauauuauuuaauauaaugagauuucucuuuucucucuaguccauauuucagugaagaauuuuauuuugagauuccaagaacuuuccaguauuugucuuuuuauguuuaugauaaaaauguuuuacaaagagaucuucguauagguagguacuauucauaauuauuuauaauuacaacauuaguauuauguucauucuuucuguaagucuuugauaucugcuuauuaaaguaaaacccaucaggcauagacguucacaccaagagacuggcagaagguugcugucuguccguccaucucaggcucucuauugugacauagaguugcuguccaucucaggcucucugaguuacagagucagacuucccaucuagagaaaaagaaaaccaaacaaauauuuuuauuaaaaagcaaauacuaauuuuaagaaaaacgauuuguaguuaaaaacaaaccuauagggcauaagcagauaauuuacuucugaaauguuauacccggggucuggguuguccuuugggaagaugaagaugucagguguauuuccugugaucugaaacauauaguaggaaagacucguuccugugcggcuuuuaggccaugcuugguuaaauagucuuaaguugaggcaagguggaaguugagucacugcuuguaacugcaccgaugugauuuuuagaaugugggcaugaauugcucaaaggaauaagcauccacauaaauauuuuaaaacccucccuuuuaagguugaggacuugucuuguuuucccuucauuucucagcuuaaaauucaauuuaaaagcccugaaguacaucuuucuagugucacuuucuacaauucuaacugucacacaaagauuuuuuaucuuuguauuagauuucacucaaaauauuuaaaagaaaacagauucauagguuuaaagauuuuuguguuuugaauuuuguguguuaauagacugauuggauuuucagucucuugaggacuauugcugcaguugccauucuacuacaaaucugguuccguacuuuaauguuuguucuuuaaauuauacaucugaaaagccaggcgugguggcgcacgccuuuaaucccagcccuugggaggcagagacagguggauuucugaauucgaggccagccuagucuacagagugaguuccaggacagcuagggcuacacagagaaacccugucucagguauugaguuuuaaguuauaaagagcuaaacauaaaacuguaauauguuuuuaaaaguuuaaguaacaacuuuauuaagguauaaguuauauaccacaaaauuuuuuguuuuaaaguauauuauauuuaaaacuuauuuuuuaaagacuuagagaagggaucauuguacauuuacauauuauacacauacacaugcacauaucagagcaaaacauacgaaaaaugauaagauuuuuggaaauccuggguaaagaaaauaguuuuauguaguguucuuggcagcuguuuuuuaaauuugaaauucuuucuccccccuccccuuuuuuugagacagggucuuucuuuacagcccuggcugucuuagaaugcaccauguagaccaggcuggccuagugcugggauuaucaagauaaaauauuuguaaaauuugaaaucacacaguaugacaauuguauaaucaccaccugcuuccagaaagaaaaaaaauacacacacauacacgcacauauguuguucuguuuguuuuucuaucuuccuuuucacuugauaauuuaaaguugauacagcuucacauaaaaauuuaucauuucuguuuucaacuguugaacuaaaaguaagguuauguuguaagacauaacauacaguuugggauacuuaaaaggaaaguauguguggagcagagacugggggaacaaccaugcagagacugccccaccuggggacccaucccauaaacaaccaccaaacccagacacuauugcagaugccagcaagagcuugcugacaggagccugauauagcugccuccugagaggcucugccggugccuggcaaauacagagguggaugcucacagccauccauuggacagagcacagggucuccaaugaaggagcuagagaaaggacccaaggagcugaagggauuugaagccccauaggaggaacaacaauaugaacuaaccaguacccccagaucucccagggaauaaaccaccaaccaaagaaaacacaugguaggacucauaggucccgcugcauauguagcagaggauggccuaguuggucaucaguggaaggagaggcccuugguccugugaagguucguugccccaguauaggggaaugccagggccaggaagcaggagugggggguuggugagcugggggaggggggaaggaugggguuuuuuggaggggaaaccaggaaaggggauaacauuugaaauguaaauaaagaaaauaucuaauaaaaaaaaucaaaaaaaaaaaaaaagacauaaccuaccguugggauacuuaaaaggaaaguauuuuuaaaacaaggaaagacgugaauuacucuuaaacuacccuguaucuccuuuguuggagcuuuugugcggucuuugaaugguuagucacaugcaaaacgaugcuucccagggcuugcauugaggaaggaagugcuuugccccagcacaccaagagcuucaucugaacauuauuugcuucuucucuccuuucauccuccuuuguucacgguauuuccucuuucccugagacacaagcgcuuuagggagcagcuuugauggcuaaagcaguagagcuagcuuaguaauguuugauaaaaugaucuuugagguacuuugcacauuuguuaguaauagguaagauacuguuuguccuuucacuuaauuggagcauauaacuucuuauuaaaugcagguguuacugcucagaauuaacagcacacacacuucauccacagugcuucacaaccuggaaaauuauauagcauugccauuuagauucuguuuuuauccugaauauuaaucugaggaagugcuaacacaccauaguuacauuaaguccagcugaguccuucuacugcccugauucagaaugacccacaaaagggccuuccagugggcaagcagaaacaggacauuucuucuuuaagguauaagaaaaaacaaacuuuauagaaacaaauuuuuuaauucuguaaucucagcacucagaagacuaaagcaggaggauuaccaugaguuuaggucuaucuugggcuaaaucgcaaguaccaggcuagccagggcuacauagcaacauccaguuucaaaaaaaggaguaacgguggauuuuuauaucagcacauacaaauuaaaauauuuucuguaaaauauauaacaaugcuuaugaaccauaagguuauauaaacuaugguuucucaucacuuuauuuauuuucuguaggaaaaguagccaucaaaaaagaagacuugugcagucauagugguaaagaaacuugguuuucacugcagccgauugacucaaauucagaaguucagguaaguuaaauaaucaggagauuauaacaugaaaaaccagugaaaaccaacuaauuauacuaguuuauacugauagaacuuguaauaccuuauuuuacauucuaauaccaaacauagaccuuaaaguaauagagagcuggaaggaaauggcuuuuccauuuggauuuuuuuuuauuuuauggauauauaaguacaguguaacugucuucagacacacuugaagagagugccaaaucccauuacagaugguugugagccaccauguaguugcugagaauugaacucaggaccucuggaagagcagucagugcuuuuaacugcugauccaucucuccagcccucgagaaccaacucucaucucuaacuuccauucaugugcacggcaccuauauacauacauauauauacauguauccauacaggaauuaaccagaaaauaauaaauucucauuugaacgcauuuacuccauuuguaauaaacuagauuuguggagaaaaaaauguuccuuauuuaaaccaugccugaaucugcaaugcauagccuucauuccuaccuccccuccuguuuaccuccuuuuauuugaagggguauaauuauucuuguuaaucuauucuuuuuccccuugccacauaaaaggccuuguauaaauucuauaugugaacagaaauguauuguugaaguuucuaaaaagcuuaagucucuaugacuuaaaaauuaauucuaagggaaucaaucucucucucucucucucucucucucucucuuauuucuuuucuuuuuuuguaaacuuauuaacuaugguaaugauuguguagccauucacaagggcauaacuccaggcaggauucuuugucucuuaagcaggcuauaauuugcugcuaagacucagaaguuuaaaacaaagagacaaaaagcauacccacagauacuuugcaaauaaaauacgucuccauuucuucauaaccuuuuaugcagucucugugauuaaauucuaaaaaaaaaaaaaaaaaaaguauugugugcaaaaaucccuucuuaaauacagaauauagcuaaguacuuuuucuguuuuaucuacucuaccccguuuuaaucuucugucuguccauuugaccauauguaucauucagcucucaggaagagcauuguuggugccaagggagaagccaugugaggaaguagaaugggcugaugguguuuucauauguucaguuuaaugaccuugagcuucauuucuguaaaaggagaauaaaauucaccaugcuugacuaauauggaucgagaauacuuuaaaacuugauuuagggcuggguuguagcucaguugguagaguguuuggcucgcauguacaaaguccugagugccauccgcaguaccacagaaacugaauguuguccacgcacauuugucaccucagcaccuaggaagugaaggccgccaggcugcauaaacccugucuuuaaaacaaacaaacaaacaaaaaccuguuugcuucuauacagauguaaauuuauuaccacuacucagucugguggugcccuaguuaggguuucuguugcugcagugaaacaccauggccaaaagcaaguuaaggaagaaaggguuuagucggcuuacgcgucaguuuccaaaaaagucaggacaggaacucaaacagggcaggaaccugaagacagaagccgauugcagaggccauggaggagugcugcuuacugacagccugcuuucucacagaacccagguucacagacccagggauggcacacccuacccacaaugggcugggccuucccccaucaaucacuaagaaucuuacagccacagcuggaucuuauggaggcauuuucuuucuuucuuuuuuuuaagauuuauuuauuuuauguaugugaguacacuguagcuguacagaugguugugagccuucaugugguuguugggaauugaauuuuaggaucucugcucacucagucccugcucgcuccggcccaaagauuuauuuauuauuauacauaaguacacuguagcugucuucagacacaccagaagagggcaucagaucucauuauagauaguugugagccaccaugugguugcugggauuugaacucaggaccuucggaagagcacucagugcucuuaaccacugagccaucuugccagcccccauggaggcauuuucucaguugaaguuuccucuuuucaaauaguucuagcuugaagauaguugacuuaaaacuagccaacacggguggcuuucuaauauagcuuuaccagauuauccauuuucaguuuuugacacaugacuuaauacauuuuccaucuacgcccacauggugucagucauuugaguaugcugcucauguguacuugagguuggcuucgaucucacagugcucucuuaauauugggauucuaggcguacaccacugcacccaucuaaucugucagugauuugaacaagaggaaagagaagaagaggcuuguaagauuuugaucugaaauggaauuacuuagaagauucauuacaguuuauuuauuuauuuauuuauuuaguacguucuuaaugaccagcauacauuuuucuagauuuaagaauuugauucugggggcuggcgagauggcucaggugguaagagcacugagugcuuuuccgaagguccugaguucaaaucccagcaaccacaugguggcucacaaccacccgugaugagaucugacgcccucuucugguaugucugaagauagcuacaguguauauauuaauaauaguaaaucuuugggcuggagugagcagggacugagugaguaggguucaacgaggaccugaccagagcgaguagagguccuaaaauucaauucccaacaaucacaugaaggcuuacaaccaucuguacagugacaguauacucacauacauaaaauaaauaaauccuuuuaaaaaaagauuuugauucugaaaauauagagcucuauguguucuuuguguaaaucuuggaggugauaccagaaacuaauacuagagcacaggcuuuaucugacaguguaucuauaaagccauuauguuuuauauauaguauuggcauuuacauuuuuaguacuguuugcuuccgugcccauuagucauuagccuuuccagaacuuuuaucuuaaaugguaauuaguaagacuuacccacuacuuaaaauagauuuuaaaagaaaaaugcuguaggaggugggagggagggauaauacuuuucaggguaauaugcuaucauugggaauauuauuauuuagccacaaacaaucugaaaauaccacacuagccuugugaguauaaaagauuugaaaacagcuugaaacuaauauagagccuacucagguuuuguuguuuacccuguauaaguuuuauaauaucuuuuaaagacaugcaaaaagaaaaauagauggcagcauagaaagcaaugagauuacauuuagccaggacucaaucuaaugauuacuuuuaguaauuauaaaauauguaccaaguauagccgugaguacuuaauauacauuaucucauuuaaggcccauaguagcacuaugagguagguauauuaaccucauuuugcagauuauauuaauaggauuaaaggacuuagucauagaagaugugaucccauuagagaucugccuaacuccuagucacagcacugugcugucuuucagugacguguacucuuaguuauagaaagaauucaacagauuagaauugcucagggagcaucaaaauauaagaacagaagccuacccaaauuagugggcaaaggggaaugcauuagaaaguguguagggagcuguuugaagucaaauuacaggaacuuccucgggaaugugagcuacauaguucccagacauuugcacagauacuucgugguaauggcaguuagguucugacaguagcacacaagauagaaauucacauaaguuaaaaaugauccuugaagugacuaagucuucauaacaugguugacugccacagagaacauuaguuuuuaucuggggcuuugaugaacaaacgcuguguagugucauucuuagcaguagccccaacucggcagcaauguacuguaaggcaggugagaccugugauccacugguugauuuuuuucauguuuguggcuuuucauuuuucauuuugaaaaaggaauaguuauguuuucuucuuucacucucuuuuaaauaacuauauacuugcaaaauaaagaguguagccgugaauuaguuaaaccgcuuuggcuccuagcagguugcgcucucacuguacccgcccaagagcucagauucccaaauaaaagacaaacacacacaugccaguuaauuuugauaugcuuugacuagcugaauggcuggacacuucuaaaccuccccauggcuagcaaacacuccccucugauauuucugaguuaacaucuuuaaaaaucuguauuucaucucugcuaccccagacccaaguggggaaguggccccagauacuuauuugccugcaggccuauaaguuucaucuuuuugcuuccccauccuugggucccuuguccacacaagucucgccccaucucccuguccaaccauuggcugcacagcaauucuucauuaucagucaaagccaguagggggcaggaauccucagguaugaagaaagcaugacuuuuggaagccaaaauaagaccaaacauuagaaccaauuuccaacaaaagagaaaaaagauucugggugugugugugcaggugccuguguaugugugagcuuguguauuuagagaaagaauaaccuugggugucauucuuaaagauacuucaacucgguuuucagacagggucucucagugggaccuagagaucacuauugcuaggcucgcuggucagcaagucccagugaucuaccugucucugccucccuaggacuuccaaguacaacacuacaaccaucuuuguuaaaaauuauuucuuuuuuuuuuugagauuauacuauaguuauauuauuuccccuuuccucuuuccaagcccucccauauaucccucauuguuguuuuucaaauuuaugacuucuuuuuucauuaaauguuguuagggauguguguguguaugucgguguguguguggguaugggugugugugugugugugugcucgcgugugcgugcgcgugcgugcgcaugugugcauauauucuuagcaugacuaccaccuauuuaaucuguauaaggcugggcugacuguuuggugucagaugcccaauugguguagccuucuggguaagggcuucccccgccugggcuaccucaccccagcccacaaaggcgugucuguugucauccuuguuccgcuuguauuuaggcagucauuucugugaaacuucauggguguaccuucugacauuacugggagacauaauuccauagcaaacucucugauccucuggcucucacagucucuccaccccucacuccccuuucacaaugauccuuaggugcaggaguuguauuguugaugaaucuguugggacuggguuccacggcucugcauuuuguugguugcgguuuucuguaauguuucuaguccuuuguaaagagaaguucccuugauaugcaggaugaggauauaagggcagauauucagaauguauuagauacccaucuuuauuuauacaccuguuuuccuggguggcuggugggaguuacucaucuucaggcaggcauggcagacgcuuuagcaauugagcuaucuccucacuuaaugauuccuaaagaugucaaccauucuuuuuauaugccuaaugagaguacauaucucuuccuuuguuucuuucugugaguuuacucuuagugccucuuguaaaaugcuauauucaucuuuaagucucuuuguccauauaccuuccucauccucaaagaucugacucaauuuacagagagaaguuagcuaaauuuuugucacuguccacuaaagucuaaugagguuggagacauugcagggcaguucauucuggagucuggguuaggcccguuuguuuaggggauugaguggaugaaaugaucagcaucuuuaucucggagaggaagcaguuuaguuaucugccauuaccacuaauuaguauuuguaacucaaauccguaccgauuuguugguggaagaucacuuauggaaugaggaccucgguguaaaggaccacgugucuguggagauccaggaagugacacguguaaaugucggucacuccuugagugaggagcuucacuaguaacucccauuucauaccacgcacuugauuguuaucuuagccuuuuacuuuaucucuugcuuauuggacuuacugauuauuuucuucuuagaagcucaugguagcaggauuuaaugagugcauuuucuaccuuuuuggacagaauuuuaauuaaaaaaauacuuuauguguauguauguuuugccugcauguaugucugcaccacaugugugccuagugucugugaaagccagguguuggacccuuuuaaacugggguuucagacaguuaugaaaugccuuggggguguuggaaccaagguccucugcaaaagcaagcagugcucuuaagugcugagccaugucuucagcuccuuggcaggauuuuuagaauauuuauugucugugucugugucugugccugaguguauuaggggcagcacgugugugcaaagcccacagaagucaaaaacuggcauccgauccccuggggggcaggagucggaugugguugagaguccacgcuggguucugggagucaaaucugagucuucuacaagagcagugcuugcugucugucaacugcugagccauuucuucagccccuuuucuaccuuuuuaauaaaauacaaaucuuuuucuugacucuguuuuuugccauuuuccccucugacaugaacccuuuucuuuugaaaccauuguagugugccuucagacucgcuucuugggacuugaugccccuaagcaaaugggcacgucacuuuuaucagggcuccacuggcugccugcugcucugguuuugaagcguucucuuccuuaggcuccaguccugguuaugauccuggcugucagucuguuccaguugguguacauuuucuuuauucucuuccauacaagugaugauaauacagccauccucuuagcugugagaugcugaaacucacaccuuauaagcauuguuccauucuuuauuuccuagguaccucgauaaaaaacaugcuuugcauaagacuguugauuauggguggggucucacacaacauguacaggcagcaaacccacauguuaugccagaugcaauguuaguuauguccuuucgaugcaauuacuuaguaagucuuauccaacaggauaagcuugaccaucuggaucauacuguaaguuaucgaucgguauauacuuuuucuuaauggccuuuguuuuacuguuuuguuuuuuuccgagacagaguuucucuguguaguccuggcuguccuggaacucacucuguagaccaggcuggccucgaacucagaaauccgccugccucucgagugcuggaauuaaagacgugcaccaccacuguuuuaaauagccaguuaagaagaaaucaagacauuaaacacauguucaguuaagggaucauaauauaaaagcauaauucauuauuauuauuauagauugauuuuaaaacuuugugaauuuguauaugggaaguaacagaaaugagccauucuauuucuuuuuagauuuuuuuauuuuuuugaaaaaaggucucacuauauagucuugauuggccuggaacucacugugcagacaaauucagaucugcuuacuucuaccuccuccugaaugcuggaacuaaugacaugugugggccacugugccccacucuuuaucucauuauuaaauuauuauuuaaggagaaaaaaaucuugccauuaauauaagagauauuauaaaguaaaguuuugucuuucaucugacaagcaguugugucuaaaauuauuuagaggcaauuucuauaacuaaagcugucuuagcugcuguagcgaugcaugaugcaugccuguagcuccagccacuccagaaacugaacagcuuaggcaguguagccagaccugaacucaaaacaaccagugaaacucugucgggagccauaacgucgugguggugguggugguggugguggugguggugguggugguggugguggugguguuaguugguuuauuuguuccucgccucauaaguuuuuuaaaccaauugaaacauacagaguucuuuuuuauuugucucuaaggucuguguguuuguaugaguaucuacaugugugcaugugcaccguaugccuauuugguacucuuggaauccagaagaagcaucggguguccgggagcuggaguuacagacauuuaugauuggcuguguggugcugggguccucugugggagcagccaguguucuuaaccagagagcagucucaugcugaaacagucucagucauuuuuaugaggaaauucucaauauuuaaaauguucuaugauuuaaagacuauuuagaugugagaggauuuuaucuuuaugcauuauuuuuugccuguuuuuacaaaccuguuuucugugcauuuuuugauaccaggagauagcagcugcacuaagguuccuuuuuaucuuuucagcugucucacuagugcuuugguaugcugucuucuuauuuauccaacugauauguuuuuaggagauuuugaaucuguaacguaaugucuuucacaggucuuagaaaauuuaaagcaauucucucuggauucucccgucucugacuuucuguacugggauuccaggcucccuguacuagaaccagacuguuguguaugugucuuaugucuccuaagcgcuccccuccucuguacuucaucaugaacauuuucuauugaugagccuuucacuccuguuuauucuccuuuagcuguggcugaucugauguuagauauaucucauuucaguuacuuuaguacuuagcucuaaaguuaucauuuaauucauuuauaguuuccaguuauuugcuagauuuuucacuuuauuuucuguuagaauaaaaacaaggcaaaauaaacaaacaaacaaacaaacaaaugggugguauauauuuuaaguuugaggcuggccuggacuaaauagcgagacccuauguuaaaagaaauuaagauaacuauuuuaaacucccacuccacuuacagucuucuguucuugucucucucucucucacacacacacacacacacacacacacacguaacacuaaaaauuacuacauaguauagaccuucaaggucaguaucaaaacgcagagguuguaaaugcucaaugcaggaauagugaaggaccgaguuuguaagauauauaugauuuuaucaguauuuauaccuaaauuuuuuuuucuggacuauuuuuuuaguuccauauuuauaccuagauuuuuuuucuggacuauuuuuuugguuccauauuuauaccuagauuauuauuucuggaauauuuguuucuguuuaguuccaacucuacaugacugcucguuuucucauugacgccuuuuguuguuugcguuagagcguaucucucucauucagaccuuugcacuaugacucauaacuguauauugcucauuguguaguagucaucuagccuaaaguucacagcuaaugguccugagauucaguaucauaagaaaagucggcauaaaguaauaaaggugauucagauuauaucuuuaaaugaaugucuagaagggcucugaagagaagcuguaacuagagugcaaauaucccuaccccugauacuaucacucaguacaccaggcccuagacaucacaccccaagaucuccacuuggcacugggaauuugucuugucagcuauguggagguaaggcagcacuaauuguuaaccgguuuaggauugcucaucgccaguaagcagaagagauacccaagcucuggauuacauugucccuaagcucuuucuugaggaagcuaaugccuugaguuccuuaaaacguacuaaauugcgcuuucaauucaucucuuaccagcuguguguaagagagaacucuauuuuauuccaauucuuccaucagugcuuugaccguauagugucacucuuacagucucucuggcuaggucaugagcuucuggucaguagugacggugucuuacacagcuguuugcuccuguguauucccauaggacuuccuaaaacauagcagauucuaaaucaaucuucaguaguugacaagguauauuuuaaaaaacugauucuuacuauuuuuaacuuaauuucauagcuuuagaaauuaauuuauuuuauguuuucaaaaaauauaagugccuucuuuaaggaaauacuguggucauugcaguauauaaacauuuauuaagcagguauaaaguuccuaaauuucuaccugucauauuucauauaaauauuagaauguuuucucucagaacuuugcuauauaugcgcaugcaugcacauacauuggugauuauuagccauuuaacaaauaaaucuaugcagagauauguaauagugguuagugaauaauuaugugugccauuuggauagaaguacauuguaauauuuuguuagcaaaauaaaauagacugaguuugauauuuucuuuuuguccuagggaaagguucaccuugaguuaagacugaaugagcugauaacagagaauggaaccgugugccagcagcuuguuguacaguaaguauauccuuuuuauucauuuauuuguuuuugucaaaaccaccuagaaauaauucuguuuuauacucuuagacuaauuucuuauuuuaaauauuuuagaaacuucaaaauaaagcucucaugcaucauuucuuuaccaaacugagaauccagcuuauuuuuucauuuaauccacuuaagcuauggcaagucauuaauuacucaacaaaguuuuaaugaauguggguugagcaacaaauguauguaagcauuaaggcaugaagggucauaggaaggagccucuggcuuccuagcugcggagacucagaaaguguuuccaggggauucuucuccgagcacucagucacuacgcagagcuucagggagccagggaucagggugaggaggucauacgacgugaugcucaaacuacgugaccaccuaagauugcuagcaccuuucccucuaggaagcucucaguagucaguccaacucuguugugaggucauguucuagccuagucuucuacuucuugccucuguaaacgcuugcuaccaagcguuucucauucuggaacuuucugugucuuugccucaguugauaucugaaugucccugagguuaugagguucauaucuacauaccuuaggaaggaguuagagcaguuguuacuuuccuauugcugcuccacacuauaauucacucuccuaaugaugaaaaccccaauuccuugaagcauugccuuucuguguuguguguacuauaugaucugagguguucaacuucuuucugcuuuuauuagcuaucucaacuaauaaauaauaaagagacuaagcgauuuuugcuguguguggaugacuuaccaaaacaguaugcuuaaggcauuuuuuccuaaaagcuuuauaaucaugguaacauuuaauagauuaauaaaguaauaaaauuuuuuuauuuacuaacaguuuuugucuuacugauuuucaaauuccauuugccuauugaaaauaguccaaagccaggcauugugguaugugccuuuaaucccagcacucaggaagcagaggagguggcucucugugacguugaggcaaccagggcuacauagagaguucuaggacagccagggcuacauagaaaguccuaggacagccagccagggcuacagagaggguucugggacagccagugcuacagagagaguucuaggacagccagggcuacacagagacccugucuugacaacaagaaaaagacaguagaaaugagugugcagacuucgcccgcagacugagagccuguaguggaauucuuuggauaaggcccuccugcuccucccuucccugcuuggguuuagugacaguagucagucauuugaaguacuaguaguuggauuagcuuauuugcauacuuguuuagguuuuucucuugggugcuuggcuuaguuuuuauuuauguauauugugugcuugugugcguguaugccauacauguauaaguccuuacagaggccagagauguuggaucuccugaaguuggagucauaggcuguugggagcuaccugauuugaguacuuggaacuuaccugggguccucuggaaggguauccagggcccuuaccugcugagcauuucuccagcuuccuguuguuauauuuuaggauguagaauauuagcaugauuucaaaggaaaaauuguaucagaaggcauuauucaucggugugguucaguucccucuuccucacacucagcccuaggcaaccacagucugauuucugugucuguuuuuacuuuuugguuagacugguuugauauauuuagucuuuugugucuggcuucuuuuacuuaguauucucccuuucauacucauuuacaucguugccuauaguaguagagaaucuucuuuccaguguuuccagugucuccugagcuaggcacacggguucuaccacccagacaaaccccagccccuuauuuuuucccaugacuugacagauaacucaacaauguacaugcuacuuaaauaagcccaauuccauacucuugaguuucagggcuagauuucaguuuuucuauuuuaauguuuuaacuugagguuauggauuuacaaaguacaaacaggucuuugugcucuuuacuuaguuucccccaguauuuacauguuacaugacuaaaggaaauuuuuauuccuacacuuuguuguguauauaccacuugguuacauguaugaauguaugcaaccaccacuacaaucaagguacaguacauacugucuucugaaggcuuuuauucauacuacagcugauagucaugcuccucucugccacucucccgacucuuuucaaaccucuuuucugucuccaagucuauaacauugucauaacauggugugagagcuggaacugugacucacugcuggaacacggaacucagugcuuccuuacacgcugugagguccugcguucagucuugaguaaacacacacaaacauaggcacacagaaguaggagaaauagaaccuaauuguguauagccuuugagauuggguuuugugcaaauccauaugaauuauguguacucucuuguagauagacccuaucauuguaaaaagucguucugugggaaggcguugcuagagagauagcuccauaguugaagagcacuugcugcaugugcagaggaccuggacuacuuccccagcucacaaccgucuuuaauucuaacuaggggaaccuaagaacauggucugcucucuguaggcaccaagcaggcaugugguaaacaggcauacaugcagacaaaacauucuggggcuagagagaugacuuugugguuaaaaauauauacuucucuuauagagguuccaaguucaggucccagugccuguaaccgaauggcugacaacugccugaaaugccguaacucccaugcauuaaacacuuauauacucguggauacaugacauccuuccaguauacaucaauaaauaauagauaaaaacuauuuguaaagagccauguucuguucugugaauuuuuuccauuuauuuuuaauguaauuauugauagacuuaacucugucuuguuucuguauacugucuucuauuuucugaacuuaccugaacauaaguuaaaauuauguuugguuuuucuuggauauuuucuuuacauuucaacuguuuuccccuuuccaggucuccccuucggaaacccccuaugucauuuccccuccaccugccucuaugaggguguucccccacccacccacucccauucucccacccuggcauuccccuacacugggguaucgagcacccucaggacugagggccucuucucccacugauguccaacaaggccauccucugccaccaugagccagcaccaugggucguuccauguguauucuuugguuggugguccaauuuccgcgagcucggggagugggggggucuggccuguugacacuguugcucccucuaugaggcugcaaacccccucagcuccuucagucccuucuucaacuccuccaucagagacccccaagcucaguccaaugguugacugcaaacuuccuccucuguauuugucaaacucuggcaaagccucucaggaggcagccauaucaggcuuccaucagcaagcacuuccugacauccacaauaauguccagguuugguggcaguauaugggaugguuccugggugggacagucucuggauggccuuuucuucagucccugcuccacacuuugucuccauauuuccuguucuauuuauagugucuuauuacauagguccuuuaaagugguugucuuggguaucagacuauguguacauaacauauaaccuccuguugucaacaguucaccaguuacagauaucuugccuccucuuuuaccuuuuccuugcucccauguuuaauauauuuuuguauuaaacauugagaauugugcuaguguuagaauucuuugcaucaggcauuuaacuuaauccagaaaaaaggaaagcauaguauuauuuacacauuuuucucugucccuguuccuuucuuucuuccugaauuaacauuccuuuugucauucuguuuaaauauccuccccgccccaauuucccauacuucuaggguagaucuagggugacaaauacuccucauuuuccuucucagaauguuuugauuuuucucuauacacacacacaagcuacaaccaguuccucucucaccagcuaagcuuugggcguggguguggguggugauagcauuaguuguuuuucauuugguugguugguuuuugguuuguguggguuuuuuuuguuuguuuguuuuuuguucuucugcuuuuugcuuuuugguugaggagcaaguggacauuagcuuaugaagguuuguucuguugggugcccuguuucuugcucuccuuuggaggccgauuucugaaagacauuuguuuaaagauacaggaguuggggaguagugugugcacaggauuauucacaaauguguacagcaucaaagcugaccaauagauacuuacaugacagaaaauuuacauauucucucauacuuuaguaccgacuggccguguguggcuguugaagacaugaaauaaggcauaugugacugauauuuuguuaaauuuuaauguaauagccaaauaugguuaguggcugcaauauuaguauagcuccaauagaaagcagaaagccuggaauccuuguuagcaauggcugaucuagggcuggcuuaaggaaauauaugaugaagcuagaauaccuuaugaaauuagaauguaaggaaauacuccaaaaaauaauggagagauaaaugaaugagagacauugaaaucaaucugaauaaguuucagaaggccaauugugggacagcuucagauuugaggacagccucaaaauuaguauuaauaauggacuaaagcuugaagaauaaauauucaugaaucacuacugauacaauacacacaaucguguagauacauaggaagaaacaguuacuuuuccuuacaguauaauucuaauuaaugaauuuaggaagggugauggagauugaaucagcacuggcaaauaccacagcuggguucaagcagagagacaagcacucuaugcucucaguuauauauggaugcacagaaagccuuuaucaaggaagccgguacagaguaguuguucccagagccucgggaagauguaggggaaggauugggagaaggaggauuguuuaauggguacagagcuauagcguaggaggaauaauuucuaauaauuuauagcacagaauaauuaugagugacaacuggauauuucagcacagcuaguagaauuuugaacauuccccaaagaaauuauguuuagauguuagauaugcuaauuucucuaaucugaucauuacuguguguguguguguguguauguauacauauauguguguguguguguguguguauuggucugugacacuguauucauagguauguacaauuacaugucagaaauaaaagcauauaugggggcuggagagauggcucaauuguuaaggacauugacucugcucuuccagaagaccuggguccgaauccuagcaccuacauggcaguucacaacuaccugugacuucaagaucugauguucucacauagacauacauguaggcaaaacauuaaugcacauaaaacaaaaagguaaauaauugaaaaauaaaagcauauaauuaaaauauaacugagaucuggaaggauggcacagugguuaagaucacuugauacucuuucaaaggaccuagguucuguucuagcaccuaaauggaagguggcucauagcuucauuuccaaggggaucugauacccucuucugaucuucacugguaucagacauguaggugguguacauacauguauguaaacauucauagaaauaaauagcuaaaguauaauaaauaggaugagaaguaucuaagaguacuaaguauguuagccuaaguaugauugcauuuuuguauagucucaaagaaucucccucugaaguuauuucauagauaacucuucacaguagcauaucagguagucuugguacuauguacagaaaagaacagcgagcuaucuaauugaacagucccccuccaauaauagacauggcccccaguggagggauggggccacccaucuucaaaauuuuugacccagaauuguuccugucuaaaggaaauuuagggacaaaaauggaacagaaacugaaggaaaggucauccauuguccaucccaauuugggauccuucccaugugcacacaccaaacacugacacuauugcugauguugugcuuguagacaggagccuagcacagcuguccucugagaagcucuaucagcagcugacugagacagaugcagauacuuacaagccaacacuggacugucggagacaccuuuggaagaguuagggaaaggauugaagggggcuaaggggauggcaaccccauaaggaagaccaacagugucaacuaacugggaccccugcaacucccagagauuaagccacaaaccaaagaguguacauaggcugguccgugcccccucccccaauccacacagaggacuaccuugucuggcuucagugggaaagccuacuccucuagagacuugguggcccuuuaucuauuuuuaaauauauaaaacuauauuuaagcugggacauucaccccaaauaaaaccucuuugggaguagaaacuagacaugugucugauuuauuuaaaugauauuuauuuugauaaaaaugggggggcaucugauuccauucuggucaagagcaaaugucagacgaacuuagauuaaguaaugugaaagcaguuaucacaaggucagagacugggaggacauggcagcugaaugcaguguagaaucccauacugcauccuggaguucagcaaaauuugaguggcaucuguagauuaauuagcguuaguagcauuaaaugucaguuucuugauuucaguagcuucaccuugguuacacagaauguuaacauucaauguuaggguuuauagaaacucuguauguuguucuuacaacuguuucaaagucugcaauuauaacuaaguguguuuguuuugaguccuggucuccuauagccacuguacugucacauagcacugccacugucacacaccugaacuuuuacacauucaguuucagguuuguucaacuccuuuccagagucuuagcagauauuugagucuaccuguguuucuuuaaucagaccuuacauuuuuuccauuucuagaccuuuguuuuauuauggaaaaauguuuauuuugaaauuuuuuaaauuuagaaauagaaaaccucauaggaaggaggaaagaaacaaaaaccacaaagcauccaggcaguguuuuacuucaugaacaugucacccccucuggcucacucgucccauggugagaaaggaaggacucagccacccacagcaauguuauuaaucgggauauggaucaguuucacgaagaagccagugaaccccaugauagcaaaucccaucgcuguggccauggcagucuucuggaaaauucuuuucuaucaaguuugguacaucuuuuagucagccgcauugagucuuuuacaaacuccugacugggcucuacagacugcauuaucugauccaugugugugggaugacgguuugagaggguagaggcacguagccuaggagagaauugagcccuagaccuuuauuucuuaaggcuuucugugucuauggugugugagguaaaaauuuucaguguucuugucuacaauuacuuuuugucguuucugcuucucuuuuggugguuuuucuucucacuguaggccaugcuuauucauuguuugaguuggacauagaagucacuagcugcucuguguugcuguaauguacuugaauugguuuuuagguaucaguuaacuuacuuggaaacaauucauucuguuuauaauuugguuuuaagcuuugucagacagaugagaacagcauauuaucauagagcuugcaagaggcccacccagccacagaagagaacugguaguuuaagaauaaugccauuagugggaaaauaugaaccccaaaguauuucuuugggcuguacuuuuuuugguuaguuucagaaauuugugaauuuuauuuuugaugcucaguuuagcagaaaugagucuuguuuucaauuuucucuuuacuuggcaauacaucauuugcaguucacccaugagugagucuuggagagaaauagaggauguuucucaguagggguuugugaaacaaaaacaaaacacuuggcauuuaugagccucugugagggagcaggaaaugagacucagacuuuaaaccaacuaacuuaguaauaauuacugaggaauaaaccaacuaacuuaguaauaauuacugaggaacugugagaaucgcaucauuagagcguguucuuugcuugcuauaaauacaaccauaguccguacaguagauuggauggccuuggguuuguagugcaguucauuuuguacagagugauauaggagcugcuguugagacucagcaugagagucuggagaacuaugugaggcuugcccuauauuuaugaaucagauuuuaaguaaaaccacaaccauuuccuugugugucauucaugcuuuagcagaggauauggugccacagagcuggccugguuuguaguuucucauguaaggcuacaccacuuucuuuuccguuuuagaagccacagcaguuuugauguauuaucaaaccacaaaauguaccuugagcauuucccaggaagaacugugcuaugcuggucugaguaccgauuguccuugcugggugguucuuuuugggaaguacucauguaaauaaguaauuuggaguaguugauacauuggaacuacaaaaauggaaacaguguuacggucuuugaauauauagauuucuauugaaagauaguguuuuagguuugguagugcagcucaguugcagggcacuugcccuguguauaugacugaagccagggacuguucccaguccacaagaaggaaacgagagggagagagagaggggguagauacuauguuaugauguuagugcuaacauauuaagaucuguuuuguucuaccuuagcaucaaggccugccauggguugccucucauaaacggacaaagcugugauccuuaugcaacagugucccucgugggccccucuagguaaugcuuacugaauuguuacugcauuuucaaguuuaaaguuggauuuaagaauuggaaauguacaguucuuagaucaagugcugaguaacugacauaaaauaaugcuuuaaaagaauuuuuuguaaguucuagagcacacuugguaaacaacugaguucuguuaucacagaaagauacuggguguuauuucaaaucugcuaugugcuuauuaggcuguggugaaagcuucaaucuuaugccauuguaaaauguacuuuaaaguauauuccugggccagguaugggggaugcaugccuuuaauugaaguauuugggaagcagaggcagguggaucucugugaaucaaggccaccuuagacuguauagcaaacuacaggccauccaggaucuaaaacaaaacaaaaaaccaaaaaaaaaaaacaaaucauauacaccuggcugccuuuacucauuaacauucuuacuuucaaauauccucaauuuucuguaaguaaaaaaaucacauuuuagugauugucaacucaaaauagcaaaacaguuuccauaccaguaucugggaagccgcuuaggacugagaacugccuuuucuguucaugugucggugcuuugugaagagagcuccaaacucuagaagaacuacugaggucccaggccauggugaagugcagcaugauguugaguaauuggucuauaauuuaugaaaaaccaguaacacuuugugguaucuauauuagauaacuucauuguaguuucuuuacaagacugacuagucuggaguuugugugcaacuuaaagcucuuugaaucaagaaacaaaagcacaaaauuuguuaucaccaugacuccccuuuaucaccuaaagcuguagucuuuguuuuuucggucaucaagucuuaaaaaaaguguguguguguguguaucaaagcaccugauaccauggagcuuaaauacugauaugcuauuauuacagauugguuuuaaauuuaaaagcaaaaauguauauggcauuaaaugcugccaaaagacuuuucacaucaauguuaaaaauguucauccucacuggauauuggaagcauaaugauaaccccuguaccugggcagcagacguagaggcucacacauucuggccagccugcacuacucacaaccaugucucacagagaaaugagaagggaaaccagccagccuagaagagcugcuuguuuggaguaaaccucuuuuguaguucugucauugaaccagacuauuguuacuaagcaguuacucuaccagagagagauucucaacucaggaaguuguucuugguuucuguuuaaugauuucuaucucaugacaaauucuuuaguggagcuuuuaaaguaacauuucacaagaacuauuuuuuuaagauuuauuuauguuuauuuuauaaacauugguguucuuccugugugugugugugugugugugugugugugugugugugagagagagagagagagagagagagaaagagagagagagagagagagagagagagugcaugccagaucuccuggaugcugggaauugaaccaagauccuuuagaagagcagccagugcucuuaaccacugagccaucucuccaacccgaaacuuuuuuuuuaaucacaguugauuuugcuauuauacuaccguugcacagacauucccauugguugagucuagucaaagacacaagacucccaguacauuucuuuauaacugccucugaaauuguccauucacugagaauuagcaggcuuuguuuuuuuuuaaguuucuguccuggcugcggcccucagaaguacacuggguucagaguuaccuuucaugcuucucagguguuccagcaucaguaaaggcuuggaggcuugggccuuucuucucaccacuccuucugguaguguaaucggaucagcuucuccuagccguggagacaguaacccaaucuugccauguauagauauguaaaacuugcauccuguguguggauauucaucagauucaaguuugugagguuuauauccuuggcuuuuuuccuuugcauaauauguaaguuacugucuucucucaguuguccuaaaauguaggcagagguuaggcauccuagcugggaauagcuuguuuuauaauuguguacuauuaaguucuacaagguauaacucuacuacauuggaacaggaaugaccaaaagaagacaaaaguaaagaagaaaacaagcaauccacaguucaaugaagucuucuauuuugagguaauuucuuguuuuauauaaauguuaauguuugauauguaauucuaguugauuuaauuucguaaaccauagccaucaaaauuguuuuauuaauuaaugcagcuaauaaucucuacccagagaugaguagagccauaaugucacacaugcagcucugguugguuuggaaguggggagggcuagagccccuaccacauagucacauugucacagcucccuugagagccuccccacacuuuccagucuaccugacacauagugacuucugagcagacuguuggaaauccuauagaaauuuaaauauuaccauucagaagaucugaaaccuuuucccagcugauauuaaugaucaauuaaauguaaacccugccuuccauauccuguaaaaggguaauuuuauaaggaagaacgguagcaaaucugccaaauaugagacuacuuugagaguuugaaacaguuuacgauuaugccuuuuuaccauuaaguucucuaaaucuaauuuacucuguagauguagcuuguucaugcggaucuccagcugccuugagugaauccuaaccacuggaccaccaagcuugcaucuucagcugcuuugaaauugccccaaauaaagugcuuuggcauucuuuaaaguauuuagucuuuuuucauauuaauugaagacuauagaaaaacuaaaaaucaaaauaucuaaaagguuguaauaacagaacaaguugcaauugauauuaagaugugagaacagguuguaaaaguggguaauuacaucuugaaguuuuuauuuuguuuuuuuccucuguuuuggagagggcaccaaaguaccccaacucaugccugauuguuguucuuuaauaacaaggagcaugagcugaagaaaaugccaaaggugacauaggaaacuggggguggggugggggacaagaaaaaccuacugagucaagaggcuuccuuuccuggcugaggacuuggugcugcuuucuacauuuauuaacagcucuuaugucuaaccaugagaaugagaagaagaugacaguucuaacagcuccugcccaaagucacucacugcauauaguucacaccucagguggccuggaauucgcuccuuaggaagaaccuguagccagaggguaacuuucugaaaguugaggucagaaaugcuugccuuaccaauuuaccucucaggccuuaaacuguuuauucaucuaguccuuuguuagauugguuguacagacaggcaugcucaguacaaccagagcaagacauaagaaagcacacacaggugcauauacacagcuauaauguggagcaagacauaagaaagcacacacaggugcauauacacagcuauaauguggagcaagacauaagaaagcacacacaggugcauauacacagcuauaauguggagcaagacauaagaaagcacacacaggugcauauacacagcuauaauguggagcacccucucucgagcucaggguuaaaacaguccaaagcuagauuuuugcgagaacagaaauaauauuacagagacagaacacuuugggcacagagacagaaaaacugaaaguuauacccagagaacaucaaguaaagauuuaacuaaguuuaguaaaguaaccaaaaaagaugggauaaacugguaaguguccggcggugcuuuagcuuuagccauuaaacuagaaagaaauaaccaggaucuguuagcagagcccagagaccuucaaagagcugagagcggggcagaagucgagauaacugaucgugggagaaaagggagaaagaaaucaaaagcauccauggaucuguguaaaauuccuccaccaggcgucagaugugguacaugccugucaucccaguccuugagagguguaggcaggaagagcaguuucaaggccagucucagaccaccuuaucucagaaagcaaaucagauuugcuaacaggacaguucaugacugaagcaugguaggugauaacuauggaucacaauacaggauuugguacagagccaggagagccaacagugaagagaugcagcagaggagaaacccagucagcucuggugcuuacuaaccacuccgcuucagacgugcugaugaaguuuguacugucgcuuccucauuuuuaaagugaggggaauaaaucuagcucugccugccucaaagcaacagucuaaugaguccagagaugugauagcacugaguaagccagacaacaugguguggcguuaaguuacauuuagaacaaaauaaaacaaccuuggagaaccaccugugcaauuccaaggaggaguagagagcaagagguagcaggcuagcccacagguaaaccgaaugcaaagaacuugucugggacuagggcgggggagggggagggaggaaaggagagaagaaagaagagagagagaggccaaggacacugacaaucuuagacuagaaagaagugaucagacagcuggacuuagaguagaccaaacgcuuauaacacaugcuuguuaguuaauacuguggugaaaggagcaggcuuggggagguaaucuuagaaccaucaccucuucagaaguccugagggugggggaaguggaugcucagcuugguggcaguugaggaaguuccugcccaguggccuugauauuuucaguaaaaacugugagaaggaaauaugaguaggugugacccgugcagacagagcguuguaaccagggaaccagauguggcucuaaguagaacugacgguguggaggcgaggaggccucugauuuuuaugccggacuuucuuaccuucuggugcauauuugguacauuucccaugcuuuggaaauugcauucacacuugacucuuuauauuuguaauugaauauuuugggaauggucauuuuugagcucaugaaggaaagauacuuuaaacagucucuacugaaauccuucguuuguagguaaccagauccagcaguuacagcaggaagucccaguuccagguggaggaggaggacauugagaagcuggagaucaggucagugccguccuguggcgcuggagaacggcuuuucuccaugcaaaccuccauagagcccuucauagcaagcugaucgaugaacuuagaugaacaggcaucuaacuuaauccacuuagccuuucaaaaucggauucuucucagaaauaucaaguaguucucuugugugagcaaagacagccuaauuucaccuagucuguuuucauuuucccugauuuaauugcuccuucacuaccuggauuauaguauaaugaauggaagacugauuauauuuaauccaauuuagaaauaauuguuuuauucuucuuaacauaucugcugacuaucagacauuucagugagguaaggcgauacccgcacaggugcauguguuuggaguuugugguauuuccuaggccuucaauaucuaugcuguuuuggaaaggaaacuuuugcaaaugcauguguaggugugguguuaacaguguguuuucuaaaaggcauauuaaucauguguucacauuguuaggcaauauuuuucuaaaucaccgaucuuuauguauuaauuaauaacauauugauuuaucaucaaagaaaaaguguggucuuguuuuguuuccucaauucaguaaaguaacccuuuuguccuaaugcuacaaacuaaaaacaaacaaacaaaaaaaaacaacccuagacuuucaaacuuaguuucuccuuuuauacuguuuagaauuuggccaggaagcuggccuaggugggaaaggcacuugcugccaaacaagucuuccugaguuguauuccuuggacccucacaacggaaggaaagugccaacuccuguuaauugucucugaccuccacugugcacaguggcaugcaucccucccccaaaacuaguuaauaaggauguaaauuacaauuuaaaucgugauuuuuuuuucauaaaaauugcuguaguaauuugcuuucaaugucuagauaaugcauuauaugacaaugcuaaucuaacaucucuuuuaaaagcauguaaaaauauaguacaaaucaaaaucacuugaaacuacucagugugguuugccaaaacuaaugcuagguuuucaauuuucaggauugacuuguggaauaaugaaaaccuaguccaagauguuuuccugggagagauuaagguuccugucaauguguuaagaagugauuccuuucaucaagccugguaagaagacagauacucuaaugaaccaaauuuaauucucuuuaauaaagaauauaaauauaugcuugcuggaaauaaguaaaaaguuacugauauuaauuugguuaugaauuuguuauuagaggaaagauaaguacuuuaauaguuguaucacuugaucugugauacugagauaaagaauuuaguugucuaggaauauuuuucuguuuaagaauaaaaucuuggggcuguagaaauagcugaacucucuucucaguuuggacgggguuucagauccuagcaccuaccucagaucucucaaacaaagggcuuuaacuuuaggucuaaggaauccacuggucucuuuggucuugaugggcaccuguacauggacacacacaaacacacacacacuaaaaauaaagucuuaaaucuaagaaaugagaaacauuaagacaucgaaugaaccgcucguugaugcuugaucacaugucaucaucugcaguuuggaugcuuuucggucaaagaauuguggguagaaagcagagggcuuauugagaagacacagcagucuucugugugaggcaguguaugauuuucaguuaucacacauuuacaaaugcagauaaccucgauguguuuucugagugugggguauugacuauaaugucauuuggccuuuucauggcucuaauagugauacugaauuaauaacauuaauguuaauaaccuuaauguuuugacauuaaauucauacuuauuucaaugugaaacuuuuucucuauagcccuuaaaaacuaguguuuucugucucuucgugugucugagcccauguuucuuccuagauugauugguauguaggaucaugcuuucucaguuguuggugcuuguugaugcugcuaugugagcauguagguaugcuuacacucaugcgcacauagagaacagacuugacacuggauauguucaccagucacucucaguuucugaagagaggacuucagaaccaggagcucacugauuagcuaggcugggugggcagugagcuccagggacugccugucuuuuccugccccgugcaaggauugcagaugugcacaccacuaaacccagcuuuuacaugggugcugggaaccuaaacucggauucucaugcucugcagagcaagcacuuuaucagcugagccauuucucugaccucugucucuucccuuuaaaggucacuuuuuaaaaugaaauguaauauuugugccugcuuauuaaguguaauagucacuuguauauacuguguaaugaucaaaucaggauagucagcauuuccaucucucaaauaccauuuccauguuggaugcuggagaauuagacugugcugaaccgugacaucaguuguuacggaccauagugaaccuguuggauuauaaacagagcugcuacucccacgcugcauugagagcccguucuaauaauaauaccuuucucugaugaucuccccuccugccucuagcaacuuacagucuuuguuuuuauguggaucaacuuuaguuuucacaaaggaauaagaacuuguggccuuugucuuucugugccuuacuucacaugauaaaaugaccuccaguuccagauggguuaccauaagugauaggauuucacucuuuaauagcaaaccgucuguugaugaguaaaugaauuuaaauaacguggucuguacacacugggauguuaacauaagaaccgcucuuuagaacucagcugccuagaagaggaguugguguugacuguuuagggguuggguuuuuguuuuuguuuuuguuuuuauuguuuuaguuucugagacagaaucucacuauuuaaccuugacuggccuagaucuuacuaugaggaccagacuguccuugaacucagagauccaccugucuuugccuucuaagugcugagaucuaagcugugcacacuccagcugaccuaggacuuagacguuucucuuuggucucacuugccuuuaaaggagccugccaccagacaguccucauugggauucugcuauuccauagccuuccuuagagagacuguauuuuagacuaauuuucaaauuuuauuuuuuaacucuuccaaugcaaaucuaaauguauuagucucucuaaaaacauuuuguguguuuuaauuucuaaaugcauccagagaaggagaaaaaugacuuuaauuguugagaaaaauguauuaccguuugccuccccugcccccaugucauauuuccucccuucuccaugaaaauuccugaacucaguuuuuaagucuugaaaauaacauuccauaccuuuaguacagaagaaaaaaugaguuguugugucucccaggggccuccacaaugagccucagaccugcccccacagugugacacagucuuuccauauacuuucaaauuugacagaacuuucuaccuuggccaacuuggaauauuaacagacaauaaguaacuuuauuucaauuucuucuaucaauaguauaaauacuucaugugcucuugagugcuggugucuuugaggucagagucguugaauccucuggagcuggagucacaggugauuuguggcugccugauuuugguugcuaagaauugaacucguucuuuguuuaugaucucaaccauugagcuaguucucuaggcuccaauaaaaauauuuuaauuuaaaguagucugucagaagcauaaaugcuaaaauuuauguagcauaaaagagaagaaucugcuaauguauaugaauuaauguacauuguauggaaguauaaaaauguuaaugccauuuuaauugaagaucuugaucuccuuuaucacuuauagagcuguagcauccucuagugguauuaaagauaacugcacaaaaccucauuccauucaggcauaguuauuucuaacguugauauugcaaagggucauaauaacuuauuaguaggcaguacucuugcuuuaaguuuuucuauuuucuuuuuuccaguaauuuccauuaguauuugccuauuauauuguaugucuaaaaacugguuuuugaugguuuaguuuuuuuaagauuucuauuuuauguauaugaguguuuugcucuauguaugucuguguacugcauguaugccuggugcuugugggggucaucagauggugucagaugcccugccacaggaauuagagauaguugugagccaacauguggguccucuacagaagcggcaaguggucuccacugcugcaucaucucuccagcucuacuuccuauuuaauuuuauuugcagauuauaauacaaugacucaugccacuuucccuugcuuucuaagacgucuuuuguugcccuuauguacauauuacuuuuaugugugucccuugcgcgcgcagccugugaaugccugcaggaauuguucucuguuuccaccacuugccuucuggguauugaaguaaaggcaucucuguuuaccuugagucgguucuugguggugggggaaccugggagaaugaaacggacuacagucucgugcuagccagccgcacucagagcaucacacauuucauacucggagugauuuaccuccuuaaccuugauuguuuuuuaauuggugauaauuagauuggacguuagcauugucuuuuuuguguugauauuagcuaauuuucauuuugccauguguagauaauagaacauaauuugauuguuuuuuuaaauaaguuuuuuuuaauagaaauuacaccauuccuagguaaaaagauguaaaagagaauccugccuccuuccccagugccacuugccuagguccuauuucugagccagccucuguucucuagauucugggaauauuuucuauauucauaggcaaaugcauguauauauuuucauucguuguuuuguuguauugaaccuggguuucuguguggccugggagucauaaucucccaagugcacacacgaccacaugcccaccuguacuaugccuguauguuuacucaacaguguaguagaacacuauagauaggcguugacucuugauggugguuuacaacuuauacucuagaaucagacagccuuaauucaggucccauccucgccaguaaccacuugcucugugcuucuuauuucgugggcacagugagggcugaaugugcugagaacacaguccgcccaugagcugcagucuggcccuggcccgugguuucuucuucaguagcucagcugucuacuuaucccgcuugcucguuaacucacuaccaucacguguaguaccaucagcuguacuuuuacuuuagguacuugcuacagccaagagacaauggaaacaaaucaucuaaaaccgaugaccugggaucucuucuguuaacucucugcuauacagaagacugcgugcuuccaucagaguacuauggaccgcugaaaacuuugcugcuaaagucaccagauguucagguacuuuaaaaaucuuuuuuuuuccccaaguguuuugugauuuguucuggauuuguauauagguacaaagcuucaagggauaaacccagaaaaacggucagcuucauccguccacaugucggaggagcccuuguggucagcucugggaacuacuuuaaaaaucuuauaugauccccaaguggggcagucucuggauggucguuccuucagucucugcucugaacuuggucagacugccccacuuggggauccaugccauaaacaaacccaggcacuauggcagaugccaaaaagagcuugcugacaggagccugauauagcucucuccugagaggcucugccagugccuggcaaauacagaaguggauacucacagucauccauuggauggagcacaggauccacaaugaaggagcuagagaaaguacccaaggagcuaaagggguuuucagccccauaggaagagcaacaauaugaacuaaccaguacccccagagcucccugggacuaagccaccaaucaaagaaaacacauggugggacucaugucucuagcugcauauguagcagaggauggccuagucagucaucaaugggaggagaggcccuagguccugugaagauuauaugccccaguauaggggaaugccagagccagaaaugggaguggguggguuggugagcagggggaggggggagggaauagggaauuuuuggaaaggaaacuagcaaauuucauuugaaauuaaaauaucuaauaaaaaaaaagaaauuaaaaaaaucuuacaugaaaaggcuaaacuaauucugcaaaugauaaaagauuucauagugucagcucuuacagagugcuguguauuugauuucucugaaccugaauacugaugugcuucaaaucuuaucucugauuauaauuuagaaaacuaaauacuaucuuaccucugaucaguuauaauuaaugaguguguuuaaauuucauccacagguuagugauuacgcaugcaaccaugguuccuugauucuguccuuguuuuuaccuucuuuauccuagccaguauccgccucagcugcuuauauuuugggugaaauaugucaagaucaaaaggaugcuguuuugccccuuguacgacuguugcugcaucacaauaaacuugucccuuuuaucacugcgguggccgagcuggacuugaaggauacuccguaagaacuguauuucauuaaauguuuaaacuucaauuugccagauuguuuuuauagucucaguucuuuuguauugaccaaguuuacuauacacuagguuaaaaagaaucgcuuagucaguaacaaaagacaguucuuagaguuaccaaacagaauccggcugaccguaagaaccaguuaugcagacauguguauaagucaguggugccauuuccuuuguuacuauuacugaucuuugcuccuggaugcagugauucacaugucacagcaacagcucucuaucacgguuguuacacuguaggcacacguagagcguugugaagagcggucagugccuuuccauuuccaucgcagugagacaacaccaucaucuuaugcacacagacccacacuacaccaucaucuuaugcacacagacccacacuacaccaucaucuuaugcacacagacccacacuacaccaucaucuuaugcacacagacccacacuacaccaucaucuuaugcacacagacccacacuacaccaucaucuuaugcacacagaccacacuacaccaucaucuuaugcacacagacccacacuacaccaucaucuuaugcacacagacccacacuacaccaucaucuuaugcacacagacccacacuacaccaucaucuuaugcacacagacccacacuacauuuuuuuuacauucauaaacauaguuuugauagguuuagaaauucuaauggcagcaaacauugcuguuaauaguaguaaagguuacuaaaauuguguauauguucaaagucaaauuauuacuguuugaaacuuuucuucuuuuugcugucaaugguuuuugucucuuucuauuucagagaugccaacgcaauauuuagaggaaacucccuggcuacccagugucugacugagaugaugaagauagugggagggcacuaccugaaagucacgcugaagcccguucuagaugagguacagaguagaccucacaggcagagccugugaccagcuagagcagccuucucaacuuguauguccugaaaagcccuuucacagaucaucugaggcgucugcgugucagauguuuacgucaugauucguaaccacagcuaaauacaguuaugaaguaacagaaagaguaaccuuacgcaggggucaccccaacaugcggagcuguaggagagggccccagcaguaggaaggcugagagccacugcaguagagcuucucuuuuaagaaguaauguguugauuaaaagggucuguccauucaugggcuacuggaggaauagguguagacacuuuguaaguaaauuucuuugcccucuguggauucauucuuacucacaagacacacugaucuacauuauuguuuguuagauuuuuuuuuaacuaggauuuugauauaguucuuugggaaauuguuuaugcugcuuuaaguuaucuucagguggaagcuuuaaauuuuguuagauuuauuuuuuauaauaucagaagaagaagaauuauauucauguuguuaaaucaccuaggaaagaagaguaacugagaaauacuuguauauuccagauaugugaauccucgaaauccugugaaauagauccuguuaaguugaaagagggagauaauguagagaauaauaagguaugauuauacagugucauuuauaucuacauuaauuuuuaucuucaugugauaccugucucccauaaaugguuuauuuuauuuucuauguaugaguguuuugucugcauguaugucagugugccauaugugugccugguaccuguggaagucagaagagggcauugaaucaucugggaauagaguugaggugguuauaaaccauuaugugggugcuaaaaucaaacccagguccucugcaagcacauaagugcuguuaaccacuuagccaccucucuacccuccaacauauacucuuaaacugugcuucuugugaaaauuacucauauauucauucauuugucuagaaagucugaauuuaacuuaauaaauuaaccuuaauguugaucggccuuuaaccugaguugggacuagaagcaggagacucgagagucaucuucuaauaagucucauacccauuauuuguucucaugaagauauugaagcugugugacaaucagaaucuuaguguuuacuuuguuaaaaccugcaggagaaucuguacuacuauguggacaaaguauucaauacaaucguaggaucaagugugagcugccccacugugaugugugauauuuuuuauucucugaggcaaauggcugcuaagaaauuuccuaguaagugccuugguauacuuaaucacauuuucuuuuucuauuuuuuucuccaugcugcucauuugguuugugugaaauacuugugcauagguacaaucuucugaguuuuucaaaauggugcuagcuucuuugugagauuuaaugauuuauuuuuucuagaaucucaaaacaugcaauucacuuuauuucaauauaauggcaacuauauaaagagcuaaucaaaaucauuaguuuuaagaagggacaguuugcaucuguacaguuuucuauaauauguaaggaaaucuuuaugugucguauaguuaacagauuguagaauaaacccguguguaccagcuauuuuuuccaguugcagauuuucaaacaguaguaauugguaguuuuauacaauugacuagauuugacagcuugaagauacuaagaugucuguggugagaugucuuuucagaaauagucuuuggcuuuacaaauacuugucccacaauccauaggaugaucuugcuucagguuuugcaaaaauaucuauauuaagauuuugcuuggaaaggcuuuauaaaguuaugagaucuacuucuuauuguuagcacuuggaaauacucaaaauuuuaguucauuucuguuacauaaaugaauuugccaaaacucauugcagaucugcccauaacacagacaaggcaacuauuuacaauaauaaucagguuuaucuaucugcauaagacuguaaauuaacuuucuuagccauccaacgagauuuuguuauuucauuaugcuuccauucgucagacccuuuauuuaauucacccauacuaacugcuacaugaauucggguuuuggucucuuggcuaauuacaauaaagagauaaaacauuuagcuuuaaauaaauauaucuagucuucauaaucaauaaaggaggcagagacuugauuuugcauacauaaagaugaaauagcaauuagauucuguuuucaaauagugagcuagaucauaaccacuuugccugcuugcuagucugucuuauccuuuacucuuaacauguuugaaaccauuacccauugauuagccaaugaaacugaggucucaguuguuguuacuaccuggagcucugcuacccugcuagcagggcaggcagucauaaugauggacagcuugacaguucccuacugggugauuuguaagacuaaaccccacgucaaauccggagauucuuucccucacugcccuuucucuggcgucugauuguuggguuaguuguugacuccagucugaaacaaguccugacaaugagugaucauugcuacaaguagcuuucaauucaccugcaguuuaugugaaauauugguagcuuuaaaaguacugucucuaccuaauugcuuuuagucuuuaaauuguuggcuuuucuuuuugugacaaguacaugagagaaacaacauaaaagguaauuguggguucauaguuucagaagccucaguccaacacccacaggcuccguuacuuuagucaggccugagacaaggcaaagcacuguuacggcaucuuguagcagagaccgcuugucuccuggcagugaggaggcagagagagggagggaugagccagggccaaaauacacccuucaaagacauauccaaaguccucugcuuccgcuaauaagccuccagcuuccacagccccaccaccucguacaacagucuauugcaguuggaauccgucaguguggugaacguugauuagaucgugaucuagucaucucuggaaacauucuuacagaaauacuccagaugguggucuacuggucuuguaggcauuuuucaucuaaugaacugaauaaucaagacuaaccauaauauagccuuagacaccaugaagauuuuuagggugaauuuaaaacaaaaauauaaaacugaaagcuaguuuuugguauucaguguugucacuagguaguacuacguagggcuuuaauguuacuuuuuuuaaaaauaauuucaagaaucuuuuauaucaagaagcuauuuuucaaauuaaaaguauuucuuuaaaaacagcaacuuugcuuuccguuuguuauuuuaaguuacagcauuuuuuucucuuaguuuagccacagucagcaucauuucacagcucaguuuuuacaaguuauuuuccuuuccuacauaguuuacaugauuuuuuuuuuugcuuucuccucuuugguuuauaaguaguguguuugcaugacguuucccauuuuaucccugcagaucacccucauguucaguacucugcagugagcagcuuugucuuccuucguuucuuugcuguagcgauacucucaccucaugcuuuucauuugcgaccucauuauccaguaaguguuugcuccucucaaagccuuguuccauuuuuauuuauuuuuuguaaaaugaagaagaaauaugccauuuuucuuuuucggugauaagacauuucacaguuggcagaaugcugcuaaguugaugucugcugaugagcagaggggagcacuccucagggccuuucuccggcugcugcacacgggcugcgguccuuaguuacagggagcuggggaugcuggggugguagguggaguuggggcugguuguuagccgacccucuccugguuuauuacagcagcuuauuuuuuauuucuauauucugaggcagacucuuguuccauagcccagauggacccugacucacagucuuccugccucagccucuagaguccaggaguacaggcauucccaccgcuccugguuuacggugguuuaaucauggcaguauuuuaagaucucagaaaugugaaggaaaaugaagaaguuuauuugaaaaguauucaggaaccugacuuacuugguaucuuugugcuuuugcuuucuguucaccuaaguuauaucaaaagaugagacuaaaaugaaguucuguucaguuaccuaaaucuacaucugcguugaauauauaccucuucauauuuuaagguuuccuuuuucuuuuaaccuauuucuaguccuucauauagcauauuuuuagucacucuuuggucuuucucuguuguaaauauuuuauauauacucuugaugcuuuagcugcugcuguguacaguagaauaggaaacauuuagugaugaccuuguucuaagcuuuccuugaaucacuuucuaugucuaacucgcuuaggucuuccuagucacuguaggaguaaauuacuuuauuagccccauauacagguaaggaaaucaccaugcaauaacuucucuaggcucauauaacuaagacaucacauuuggauccuacacaauuuguacuagauucaaaugggacuaguucagucuccacagucuauaagcagacugguauugaaaaucuuuuuuuuuuuuuuuuuaauguaugugaguacacuguugcugucuucagacacaccagaagagggcaucagauaccauuacagaugguugugagccaucauguaguugcugggaauugaacucaggaccucuggaagaguagucagugcucuuaaccgcugagccaucucuccagcccugguguugaaaaucuuacagcaaccacugucacagugcucagugcuggagacauaugcagccuuaauugacauucccuacuucaauguacccaugguccaucuaguagugcaguguagggaaaacuuaggggcaaaacuggcuucugaauguucacuuccccuccgaauagccucacaguguuagcugagagccaugcugcaguggcagaagauggauguucuguguagccuguauccuuuuguucauggagaacccuucuguggcuguguuaacuaaagcuggaaugaccuggggcagugagagcuugccagccacauucuauacagaaguagaacucccaccucuccacuuguggcucugcuuguauucagacuuggaauuccuagauggaauuugaagaaaaucccucuaacacaaacacuuuuaggucacuuuucacgcaacuuuauuauuuaaaguuuucuuuuuguuguuauuugcccccauccccaauaccucagcaucuccauccagucuuuagccauaauucuucauuuuaaagaaaauuugaaguagugggaauagagacaauaugacauuugacauuggugcuguagggaugagcauagcugccuucuauuaagguagaacuauugcaucaguuuaaagccagcacaugauuagccaaguaaaaaguaauaguaagcacugcuguacaggccgagaauacagagcaaucccagacucugauggcuucaucaggaacuggaaguuacaaaguaauacaggugcagaauugaucaaaugcuacugaauuuuauguuuagaaauccuuuuaauucuaagaaacuaauuauagaagauguuuuagaguagacaagaaagaauaaagaacagguagcuaaauaaucauagcaagggcaggagaucugagcggugcuugcugacagucaagggaugugugcacacacauguauaaaaacuguuuugaaaacauuaguuuaguaaaaaugaaggcaugggcuggagaguuggcuccgcgguuaagagcauuaacuguacuuccagagguccugaguucaauucccagcaaccacaugguggcucacaaccaucuguaaugagaucagaugcccucuacuggugugucugagaacagcaacagugcucacauacacaaaauaaauaaaucuuaagaaagaaagaaaagaagaagaaagggugagcuggauugauggcucagcaguuaagaaggcauacugcucuuucuaagccccuaacuucaguucccagcaccacgucaggcagcucacggcccucaguaacaccuauucuagagggucugaccccucuucugagcucuggggacgugcacccugugugcacauaccuacacacagauacacauaugcagauaaaaaauaagguuuuaaaauaauguaaauaaugagauggacuaagggcugggacuagagcucaauguucagucauuugccaagcauuugugaggcccuacauucaauuccuagggcuguaagaaaggaaaaaaaacggaaaccuucacuugaaccuccuuggugauuguuguguguuuuuuuuuuaaauacagauuauguaaacauugauuuuguaaaccaauguugaaauuucaaaaggaaaaucauuagaugauucuuauuaaaucccucauucuuccuugauuaucccuuugaaggcccuccugcugaagaccucuuuuacccauugguuuacuuucugucuguuguauauaccuguaauacccugugcacucucucucccucucauggcauuuucuauucuggcuaguaacaucuguguauaacagaucucugcauacagacugccaggaucuccagaacaagggaggaccuuuuccuaauauguguauccaaagcaugugguagugucuaagacagucacaugaucaguuuaauuaauaaaaaugauaguugagagaaggaacucaucaagugagucuuuucuuaauggagaaacagauucaugguuuaaauacaggggaagaggcaggcacucgaaaagagggcuugcugccuccaggucagaauccuagaggauucuaagcaaagguguaagauuagaaccgagcagcugcucuuuugaaagauaacagcaaacuugggacauuaguuuuuuuguagaccaaagacagucaaauggcaccaaugaaaaacaagagaaugugugcugaguuacuuugaauuaaaaaguuuaacauuuugguugacuuuaauaauuguuacauaguguuugcugaguuguguacuggaagccaggugaggaagguccuggguauacagugaugggaaauuuuuauuacaguuugcauguauacaguaacgagucaaagcagccgagugacgugguacuacaguagccacgguuaugugggucaaagcagccgagugacaugguacuacaguagccacaguuauaugggucuaagccagccuuggugaccugacacugaauaaaaugagcucuguucccucuugcuaguucaaaaaaagaauaaccuaaaacacugaauuuaaaaaccacguuuaagcccggcaguggugacacacaccuuuaauuucggcacugaggaggcacagguaggcagaucuguguucagggccagaauggucuacagaaagaguuccaggacagccagggcuacacugagaaaccuuguuucaaaaaaucaagaaaacaaacaaaucaacaaguuuaaauggagaagucuugugaaauucaauucaaacuuaauguucccggaacuucuaaagaauguuaacucucuucccagguagagcuguagugggguucucuuacagguagaacagagucccaggugcuccaucugaagucauuuuuagauaaccauaauuuauaacuuuuaccagauauaucauaauggucauauaccagauauuccuucuccggauuuccucauuucuuggucauuucuuccccacuacauucauugccugcuuuuaauaugagauauugaaagauaaaacaguauuaacuauaauaauuguauuuuccuugauaugucuuuugauaauauuguuuacugugguaagauaguugguuauguagacauguaggucaguaagacucaugagcgaacuguguucuguccauuuauuauauguacuuuaauguaaauuacacuacuaucagguagacagaccugaaagauaacguggcuaacagacccaaacaguuaccuuccaguacguucuuaugugagugggugacuccauuuccuggucugaauuuguauucucccucugcucccaugaugggaacaguugauugcagaagucuuacguguucuuugaauaugcuuagaaguagacugggcacagaaaguuggaaacaccucuaaguuagaaaaaaaaaauagguaucucugauauuccaaaaauaaauagauuuggagugugauccagucuuucgacuacacaaagcccuuagauacaguugauuacauuauguuuuucuuuuuuucuaaguccuuaguauugucuuuaaagauugauuuauuuauguuauguguaugaguaccacauuauguuuuucaaagggaacaagucauuaaguguuuaaucucugacuuuuuuuuaaugguacugagaauggaauugaaaggucacgcaugcuaggcaagcauuccaccacugagcuguucuaccggcccucuuuacucuuuauacugaggcaaagcagucucauucgguugccuggacuggauuuucucuguagcuuuaacagaccugaguuugcaguccuucugucugagccucccaaggaauugagaucguagaccuacaccaccaacuucuuucauugucucccaacccaaguucuauaaguugucuuaggcuuggcugcaucuuaacuaucuuuguuugaaugaacauuuuuagccauuauuuuagagccauauagcccauucacucuauucugcuuuuuauauaaacucaacuucuugaaaacuuaagaauuuugaucauucuuaccuuuucuaggauacacagacaguuaggacauugacucucaucucaaaaaccauucagauuauuggaaacuggggaugucaguccagaaaaaaggugaguuuauaacuguuuccucuuugcauacuuaacaaauuuuauuauauacuaagauuccuucuucacuuacuuccuuacauguuaaaaauaaaacugaagagaauacauauucacaugcaauaauggucuuuuaguggguguucuacuguagucaccuuuugaaggagacggugauacuuaaccugauauacccgugguagggaaaaaacuaggaagaagacacaggcacagcugaguuaugugguggucugugccauagucaccuaacagcacuggaagaagccuucagcuccaggauggaugauucauggagacauggacagcuuuauccuuagcuucaaaauacaggcccgucauugucuuguguucuaccucagagcuucauaaacuugucacucaugaagccguuuacuuaagaaacuuaugcaaccuuacguauaaaaaucaaacauuuacugauaauaacuuacuuuagcauuuugaaguccucagcucccagugcugaggaguuuuuucuuccauuugcuuuugcaacugcuuucuuggggcuuuucccuaguuuaagaccuagaaggaaaaggucaaacagugacugccaguucaaagcuauaugcaggcucugagggauauucacugcuccucgguuccucucucaccaagaauguucaucaaagaagggagaagagccaggcucagaucaauaaaguaacugcaggucacugacucuacaaaaaaaaaaaaaaggcuuugcuggcacccugcaucuggcccagcaugagguaucuuuggcuaucagcagcuggaaucaacagaaugugaauggagccugaucauguucagggagaggcugagcaugauaucccaugugcuguguggggaaggcuaaagaccaugagugugugguagccaugauccuggaacauucuggguucgcugacuuggaggaaugcucucuaggagagcucugaacaagauggugaauguggcugugaguucccagcccgccugcugucccacauggagaagaguugaagaagcucucuauaguugcuucugagccacgaucuggccuacuacacagaugaggcagcacucuuggcccucuggcugcagaccuggcuccuuaaggcacccaagugaauugccaugaguaauuaugacugauuagccaagaggagagacaccaccuuacuugcuaccugacaugaaugaaaucugcggaucccagaggauuggggaaccagaagagauugugccgcgcuuucccggaguuggcucuuaucaguggggagaaccgcauaguggccagcuacuucccuacucugaagaaaguagacuugagcucaucuggggaaacaaagcaguugguauggaagcuggaagccuuaagaggaaguacuuugccuugcccuggaaaccugccuaggacacggcugguaugaagagccaacaaacacacaaagaaaagcuaggauugggugaccuacacuugcucugaucuacuaacuaaccuguauuagguaccuuuauuauguauaacaagaggaguuagcugaucuuaaugggaagucucuguaggacacagucucaggcaguacuuccugaaggaggaaguuguauuugcuaguuucuggucccaguaaauggaagguuuugccauuuacaggggucugaggcaacuacaguccuugacagggcuauguucuugccaucaguccacauucacccugugcuucaucugauccccacacuagaguguuguaaguuccagguucuauagggaaaauuuaugaaguuguucacaauuuuucauuugugauaaauacauuugaacacuccuaagcugggcccauuccuguguggcuggugggagcagccccugugagcuggaggccucacccuuaucacugucucucacgucucaggaucuuucuuucccucccugccuucuuccuuucccuugagacuagaaaucaaagggcugggcuguauguaccucagugggagagcccuuaucuuuuauaaaucagaccauagguucaguccccacuacuaccauuuuuaaaacaaaaaagaaaccagacauugggcugcauagcuuccauccagaucugcaucccuccuguguuuacucugagccucuggagagccaugagcuuccaggaggcccuuguuuuggauucacaguugcacuugucaggagacccccagguagauuuuuauuucuuacuugguccuuuagaccuuggaguaaugauggcucuauaccuuauuguaugcuaguuaaaccuauccaugcauuuguaaguacuuuucaaauucucuguuacauuuuucauuuugucauauaauaauaauacaaauuuauauaugcaauguuuuaauacauauuuacauuguauauuggucagauauuuuaaaccacucuuuguauauauaauuuuaccacuuauuaaagacaaaauacaaauuugcauacuaacgagaaggauauacuuguuuauguuuacauaaauaaauacuaguugaauauuuagaguugaguauauagagcaucuucaguguuuuucagaguugauuguauuuugauuuuguaaucauucaguuuacauaaacauauaguacaaaauggcagaaguauauuuaaggccauuuuuuaaauuguuggaaauuuuguccuaaucucaagcuagaauuuacuuaguguuucuuugguuuuugguugguugguuugggauuuauuuguuuguuuagugaaacuuaagucagcaacauaagcaauuaaagucaaacauucuaauaaaauccaaaacuacuaauugauacaugcugacuaaugaugugggagaauauuguagguuuuuguuucuguaauuaagccauuauguuuuuguuagagcaaaagccuucaugucuaguaaaaauagcucaguuccuaguauacgguggcccagugcuuugcgcugaggccuucagggcagcagugacuggggaugugugauguauuggcaugcagagugcaaagcaugcgugcgguaccaugcagcagaaacaccucagaguuggacauguuugauuuugaacuaguucuuguuguuugugucuuuagaaaccuuuauuguugauaaguuucucaugaccacaugugagacacgacuaauaauuuaagaacugugcguauuuaacauacacaaauccuguauuuguuuucucauagucacgguucaaaaagucagucaugugugaauuucucaaaauguuucaagaagaaagauauuuuacagaugugaaaaagguaugguucuuucuugucaucuaguuuaaagaaaucaacaucucauauucuuccaaagaguccauuuccagcuuuaaaaaaauaaaaucauguugaaacugucaaccaugaagucuuuuuuggguuggagagauggcuuagagguuuaaagcacugacugcucuuccagagguccugaguucaauucccagcaaccacauggugacucacaaccaucuguaaugggauccgaugcccucuuuuggcaccuagggcauguaugcuggcagaacacuguguacauaauaaguaaagaaaucuuuuuuuuuuuuuaaaggucuuuuucuuccaauucuaucaaauaaagcugugagauuaagcaagucuuaacaauaacuacuguaagccuuaacucuauaaauacagauuucuaugcaacacuauugacauuuggggcuagguaguuauugauuuugcaucguaggauauauggcaacauccaucaauuaaaugucaauggcauauacccaguuuugaaggccagaaaugcuuuuagcuauuacuaaauagauguccccuggaggauggaacuggcuuuguuaagaaccuuuguucuaggacuaaagccuaguagagcuuguuauguaguagaguggguacucacuugccauagcaaagcaaaaugggucaccaggauggcucagcagguaaagggacuucuuagaggaccuuauugcuggggucacagugauuggaaggaggguaccagcucccauaguuguccuccaaccuccaugugugugcugagacacacacauucacauaaagucagaaaaaaauguaaaacaguguuuucaauauaaugaguaugcaugguaguaacuggaaaaaaauaaguaaaaauaaaaauauauaaaugccuacagcauaaaaugucgauauaagaccuacaauauguaaaaaggagugugacuagaaacugagaagucuuuuuaagucuuuaauuuuuugguccuuaacuuguuauucauucacauaaaauacauuauuauaacccugaaaaacuuggaacaaaaaauuaucuuaggauauagcuaaacuaaacuugaagaaaguaauguuucguuaucacaauccuaacuuagugaaccaaguuagcaaggcuagucuuaaagccuguugaguuucuauacaugauuuagcuguugauggccaagaacauuuuuacugaaguaccuguuuagacugaagacauacuuucucgaagacucuaugagugaaaaugcucccaucagauagggcuugguuuuguuuuauuuuuacagagucucaguauauagccuuggcuauccuaguucuuaguauguagacccggcuggccucaaacucacagguagccaccugccucuaccuccuaagugcugaaacuaaugguguacaccacuaugcugaaccuaaauuuuuuucuccuuuaguugaaagcuuuugagaaaauuuaauaauaugcuuuuaauuuguaaaauaaaauuacaaguuuuguauacucacaaauagauucuaaccauaguacauuuacugucucauguauaucuguaguccugagguagcauaagauaguuuguccuaaaaucuuaauuaucgccaggcagugguggcacacgccuuuagucccagcacuugggaggcagaggcaggcagauuucugaguucgaggccagccuggucuacagagugaguuccaggacagucagggcuacacagaggaaacccugucuccgggggaaaaaaaaucuugauuaucuuuguguguguccaugugucuuucugucugucuauagaucggaccuaggauuuuacauauccuagacuguucugucuccagccucuauaauuaaggaauuacgaguguccauguaacucauccauacuggcauuuauacuagugacuuuuaagugacucguaacuaaaucauacgcuguugcccacacaguaaaaggaaagguaaccagcagaguucuggauacaaggugguuaugcaguuuggugacagaagcacagcacugugagggagugaagauguuuacagcucuaaguagagugaaucuaaaccagcuccuuaccuacaguuacuuacgucugagugguuucacaucacacauuggcuuuuaucugauacuucuucauauaaugcuaagaagugagauauucaaguagccauuaaacuccacugguggauggcccaucuauuagaacuacagaugagacagcauacuuuguuacuguugucccuggauacuugaaccugcaccaccaagacaaaaaggauucuguucuugguuguucacuuaccaagauucccuuccagcaaacuggaaggaagccucuugagugagugcucuggugggcgaaucacagcacccauagccccagcuugcugcgccuucaguccuguagaggaagcacucgucccuugauguccuucuuauaaaacuaugugcuuuugucguguguauccuaaauccuaaacaaaauaaaguuaaaaacaaaagcgaagacagcaauacaggccagacaacugggagcauaauaucucuuggauaagcagauagauaggauuccucucuaagagggggaggugcuuugugaagugcuguuuccucuuuccacgugcugggaagcccgugacuaguccagcuuacauacucaugaagcuaaaugcuguucacugaguggccuccuguuucuagcaauggaugcuacaaauuuucuugagccacauccuuauauucugcauagaaaauuuguaaauauuuauauuugauuuuagguuagcucauuugucaaggucaccaguuauauauaauagaaaucagcaagcuauuuucuaugaauaaccaaugaaugggagggcuuauugguuacauaagaccaauaaauccuuguacuuguauuaaauaucccccuuugguuccauccaguagucacacacaguauuuauuugucacgauggaaaacacacuguaaaauaguacaugagagcccugugccaguguuugcugcaaaucaaagaugagaguuuuaaaagggaagaaaaauaaaugcuuugagccaggugguggcagcacaugccuuuaaucccagcacuugggaugcagaggaggguagaucucugugaguuugaggccagucuggaccacagaaugaguucuaggccagccaggguaccaaaaauauggauaagggccagauguggugguauaugccagucaucuuagcacugaggaggcugagacaggaagauuacaguguguuugaguucagccucagaaauagugagacccugucucaaaacgaauuacaguuaaggauuauagauugaguuauuucucuagguaaguacauucagaauuugaguaaguuaagaaacaauuuuugccuuuaaucccagcacuuaggaggcagaggcaggcagauuucugaguucgaggccagccuggucuacagagugaguuccaggacagccaggguuauacagagaaacccugucucaaaaaaccagagagagagagagagagagagaaacaauuuuuuagaacgccuuucuuuuguaaauugggaacuuuguauaaccaaauguauuuuauuucauagauuacuauaagaugagccucuuugauccaagaugaucuaagaucugaacuauugcaauauuuaaaacuucuugaguggacaugaugucacaguggaaaauuaaacacuucaucucaagugauaggucacaaacugcagguguaguaaaacaaaaacuauaugaaauuacccuuaggcuauguauaugaauuuuguuuagauaugaguccaguccccaagauaccuuacuauauaugcaaauguuucagaauccuaaaucuaaagcacuuugguucuaagcaagagauuuccaaccugcauauauauauauacuuuaauaauaagaaauucccuaauauaaucagugacaugcaagauaaaaguuuguuuguuuuuuaagacagaguuucuugguauagccuuggcuauccagaaacucauuguagaccaggcugccucaaacucagagaucuaccuaccuuugccucuggagugcuggaauuaaaggugugugcugccaccaccaccugacagauaaaauaauuuuuuauaauauaccuuauuuacucacacacuguaauacuuccccaucuccccauuuaguucuuggaugaaauuucaucuacggaaacuaaagaguccagugguacgagugagccugugcaccugaaagaaggguaauuaacuaaaugagacaugaaaguuauaacucacuguagacaguaaguacaaagaacauggcuuugagaaggaggacaccugaguuuucauucuguuccagagcuuccuaagcggcuucagccagguaaaucacccucacggcccugucugcuccgucuuaggacagcacacgcugacuacacagucccaggcuguucuguaguuaggaaauggcucuguuuccuuaccgaggagugguuguuacuaggaauaaugagauggaaauaacuuuccuggcccuuuuuauucuguauagcacaauucuaaaacgacauuacuuagaagaggagaggugccucacucaugguuaagagagguaguggcuccuguagaggaccuggguucaauucccagcacccauagagcagcucacaacuguuuguaacuccaguuccaagggaucugaugcccucuucagauuuccacaggcaauguacacugugcauagaugucaugcaggcuacgccauuccuaaaaggagaacuaagacagcccugcauugauagaaggacguccugagucauccccagacgucacugcugugcacuaguagccgugcauggccgcgauggcaccuaacagucagggucagcuugguuucagggcagugguuugcaccucugaggguuaaauguuugcuucugucuguuauguuggcagugagauguauaagagagcucaaggaagaacccguauuggaaagaagaacuucaagaaacgaugguucugcuugacgagcagagagcucaccuaccacagacagcaagguagaguugugcuugggcuucguuguggcuuuacucugcugguucauggugccgcggugaucgcugcacaguaaaugguucagagugucugucccacagugacacacaaaacugaacugaaguguuucuuuuaucacauuauguaguauauaauaaaacuauaacguaaaagccugguguaaaccaguuugagaauaaaacaacuggacuugguaaguaagacaguauaacaauacaaagcagaaaggcacagacuuaacagguuaacuaacaaccacaagcacucagcuaaucuguuaacucauggugcucaguagguuuugaagucccaugaaaucugauggguaaauaccaacuaggagagcuucuccuaugaauaccgaaaugaugacauaaaggccugauacaagguacuuugagagaauauagagugcuucauugggaauuccugaauaguagaauaauugagaagagagauauuuuaaagagaugaggucuugacccagaacucugggcuuaagcagucucuugcaucagccucccaaauagcagggacuacuggcaugugugcacaugugcacacacacauaugagcaguuuaaccugaaggaaugaauagacauguauauuccaaguauauuaauaagaaguuuuuuacaguguguugcauuuuaggcaucugcauaguuuguuacaguauauaauauguauacaguauauaaauauguaacuaacgaucaguaggcuuaccuuuguuuuuaaagcugucuuugaauauuucagaauucuaguuuauauuaaauuuuauauaaauauucuuaccuauggauaccauaguuguugauaauguuuauuuuaauagcacaagcacaauuuaaaccaggcauggcgguacauaccucuaauccaggcucuaaacaguggguggaguuauaggacagagacagacagaucuccaugaggucgaagccaaccuggucuacauugugaguccuuaaacagcccagauaacagagagagacugcugcuuaaaaaaacaaucaaacaaaaaacccuaauaauuauaacaacaauagugcaauuaaauaaaauuuaagauaaauuagucaucuucugugaauaaacaaguuauuuguuccucaguuaaaacacuaucuagccaggcggugguggugcacgccuuuaaucccagcacuugggaggcagaggcaggcggauuucuugaguucgaggcuagccuggucuacaaagugaguuucaggacagggcuacacaaagaaacccugucuugaaaagccaaaaaaaaaaaaaaaaaaaacaccaaaacaaaacacuaucuaaucuaacccagcauuccaaagccugcuaguuagaaaguuguugaagucagaugauagucauggugaauuuccugagaaucuuacuauguacauauacacauggaguuugcauaggaauuucauggaccucagaagccucaaguguaccuacaguugucacauuuagccuuuuguucuagccagugaugcuaaaaaaggauggacuuucacagaauuaagcuaguagaacuguaagaauggauguauuagaucuguguugguuuuauguuggaggaaauacacaggauggugagauuauuugccaaagcuuacaguucuaagcaugaauaauuguuguuuuaacuauuuugauggauuuuuuuccaaauuggauuacauccuuuccugcugucuaaaaaagaauucaucgaacauaaguucacauuuucugauuucuugggguggucaugggugauauuacugcauuuuuagagugccaaaggguaggugcagcuguuuuuuccagcugacagccuuuguucccaguuaaacaccucagaagcugcgcuuuuguguccguguguuugcuuuguacaguuuaucucucaccucuuuuagucaggcuguuaucuuaaguuuccuuugcugucagugacgugucucacucccaucccuguagccagccuucaucccuuauggcuaauauacuagggauuaaggugcagauacuauaauugcuaaacuacaccuaagaucuaaggcuucgaaagcagauguaagggcuuucccucauaaauaaaguguccgagcuuuguauuugcugcuugcucagcuuacuucuaucuucuggcuguuuucuugauagccuaaacuagucauuauuuuuuguugcuacagcuacuauauuaaauuuugcuauacaauaaauuuugaggugccgggcgugguggcgcacgccuuuaaucccagugcuugggaggcagaggcaggcggauuucugaguucgaggccagccuggucuacaaagugaguuccaggacagccagggcuacacagagaaacccugucucaaaaaaaaaaaaauuuuuuuuuacauuugguuuggauuuucuauauugauacagauuaaggcuauauuucguuacaacauacuaugaauauauguuucaacucuuguuuaagguguuguaucuaugcaaugcuucaaaaugcaauauuaaguuccauauaaugauccuuaauuuuccucagaacuuuaaaguuauaauacucugaccuauggccauaguaucauaguuccauucuuagcuuaccucagaaaauaaguagaccccuaaccuaguuaguaguuagauggaaaacuacuugggaauaacaggugcuguaggugugugugugcgcauauuuuauuuuuauauauauugcuccauuguuaauagcuuccauuguugcuagugaaaauuuuuauaucugauuauuaaauuucugaugugucucucuggaaacucuuguaacauuucuuuaguaaguuuugcuauuuugugacccauaauuuagaaauuuuuccuuuuucuuuuucuucuauuccugccuaacacuugguauaucuuuccauuuagagacuccuuaucuuuuucuuaagggcauuuagucacuugccaacacuuuuaaguccuaugagucuaagcuuguauuauuguuucuaugucauucuguguuguaguuuuggaaacuucuuggagagaucuuuuguuucuaacucacauuguaauguuaucaugguugacagaaguagccuucauaguguaagaacagauagguagccccuagagcaucuaacauuuguaguauuagaauugguuccaaaugaauaaguacaacuuuagaguauggacauguuguaaauaucuaacagauuuaaagaaagaauauuuuuaaauuaucuggccuccacuguccuguauagcuugguacccaacgcugucucucugucuccuuugucccccagaucauaccucugauucauucccucagauguucucuguauguguagcucugcuuucgaaugcuaauuuuccuaucuauuugguuaccgccuugacaguuugcucaucuuguguucuacaguccauuuaccuaccuuaggguucaguaacauacucacaaugaucauguuaucucauugcacugcccugccacccagcuacagccuugcuucacuagccuguguaguuuggccugauggagcucaucuguuaguuaaccauccugcuaugucugaggcuccagcuccagccugcugugccugcagcucuccuaacuucuccccagcuguggcuuccaucagcauuuccuucggacccuaccuucuguccucgccaauguuaucuugucugcuuuucuuuuguuccuguagaugacugguauuuguugaauguuauuuccacagggaaguucucuaacugcccaaucuagaguaacuuuccauuacauuuugucacaucacuucaguuuaucuucgucacaguguccaucucuaguuaauauugcucuaccagucuuuucagaacucaauacagauuucacuaggaaccuauucccuguuuauuguucugucuuaaauuauuacaauaguaccuggcauauaguagacauucaagauguaucuuuuuaaaaguacaugccaugucuguuugaaucaccuuaaauuuuaggcuuuguaccaggaaagugucugaacaacuauuuuguauuaaugucuuuauuuacagcaaaaacaaaaucacaauuaaccagauacuguucuuugucaaaaaaaaaaaaaaggucacagcauuaauccuuugaauaguguaaaauagaauguuuuuagcuucuuauauuucaacccacacguccuuaaagaaaggcuugaggaagaaguagaaacaaagcuuuguugguguaaaaaugccaucacaaaaugacagaagucaaaacugcauuugucauuagcuucuucuauaacuggaugagggacagauacccaggcuguacugacaugcaucaucuuagaggaggcccuuuaacaaacucaaauucccuuaccuacguuucagauuguaaaggguuagggauuccaucugcuccauaaacucucacauugucucuagcaccuccuaagcaaacuuuguagugucuagcuagugacuggcuaaccggugacagcuguaaauaguuuaaaccaugcuuuggagcuagcaagaugagucagaggguacaggauugacugucaccaagauugauaagcaguccacugucugggacccauaugguagaagaagagaacugauuucugccaguuguccuauaccucuguacaugugcugggguacacgugcagguacauacaugugugcguucgcacacacgacacacacacacacaugcacacauauacacacauacacucaaacacauacacacacacuaaaauaaaauguaauuuuaaaaaaauuuaaacaaggcucauggugcucaugguggcacacgcuuuuaaucccagcacuuacaaggcagaggcagguggaucucuaaauaugaggccagauugguauacaggaugcguuccaggacagccaaaagagacuuugucuggaaggaaggaaggagagagagaggggagagggagaaaagagagaaacuuaagaauucagugcuuuuaaccacuugguuuugcucaguuuccagcaccaacauggcggcuagcagucaucuguaacaucagucucaagauauggaaagcccucuucugacuuuggggggcgggggagagggaauuguuuguuuuauuuuuuugagggcacugggcacacaugugguacacguauauacaugcuggaaaacacauccacaugcauuaggaauagagauguagaucagagcuagagcacuugccuaacaugcaucaugcuuuggguuugguuccuugcacauauacacacacuaaacaaugauguuguugcuguugcuguuguuguuguuuugagggcuaguccuuuaauuaaauguuagguugacaaacagaaaggauucuacuugaauagucauauucacuguggucauagcuccugagccugggccucaaagugggucucugucacuagacacauuaguucuuucagcugccacauaauuaguguugcaaauuuguaauagcauagaaaauaauuguccauauaaagaucaaacuuagaugcuuuuccuugaaaauauuuucauuuauguguuaaaaggcagggacauuccuuuacauuaaacaucaaaauucucuuuccgggcuggagagauggcucagcggguaagagcacuggcugcucuuccagagguccugaguucaaaucccagcaaccacaugguggcucacaaccaucuguaaugagauccgaugcccucuucuggggugucugaagacaacuacaguguacuuauaauuaauuaauuaauuaaucuuuuuuaaaaaaauucucguuccauauuauacauaaaccauccagaagucuauuguggaugcauaugcuucuaucagcuaguggaauuagccuugcagaauuaacaucucaucuuuaugguuauuacaguaauucuuuuaauuuugucgucuuuuauuauuuaggcaaagaugcaauuuacacuauuccaguaaaaaauauucuugcuguggaaaaauuggaagaaggcucuuucaacaagaaaaauguaaguugcauaaauauugaagcauuuuaagucaucagguguacguaauuuugguaucuaccauucaggucucucaauaaugucccaaguuaggccacucagcuggugcaggacccuccaguccccaggaugacaucucuguuccuuagcaucuccucacuaacuugugguucccccagguucuccugcaucugaaauuaccuuuuuguucuuaugcagacaguggccuccucugcacuuguauggcaucugcagucuguauuguucugcuuagccccauuggcuaagaugaucuuugguacugaccugcuuacugcaccaauucauuccgacacauuagcagacauuucuuagccaagcaauccaggucuccuaagugcuuuuucuuuuuguauaguauauguuguuuuuaagguuucucuaacuuuuuauuuuaauuugcaauaaagauguuccaagugauacauacagagaaaacgcuguacauccaagcaaacaacuguguggaagccaaugaguggauagauguccugugcagggugagcagaugcaaccacaacaggcucagcucuuuccaccccucagcguaucucaacggaaacuggcucugcugccaggagacgagugaaagcacaccaggcugcaagccgugcaccgcgugaguaacucaugacugcaugcgggcgugggugugagagcaugacagacgcuauguagaaguagcuggacagaggccgcacggugcugaagacauuucuauaaaccgugucuagaaaggcuuggguuguugcccagugguagagugucucucucaccugacacacacaggggcuuugguuuaauucuaguaccacaaaaauuaaaauacagagaguaaguaaauuucuauagacacaacuguaaguuaguggugcccaggggcuagauugaugcauuguucggugaacaacuauagguuauauauauguuuauugggacuggggagcaguuagugcuuguuguucuuguagaaagaagacucaaguuuaguuccaaaacccaugugacaccagcuccagagcacagaucagauaccgucuucuagccucugcagaggcauguauaggcacgcacgcaugcgcacacacacacacagauauacacauauacauuaaaaauauuuuuuaugauuuuacuucaaaaucuuuuucaagacuugaguccuuaacaaccagaccuugugauccuguugaaguaucucggaaacuaauuucugaagccgcuuuuagaaaauucuaauucuaguuuuagucuugauucauuucuaauguuaacaaagaauuuuuccaaugucuuuaauuuucuucuuaucauagaggcaucccugcagacauccagauagauaucgaugaagacagagaaacagaaagaauuuauucuauuuuuacccucaguuuacuuaagcugcagaaaauggaagguaaacaaaaugaaaccauuaguuuucauuauuaauuucuagguuauuucuuugacuuuuuaaaaaguuaaaaauauuuauagauuuccuguuacugauagugaaguuuacaaacccucaaaggaggcauuaaucuuuaucuauucaugaaauuaaauaauuauucuuuguaaaugugauuguucaguaaauuguuauaauacagucaccugugcucuugucaaagaaacucacuuaaaaacuucaaaguuuuuuaaauuacacuacagauuacacuuguggaauuuaguuuucugaucagagauuucacuguuccuuacagagaccugugggucuauagcuguguaucaggggccacagaaagaaccugguuauucuaaguucaccauugaggauucuguugcaaccuuuaagacaauucagcaaaucaaaagcaccauagagaagcucgaugaaccucaugagaaauacagaaagaaaagaucgaguagugcaaaauacggaagcaaguaagucuccugggcucugcucccgccuaucagggcccgcgcgugcgcgugcgcgugcgcgugcgugccucccccacucccucuccuggucggccgccgcaggccagccauccuuucugucagugcugagcgucaucacugcuuugaaugucguggucaguuguaauucacucugaauaauucauagcuuuuucuuuuuguugucuccuuuauauuucucacaauauguuauauuuauaauaaauacuaaaaaaaaaaaaaaaaaguaagccauaacagugcauagaagcauuugaagguugguuucaagugcuacaucucagaugaagagaaugcgcuggcuaaggacagcagcagcuggcaugccgugggacguguuccucucaggacaccggcagcuggauuccucccaggagccguagcagacucgagggagguuuucagucuccacagugaagaccaagcuaauccaguggguuagugcaucacugagcacugucacugagaugcggucauugucacugggaucaucuaaaucucgccuuucuucuucucaccaucagaggagccacaguagcucagagccccauugucuucuuuaagauaauguuuacagggagaaaaagaaaagacucuuuccucccuagugugaggaaagaaaugugucagcuguaacccuccagcacucucugacacgcagcacucagugugaccagggaccugcuggcaguacaguagauggacuggcaaacaacaguguccuucacggugucugcuggcaaugcagugucugcuccugucauugaugcucauacagccuagcaugguuucauuccuacuuuacagguagaaaauuaaaaugcacaaagauaguguuagugugaggacuccaaguccuugcuacacuauuuuaaauagucuuauguuggucgguacuuuuauauuucugaauaagaaaaaucaauuuuguggauauaaauacauucuuccuugguagaaagcuuggcacauuaugaagguuguauuguaaacaucuuaauucuguauuuucuucuuuaguauaauugaguaucuuccaacaaaaguuaaucuaguuuuccugaaguccuuugaaguuccuagccaaggcuuggccauucuuaaauuguaccuuauaauccaugcauaccauacccugaucaacuuugauuuucucuauuaaaaaauacaaacucagggcuagagagauggcucagcaguuaagagcacugacuguucuuccagggguucugaguucaauucccagcaaccacaugguggcucacacccaucuguaauugggauccaaugcccucuucuggugugucugaagagaacaacaguguacucauauaaaauaaauaaaucuuuuaaaaaaaaaaaagcacucagcugcugauggcacuguugcccacuaccccugcaguguucuucacacacauuuucuuucuuucuugggggagggcgggcuugggcugggaaaguagcuugguauuagugugcuugccugggagcccagggagggcaggcaggcaucagugaacagcaaacccccucuuacacuuccuguaccaucaugugagcugugugcaugcugugucugauuuguucagugcuguaccauuagcuucuagaauagaacuugaaauauaguaagugaucaauaagacuugucagauuaauaaaacaagacucagcaugagcagucaaggaaaauuaaaaguguucaguggguucuguguaugucacauugcuaauuuguguauuucuuuuauuguuuuguagggaaaauccaauuguuggaaaaauaucauaguuugaccaacugauggagaacuggaaaauacucuuuuucaucaaguuuuucaguucaccccguuuuguucauaguauguaagaauggacaucggcuuugaugauacaugcugucugucauaauguauaauauuuaaugauugaaauuaacuguuuggggauccugaugcugauguguguauuacuaaagaauuugaaacccaagauuuccuccauagccaugcauccagccccgugucccugcagcuuccuucugaugggaagggucuuccugaggacccaagcagcuccguaacaagggagcacuugacagcaagaccccaccuccaccuggagcacuccugugucacucaccaccgucagugccuccucugugcugccaacauugaguuuacuauagagcuagaguuccuugucggucagaacuuuccauuaaguucaucuggacguuugucuuuaaaaaaaaaaaaaaggaaaaaaaaaaacccuuuuccucuguuguguuagccauuacagguuagagacagacacagacaucugaacaccuuugaaagcuggcgggugucucuccuggucacaggugagggugcucagcugugaggggaugugugcuccugugugcaccauguuuacauuggagugggggguggugccaagacaguggaccacuaaaguggccuucauuguucagcugucagggacucgcucucuccgagaauucagguuagcacuccuccugagggcagcucuucccaaccagaagagaagcaugagugaguagugaggagaucaccugauguugccuucugucccacaucauaauaaggguguguaaggauacccuccauaguguuagguccugcucuaacuagagaacggucacuuggcgcacuuuaauaaucuggcacauuccagguugugguuuggauacuccguaguaucuauuuuuuugaucaguugaaugaucaguguuuaaauaucaaaccgugcuuuccugaaaauguugauauuguauugcuguuuccuuauugccugcuagccaaaggggaucaggggcagcaacuguugggauaccuguguuuccuuacccuccucuggcccuagaaacccuaccuguaaauaagcaguugaagcgagugucccugaggaggagugauacacucggcuucaucaguauuaaaaccuaugguacuuacuugucuuuuuuaauuaaaacuauuuucugagugugguacuuugaaccuuggucuauuuccauauguuccuguugaaaacugugacuuacugguggaagucucacuagcugcaauccccugucguugagcuuaagcuauaguucaaaauauacuuaccaauuauguuguugcuggguaauuauuuuuacuucauuagcagguauuuuaaagaucauuaacacagagaauugucccauuauaaacgucaugacugaaaauagauuuuuuuacaaaugacuuuuaagucagugcuggccugcauugugcuacgcugugacuccugguccauacugaagcuuaaaagaguccuucaaaucugacagacuuauggaucuaauuaacuauacuguuacagguguuuuuuaaaaacauuagccauuuaauaaauuuaucaugaacuucauauuaaaaugccuacuuagauucucucaaaugucuuccuaaaaaggacaaaacccaggggcauugaaguucaagacucuagagugguuugggaucaucuguucguuguuuuguuuagggguuuuucucccucaccccaccccucaaaaaaggaugauuuccuaaugauuucuucacucuaugucccuggcuggccuagaacucauagaaauccaccugccuccgcuccugagugcggggauuaaauguguaucaccacaucuggcucaccuggucuuucuaauaucaaacuccaauugcaaguauuuuuaaugaucauagggucacaggggccaaagcuguauacauguguaacucugagagcucaauauuguaguucuuuuauucacaugaccuuuuaaacagccagcuugacuggaauuaauuagccagcuugguacaguguaaaaagagaaauacaaaacuaauuuucuuuaguaagucuuuuccaaucagaaacuauguccacagaguccaaggacagucagggcccuucucggggcuucuccuaugcugugcucuugcguacuuagagucuuaccuccauggucuccuuucucugcuucugcaaagagcauuugaaaaaaaaaaacauauauacguacacacacacacacacacacacacacacacaugguuuuuguauauguauauauauauacacacacacacauguauguguauguauauauauauauaugaacagaagaugauaggaggaaacuuagcacagucacucacuagcucugacuccuaguggagcuguauccauccauugagauuauacugaucuguuguuuagcuuucuuuuaaaucaucaccugguaagacacugggcaacagcaaaaguuuugguuuugguuugguuuuuuuuuuuuuuuacucccaggaauauaauuuaucaaaucaaacuauuuugcuuaccaaagaacuauguuuuuaauaucacggguaauagcuaagcaucaaaacugggcucuuauuuuaccaacaagaaacaucaugugacugauggcugggguuugucugugucuccaaggccgaauugcauucuuuuacuggaaaaguucauucaagcuagguuuuagaaaauacauuccuuuuaagugaacacaccuucuaaauugcuuuaaguacuauugaauagccuaaaagauggacuccgcagugcuuucuaguguccccaccuaugugacaaaugcaaaacucauucuagaguuaaaaugacugauuuuugguugauauuaucugcuuccauuuuuaacuugggaauuaauauguugcuaguaaauacugguuuguacggugucuaguuuguaaguguaaguuaucagaccauaauauagugacucuauguuguugagaauguauuuuuauuuaaauuuuauuuucuuaugaagaguauuauaaaaauuaaaagcuuuuguaacugucauuugaaaauaacucaaauaaaguacaagaagccuauc

SEQ ID NO: 5254 - RNA, 1136 nt, Mus musculus
uggggacucaggcggcugcaucagaugagagugagcacuugaguucucuagaaagccuuucuagcuuccccgggugacauccaaucgauguccauucaaacccuccuauguaagguuauuggugcuaaggaggaaggcuaacucccucagagccagaucuuggacaacagaagaaugcuggcauagccagucuccgaagaagaugagcuacaacagcuaaagguugguggcuugccucuaacuuagcaaaagcugucugcguugacuuucuuugccaggaauuccaauagugccuuuuuucuaagugaguuuuucaggcaggcaagaaggaaagauuuuaaaucaacagcccaagcuucaugggguccuagaguuuagcugccaucaauucaucagcguccagcggugcuuaucugaugcacuggugcucacuaagcguuugggagaagaagaagaaagcauugaaggauagaugugaguaggaaaaaugucagcgauguuuagagaaacauguugcuggccaucuuguuuuccaaaccggagagaugcauuaucacuaacucccagaauaguuuaaucuaauaucacuuugcaaaaugauaauggauaaaaagaauagaggaaugacaagcaaaacauagucuguaaugugcauguguaaacaguagugaucauauuucaauauacaaucagaacuucuuccugacuuuagcaaccguuuguucugugucucugccauucuuccaaaggaaauuagcuaagcaagauuuguuucgggucagcaaguggguguuuuggggauaaaugggagcugacgguggaggcgacagaguugacuccaacuaguccauuuggcaucuggaaaaggucagcucaucagaaaugguguguggagaaaauucacuaggcuuccugcugcugagagagcaaaugcucugucuauuuaaucguguaucaaggaaaaauaacucaguucaggagggaaaaagauaaaggaaauauauauauauauauauauauauauacauauauauauauauauauauauccuuuuaguaucagucuuucauauauuucaggucauacagcuacacaauucagguccaacaaguccacuggauggagaagggaaugcu

SEQ ID NO: 5255 - RNA, 760 nt, Mus musculus
cuuuuuuuuuuuuuuuuuuucuuauuuaguuuuuauucauaaucauaaacuuaacuuugcaauccagcuagacuugaaggggaaugaggaaaauauggaacccaaagaacuucagugagagcagagauuacaggacauugcgagcagaugggguagggacgcucuccugagcuacagaaggaaugguuugauggguaaaaugcccgcaagucaaaagaaauuagagcuguccacagucggaaauggugaucuucuugcuggucuugccauuccuggacccaaaacgcuccauggcuuccacaauguucaugccuucuuucaccuucccaaagaccacaugcuugccauccagccauucagucuuggcagugcagauaaaaaacugggaaccguuuguguuugguccagcauuugccauggacaagaugccaggaccuguaugcuuuaggaugaaguucucauccucaaauuucucuccguagauggaccugccgccagugccauuauggcguguaaagucaccacccuggcacaugaauccuggaauaauucugugaaaggaggaacccuuauagccaaauccuuucucuccagugcucagagcucgaaaguuuucugcugucuuuggaacuuugucugcaaacagcucgaaggagacgcggcccaagggcucgucaucggccgugaugucgaagaacacggugggguugaccauggcugcagcaagcggcgaaaagcgacaguggcgucugcaaagccg

SEQ ID NO: 5256 - RNA, 4219 nt, Mus musculus
uguuccaucgcggagaggaguuagagaccuugcauagcuguggucucacuugaaggcacaggggaaagauuucuucuguugaccuucuucuuugaacacuugguuagagcuggggucuucaugggcuucuugaacacuuacaggacauuuuagaggugccccaccgucccggggggccuaguugaccucagaagacaagguaaaauauucuccccuuucaaucccucuaaccacaucagucuaggccuccaaaaauggcgcugaaaccccagaagguugacuacagcaaccugguacuuuuauucauggugugauauuaagauaaagcuggggcaaaauccaaccacuuuaaaauaagcauugcuuugacauacaguuaagcaggguuuugacagcaauauguugaacuuugaccuuagauguguuaauaucguauauaaagccucaucuuuuauauaccuuuaugccacuugcucaaaccuuuauggcuugcuucagacuuuccaacuuuuacccauucuggaaaaaaaaaacaucccaggcauugcaaucuuuaucaauaaucaacaaggccagcugugaugauguuucauaagcaggcacagcuggaauucuaaagucaguaauuguuuggcuuagagcugugguucucaaccuguggguugcaacuccuuuggcaagccuuuaucuccaaaaauauuuacauuaugaaucauaacaguagcaaaauuacaguuaugaaguagaaauaaaauaauuuuaugguugggggaucaccacaacaugaggaacuggguuuuuuuuuuuauuaaaggguugcagcauugggaaaguugagagccacuggcuuagaggcucagagggugcaauaccaccuuaaaacacaguauagucaaaaaauuuucuauuugugcuuugcacaauccagggaaugaugugcuuuggcaaggagcaggcugaggaaagcagaaauaacacaauaaaacaucuucacggggauguuugcaaccucccgcugacucagcgaaggaggcuccguuaaagcugugaggcuggaauucuuggaaagggauguaugucaucaauuggucuucuucuguagccugucaaugucacuguaagugggaagucaaaacagaagcaaggugcccgggacuugaugugaagaagcagacaauaaacacggaguaaaggggucucacgaaggguaaaaacucuaucuucaucagagaaaacuaagcguggagaugccaggcaggaagagaaggcccuaauacaaaccacaguccauccucaucuccagccucccaugcugcaggcugaauccccuuugccuccagcugugggagccaugcucuggcaaucacccuucaguugcucuggcaaucacccuucagugccaguuggaaucugugcuuuuccaugguucucccugggcugcuguaaauguauaggugcuuuccaagucuaguuccuucagugucugcuccguuuuguagcuggcuagugcuggcggcacauagcuggggaaaccuuaaaugcccucugaaagccagcaaauguaucgugcaaaccccaaccaaaacaacccacuguggcgguaagguauugucucccuagucugacgaaaaaaaaaaugcauugaccuuggccaugagaguccaugcuggagucgucucuaggucucccauuuccacgauuccauuaggcauccaggaagguaaaaagaaaaaagaaaaaaaaaauggggaagaggacggggacauggcacaggaaguucuagggauggaggugauugucugaggacucagccuuggcaggaaguuuuauggguggugaagucauuuggucaucuucaucuugaugauguuacuaaccaagauggaggucagauggcaugguuuaugccaucuugaugacaucacucaggauggcagcuaagucacauagcuguuaccaccucgaugaggucacuagucaagaaggugacaaaguaacauaguuacuuuuuuauuguggugugggggaauccaugauaaaaugaccccacccccuaccagggaacuagucucugugggauccauccaucucccagguuaaauauggaugcuacucccuucucuuuaaaacaaucaccagaguuagguuagcacagcuacagggggagauaguccacauggcuugaguauuugggccucaaaagaacaaagcaaauaagcagagggaggaauuccauggucucaaccucaaaaaagggaguccguaugucuuaccaccaguuguaaauagaaaaugccgaguacagucaucuggauccuguuucaauuucuccucugcucauagauaaaggcagggguuagaaaaggaacccaggaaagaagcaaaaggagugcaggugugccuaacacucguagguggcgcuguugcucugggaacauauugagacaacagggaagugaccuuaaugucaauuugucccauccaaacagggcaugggcugagaacacacaaaucugugaccuucuaugcuggcuagaacuuaagacccuuagaaaaccacuuguuaaaaauaguuaacccugacuuaaaacuuugguaaccucgugucuuaguuaggguguccauugcuaugaagagacaccaugaccaaggcaagucuuaugaagacaaacauuuaauuagggcuggcuuacaauugcagagguucaguccauuaucaucauggcaggaagcauggcagccugcagacagacauggcuccagaggagaugagaguucuacaucuugaacugaaggcagccaggagacuacuucuucugcacuggggguggggcaggaggggagcuugagcacuaggagcccucaaagcccaccuacacagugacacacuuccuccaacaagaucacaccuccuaauauugccacuuccugugggccacgccacauucaaacauucacauauucaaaccacaucuuguguaaugcuuuuguguaauuagaggggcacugccuggguaucauaaagucuaccaaaguguagggcuuaaccaaacccaguguuuucucuuccucuaaacauguuucaaagugucccaggcucuccagggaacagucuggggagggcacaaagagagaauccaugucuagagaguggcguugacauagguagguuguugagcuugggucuuggaggucucuuucacauuguucaaucucucccuaauagcaggagagguauagucaacagggugggggaaucucugggccagcuagaggaauugguuucccugucugaaaaaaaaaaucugcuucuccuuuuugauacauuguuucccaucuggguuucgugaguguuaacccuucagagauccuccauccccauaauguagguuucucucacuuugacuuccaaugcuuagucaaucugaucgauuccuuugaagggugguguuugugucaggugcuucuuuuuuuuuuuuuuuuuuucuuauuuaguuuuuauucauaaucauaaacuuaacuuugcaauccagcuagacuugaaggggaaugaggaaaauauggaacccaaagaacuucagugagagcagagauuacaggacauugcgagcagaugggguagggacgcucuccugagcuacagaaggaaugguuugauggguaaaaugcccgcaagucaaaagaaauuagagcuguccacagucggaaauggugaucuucuugcuggucuugccauuccuggacccaaaacgcuccauggcuuccacaauguucaugccuucuuucaccuucccaaagaccacaugcuugccauccagccauucagucuuggcagugcagauaaaaaacugggaaccguuuguguuugguccagcauuugccauggacaagaugccaggaccuguaugcuuuaggaugaaguucucauccucaaauuucucuccguagauggaccugccgccagugccauuauggcguguaaagucaccacccuggcacaugaauccuggaauaauucugugaaaggaggaacccuuauagccaaauccuuucucuccagugcucagagcucgaaaguuuucugcugucuuuggaacuuugucugcaaacagcucgaaggagacgcggcccaagggcucgucaucggccgugaugucgaagaacacggugggguugaccauggcugcagcaagcggcgaaaagcgacaguggcgucugc

SEQ ID NO: 5257 - RNA, 6425 nt, Mus musculus
uauugaucuuuuugccaaguaugagugaucauguucacacaaguuaagugcagacauuaaguacuuuuuuuuuuuugaaaaaaaaaaaaaugauuaccaggaaagacuucuaauggaccuagcuaggucccucuaaccuccugauuuuccacauccaguuucuuguucuaucuagggagcuccuggagaucuuuuguuaccgugccaacagaggagggcccuuucaggagcaccgauguguggcggcgagccagcugagccagccggcuuagaaaaaaauuaacuggagcauggggguguugacugggucuuucucucaaagggcaaagaccuugccucaggccugagccuuagccacauccugggacaugcuuccaugacaagguuccgauccugugaccaacuugggguaggaauggaagucaggaaaggaauaagcccuggaguguuggagcaaaaccaagaucuuaggccaggguuucagggguggggaagggggaagugacagaaaagaagguggggucagugaaagccaggccuagagggcaggcccagucuucacuccuaguagucucgaggaaguucuagcuuuagaaaggaauuuggacuauuuacauuuuugaggauaaauccuucuugcuagugaauggccauuacuauuugccaaucugauaucugaaaaacugaaucuucuggcuuuagcacacguuuuucuuauugagguaaggcgcauauguguuauuucuguuucacucucucuggguaaauugucuguagucuuuguccuuuggggcucuuccuugucuugauucuuuauacauuuuaagcugaggcuagagcuuagggguggagugcuuaucuuguaugcacagagcccuagguuccacucccagcacacagacaccccaaaucgguucccaauuggaagcuacgaagccacugcaguaaguagcauuucuuucccagcucugccgugacuuuugacuucuucugguuuuuccuugcagauuuuauuucuaugucacugaauauccuuaaagucgaagagaaaugaaaacugaagagauauuugcauggcauagcuggugaaucuaauuuuguucgcagcuugccagaaguggcuuaaauucuuuuuaccguccuugcuguggaaaucugaaacauggauucagggugugugucucaaaaacuguggccgucuguaaaggaugucuauaccacacuuuugacauuuuguuguucugcauagaggguuuaucgggcagcccaaaaccaauugggagagcgaguggagcagcgagguugaaagauccuccaucacccugagcaauagaaacugcaggcuuuaguugaaagacagaggugccaaagugaggaaacagacaggaagccucagggguuagucgcuuuccacagggcacagugggaagugaacuuuccccuuaucucuucuaaaucuagauaggcucaacaacuguuaggggcagaugaauggaaggauaagagauguucacaccaauuccuggaguagggagggagaggaaccaggagaaggggaagaaagggggaggggaggagggcgaggggaagcacagagcagcggaccuuagaagaaucgcucaaggucacaccgcgggauggagcugaaagccgaauucaaauccaagcccgggacugcaggacugaaaguucuagauagagccacacaaacgugcucucuucucucuucuugacucagcagcucucgcuuggccacggggcggugggaaucacacuuccugggccuuucuagccgggaguuuggggucccuuguuuuuccuggacuuauuugccgcacuccgggcuuuggcuuccuccucccugcuucccagagcagaauccggagccaccuauucucuccaaguuugucucgcagccaggcugggaaccgugcgcgagcgacucccggacccggcaaucagucuucccugccccagcgucggagacgaacaaucaccaccagcggcugcugagugcuagacgcuuuacucccacagcuccaaaagccacagacgagcagacccccagaaauuaguccucgccacucagaugaggcagcucugcgaaauuggaugaugugcuuggacucacaaggcuaauaacgcuaguuaguaucuaagugcuuucugaaugccagacgcgggucuccgcaccaccccagcaguuccuccaacacucuaguaaaaaagggcacacuaucacccccaucuuauggaugaggaaaccgugguuguggcaccuggcccaaggucaccccagagagugacggauauacgaccggaacauagucgguugagucuggguucaauuuguguguguugucuccacuacagggagagcagcgguuucaaaccuacaguaccagaggcugaccucaacgcaacgcccgaggcugggcgcaaaccaaccaguucggaaugccauaauucacagagacauucccacggaccggaaccagagagucccccaagagcaccgagugugaccgguacuggcggacgaucaccccuuagcaggagcuggagaacacuuaccauaaaagagagggcgagcgccugccugggaggaauccccagcgcuggcagguccgggacucccgggagagaggucugcugccacugccgcccacgcaggggcgcccgagcgaccccgcggaugcuggcugcugcuucucaaccagcggcgcguccucucgacuuguauccggcggcagcgcccucucgcuccgcagggugcccuggaguuagggacguucuuggagaaguugacgcucgggagaggccgccgagguccggucccgaguagugaagugccccacugcgcugaucucagcgagaugcggaagcccuugcccugauggcccuaaagcuuggcgccugaccuggagagcgacgagucccgcgcucagggcacacgggccgcaccucggccgcccguccccggagcaccggguuucuucccuagagcacugagcacacgccgcgagggcugcagugguggccagggcccgggcagcugugcgcucauugccuuccccaggggcugagcgccuuugugcgccgggcgcgccgaccgccagggccagcucuggaugcugcagccgccgccucccccuccuccuccacggccgcucgcuccccgccuucccggccggcccggaggcugcagcugaaagccgauccggcugagcucaucccugaaggccacuaauccaauagccgcggaaggcgcggccgccgggaacgccccuucccccaccaucccgcgccccggccgucccagcucgggccgcugccggcucugccaccuucuggaggccaccagcuggcgggaaagggaaguggaacccucgcccgcgccccugggccgaaguggcgcggacgccauucacucaucugcggacuggcuagccuagacacucgcucacacacgcgcucauucaugcgcauggguccucccccauucauucaagcgugccuagagagccacggugggugucccuaggggcggggaugaagagaggagacaucacggucgccagauagcuuuggagccuguauugaaggccugcgggaaacaacgacugggaaagagaaugcuuuaauauacccccuugccuuaggcacacacauguccacacuuuauuucugaggccagacuccaacucaucuuucagaauccaauuucacgcagcaccugcuccauggugcuuuuccccugaccaccugaggcccgagagaaggaucaucgaucagagggcuaccgagagcgcugaaggauggcggcucccucgguaaccagagcgcagagauaagagggcguggccagagcgagggaugcucuguaccuccaaguuggcuuccuuccaggccagggcauccugcuuuccaugccagaguugacauuagguccauuccauagucuuaacugaccucaccccucagaaaguguccuuuuuuuuccccccauguacacagaagauaagcaccuguaauucagcccugugagggaaauguguugaccaaggcuccaggguaccucucccagacuggggagggcaauuugagaauguuuccuuguggaagugucugcaugaaugagcugcuagaugcagagacaucauagucucaugguagguaccuguaacagccugugguaugacuggagccaaaacaggagguaagaugaaacgagaguagguacuuagggucuuggagagcauccaaagggcuuggcuuuuccccaagaucaguuuggcaggccucuugaccuucacagauuugcuguccagaaagauaauccaguggcaggauggauagauggaugaauagcacuggccagcuuggaagcugcuucagagauccaggcagucaaugaugcuuugucgauuaggacagcucagugguguggcagagggguauucugagcaaguauuuguggcgcucuugguuuuauuugggcugcuucaucuauaucugcaugucugucucuccguaccugugugucucugcucuugggacugcacagaagagcugcugaagggaaugugacccaugcacacauuuccuuguccccccgaguccccucccuccccaggacauuucuggaguacgugcucugaccacggcuguggugcuaacagagcuggacaucgugaaaugagaaccgaggaaaacucagcaaacaggaacuuaagcaagacuuuucaaggacuggagagaugacucagacgguuaaaccaggcaguggguggugcacgccuuuaaccccagcauucacuaggcagaggcagucagaucuuuuaguucaaggccagccuagucuacagaaugaguuccaggacagcuauggcuaccuagagaaacccugugucaaacaaacaaacaaacaaacaaacaaacaaacaaacaaaguacuugcugcucuugcagaggaccaggguucaguucccagcacucacauggugggucacagcuguccagaauaucaguuccagggcaucagaugccuuccucugacuuccaucagcaccaggcauguaaauaacacacauacauucacacaggcaaaguacucauacacuuaaaauaaacccugaaaaaaaaauaccauccccggcugaugguuuuucuaccuggaccccaauacaacugccaacacucauuucuuccuucuuucuggaagacuucacaauagcucuagaacaaggugaggaagggucaagggucacauuuugagaaacugcucccccaaauacauaccugugugccagauaaguucucuacacaagccuuugugacuugccuuggguaucaagaaaugggcacaauggcacccccaaauaucacuaaaguucccccaaaucuuccacccccugaauagcauagguaugguguguccccaaguuugaaaugugaacaaguaucuguucauuccacauaggguaucuaugguggaaauaauuccacccaagccuauuuuggugauccauuaguguuacuuauagaagcacgggaggcacagagauaucacuaaaaagcccaucccgggauggagagcaaguggagcucugugcacagcuagcgaucagaagagccugcaugcuccagcuuuuacaagcucgagaaggagccuugugaaucuuguaacuuucaugagcuuuccgagccuucuaaguuuuauuagcuuccugaguuuuaguuuaaaaaaaaagaagaaaaagaaaaagucuuaguaaaccucucugagagaauguuucaauucagaggaaacaaccgcacaagaagaaggaacaauugccauuugaggaauggccuggaucaccugaccaaauguucuuuaaacugaagcucgaagccuauaaacuggccucugauaaucuuugacccuggauugccacauucugucucccuuccucggaaaugcaggcuagacugccuugcuuuucacaaauagaacacaguaagacagacaugcugucuuucccuccugggauuggauaaggaaaaggcuccaggcucugggcacacaucaucucucuugcucuuuugccuuuugccccccacaaaggaagucagguauuguguggggaaacuuggugaaggauugaggccugcagccauggaacugagcuagguagcacauccccuuccuuggcugagacuuccagucaggcuucgauccuuuugaugucuugaauacauucaagacaccugaaucagagacauaaacuaagccacacugauucucucaacuguggaaaugcuaagaaaaugauugugauuuuuaagcuucugaaucuugggauuuugcuaaucggcaucauauauacaagaaauucuuaacugccaaggaguggaucuaaaauaaaucccugaugaacuca

SEQ ID NO: 5258 - RNA, 63716 nt, Mus musculus
aagaaaaauaagauuguuuaaauucuggccaaacuaaucaagaaaaauucacucucauuaacaaacgaauagauguuaauuagcgagacuuauaagcauuaucaggaugauaacagaaaaccuuuuaucucacuguuaguucuguacaggaaaugugugugauuuuuuuuuuuuccugaaagaacggagggcuaucaacccgauaaggcacccacaacagaaacaugcaacaguccaaucuugcauagugaccccgugagcuucuuggcuuccauacaugacaacagcgaggggcuguuuacaggaugugacgucaaugguagcugcaucgcggaaagauccauccagcauggccgaugacggucagaggaugcaucccucgugcucccugaacagcugaacccagcuucccucugcagcaauuguaacacgugcaacuugugaagcuuguaacuuccguuagcuucuggggcuuguaaguuuuguuaucuggcugaaccucugggagagaauguuuaguuugggggaaacuuaacaacacuccuacagacuccuauguugaaagcuuggcccucacuuguagagcuguuaaggaaggugcuggaacuuugaggagguggagcauagcuggaggaaacagcuuuggaggcaccgccuugggggucauaucuugcucugggccugccugcccuucugcccgcccgcccgcccaugcccaucugucugucuguguuuagcugcuaugagacucugucccacccuagccuucuacggagacgaaagaucccacaauccccacagaccaaaaacaauggagacagaaacccgggcugaaagcuuugaaacugugagccaaaauaaaucuucccuccucucgaguguucuucucagguaaucgucgcaguggugagaaguuaacgcacggcccugugcacagcuuuaggaacagcguugugcauuugauaauacagaagaaaugggaaaaugccucgaaagaucccgaugugcacaacuccauccgcaggaagcagacaucccgagaaacugucuggaaaaaagaauuuaaauucugaguuaaaaauguuuccgcaaaaacuuuccagucccagauggcugcacuuguguuuucuacuaagccuuuauggagaaaauaacgccuggucuacauagauuccuccggaaaaggcagccaggcaggcaggccucccaauucacucggaaagccggagacgugguaagaaaagaaaaacagacuguugugaacacagacgcaaauauccuuuuuaaaauuagcaaauuaggggcugcagggauggcucagcaguugcgcgcaccuguugcucuugcagagaaugcggguuuuguucucagcacccacaaggacccaaucaucuguaacuccagcucccaggccgacacccucuuccagccucugugggcaccaagcacucacguggcacacacacacacacacaaugcaggcaaaacauuuauuuauuuaaaauuaaaauaaucuuuuaaauuagcaaacuuaauuuuaacguguauuuaagaaaauaguaauacaauaaaaccaaguaagauuuaugccaaagagcuggagguagcggcucacgccuuuaaucccagcaccugggaggcagaggcaggaggaucgcuaaguuagaagcuagcccggccuagggagacacugucuccggaaaaacuaacaaaaaaugauuuaugccagaaaugcaaauugagucaacaucaagguucagaaaucaagcaauguaauucagaauaccagcacacuaaaaaagaauucuugauuaucaaggaaaaacauuuaauaaaauucauuucccucuuaaugauuuuuuaaaaccucucagggaaaaagaaacaagaauaaaaguaaacaaaagcaaaauuccccaccugauagugacaccuucuaagauauuuuaaauccacucacaacgcggaugagagacugaaggaucccuccagacaaugggaagagcagaguucagccuuggcauaccuauucaguacuauacuagagauacucguaaguacagucagacugugugugugugugugugugugugugugugugugugugcgcgcgugcauguguuuguguguauguguauauauuuauguguauuguguauguauguuuguguguaugcauguguguauaugugcauauguguguauguauuuguguguaugugcauauguuugugucuguguguauguauguauguguguauauguaugugcauguauauguguguaugcauguauuauauuuguguauauauguauauguuuguguguauguauauguguguauguauauguguguguuuguguguauauguauaugcacguauauguguguauguguauauuauauuuguguauauauacauauguauauguuuguguguaucuauaugugugugucuauguguuuguguguauauguaugugcauguauguguguguaugcauguauuauauuuguguguauauauguacauguuuguguguauguauaugugugucuguauguauauguaugugcauguauauguuuguguaaguauauauauguguauauauguuuguguguaugucuaugugugugugugugucucugucuccaggguuccagacauuccucucucaccucuucacccucauuuccuccucuucacuguggccuguuuuucuuuucuugaggccaucacaguuggccugcugcucucuggccagagcugucccacaccuuccuucuccacccaggagaucccucagcuaccccagcuuuuacauugggaauacuagugacuguccauaucuaaaccucucacuuauggcuucagaucaccuugacugacagaaugaguggaaggcccauuuuccagggaagaagacugaagcccaugccugccacacuaggucacacagcccauccaugagcaagcaaugccagcaucagcugcacgucugucaggagucugguaccugcugaggcaaacggaggcucuggaaccagacaaagcugggccugccucagccucggccaccugccaccugugugauugugggcaauucucuggccuucucugaguuccuguuuccuguguuuugcugggaaugaagcugucugccucacagggcugucaauggcaaucagauguaugaagucugcagcaaucuucuacaaagcgcucauuugauuucuuucuuggugaaggcaaauuugcuuaaugauuuuugugucuuucgucacucauuuggccuugaaacaguaaagccugaguguucaaagucauauaugcguauaaauacacauggaaaaccaccgcuugcaguauuucaaaccagccuuuucccucauuuguuuccauuucuuuuccuccccucauccuccuugucccugcacauaaccacacaccacuccacagguucucccucuacagagagccuaauccugcuacuguaagagucaaggaacuuccuuaaugaaugccccuaaccacaaugcauaauugaugcccagcagggaacacacagacaaccuggaaagagacagaaugagcuguaugugaagcaucgauacacacacacacacacacacacacacacacacacacacacacacgacucugucaggucaguccccauacauggucagaaccacccugugagcaaccauugccaaccugagcucaacagcaagggagggcaagcccaggccacggcggcaaccccugucuuucugucucccacauccuuuuccaugugagcccaucugggcuuggcucugagugagagaggccacaggcauauacaaagcccgagcauccuggacauuguuuuugaaggaggcccucccugcacagcccccaggcuggcagagguggagcaggcuaaacucauguggcagcuggccuuggcucgccggacagauggugaacaaaacguacacacacaaagggggcgagccacauagcucaauucccacagggagcccugccuugcugcccucggaggcacaugguauucuggaagcaauggaauacaaaagggaggggaaauggccauuuguggaaaaauccaauuucuucauuuaaaugccauagccaaaucuucucccacccccaccuggucauagauguggaaacuggcuuacaggaaugcuuaacccacucaggauugaaaccaggacgucuguuucccaaacccuaccaugcuccaucuaauucaccagauuauuucuagauggugaaugguaaacuuauggcuucuuguagauucaaagaaaaggcauaaugcaaaaaguacccugugauaucaaaaguggagacaacuggagccagaugccagacuacuugacucaacucagucacaucguaauagaaaaaaaaauuuaaagauuuguuuaucuuauguauaugaauacacugucacugucuucagacacaccagaagaggguaucagaucugauuacagaugauugugaaucaccuugugguugcugggauuugaacucaggaccuuugaaagagcagucagugcucuuaacugcugagccaucucuccagcacugaaguauuuuuuuuuauuuuacauucuuuuuuuuuaauuagauauuuuccucguuuacauuuucaaugcuaucccaaaggucccccauacccaccccccaauccccuaccccccacucccccuuuuuggcccuggcguuccccuguacuggggcauauaaaguuugcaaguccaaugggucucucuuugcagugauggccaacuaggccaucuuuugauacauaugcagcuaaagacaagagcucccggguacugguuaguucauauuguuguuccaccuauaggguugcaguucccuuuagcuccuuggguaauuucucuagcuccuccauuggcggccgugugacccauccaauagcugacugugaucauccacuucuguguuugcuaggcccggcauagucucacaagagagagcuauaucuggguccuuucagcaaaaucuugcuaaaaagaguuuugacugaguacacuuggacugaagcacagcuaacuugccaggcgcacuggaugaauucgauaaacaccuuuuggugaccuacacaguuuccauguagcagaauacaucagccuccuaguuuuauugcuacaauuauuauugccaguucuaaggcuaccugaugccaggauggggagaagauggugaugcacacauaugcaggcucuaggggacucugaagucugagguccguguccacacaaaaagaagggaugcaauucaccagagagaauggaggaacagcuuccuucaucccagguuugagugacaggaacuugagagagcgcacugagaccucagguaggcaucuucauuuacagacgaggaaguggaggacaggucacggugaagugauagagggaucaagucccuccccuuugguagccauagugagcuguugccugccccacucagccugcugugguuuaggggaagcuguguagcucuagggauggaggacugaccaaguugcccccucacagcuuucaauuccuggaucauagagguacgguuugaugcaagucagccaagggaaaggggauucugggacugaucauauugggagagggaagacccucuuggcuggaaccggggcggggggggggggguuggaagagagguaguggauuuccagaggucaggcuuccugaugaauaaccucagagaccaggggcugagagaucaaugggucaguuggguguggagcuuuucagcaauccaguuugggguuaacucaucaguucucuuuuucuuccauuuucccauuauuuuccugagccuccuucugugcuuuguaaccucaagucaggugggaggucuaaugcauuccucaggcaggcauggcccuugaaggcccaggaaggccuaggaggggcugagcgcaggguguacacacaggcagcuucccaccgcccuggcaggagaguguguccccuaacuuccggaugcucuuccauuuuuccucccgccuccucucaugggcuguuucugcuggagcauuuuaaagugaaccuagauauaucauaucacugcaccuccaacaaaaacuuuuaaaaaauaaacaaaaaaaccccagugagauuggcuuaauaacaucaggugaccugccagugugaacaggggaacuucuccauggucccaccucuacgugaagggcugcggguggccagugucugcugggagagcgagagagaagccauucccuccagggguguuucacaugcaggugucguccaauccugagcugccagcccuggacacaugaauaugagcaacacuaaauguaugcaguagguuguauaucaucauaauaaagaagauaacaggaauuuggaguuugaagggaaagggcacacaaaggauuucagggugggggauggugguacagaugugccacucaugugagggucucaauaaaauagaacuuagcuaacucaauauuuaaaaauuaagaacauuagaaaaugucacaauuguacucucagugaugccuauuaaaaccugucuuuuccagguucauaauucccuuuuugucuucuuaagugucuuucugcuguuggcuuuucuaaaugagaauccuuggucucaugcugucuuuggcgccucccacaucaucugaaucugcauccacagccaauucuacaucacaucucaccccacuauagacugaagaaaccaauccauuucaccugcagaugccccagcccccagaacuugaaggacuguguccccacaccguuuccuaauaugcucuuucacaccuaaaaguggagggaugacugggaggcuugguuuccaucagguuaaaguacgguuucccaggcugcuggguaguuucuguggccucucaccuagaagcacgugacgccagggcagugugcuuuuccaguguuaaggcucauuaaagcucaaggcuucgaucgucuggauguauccaucacugcaugaccucagcuugcuucagaccaugaauggcuguggcucagauccaugauggccuugggacuugcaaaaaguggggguccagggaguucugauucaaccaucuauuagcuaugauuauccuauaaagguaaaauaaccaucaauuauuugauuacuuugggauauagucuacccagugaagucagaaugcauauuucuacucgauucuuucauuuaccuuuucaacaguaaauggggaaaccagaguaaguguucacugucauuuuacagcguguuagacuggagggcagaggagacggcucaguaaguaaaaugcuuccugaacaaccgugagggcccgaguucaagucuucagcaccuacauaaagaaucagacucauccuugugcaccugcaaucucugugcgagggaggcagacggggccccugggcuuuuggccagacaauccugccgaaucagugaacgccagggguuuagugaaagacccuaccucaaaaaauaagguggaguucuuuauaaauuuugguuaucagucuucugucagaugcaggguuggugaagauccuuucucaaucuuggggcucucggagacugcaccacuaacuggagaacauacaugggcuggaccuaggucucuccgcaccuauguagcagguauacagcuuggucuucauguggguccugaacaacuggagugggggcuaccccaaaagcugcugccuguacgagggauauaugggauauguucuucuagcugggcugccuugucuggccucagugggagaggaugugccuagccucagagacuuggugugccaggguaaggugauacccagcuuggagaagaacgggaaggcgggggguggggugggggggaaggcuugugggagggaguaacugagaggugggcugugagagggauauaaagugaauaagagacaaauaauaaauacaaaaagagaaauaauaagguggaaagcaauggaggaagacaccugacgcuggccucuggcuacauguauaaccccccucccccuguauacacaugugauauacauacacuauacacaaggcaagcuaaaaacaaagugucugaaaaccauauguucccauauauucuagucauuauuguuuuugaugcagaagccacuuugucuuuggccaucagaaguguuggccuucuagcugggcuuccaguaugucccguuuaucggcucugguuuucugugcucucuggaugugagcuaucccaaacucuucuuguauauagacgguccugcccuggcccaggaucccgucagccaucuuucccaggagcccagguuucucuggauguaaauggugcuugagggagagaugucccuuaaaaaggauguggugcggaagggaagggcaugagaagcucgcagauuccucacuuagagcuuuacgcaucuacgggaggcagaugcugcaagggacuagacuaugcucaagaguuuggccgcuggcugccccugccggaaaggaucgcagagaagagcccagaaaaaccaaacccagcugucuccgcauccuucccgcagaguugggggccaagagcugacaggugugaggcggguguuuuccuugagacuagcuuccucugcucacugaacugugugcggaacagugcgccgggcuuccugacgggagggcccagcacugcuuauuguuaaguguguaacggggcaggaggaggugaaucuagucagggcuuuggcagggcucuucuuuaaaguucauggugacuccagagaguagguucuauuucugucuuucguguacagacaagaaaaggauagcucagaggcugucacuuggcucaggucagcacacaguggguggaggggccacaauuagaugggaugucucuugaauggcacaggcuuuguucuuugaaaggucaucagcucuccguccugggaggaaggcauuucuucauuaucgacacucugagcaggucauugagaucacuaaaugccaugccaauguccuuccuuccuuuuuuaaucacuccugauuucaucccauagaacaaugcacuucagcugcaagauggcuuuucccagccucuuuuaacaggaggcgggacaaauggaugaacagcagcuguuggauggggcuucuggguaagcuccuuagccagggacagacagcugcaagguaccccuuugcccuccugccauuccuagcuuccugcgcagccugugauggcgacgaccugcgggccagugucaucuuggacccagccuugaaaaugaaagcuugacauuaaagauaagggaacagaggcauaggagccuggguccccagcgacugccggaaccgccgugccagcugcaaucacuuuuccuuggauuucacuuaugagaaagagaaacagaacuccgucuuguuuaaaccacuuauuaggguacuucgcugcagggagauaagcaucagaagccgggcuggagacacuucucggcagccagauugcuuccuaccuugcacgaagcucugguuugaccccaacgccaccguaaagcaggcacagugaugcauacuguaauccaagagcuucggagguggaugguggaaguucagaaggucaaggucauccugggcuacguagagacuuugagcccagccugggaaggcugucuggagugggaguggaggcagaaaaggggaagaaaaaaaaaaaaaaaaccaccaggagcaguagagaaucuagacccucccagauuuuuagccuuccugauaaaaccuccccuuucaugaaaaauaguuuguaggguucucuuuaaucaucuuggaauaaaauuaugcacaguauacucaaauccacaugcagaugccccucgacuuaaaaugggguuauauucugauaaacccaccaauauugcauaaguggaaugcauuuaacacacccaguguugaggacaucaacgccccccaccccaccccccagcacaggagugacaguuuacucucaugauggguggcuggcugugggcucagcucccugccucuuccagcucugccacagcacacuaucacagcucugacugccuggccacggaaagaacccagaaugcaaaaucugcagugcucuuucuauugaaaagguguggcuuuuauaccauugucaaaaaauccccagucuuaucaggagugguggcacacauccuagcaccuaggagacugagccaagaguuugaagaugucguggguuacauagugaaucggaggucaacuaaacuacacacuaaguucaugccaaaauguauuacacaguaagaccuugucucaaaacuaacaacaaccuaaaaucauaggucaugauauucuuaagucaaggugcaucuguaauacuauaauuguaccauaugggagaaauagagaagagucauuugugguaauguaaugcccaaaauuaaccuguaagccccaucugcccaaggaccagguaacuuccuggaaugcuggguguuguagucauuggaaaauagcaaagccucaugggaaaguaggguguccuguaggcuugucuuuauaaacccuuguagcacacaucucaggccauucagcugggaaaugccagagaaugguccugaucaaaguccaucucuuggucaguauuuaauauuuaauaagacaugcugcccccaauggaggagcuagagaaaguauccaaggagcuaaagagauuugcaacccuaucgguggaacaagauuaugaacuaaccaguaccccagagcucuugacucuagcugcauauguaucaaaagaugaccuagucggccaucacuggaaagagaggcccauuggucaggcaaacuuuauaugccccaguacaggggaaugccagggccaaaaaaugggaauggguggguaggggagugggggggagggggugggggacuuuugggauagcauuggaaauguaauugaagaaaauacgcaauaaaaaaaaaaaaaaaaagacaugcuucaaauuuggcccaaaauggugggguugguuuuucucuggagacuaucagaauuaacaguaauauguacuucaguaugugaauguuuggguacaacugggcuaacugccggagcguagcagucagaugcuaagauguaggcaaacucaccccauauaggguuccuccauuucaggaaugaguuauuuuccauuuagauacagagcuaguauugcuauaaguuuugugacuuucugaaaugauaaauguaccgcagaaaacuucagucuaauaagaccaacugcagugauuuaugcuauggggcuacaucuuuugaaaacacgucacagauuagaaacuuacagaaaucucuuccauuuauauagagaacagagguguccaucgagguggauucuggggggaugcuaagaacuccuguuggguaugaggcaggucagcacugcccuguccuugauagacaucccugauggauggcaacucucugaaaucacacaucucugaagccugcagaacaagcucacaacaagaggugugucuccaccuccuccaugccuugugaccuggaucccagcaguggcuuugggaaucugucaucucugcguucccauuugucagaggaggaaggagacacugggaacuugcuggugcuugaacaguuguguuuuugagcugcugaacaauuuaagccccagaccucuaaacgaucuagcacagaauaaauaccauaaucauuaacacgaugucuguuuuauccugacacacaggcagugcuagccacagcuagccagugcuaacacauuuuuucucauaagauucaucaauuagauaaugucaaaucacagucuaaugaggcuuugcugagggaaaaugccuggcacuugcugaucaugacauccuuuggcauauguacggcagcaacugcucauccugagacaugguuuggagugcaggcaccuuguguagucacaugggcagcccuuacugcagggccccaggagcgcaagcucaagcagaagcaguaugcccagcaacugugcuguuccugucagagcucugaccgacccaccuccuuucccucccuuuuuuccuuccuuucuuuucaagaaaggguuucucuguguagcccuggcuuuccuggaacucacuuugcagacccugaaacucagagauccaccugucccugccucccgaguuuuggggaauucaaggugugcccagcucauccuuaucuuucaacauggccugggccaugcagaaguuuugacaggugaacuuauuauacauuauguguauuauauauuauuauguguuuuucuccccuuguccauagaugccaaauaugcaauuaacugacuuaaaugguuucucauuguguguguguguguguguauauauauauauguguguguguguguguguguguguguguguguguguguauacacauuucauuuuccaaucaagaaaaaaugcuuucuugacccauuauccccuuuccaaagcugguuguauuuucuuucucaaaacaagaacggcugagagcacaggaagauugucggguuugaaggaagcuacaucacaggcucucccccacucggggccaugaaggaugcuguagcuuggcucucccucugcgcaucaagccuuugcauagugcuuaucaaguuuuaugcugugagcaguccugugguucccaucaucuaguuuuauagucggggaaacagaaaauaaccucgaguuuccagaggaggugacagacacuggguuugaagaagacaugucggaacugggaaaucaugcgauccaagccaucaguggguuacugguuguuugaaugacuuuguccccuuccauguuucacauggggacaaagaguaacacugccuuguugaguauaguaaugugcugggugccaugggccagauuccuguccuugguauuugucccauuuccuaagaacuccagcacacuguaaauccagacucuuccucaaaauggcacacuggcuagagcuggcucucuccuggguauagugagaguacaguucagugguauuucaccauaugcuccccagaguucuggaacgaaguuccaaaugcuggccagcucugcauggacagcucuaaucagcagauacuugcugaucauaacaaaagggauaaacaagaaaauaacgacugcguucucugcuuccccggggcugugaauagucucggggagugauggauaaagaaggggcugggauggcuacugaaggccugggcucuucucuucugucccaccugccuucaacugaaacccccagggaacgaagaggaaauugcaccaauaaacacaauacuacuuuaaauccuugguuuccugagugacauggcacaguauucugcucaaguccgugugacaucccauccagggaaaaagggagaggaagcaggcacuugucucaguugcaacuagauaagaauuauguugcuuuuaaagauacaguguugaugcuuuguagagcccuuuucugagagcuggggaaucugggaauucuuggcugcuacuucccacacuacaaucucauuccagcugaauuagaacauucauucauagacuggugaguaugccacacagauguggaucuauucaacagugcuaauaguguggggucuugcucauugguuuguuuugggacucagggucucacacugcagggaaggccagccugaagcucaguaugcacgcccuggcugcccucaagccuguggugaucuuuuauacgugcugggcuuacaggcaugagcuaccacaccagccuaauagaaugauaccacuggguaaaugccuaaugguagacauuuuuauucaaacuacauuuaauuggccuuuacuacagaagacuguaauucccuauuuccuuuguguuucagugacuauaauuuaucagacuucugagaucaaugcacgaugcuguccccagguucugcagcuccuggugccugauccugagggcaggaagaaaucuacuagaagaccagauagcagcuccaaaccacacagcaggugcuggcacgcccuagagacguugagagagaacgguaccucucucaggccaguucuaaagccaggaaaacuaggacuaagguggggcauugggacagacauugggauggacauugggacggacagcuuucucugaaucauuuuuuauuaaauuaaaaaaaaaaagaugcccugguaauuaauuauuuucuaauugcuucaggaauuaccaacucuucaaauaucuuacgauaguaccaucgagaugucuagagaacaaagcccuucccacgggagccugacaaccugaccuugauucuugggacccacaguagaaaaagagaacugaaagucgacaucugaccaucacacaugcuguggcacacgugcuugugcacacaucaugugcauguagauauacacauguaaacaauaaauaaaauuagaaauuaaaaauacccuguaauaacaugcuuuuccugugguaucuccucccuccggaacuucaguguaagcauacacacaaaauaagacuguaaguguucugggcgugguggcgcacgccuuuaaucccagcacucgggaggcagaggcaggaggauuucugaguucgaagucagccuggucuacaaagugaguuccaggacagccagagcuauacagagaaacccugucuccaaaaaaccaaaccaaacaaaacaaaagacugugugagucacucuacacaagagcuagccugugcucuagaaaauaucagugucucaagugaaagauugaaagggaucuugcagaaggauaaaacgcugugagcuauaugggauugcaacaggcacgacugaauacguguugaacgaaagggauagcuguacugccugauaccgguuuuccugaacuacaucauuacugcauugugacugaaagagugugcugaucccuaugaaaugaucaaaacaaaaacaaacuaaaaacaaaaacaacaaacaaacuaacaaaaacauagaaggaaacugaguaaaaacacauaaaucugaguaaaaaaugacccucacgcucuaguugccccaauguaagcuuauccuucuagcggauaaaugaauaagacucagacuaugguuauucgauuuggccuugacaauuaucgggggucaccccuggucuacuauuauaacugcuggccuggcuacauccccggugguggaccccagauacuugcuguuucuccuggccaagggcucaugguccaucuccccucauggcugcuuccucuucucucccuguccuuucaucucucuccccucucugcaacuccaauccgguaacuccaacccuguaauugguuguagccauuuuuaucuaaccaauaguuguaaauuaaggaacaagguuugcacaagaaaagcugguaacugugagaauucgcuccuaggcaacuagaccuuccggugagagaccaaaucuuuuaaauucagacuccauuuuaaagaagcugaccuaaguuuaaacgcaggugaacuaacaggcuaguaccuagcaugaguucccauguugccccacaacaaaccccaagccuagcuccagucucuaggcuuacccuccucccccgacccccgcaucuccagguuauucccgcaacaaaucugcaccccagguuauaagcccacccccugcuuaacggccagcaacgcagagggaaaugaaguuuaugauaggacucccagcacagccaauuauguugaaggccacagcagcuuuucaaucagaugcuugcacacuuaccccccacuugcugcuuacuauaacgccuugcccugauagauauucagggaucccuaccaccaaaaccauccuucgugacagcggugcauuagaggggccccgagcuagcuugaauaaagacccugcugugggcugcauuagaucuguguuuuugaggaucacuacucuucccuggcacuacaggauuuucuuuauuuuaaaauaggaaaguaauuauuuuuuuaaagauauagagcuauuccaguuauccauauguuuugggauaaacuguggucguuuauacuuuucaaaaaauugucccauuucauauaauuguaaaaaaaaaaaaaaaaguaccaucgauccaggcuuaggauucccuuauuaucuuuuugagucaaugcagaaucaaucaguagcaaugccauuccucucauuucugguaauuuagccuccucaagauugcuguugcuuucuucucuucuuucuccuccucuuuccccacucugccaccgcuugcugcuuacuauaaaguuuugacccaauagacauucggggcucaucaccaaaacugugugacaggugugcugaagggcccaugcaagcuugaauuaaaaggcccuacugugauugcaucagaugaggccucuggggaguaaggucacuggauauguccuuuuuuuuuuuuucuguugcuggaauaaaucacucugaccuggggcaacuugaaggcagaaagggcuuacuuagccuacagcauauggcccaccguggagggaagucagagcaggcccugaagcagagagcacagaggaccaguuuacuggcucauguucccuggcuugcucaucuagcuugcuuacguaauucaggacuaccugcucaggggugaaucugcccacagaggccugagacuccucuccauccaucagcaaucaagaaaaugccucacagacaugcccacagguuaaucuaauggaaacaguuucucaacagagauuagcuuuucccagguaugucaaguugacaaccaagauuagcuaucacaggguguguuuuuguagggggaugcugggauccugauuccagaugcuaugaagggaguggcuugcuuucuuacccauguacacuugcccagauauucugucuugccauggaaccaagugacggcucucugaagccucuaaaaccaugagccaaaaacacaccuugcuugauacaaagugauuuuucucaggucacugcaauacagggcuguauaauacaacaaacuaccaccaaccuaguggcuuuaaggaacccagacuuacuguuuugucgucaugaaagccaggggucugagaugggccccacuaggcugcauucuuuucuggaaacuccagccuucuuuuuuucuuggccuuuuucagcucccagaauuugccugaauucuuuggcucacggccuccuucaucuaaaaacaccgguaagagcugacugaaucuuucucacaaucucucucugguccugauucuucucucucuuucuucccaauuacaaagacacucgugauugaacuggacuugccuuaguagccccggauaguaucuuagcuuaaggucugcggacuaggagccugaaucacuccuugccauauacacauguccugacauuaggauguggacauccucaaagacucucacuuaagacacaagugugugcugugugcaugcacacacacagaguaaauguaccaagauguuaacaaaugaguuuauaaaugaagggcauagauuaaaaacuucuguagguuugauuuuuuucaagaugcgaagucucauuuggaaaaaggaaacuucucucaaugauggauauuucaagcaagcacaaauauacaaucuauugucugaaauuccaaaguucuuaaaugugaccauuccuccuccuccuauucuuuauaaccccacacuacugggaacuuuacagcccuuuacucuuuugucauggcaacacauuucaccgcagaauggccccagcuuuucucuuaguccacacugcuuccccugcucaugugcuggguggguccugggucaggcacccagauguaaacggggagagauugguuagucaaccugccuaagagacagauagggugcagucagaggauggggaaagaugaggagcuagagagaacggguccccaaaagugcuacacaccaggcuguuucaaugggcagcgugguaaagcauuuagggguuuagagcuucccugaggggggagggggaaucaaggacaaacuacugggggauccagaacccucagcccaguaauaacgggaaaguguggaagcugauccuuccucaauugccucucuccccuccuggcagauccaaugccacuucggagaguccuggaggacccaggguucuagucccuggaaacuaaguggugagugacuauccuauuauuuaauaucugagugaagucugggaguaauuuguuauacagugacagaauagaaaaauauuuucuccugccccagaugacuaucaucaggacuuguuuaccguucucuuggcuuucauuuaucauauugacgggcaccugcuugccuagauacaugguuguguuccucagguuuugaucuuucagccuuggcuuacuuucuguuuaccguuaugaucuacuuuucuuauucaaaaccaggcuccuggaccaagucaggcugcucuuggaguucauucauuuucccucaugugaauuucugcauucuccuguucuuggacagagagaguguuuucaguguuuugcuauggcaaccaggcugcuaugaacauucuugugugacuccuggaacaucugagcuauguuuucucuagggucugugucuaggagcgaaccggccagcuuauaugcuauuagcaucaacuguagaaugcauauuuuucccuguguugauagucucauuuuaggcaacugcagcaccuaagaauuucuuugucccucauccauuugauaucguccuauuagauucugcauuuuugaaagauuuaaaaucacauuucauugcaauuuaacuuguuguuuccuaauugcuaagaugacccccccaacacacauuuauuaugguauauuagguuuuauucuccuguaaaaugcccacuuuugaccuuuguccagauuuuuuuauuggguugccuuuaauggacugauucauagaaguuuuuauguauuccgauucuaucccuugacaguuguauacauugcaaauauuuccaggcuuuggauuagauuuuccuuuuggggaaguauuuugaggaaaagacauucuaaaauuuaauguagacuaaucuaccagucauuuccugucuggcgugcacuuuaauauugagcacagaaaagccuuuuccuccaccaguuuacagggacauuucuccuaugauuucuuacaguuguaaaagguuagccugucacauuuaagucuaacccaccuacagggauagucuaggacaugagguguguaucaauuggcgacgacuauccagauugcuagcuuuucauguggauaaccacagagccaguaccauuuuguuggaugguccagccaguuuuaugcuauuucugacccaaugaaguuucuuuuguuuucuucuccuuuucuuugucaaguguuuuguuauguaguccaggcuggcuucaaucucugaaucuccugcccaggccuuccaagcgcugggacugcaggcauucaccaccacacccaucuuccagucaagauucugcuuuaagcaugugagucuguucuuggcucugccuuaaucuccauuguuuuuucuauauccccauacucaagcccuauggucuuaaauuaucccaaacuuuguaacuacaaugugacccucuccucaccucuggacaagcaucaaggcuguuuaggccuuuuguucuaccguguauuuuggacuuuuaugugugugugaguguauguacacucauaacgccugagugcauguggaggucagaggucaaccucaggaguuacucaagagacuuccacccuuuugaggcagggucucaugauggagaccuaagacuuagugauuaggcuaggcuggcuagccagugaagccaucucccuagugcugggguacuauuuuaaaaccaaggaaaauuuccccuucucuaauuugcaaaguuuugcugaaugcuuuuccaugaggaucauguuuuuucuucauuaaaccucugguauaguaaauuuacacuaauaacuuauuuaacagugauccuggaauucuugggauuaacccaauuuuguuaugacuuacuaucuuuuuucuuuuucuuuucuacaaaauaccaugaauaaagcuggugagauggcuuagugcuuaaagugugcugcggcucuugcugagguccaaauuuugguucccagcacccaugucaaacaguacacaacuuccucuaacuccagguccaggggaucggacucucuccucugacuucugcaaguagcuggauacaugggcacacguguauaacagauacuuuuuugaaugucaugaguuugaggcaugguagaucagauuuguaauccuagcauucaggagacagaagcagauggcuuugagucugaguccagccuggucuacauaaauaguuccuggccagacugaguuagagauccugucucaaaagaaacccgaagaccuuuaaaacgccaggaguagccuguuugcuacgaguccaugaaugcaaucgaccugcagcuuuucucacuuucauaucaagugaaacuaaccagaaagaagagugugcagaggacggccuguuugcuacccucugggaaaauguguaaaucuggagaacagauggcuaaaaccuccagggauacuuguaugugcagacagguauugagaguuuuggugauccuuguaauuuacaauuuuauuaacauuuccacgauuauauaauuaagaugaacugcaucuugcucauuuuuuuccuuuguaacaggaauccaaaaucuagugauugaagcagguuuuacuuuucuugugcaugagcgguggguuguccagaggguugugguagcuccccuaugcuccuggcauccacauuccuuucuuuccauucagucccauagcaugugcuucugacugccuugucacuacuggcuggguagcuucaagcaugauggucucauuccagacaagaugaaguagagagaacaagacgugggcagaguggagagaggcacacuggucuuuauccauugucaaaaccaaggagacaaacacacugaguaugcaucaugcguuugaaaagcgcauaugcauggacuuggacagcuacuaccaagcucuccaacugcucuagccaaggcucagugauuagcagcugaaaagcaagaaugaaauccagugaguagcagcauacaaagaaucagcuucaaagacuaaacaccuaaccaagauaugucugguauguccaggccagagcuguugggaagguacaggaccuagauaggcucaucuacaugugaugccucuggaaaacuucaauuccuacccuagugcucaaaauagguaccagaccaaagaaaucuacuucacagagauggagacaucccuggguccaucagcaugaucggacaggucuuaucuagcuauugcugccaccuaguggccgucuuccuuuaauggaggccgaaaucuaaaugcuaagcaugguagguuccuugaggccaggaaaccacagagaagcuggcgaucaacuuacauuugagaagguucaggaauguguucuaaaggaacuugacuugaauuucauguguguuugauucuuccugccugccucacgaggaccaccauuugugaacuaggaauguggucugcuugucaaaugggccacuucaaagggaagagugugggaaauuggaacuaugaccacaggccucuuguaucauguaccacaccuaagcuucuggcauuaaaggucuuugcaaugguuuaacgaagguacaugugaagacuuagcacacaaguaacacucaaaaguagcauauacacacugaagaugaaagauuaugugguucuucugcaaggggcagagucacucaggguccuuuugggcccugcaaaauuagaggcccagauuuccaaagaccgaaguauuucugcaaagguaagugucuauuugaauuauaagauuugccacaauggcucuguauaucuagaagcaggaagagccaucgguuuagucaauggaacugacugucauaauucagugaaagauuggaacuugguucuuaaaauaacagguuggaauaugaugguaugucaaagauccacuugugguucuggcccacuuucuauggcaacuagacagcagacucguuuucuaaaagggguacaguaaccagauaccaguccuuucagauuuuuuugguuuuuugggagguuuggguuucacucagugcagugucacugaaacucacauuaagagcuaaggggagggcuggugagauggcucaguggguaagagcacccgacugcucuuccgaagguccggaguucaaaucccagcaaccacaugguggcucacaaccaccuguaacaagaucugacuccacucuucuggagugucugaagacagcuacaguguacuuacauauaauaaauaaauaaaucuuaaaaaaaaaaaagaagaugcgcacacacgugucugcuccaucauuuccuccuuaaaaaaaaaaaaaaaaaaaaagagcuaaggggaaucuagaauguggcucugagaccugggguugggacucaucccagcagcuguccuccuaauuccuucacaggaagugccacacacacuggagucuggagcugccucugaaacacaaaggaaggagcagcuguugaguagucugugaugaucggagaugcacugugccgacucauuucagagacuuuugaauuuccucugagcagcuacagcucuugcucucggcccuucaggcaucugcacuucuuuuuuuuuuuuuuuuuaaagauuuauuuauuuauuauauguaaguacacuguagcugucuuuagauacuccagaagagggcgucagaucuuguuacagaugguugugagccaccaugugguugcugggauuugaacuccggaccuuuggaagagcagucuggugcucuuacccacugagccaucucaccagcccgcaucugcacuucuuauuggaugcuucgaugcuucuggucacacuaacuggagucuuucuuacucuuguugauuuuacagauguuucucauuuucuuaguggacagcuuuaucacuuuucuuuuuucuauuuagggauuaauuugaucauuuccuaguuucaaguagcauugauuacauguucuccuccuuaguguaaaaguuguucucuauccuuuggggcacauucuuuucuggaagcuuugaaacuuuuuacauuguuuuacuucaaaauuguuuucuggacaaaucucauuucuucuuugauucauguguuacuuagaaguaugcuguuuaacuucagcauauuggugaggcuauuccagguaucuuucuacauuccucucuaagguuucuuacaaauuuauucucacuuccugucauccaacauauggucuaccuugaauacgccauauucauugucuagagugaucuagaaaugccaacuacaucaaguugguugaauguugcuuauaauaaguauguauuuagugaugagugugugugugugugugugugugugugugaggaugguguugacacauucaaccuuuuagauuucuggaagauguuuuuauucuuuuuaaauaaguucugauguguaugcauguuugcucacauguauacuacauacauguacacuacauguaugucuguugccaugaaggccaaaacaggguguuggaaucccugcaauugagucacagacuagucuuucguuguuguuuuguuuuuugagacaagguaucacuguauaguccuggccuccaauucacagagauccucugccucccagugcaccgccauggcccuuuauaagagcagucaggagcuccuaacugcugagccaucucuccaggcugacauuacuucuacuaagaguuuaucuauagagauaacuugacaucuacaugauaaggucccacaucaaucuacaugaccuauacuguguuuuaugcucccacaggacaacacacaccuggucacaaggggaguuugggacaaagcucuacaagccugcaaaucagcauuaaccaccuguacugcagaaguuuacaugggugccauucuggaaaacucacauuaacucacaaaagcaaacaagugagugcagacaggaaugggacuaucgucccacuacuguuauuuauucucuccucuucuccuugguugcugugcaugcccaaauaauguaaucauuuuuuaaagagagagaaacuauagggcauguacaaacucauggcuacugcacccaccaugcuggacgaugaacgaauaacugagaccaggaaggaauuuuuuuuaaaaaguccuagagaaaaaugaaaauacaacauuccaaaauccauggaaaaauuaugaagguggucuuaagugggcaguuuacagcuauuggugccuccaguaagaaguuaaagacagcaaaugaauuuacuuaaugauacaacuuagggccuuggaaaaacaaaaacaaaucaaaucccaaucccuccaugggaaaaaaauagugccaucagggaagaaaucaaugaaauagaaacaauaacaaaauacuaggagucaaugaaacaaaaauuugguuaaacagcuagauguaguuguuaaacccucagcuagacuaaaagaagaaauaggaauuaauuauuaagaaagaaagaaagaaagaaagaaagaaagaaagaaagaaagaaagaaaggaaggaaggaaggaaggaaggaaggaaggaaggaaggaaggaaggaaggaaggaaggaagaagaccguugguaguggcccacucuggaagcagagguagguaggugauccucugugaguuuaaggccagccuaaucuacaaagugaguuccaggacagguacgguacacacagagaaauucugucucaacaaagcaaaauaaauuagaagaaaggggggccaucacaacagacacugaugaaguguauaacaucauuaggucuuaccuuaaaaaguaacaccccacuaaguuggaaaagcugaaagaaaugggugaauuuauagaugcauauggccuacaaaaauaacaugaagaugagcaauuaugauuacauuaguaauucaaaaucuaaaaacaaaaaagcccagguuaucagacuuuccaguguuccuccaguguuccuaggcuagaaaaggaagagacauuaccaaacucccuuacgaugcuccuauucgccugauaccgaaccaagaugaaacaaaacucuacaucaauuucccugaugaacauagacacaaauauuaucaacaagcuacuugcaaacagaauucaaaaauacauuuaaaaagaucauucacaaccaugaagcuaguuuuaguccagagauagagacuguuuaauauacauaucaauaaauguuauuuaugccuuucacguuaaagucucaagugcacucagaauaaaaggaaccucaguaucgaaaaaguuacacgacaaaccuguauuuuguuaauauaauccaaagguguccauuuucuauacucuuauucaaucauacuagaagucuuaaacuaaagccacaaccuaagcagacaaauaaaagaaaaccaggaaagaaguccaaacaccucuauuuguagaugguaugauucuauacacaaaagaauauaaagaaacuaccaaaaaaacucuuaaaacuguugaacacagggcuggagagauggcucagggguuaagagcacugacugcucuuccagagguccugaguucaauucccagcaaccacauggcggcucacaaccaucuguaaauggaaccagaugcccucuucugcugugucugaagacagcuacaguggacucauaaauaaaauaaauucucaaauauaaaaauuguuaaaaauacauuaagaugugacugacacaaaauauucuuuuaagccgguggugguggcacacgcuuuaaaaacaaacaaacagggcuggugagauggcucaguggguaagagcacccgacugcucuuccaaaggucaggaguucaaaucccagcaaccacaugguggcucacaaccauccgaucacgagaucugacucccucuucuggagugucugaagacagcuacaguguacuuaaaaaauaaaaaaaaauaaaaaaauaaaacaaacaaacaaacaaacaacaacaacaaaaccuguugaacacagcaaaaugguuggauacaaaauuaacauaaaacucaacagccuuccuacauaccaguaagaaacauacuugaugggcuggagagauggcucagugguuaagagcacugacugcucuucuaaagguccugaguuugaaucucggcaaccacaugguggcucacuaccauccauaaugagaucugacacccucuucuagagugccugaaaacagcuacaguguauuuacauauaauaaauaaauaaauccuuuaaaaaaacauacuugaggaaauaaaaggaaacaauuuuauucauaauaguuuaaaaaguaucuugaaggggaaaaaucuaacaaagauugaaaaaaaaucuguauaaugaauaugccuuaaguuuuacgaguuauacaaaugugacaguaaggugugguaaauauucagggguuucuaccacaccuuaggucauuaguucccaaauaaaauucacaaagccuuuauacuuauaguaaaaccuaaaagcauggggcuggagagauggcucagcgguuaagagcacugacugcuuuuccaaggguccugaguucaaaucucaguaaccacaugguggcucacaagcauccaaagaccucacaacaucuucuggugugucugaaggcagcuacaguguauuuauauauaauaauaaauaaaucuuaaaaaaaaaaaaagaaaaaccuaaaagcacuagagcugggcagauauccacccucucuguucuuuugucuacaucucugucaauaaucccaagauaucacuuuccuuguuccuucugggcugcucagauuccaauuggccagucuucguggccaugugcucaugaucuaucuauuccauggugacuucuuccuucucucucuuggccucuccucagacccccaaaagccugugaaaccaaagccccaccuaccucuucugcuuagcuacaggcaucuuuauucaaccaauaguuuuauauuaaggaacaaaauuuguacaacaaaagcuggcaugagaauucgcucaccuugaagcaacagauacagaauuaagcauucaacauagcagcagaccaaaccuccacacuaaggccgagaaagcauaaauccaaauuccucuccuuaacauuuaguaaaacacacacccauaccccuuaacaugagacaugaacuaaaucauaccaaucucuauacaacaggacagaucucaucuggcuucugugccuauaagaacauguaaacuuggaaacuuaaaacaugacaacugaaagaaguagguggaaacaagagcacaauucaguuaaacaacuacuauuuaauguguuuuuaugugagaggucaagugucacagucugcaaggaaacucaaaggauaauuggaggaguugguuuuuccucccaccaugugaaccccacucagguggucagacuuggcagcaagcaccucaucugcuuagccaccuugccuguccacuaccaucguuuuuaauccauauccccuacuauguauggauucaccuggucacucuauaagcucucugguuuaaaaaaauauuaacuuucuugaaaucuauuauuaggacaaaaaaguuagugugaaaaugucacuaccuagauagaguacaucaauuuaauacucuaaccagacucacuguucagugcuguacaaauuggauguuuugacagaugaaaagcauugaauucaaagaucaacagauuuguaagaccacacaccaacagauucaagguaugaaggaauuacacuaucugaccuuuuuauacccagauauuaucagguuuaacaggcagaaaguuuuuuugcguaacucagaacaaugcagucuguucuacacacagccuaaugcugguacaaugauaucaccauuauaaaaucuuaagauacacauuuuuaaaagcacauuuuaauuuuuugaauuuuaauucaaguacaagucagcuaguuaacauaaacagaacauaaaugcacauaauuugcagccauguacaaaaaccgcaacaauagcaacacucacaugaaugggcaaagcucaucagcucuuuuaaagcugacuacacugugagugauugguauaauuuaauucacauccacugggguacauucagaaagguuagcauagcugaucagaacuaguccuuuauuuucuaaaguggacagcauaaaaacccaggugcaauuagggagaaacaaaguuauaggggaugugaggggcagaaagcacucuucauuuuauauuauaguaaaggucugucuucuuuacccagauguguggaucuccuuaggaauguuggaagucacaguaaagaaggagagcgagcugugcaucagccgcaggggucccuaucagacgggcagauuggacagaagagcaugugaacugagaaauacgaaggaagggccuuggaggaagggggacacugauaucuaccacuuaaguucuucaaacugaaauaaugauuucauggauuuuuaaagccccccauguuuagacuucggugacauucacucuucuggacaccccauguugugcucauccuaauaaggcuaccaaaaguggacaaaggaccaggcugugugaccuaacaacgcugucaugguaucagaauuacaagcuagcucgagccccucugagucgggaugguuccacacaguuguacaaugagaacuggaacaagguccgugagcguggaggggcaagccuguaacgcugguacuuauaggcaaaggcaggggaagcaggagucagggucaucucaggcaacaagaguccaaaaauaaaacaaacaaaaguugaaguaaaagccaacccaggcaacuuaaagcacuguaugguaucccaugacagcuuggcaacucaccaucuggauuauccaaauuucaagcauuugagccacaggagcugcugcugugugaggguugcuucuaguagcuacugcucuagcccggcugagugaguucacuuuuuugagaagacugcaacaaaaguauacaacaagauccacccuagcucuuuaagacauuaaaaaaaagauuaucuaauugaaaacaaguuuuaaaaaaauccaaugcucugaguaugcacuuaaaaaaaaacauuacaauuagaaucuucaaagaaauacuucauagacaaacuauauaaaacauauauaugauuuccguuuuuuuggauuaucucugucaugaaguaaacugugguacacaaugcucagggaaaaaaaaaaaaaaacagaucuccuugcuccuuuccagcgguugcuuuacaaguaaccacugagacucuaaaaccccguuucuugcagaucacacgcuaacuuuaaaagcacuagaggcuaaugugaguuuuacuuguaaaauaccgacugcuacauguuaucccugaaggacacuuauuguggacuugcuacgacaacacaagcuguuccuuggcugcugguuuucaugucauucuucaucaucugagaucuguguaacacaggagaacaugucugacauucaacauaauuguuauugaucuucacagagcaaauggcgcuguauuaggcaguaucaguggcaccugaagaggcaaacacuauagccugagaccuucucuacacauuuaaguuaaaccccugcguggggauuuauuuuuugguauguuccaugucauagaugucaaagcuacaauaauuccaaagguaacggaucuaaacgugccuuuggucuccaaauagauuggaauauuuuuaauuccaauugagcaccucaaaaacauccaguuacugauuacaaggaagucaaggugagaaauuuaagagggauuaaacuucauuggugacagcagagaaagcuuucaauggcaugcggcuauuuuuuuccauaauaauguggcauuacacagcauacuuaaaauacuguaagaucuccaaaacauaccuaaaauccagaaaaauauuaugaacacugcuucugccuaauacauaacaauguuaaagaaauuaacaugaauucucuccugacccuuacccccucaaaaggccacaaagugcauucacaaagucauucugaagagaaagccauugcacaaaguguaaagugaagguccucugaugagcaccacacuagaguuuaauuguagacguuucauaugccaguauagcaacauccauaggaaaaucuauaguauugcagcaaauaccuuuauaauggccauauauauuaaaguauucaaacauguuguugacucaacagcaaaauuuaaaaacuauuaucuuguuaacacaaugaacuaaaacuagccugacucuaugagagagcauuuagggaacuaggaauaacauuugugcaauguagcacacucgcuuacaggcucucugccaacuaagauuuauuguaucugauagcugagcgugucuuuuuguaauauuuauauuguccuaaauauuaauaucacuucaaggagccuauaaagggcaaaacugaaaauuaccauuuccucuaccaacaaagaauaacuuauacagauguggaaauaauucaaagguuaaaauucuuaaugugaaaguaaguagaaaaaauucaaguuguuaguuuucuacuuuuaaaguaaauaauauguagguaugagacugugauaaucacauuaugaaucaaaauuauauccauaccugcaucacauaauuggaaaagguaugaggaugcuaagucacugagucaguauccacuagcuuauuuuauagucccaaaccauuagcuguguguguuuguuugauauguucaauuaugauggagaucuuuuagaugugaccauaacauuuugauguugaaaaugugaaguauuuagauacuacuucacuggcugucaaaauacagugauuaugggugucagauaacauaaaacacuguaacaggcaggcccuccuggggaaguguuacugaggaucgacuuguuauuuuacaguauugcagacguucaaguuagucauuuguaauugucacuaccaucuuuggaaaauuacaguacaguauacacuuaggaaugauuuuguuuaaacaaccaaaaaugcucauggaaucaacacuguauucugaaugucauaaaccaguaaaacaaacuggagcuggugaacaauagagaaaauggcaauuuugagaaaggaaugcuuuucaaagcauucuugacgaggcggcccaggguuuacucacugaaagauuaaugucguaugguaccuuacuuccuaaaaccaaacuuccacucagccauaguaguuacauguuucccaacuacugucuucuguccaccaugcuggcuggcuucaagauuccaugguccacugugaucuuuuggucuuccugcucugcaguauggcagcccuugcugcuauccguugagaagguagaccaccaguucguagguggccaucauaauggccguguuuggaaucugccucaccagaugaguuguuagaccgcgguaaagagauccauagccuucuucuugaacaaucaaagacaauguuugaaaaaaagaccuauauuuugucccuucuucacguagucuuguucuuacaacuucuguauaggaaaaacaaaagaaaauauuuauuuauuuauuuauuuuuguuuuuuuuuuuucaagacaggguuucucuguguagcccuggcuguccuggaacucacucuguagaccaggcuggccuggaacucagaaauccgccugccucugccucccgagugcugggauuaaaggcuugcgccaccaccgcccagcaaagaaaaucauuuuacugcaaccuuuuuacccuccuccuuaccgagcacagagcucaucugucacuauaaacucaugacagugauucaguguauagcuagcuuccugagaccagucagacuggauaaacaccaaacuaauacagccauauacacuaaguaaaauauaaggguauauaauaaauacagccugaugaacaaauaauauucauaaauauaguaaagaugaauacaggauauauuagaagcaauuuuuuggugggcaugcuuaauguggcaauauaaaauaauauaaaauugcuuggguccuuguaauuuaaagacuuuaaaucugggauccauuucugacauacccuugggcaaauuacaauuuuaacauuucuucuuguuuuccauuuaaacaugauggcaugacuagacuuaaaacuacuauuuuuuuuuuuaaagauuuauuuauuuauuauauguaaguacacuguagcugucuucagacacuccagaagagggagucagaucuuguuacagaugguugugagccaccaugugguugcugggauuugaacucuggaccuucggaagagcagucgggugcucuuacccacugagccgucucaccagcccuaaaacuacuauuaagaucagcaucuucuuauauggcagcugaguguuguaugccccagagggugaugcacugcucuggcccagcuauacucucaccguguggauacgcuaugguuguggcccagcuauucucucaccguguggauacgcuaugguuguggcacagguuuuugagguggcagcagcuagcaucauucucacaaaauccgaugcuucuuucacagacuccucaucaguuuccaucauagaagcagucuuacauuccaguaguuuuugcuuuauacuuucauaaauaacaaaauggauaacagucucugauaugccggcauaggaggcagacaugccccuauaaaauccucgcaguccgucugucugauagacuuuacgaacacauucaaaagcacccauuugcuuuuccccacgaguccugcaaauaaaagggaaaauauuacuggcauuaaguacuggaagauuuuuaucgaaguuaacaaaauauguauuucuuaaauauggcacucuuuauucuuucccuacuuuuauggaacuccaugccaugcucaaauguugacccaagcaagacucaaaaaguaucaaaccccaaagucuuacacugugaacauucaguuccaaggaggcuaaauuuccuuugcaguuacugacaugagacaaugagggucggcauugucuguguugugugcaucaucaucucaacaacacucugggaagcagagggcaguggaucuuuuaugaguuugaggccagcuuagucuacacagugaguuccaggccagccagaacuacauaauuaagacucugucucaaaaaaaccaaacaaacuaaccucacccccaaaggccaagggagguguuaaauuaugauacugcaucuuuuuaaaaaaaauauuuauuuauuuauuauauguaaauacacuauagcugucuucagacacuaagaagagggagucagaucucauuacagaugguugugagccaccaugugguugcugggauuugaacucccgaccuucggaagagcagccgggugcucuuacccauugagccaucucaccagcccaugauacugcaucuuaaaguaaggaucauaauuaguuuuuuuuucaauuucacaaaggcccagcugaaaagcuaucagacaaaugccugacagacucccuuggagcagcuugguaaauggccacucugucccuacauuuccaaauauaaucucuuucagugccgcaugagggcacuguagcuaucccuaaaggguacauucuuccauucuugugauacguggcugaucuuuucccuucaccuaaaaaugcgacugggguuaaagaguuuugggucaguaucacugguaaaggagauuucaggacagacuaagugaucacuuuaugcagaaagggggcaagcagaacaaagagaaauauagauacaguugaaaaaaaaaaaagagcaccaggaaauguaauguuggaaccaaguucucuuuuauugcuuuuguuuuauugguuauuuauuuacauuucaaauguuaucucccuuucccgguuuccucucuacaacccuccauugcacccucuacacccugcuucugugagggugcuucccucacccauccacccacuccugccuccccacccuagcacuccccuacacugguaaauccagccuccacaagacaagggccuccccucccacugaugccagauaaggccauccucugcuacauaugcugcuggagccacagggcccuccauguguacucuuugguuggugguuuagucccugggagcucugggggucuguuugguugauauugauguucuuccuaugggguuguaaaccccuucagcuccuucaguccuuccccuaacuccuccauuggggucccugugcucagucugauaguuggcugcgaacaucugcaucuguauuggucagacucuggccgaguaucucaaaggacaguuauaccagguggaaccaaguucuuuguucaaagagacuaaaaaguuuaguugggcggugguggugaagcacaaaugccuuuaauucuagcacucaggaagcaggaacagguaggcagaucucuuaguucaaggccagcuuggucccuagagggagcuccagccagggcuacagagagaaacccuaucuccaaaaaagggucguggugguaggaaagguggugguuaagaacacuggcugaucuucccagcacacauaugguggcugauagccaucuguaauuguagccccaugggauccaguacucuucuagugugcaaauguacauauagucaaaacacccacauagauaaaaugcauaaauaaaucuuuaaaggaaaaaaaaaaagcuuaaggaaaggucugauucaaaggggaauaaagggaauaguaccuucaggaaacggcacugcccagcuaauccagaccuauaccuagaaacuaucaacaagccuuuuaccuguaaucuucuguucucuagagaacccugacuaauacaaccagauaagaucggcuauuuaagaaguauaaucucaaaaaaaaaaaaaaaaaaagugaacucucccuuuucuccacugaggccaacaggagcugagauggaauaccucagcugcacugcugccucuagucugcucucagaugacaaaacaucccccaagucuuauauuuuagauucucugagauuuauucuuauugguucuugauuaaaacaggcuuuaagcagggcaguggugguguaggccuguaaucccagcacuuaggacagccagggcuauacagagaaacccugccucgaaaaaccaaaagcaggcuuuaaaaaagaaucauccauugaucuauccauuuaaaauaaaucccagugacuccaggugaaucuuauaacaugaagcaguacuugcucaacauagcucuguugaaugaguaaacuuuuucuugguaaaccugaggucagugguaacuaaggaagucuaccaccauagggcugcggccucccagcucagcgcuuuuggacauaggucacuggguuaagcaaugguccuuucucuagacuagcuaugaggucauuuauuuagcuguuaggaggcccuuacaaggagcuauacagguaauaaucacuacuuuggcuugguuaaccuaucaucccccaauaagcagcacauaaaacuccaaaauacgggcaguuuucuuauuuagacugucucauuaucagcuauuauauagcuuuugcuuuugguaggagauccacauuucaaaugaaacagaagcaccaacaaauacucaauaguggcccucagugcuagaaagugcuaugcagaaggcuggggaaggaguuucaaccagauuuacuugcuguggacucaauaugcacaauacugauuggcuaggcaagaugaaccuacuggcguaacacuggcaggccuauuucaggggaugcccaucugcuuuccgacuggaucagacagaggcuugcuccagaggaaaaguuucacaguugguucuaaaaacuggucaaaccccgugacuaauggggaaaugauugcuaaauggacaugacaggcccgucagauggcugucagugccaugcucaugccacagaaggaugcugcuaaauggacaugacaggcccgucagauggcugucagugccaugcucaugccacagaaggaugcugcuaaauggacaugacaggcccgucagauggcugucagugccaugcucaugccacagaaggaugcugcuaaauggacaugacaggcccgucagauggcugucagugccaugcucaugccacagaaggaugcugcuaaauggacaugacaggcccgucagauggcugucagugccaugcucaugccacagaaggaugcugcuaaauggacaugacaggcccgucagauggcugucagugccaugcucacgccacagaaggaggcugcugccagcuucuuuuugcaaaggugagcugugacuacagacugucaagagacaaagaaucaacaacuguugcauguucagcuauaaguggguugucugcauaaccucuuccaagacucagcaaauacugcuggaagaagggaagagacagggggaugacacagaaugauuucuagucaugaggauggcacuagagucguggcagcugugaugcccugagcaggaucucuacauaacuguccugucagcacugcugagggaguggaagggguucauagagugccgcucucuccuggggauuuggguauaguuaaagguugauggggcauagaauuucuuuagugguguagcuauuuuaaggggccuacccucuuuaaaacaaacucuuacccauggcuucuggaaauaauccuaaagaaacucauagcagcacacacacgaaagacaaaaggagaaauggagcuaguaucacugaaaauggaacaggagagagaacguauguguauguguguguauuagaaaugcauccuguccaugugugaaaauguaaugccaucccacuuuuguguauaaaauuagcagccaaaaagggacacugcccugcuuaaagccuguuuuaaucaauuacaaauacaaauuuauacauaaaaaauuagcuaaauccauguuggcuuuuuuuuuuaagaauaaaaaaauuaauuuaaggcuggugagauggcucagcaguuagaagacuaucugcucuuccagagauagaguucaacucccagcaacaacaugguagcucacgaccaucuauaaugggguaugaugcccucuccuggcauacaaguguacaugcagacagaguacacacuuauuuacaaaaaaaaaaaaaaaaaaaaggaauaacuauauugagcuagguguggugacucaccuguaagcacaacacuuggaaggcugaggcaguaagaucaacaugcauuugcauuugagggcagccugugcuccucccgggcuacaguaagacccugucucaaaaccaaaacaaaccaaacaaacaaaaacauaccuugcaucaagcuguaagcgagucuuuauaagccaaaugggguuuguugcagugauugcaguaaaaccuaaacaaauauauuuaaaaugugucaguagagaggaaauacauuauucacauuaaggaucuuuacauuauaugaaucuauauuaaagaaaaugucuagcaauguugaaacuauuaacugauacaggcuucacacuuuucauuuuauguucuagugaccaugaacaccuguucacaauucuggccuuucuagaugauucugucaggagcagacugaccucacuucaaguguucuccuaaucuacaugaaaacaugguguucuccccuauaauccaaguucacaaacaugcauucuaaaacaguugccugggggugaaucuauuaccugccacacuacauucaaagagaauccaacauaaauggcauuauauacuaauauuuuggucuguggaccagaaguuuggcccaucauuuuuuuuuuaaauaauauuaacacagagguaagauuucugcuaggauuaacaggaggggucacuuauuacccaauuaaacaaguauaaacucuuaaaaaguuuguccaaaaaguuacagaccggaauucucuccucccuucuacagacaaugaagaaagugaguaggguagaaggcagcccucugucacuacagucaccuagugacaccacugcagagcagcaguggccauggcgggguggcucagcuuuagagcaaauuaggaucgcuggagcagugugcuucugggaccaaguauuaucuuuaauuuuuagcaaaacagcauagaaaaugcuaucuuaugaacaagaauuuauaaagauguuucaucuauagaagaguauuuaguuugcuuucccaaauaagaucaguaacauaaacuucacagaacuacauuuauucaacuggccuuuacauccauuacauaaacucagauagagaaauaaggaaccuaguuauuuuaauaccuucuaucaaauacuaucaugucaagcggguugcuuuuagaaagacauacuauacccaacacauuuaauaugagaaaaaugcugugauguauuuaauccuacuauaaaaguuauuagagccagucauaaacuuucuuuggcuuuuaaagcugcuacauuaaguggaaugaucuaacucaacuguucuuucccuuucugcaguaucagauaauuaacuuacucaaacuuuacuucuuuuaagcccugcuuuaacacuguaaaaguagccacaucucacacaaagaagugucccaauuaagccuauuuagcaagauaaaguuuggcuuauuaacuuuuaaauacuauuuugacuaguauauaauauaguuucuacuuuccuuaagugcuuuuaauacuacauagagagaaaugagaccaauaacuuuggcauuagcagguaauaacauaaucaauuugaaauauggaacagacugucaaagaauauccuuuuuaauaagagguucucaugaguuuacucuugguggaaaaaaaaaguugacuaucagacuaguuuaaauauuuuucuuauacgcuuagucugagaaugaaugcacacuguuauuuucuuccuuugaaucuuauuuuucuaaauaagaaaguuaaacuuaacaaauuacacacuuucagacaucaauacaggucaaaacaccccaacuaaaugacuccuuguuggggacugaaaccagggcuucacaacugcuacacacauggucuaacuacaaagucacacccuaaucccaguucuuauuuacuaaagaaucguaucaccaaaauauguauguuagcuaggugucuauacaguaagaguaaaauauguaugucagcuaggugucuauacaguaagaguaaaauauguaugucagcuaggugucuauacaguaagaguaaaauauguaugucagcuaggugucuauacaguaagaguaaaauauguacaucagcuaggugucuauacaguaagaguaaaauauguacaucagcuaggugucuauacaguaagaguaaaauauguacaucagcuagguaucuauacaguaagaguaaaauauguacaucagcuaggugucuauacaguaagaguaagauauguacauuagcuaggugucuauacaguaagaguaagauauguacaucagcuaggugccuaugcaguaagaguaagauauguacauuagcuaggugucuaugcaguaagaguaaaauauguauguuagcuaggugucuauacaguaagaguaaaauauguacauuagcuaggugucuaugcaguaagaguaaaauauguauguuagcuaggugucuaugcaguaagaguaaaauauguacauuagauaggugccuauacaguaagaguaaaauauguacaucagcuaggugucuauacaguaaggguaaaauauguacaucagcuaggugucuauacaguaagaguaagaguuucuaauuaaaaaggagcagcauaaaucuacaacacuauucauuauccauaaugauuuuaauuauuccuaggaaaacuaaccugucuucuuauaaaacuuaacuuaaaaggcauagaauuuauucucuuuagcuaaaaauaaagcuauccaauuaaaaacuuucauucagcuuacuuuuuugaaaagauuaccacauuuaguucaaguuuaugcccuugaucgcuuuccaagucacaaaaucccucacuuuaagaucaccacauauaaaaaauauuuuaaauuacucagaguacaaaaguuuuaauacucaaagaguaacuuuaauauuucucuguuaauaaacaaggucagaaagcaaacaacagguauuucucacuuaacuaaaauucauuuccagauacaauguguaauaggccaacauuaaaauuuagguaagcuagagaaugcuaucuuguuaucuuacuguaaguucugcuuacugugacugcucuggcacagaguacagacaacuagcuaaucagcaaaucacucacuggcuuggauaaagaagcuaggcauuaucuauagguuuuagcuguugguccuuaaauaugaaaaaaaaaaauaaauuaaaaagcaggggcuggagagauggcucagugguuaagaacaccaacugcucuucugaagucucugaauucaaaucccagcaaccacaugguggcucacaaccaucuguaaugagaucugacgcccucuucuggagugucugaagacagguaccguguacucacauauaauaaacaaacaaacaaacaaauaaaucuuaaaaaaaaaagcuaacugguucuuuacaguauuacuuucuuuaacaaaaaaaaauaguuaaauagcaaaacagacauuauuaggcuaauuaaaucuggaaaaauauaaccuauuaacccaagaaauaaaacaaaauuaugugguaaggaaguuugugguuagccacaacuaaacauguuuucuugcuacguuuacaacaagcaaacacagauguugggcaugguaacccuaaaguuuagaaauugccuaucuguuucuaauucugcacuuuaguuuuguuacauuuuaauaagagacuaaugcauucagaacacccaauaaaacauuaaaacaauggaaaguacagugagggauccacuuguagauugaaaauguguauuguuccagaaucagucaaagcaacgcgccaauagaggcauuuaguuaguaguaucaguguuuuacugaaaaacuuuagaaaacuuuaaauguaaauuuaaguuguacaucaaauaaaacucuacuugauaauauaagucaauuaaaaacauaaacaaaccccaccuauagaaacucacugagcaugcuuaaaugagugauaccugcaguacugcauuucaguacuuauuucaauuaagcucugaaaguauaaagcauauacaaccuccuaagacuaaaguacucaaacuauuauaaaaauuauaacuacacuaaagcagcuaagaccuuauucacuacagccugaauuucuuagaaaguagagacaccagucuuuuaaaaaagagcaguaaccaaguaccaauagaugagaguggaaagcacuguguuagacuucuaaacguuagcuaggcaaacacaaaagacaacuacuacuauuuaacagcuguaguacagcauacuaaaacuaaaacucucuaagauauuaacauauacuccugucauucuguggaggucaaggcuauuauggccaagcugaggaccucaaguuuacaugguaacuggaaaaguaggccauucuuccuucuagaaggauaagauaacaaggggaccaguguuaaaucuuuaugaaacacucaacaaugcacauauugcaauccacgucccgccuucuacagcuacuauacaauccaucccagaguguguucuuauacuagaggcugcaagagacgcucaguugaguacucacgagguguaaguuaguccauauuucuacaggaagugaccugcggauggggagcaugagaugacacgaucucacucuuuucucgggagaaauguacaguaaaugccuaaaauagacacaggcuuucuguaucauaacaacaagcagugaccucauagacacauguguacaaaaugaaucucacugaaggaguuaagaaauauuuacugugagauuuuuuuuuuaauuuuuaaguuaagagaauaucagaaugugccuuguguuuauaauaaaaguacacagaguacugacaaucccgccaucuucagcagauucagaguccaaauacuuaccuaaaagacgaucaauuuugucuuaaagaaaaaaugcuaaccuugucaagggagaaucuaaaaaaaaaacaaacaaaccgagaagggauucuaugucccauuuccuaccacuauuaucuaccaugaaagaguuguaaacacuuuuauucuuuaaaaaucagauaaucuagugaauaaaauaaguaaacaaacagaaacacacagagccccaacagaauauuaaagucuggaacuuugcguaacuaauaaaguacacauugcuaacaguaguaccugucaccugugacucuagcaguaauacugcacauccauacuuauggaauauuuuggauuauuuuguauuaauucuuguguucuacaaaacagaaaacaggaaaaauguucacaaauaagcauacacagcagcuguccaaccaugcauuuggcugaguacuguaaacuuucuacuuaaggaguaaaaacaccuaaccuuacauucaaaucaugaaguuaaaaaucacagaaaaaauaccuugaaaaaaaugcauucuuaaaaaccaacaaaaauaauauauucuguaaguagauacuauucacuagauacacugacaacacuaaaugauuaugcuuacugacauacuagaaauuucacacuaacuauauggauaaacaauaauaaaaauagaagcucauuuccuuuauacuuauguuacauguagaaaguaugugucagguaaacuuuuaaaaauugggaauuacuguaaagaaagaagaaauuuaauacauuuuuuuggcauaucaacaggugccaugguugguacacucagaagguuacucaagauuauuucaagaaaaaaaagacauaaaacagaaacccucaauagcuauaguaaacacugucaacaguuguauguaagggaggaaaggaggguaaaacccagaagcaaccagcauugcuuggauggaauaucucuguaauuggaaaauguuucaguaaaccauuuuagguguggccacuuauaauacugcaaaaaaaaaaaaaaaaaaaaaaaaaaggaacacuuuaaacagcacuuuuaacuaaguuuuaauuuuaaacauguuuuaguugauuuggauaauaaguaagaugaaacugaagagagaggcugugugugcugacuggaguggcaaaacugccaaggugauauggcugaaucuuuuaaugcauuuuugcuaccuaagugacaagguuagcauuucuuuuuuuuuaacagccaguuaaaaacuuuuacacaugacuuaucuuugagaacuuuguaccucuaaaucauucuucaacauccaaaacuauggcccugaagaaaacccagaacaaucugguacagauuauuuuaagaauaaaugggggaaaaaaaaucuaccuuagucaaucuguacgggaccauucuguuucaccagccauguagcaacacaugaaaaacuugcaaagcuaaauguuaauacuaacaaacaguacaaagaaauguagagagcauaauuuucaagacaauguaacuguaaguaaauggaaaaaagauuucagacugcacaguaaguacacaguguaacaaugucugugcauacaugcucaucaauuuaccaaagucaaucuggaaaacaguauaaaugaagauguuacacauuugaggaaagaauuaaaaaguuuuacuaaauuacuuugcaauaaaaagcugguaauaaauuuuguugauauauccuaauaaaauaagauguucugguaagauacuuugacccucuaacauuguaauauuaaaucuauaauuaacacugucaacuuuaaaacgacuguuuaucuguuaauuuuuuacacuaacaucaacauuucuuuuuaauuuuuuggaguuagauauaaacaaccccauugcccccaaaccacaaaugcuaaagucaagaaauauucugaccuaauguaaugguuacuggguuuauaacuaauuggcccaacuuucaccaauauucaaucaaguaaguaagaggaaaacauccauaaucaaaaucuauacauagcaucauuaaaaacuucuaguuuguaacuagguaaauauuauuacaccaagaacuaguucucaaagcccaaccuauccagaucaauccaguuauuccauggauagauaaugucauaaaaacucccaggaauuaccuaucuuauucaagaccuccaagcuggcaaaucagaggauacaguaucuugacuuuaaacacugucccuuccaaaaugucaaucagucaacaauuguaaaaugcacagccuugaacacaauuguaaaguauuacuagacuuauuauauggcaaagguuaucaauauuucacaagucaguauuucaaacacacauuuacgugguuaaauaugugguucaaauuaaacuauucuaaauagaaaaugauuaacaguuuaaggcacuccuuaagcacacaaugggaagucaguuuauugaucaacagcugauaaaagcagcuauuguuuuaugaaauuacaggacaacuuggaaauauaagguagauuaauuaauaauucucagaaaacugggagacauuucuauuaagaacuaaaauucaaggcuuugucuaacaugcauggcagcaaaugacuccagagucagaauggccaaucuuuaccgcucauccugagaagggaggcagagaccugugaggcuguuuugauucagagucguaucaccauggcguuaauuuccugggagcauuccuacacaaguguguacacauaagccagugucuacagcucagguccaggaugcaguccaggcugugaggaaggauaaacuauucuugaggguacaccaacugcaauaacugggucauaaugaaccucacacaacugcagcaucugcgcacaggacacaaugaauacggcacccaguauuggcggguggcauguuccagacaggagcaggaagucacuaauggaaacugaggagaacaaguggcagcucuaacuccaguagagguauggcuagacucuaaaagcacagaugcaucaaauauuaaccagcacacagcaaaaugaauguguuaucugcagucugucacuuaaacccugagacacauagauucaacugauaacagauuuuauguacagcaaauguuuuauucaagugaacaaaaaccacuuugcacacuuuaauuauuaagaggcacacuaaccaucuuaauuugauaugaagucaucauuaacuuuuccagacuuagaggaguuuuuacuauuaaauaugcauaccugccauugcagcugaagccaugugcacuuggguagaaucaggaucaaaaacaccauucaacuuuuccuugcaguuugaauaagcagcaaaguauauugcucuaaaaauuaaaaacaaaauaguuauuaaguaagauauaaaucuucauaauuuuagaauagagaaguaaaauggaauaaagacucagucauagucaacauaacaucagguuuacccauuuuucccacaaaguacauuuaguccuaaaaaaaaaaaaaaaccaaaacaaaacucaaaggcauaguucuuagcaaccauucucagaucaccuaagccgugcucaauacugacaaccacuuagcaacuacaagaagcaaaaagaauuuguauaacauccugacaacaggagagucuaugcaguggagcuguggugguuguacuucagugcuaacucagagucaguguacguaaccaggucaggugaagguaauuuuagagguagagcuaaucuagucagucuaaccuggucaauuugagauuguauauauucuacacuauaagaauaugcagaauauuccuauauucuacuuuuuuggcacuggagaucccaaccaagccucuauucccuuucuaccccuugcccacauuauucuuaagacaaaacaaugcugacaaugucauuagguccgucaggucgagcuauguuugcaaugucuguaaauacuccauugaauuuagaggcuuuuagccuuucaaguacucaauucuugcuuggugaaucaaacauuacauuaucucaacaacccugauuuauaacucaguuaacaaaguagcccaauaacugauaaugggggguuuuaugacugcaucuuucccgcccgauguguaagcaagugcaccaggugcaugcagagccauggacaccagaagagagcacuaaaugcucuggaguuacagaggauuaggaaacuccacgagggcacugggaauugaauucagguccucugcaagagcaucaaaugcucuuaaccauuaaaccaucaucucucuagcuuccauuauuauauuuuuuaaaaacuguguuuaagaaaaaagaggccaaauugcuuaaaucugcaaucccagaaaacagcagguguggugguuugaauggguuuggccuccacagacuccuguguuugaaggcuuagcgcacagggagugacacuauuaggugugucccuguugggauugguguugccuuguucaaggaagugugucacuaugagauuugaugcucaggcucugcccaaugaagagagccucuuucuggaugccuuuggcugaagagguaaaacucucaguuccuucuccagcaucaugucugccaggacacugccaugcuuucugccaugaccaucauggacugaacuucugaagcuguaaacaagucccaguguuguccuuuguaagaguugccuugcuccuggugucgcuucacagcaauggaaacccuaacuaaggcaguggcuaaggcaugaguaucaugaguucaagggcaaccuaaucuacuaagugaaagccugcuucaaaaauacaaggagauuauuuaacaauuuauaacaaaagcauuaaauuuaugaagaaaauaauaauaauaaaacuuaggauauauaauuccaaaacaugacggggaauaaacucauucccaagaagaaauuacaaaagauaucuuaaagagaaaucgguauggaauauacauauaggaaauaugaaaaauaaagcaucaacuucuaauaaagaggguauaauuacacaaaaauuaaauacaugucaaaauaccaaaagaaaauuuuaguucauuuaguuaguauuuuuagaauggauagugagggcuagagaaauggcucaggccaccauaugguggcucacaaccaucuguaaugggaucugaugcccucuucugauguguuggaagacagcaacaguguacucauauucauaaaauauuucuuuuuuaaaaaaggacaguagccagcauucauuaguauguggcuuaagaacaaugaguucacuguaugaaaauaaaaacuugguaugugucuucagaggacaaauuagcaaucuguagauuucaaugucuuuucuuccuuuuauccagaaauucuacuuagguagucauucuaaaaaauauaucuuugcagcacuaaugaacaucccagaggcagaagcagaauuuugaguuugaggccguccuggcuauauaguacuacccugucucaacgaauaaauaaauaaauaaauaaauaaauaaaucuaauaaaugucuuuaacuauauaagguaaagguuugggaauauucagaaaaccacugucacaauaggagcuggaaagauggguuagagguuaagagcacaugguguuuuuccacaauccugcaucugguucucagcacccaugucaggaagagcacaacuccagcuccaggaaaucuacugccuucuucuggccuccagaguuaucuaugcacgcaugcagauauguacaggauauauuauuaaaaguaucacagaucauggagcuucaaggcaaguuauaguauuucccaugauucauuuauguaaauaaugaauaugcacaagccuuuauucaugacagcucaggaaaguuauuagaacaaaguacacuuaacugauuauuaauaguggcuaucuaggaggaaaagaauggugugcauaaaaugcaaccaguaaggcaauauauuuaaaguggaaagugaaacucuaugcuaccuuuucuacccuucauuuuuaugauguaaaauauggauuuucuucucuucuuaaauguuuaagaagaugcucuugcagaggaccuuaguugggcucccagcacucaugcuggguggcacacaacuaccuguaacuucagcuccacgggaucugauacccucuucuggaggccaugggaaccuguacgaauguacacauaccaauuugggagugugugcacacaugcaaguauacacacacauacacaauuuucaaaaacuaauccuuaauuuuuauuuuauguguguguguguguguguguguguuccugugugucuguagagaccagagaauuaggagcgcauuuuuuauuuccacuguugguucugagugcugaauacaagucaucaggcuuguaggaaaauaaguuccuuccauuacagacugagcuaucucacuaccaacacccauucacccagaacuucccccauauguagcuaagcucuggcuuugaauccaagacaacguugcucagccuagguguaggcaaacaagcucaacuguauuuucuuaaaaugaaagugaaacacaguaacaggcugugaaugagguaugcaguuugaaguacagaacuaggugugcauauucauccuaaauaugagcuuuuuugaacagcauuuuacuuaccauggaagaauccaguugcaggggaucugaucccuguugugacuaggcccacaugaugucauacauuugugcaggaagagcauucauauguaauaaauacauuuuuuuuaaaaaaugcuuauuuauagucagguaagccuuuguaacucuaguacucagguauguuagucaggagcaugguaauuuugagguuagcaggaccacccaguaagacugucucaaaucaaaaacaaagacacuccucuacacacauacaccaagcccuuuauuuucuuuaaagauauuguuuuguuuuuugaaauuuaagaguuaccgcaguuagaacuauuuuauucuacccuucccuuuccaaguaugagcacucacaguuuaaagcaaacacuacacugucucuuuacaacaugaaacauuuccuuucuguucacagcacaaugaauuucuguuagcuccagaaccaagguuuucuuuggagauuccuucugauuagcaauagaaacucaacuaacuuccugagaauacugaaauguacauuguuucugcaaaugauuauguccaaauaccuugaaauaaagacagccagaaucuuacuuauuacuuuuuuuuuuuuaccuggagggagcaacccccaccaaauuggggcccaauccucuaaacaacgagcgagggcccucuuuuuccaggauagcccugaaaagagaagaacaaauuauuagaaagcaauguucuucuaucacccuuuacuaauaugcuagagcaaagccaaugucucaccuauaauguauuuuucagguccauuucauuacuuauaaaaaccucuugugcaggaggcagggcccaggaaaaaguacugaagacucaagugacaugcuaauguaacaaaacauuucuaaaauggcuagcaagacggcuccguggguaacggcacucgccaugcagccuggggaucugguuuggauuccugaagcucagguaaagauggggagaaaacagacucuacacaguuagccucuguuuucuacauguagacuguggcaugaauguacucacagaaacaugcacaaaauguuuuaaaaugauggguuuaaccaagcaugcagacucaugcuuguaauucuaacaccugggaggcugagacaagaggacuauccuaaguuucaggcuaaccuggacuucagagugaguuucaagucaagcugggcuucaguggaacccucuaacacgguaacagaaaaaguuaggaaguauauguuggcucugacuugcucuuucgcuuuuuacuucaucauaagaacuuucaauaucucucuagauuuguuugcuuguuuuuaaauauagauuucuugguuuguugucuugagacaaggcuuuauucuggagcccuggcugagcugagugccagggaccagacucaagccuccucuguagaaaguaaacccugcaccacugagccacagcccaguccuugaaguuuuccaucuuggaaaauacccucaaguuccacaguaucaaguuccaucauuucuaggagcugcuacugaaaaaucuaucacccuaacguccuaagggucacuggaaugcuuggugaguuucggucaauuuacuauauugagaacuuaguguauaagcagcuuauaacuacauuaaaagauagaagaaaacacaggcaggcgugguggcccacgccuuuaaucccagcacucgggaggcggaggcaggcagauuucugaguucgaggccagccugguuuacagagugaguuccaggacagccagggcuacacagagaaacccuguccuugaaaaagaaaaaaagaaaagaaagagcucuuaaaggcagaugaauguaauaauuaaagguaugggcagagagacaagacuuuucuuuaugaaguccaagucguuaccugagaaaaaaguuaacuuuucacugauccuaauuuuacaauaagaaaacuagucaguauagugauaauggguucuuuggugacuaauuuauaaagagauuaaaggagaggaggaaaaacuuaagaaaaugguggagguggugcuuggcuuuacucccauuacugaguaggcaagagcaggugcaucuguggugaguuuggagucagccuggucugccaggguuacauagugaaaccuuguuucaagacaacaacaacaaaccuaagaaaucuauauuuaaaaacaaacaaaucuagagagauuugaaaguucuuaugaugaaguaaaagcaaaauuauugaaaaccagaacaaaauauaucucaggcgacuaagggagaauuuuaagaccuaaucaacaguaaugucauaauugugaugcaaagauauauuuccugggacuggagggauggcuuagugguuaagagucacgggcuccucuuccugaguucaauucccaacacccaucuauaaccguaguuccuguggaaucugauguccuauucuggugugcacauauguagacaaaacacccauauacauaaaauacacgacuaaguuaaaaaaaaaaucucccacagcaaucaauacuuuucuguaauugugacauuuuaauuuaauucaaaauugcugaauuuuauucuaccuuucauguucuuggguaaccaaguugaacaagugugaugcaauuuaguagcaaauguaaacaccuggaugagaucaucugccccuacaaaacaaacacugcgagcaaauucaaacagauuaaaggcaugugagcugauaaggcagacucgggguucuaauacaaaucuaaagucacagaaacugaucggaguaggguuuuuuuguuuuguuuuguuuuuugagauaggguuucucuggguagcccugacuguccuggaacuugcucuguagaccagacuagccucacacucagagagaucugccuaccuccaccuuccaagugcuaggauuaaaggcaugugucaccacagccagucuugaaugugaauuaauuaagucuaguaauauaaacauuuuuuccaaaucagaaaaugacaacacagauauuuaaaagcugggcuguuucaagcugcagcuguuuagguuauauguucuauauuuuguaaaugaaacagacggccagcaauuagaugcagguacuugugcacauaugugacuauuaagcacauaauaguaccacacuacuuucauuucaaagguaaacagaacagccaucuggguggaacagaggcaggccuguuuuagaggcugaauuuuagaccagggaggacuacauagugagaccuugccugaaaacaaaucaaacaaaaaaauuaaccaauuaaaaaaaaaaaacaaaccuaugauaccuuuagaaaagaaacccacuggauaauguagaaaaauauucuaaauauauacaauuugaaaauauuccauuucauacaaucuuuauaauuaacugcucuacuccuuuauggccuaucaccauuaagaaguacgauucauacuucugacuucugaguuuucuaaagaaccuuuuaaaauauggaagauaaaaauaaaaacuaagcaugugggaaucacuacaaucacagcaucaaaaacaaaacccaugacuuuuugcucuuacuucagacaaugaagagguccaggggacacuacucgguucacacuggcuccagccaugguguucagcugaacuucagaaauauacagugucacagaagaagacugcagccguguuuugacaacuuccaguggacaugucagaauagcucccacugugccaccacaucuacaagagaaacaaaaaaaccaguaagucuagaaaguaggcaucuaaucagccagugagaauacacacuccuaccuagugcuccgacccaagcuuacuacaauuuaaaauguugaagacuaauucuuuugaaaguuucacuucacugcaaaugaacacuuucuaaaaagaacugaggcagccaggugugguggcgcacgccuuuaaucccagcacuugggaggcagaggcagguggauuucugaguucaaggccagccuggucuacaaaguaaguuccaggacagccggggcuacacagagaaacccugucuggaaccccccccgcccccccgcaaaaaaaaaaaaaaaagaacugagggaacuaugggaaacacugucauguuauaacugguagcccuaguacccacauuaucagaauaaaauauggaaaaaaugagcuuaauaauuuacacacaaaguacaauuagguaaaggaagauuccaaugauggcuuuuacuaaaagugacugacaaacugaauuaaggcuguaagaggugguuagugcucuuugcccaugggcaacucagagcacuguuggaaucuacaguguguaacaucuuucaaauuucuaauccuuuaaaaaucccagaacuggggcuggagagauggcucagcgguuaagagcacugacugcucuuccaaagguccugaguucaaaucucaacaaccacaugguggcucacaaccacccauaaugagaucugacaccuucuucuggugugucugaagacagcaacaguguguacuuagauauaauaauaaaauaaaucuuaaaaaaaaaaaaucccagaacuaauucugagugauaggacagagaucaauuacuuaugaauaaccauacuuauuucuaauuuuaaguacuccaacacucaaaggacuguacuuacaaagcacaguuucacaggcauuaucuguuauguccaugugugcagaacaggcaggauuagugaaaaaaauaaauaacaaaauucauuuuauauaaaggcugauccucagaauaacaaaauacucauagcaaaauguauuauuuaagccaguuaagggaaaaaaauuaaguaauaaucuaagcaauuauucucuaaguacaagcguaggacagucacauauguacucucacuugauguacaagcaugacgaccgaguggagcucccagcucccauguaaagcuagacaaggccauacagcgcaggccuauaacccuagacuaaccagcuuggacacacaauaagacgcugucucaaaagacauuacaaacugaaaacuccagucacacagaaaaauggagacaauuuuuccugacagcacuaaaagcuagcuacccagcugagguccugagaauaacaacugaucagagaucuacuuauuuaugugaaacgggagcuaauggaauacaagguuauauagaagacgggcauuagaaaaaggaagaaaagcagcccagcacaggaauauauuuaguaucacucaaauaaaauuucaaauaacaagucauuaaaaagaaauuauuucaggauccagaaugugaccacauggaguagcucuggguuugaggccuaccacuccaaauaugaaacaaagaauacuuuaguaugauaauaacuaugugccauuaagaaaauuaaaacugaaaaguuguaucauacuaaaauuuaaaacuuucccucuuugagagaaucuguuaagaaaauggaaagagugccaaggcuacuuugcaaaucguaugucugacaaaguaaguacagcuacucagaaacuggacaacccuuuaacaagauauuuagcagaauuuacaaaagauagacagguguauucaaacaaacacagaaaguuuucagucaucugucaucugggauguaaugagauacacagcuauuuauugcuaaaauguaaaaggcugacacguggaacaagcacaucagaaaacagaaugacacuuuccaugguagagaugcauguaaacuguaaccucacuccuggguucugacuggccagagacagacaggcagacuugcugaaaugccuauuuaugaacguuuauagcagcuuaaccuacaguggcuaaaacugaaaaaccauacaaaugucugaauuaaucaaggacugcugaacuguaguacaucuauaauugaauacuauccuccaauaaaaaaaccuaggauaaaucucaaacauuaugcuccuugaaaaaaccugccacgcauggcuuuaauuauaugagauuuucacuuuuaugauauucuggaaaaggcaaaacuagaagggcagaagugagauuuguggccaccaagggaaagucauuuggaaagacugccugcaggagaucugagagagcucuugggauaaaacuuaaugaacucuaaaaucaagugagagugacaugcgugucugacaguacagcugaggagaacuguacagagcaaaggaacuaaaggaaguggagcaguguaaacugggguuagcuacaaaaggucaagccagccaaauccugaaaugagugagguagaugaucuccagaccgcauucuuuuuuuuauuagauauuuucuuuauauacauuucuucucccccaccccccaugguuucucuguauagcucuggcuguccuggaacucacuuuguagaccaggcuggccucaaacccagaaauccaccugccucugccucccgaaugcugggauuaaaggcgugcgcaaccacgucccgccuuuauauacauuucaaaugcuauccugaaaguccccuauaccuccccccccaacccccugcuccccuacccacccacuccugcuucuuggcccuggcauuccccuguacuggggcauauaaaguuugcaauaccaagaggccucucuuuccaauaauggccaacuaggccaucuucugcuacauaugcagcuagagacucgagcucuggggguacugguuaguucauauuguuguuccaccuauagggcucagaccccuucaacuccuugggugcuuucucuagcuccuccauugggggcccuguguuccauccaguagaugacugugaacauccacuucuguguuugccaggcacuggcaaagccucauacgagacagcuauaacagggucuucuucagcaaaaucuuucuggcauaugcaacaguguccagaucccauucuuacugaagaacuauugguaguugacagcugcuagaguaaggaaaauuacauuuaaaauuugagugcuguggcuacuggaacaauuuccacacuccaguggaugguccaacacccaugcacagaaagguagccccaacuagauggggugugugugugcaugcaugaaauuaggggacuguacugagaggaauauggggguguuggagggagguuuauuaguaguaaauauauuucacugcacauguaugaaacucucaagaauacaaaucuuuaaaaagcuaugcuaguuagucuuuugucaaucugauacuagaguuauauaggaagagagaaccuuuaugggaaaacgccuucaacagcuugcccucugggcaugucugggcaaguagaggcauuuucuugauaaugacugaugugggagggucuagcccaugguggguggugccaccccugagcagaugguuuuggguuguuuagaaaagcaaaaucaguagccuauggacaguaagcaauguaaacaguguuccauggccucugcuugaguucacaccuuccuucagguucuugcccuaccugaauuccuucccuggcuuuccgaagugaucuacugugauuaggacagguuaagucaaacaaacccuugcuugcccuagcugcuuuuggucaugcauuuaucauacaacagaaagcaaacuaggacaaaagccaaaugugaaaauuagcaacauaugaaguauuuggagcugaaugcauuuccacuaugcaaaaacauuuaauauguuuauguccacaaguaaauacccaacgagaaucuuuccagaagcagccaguauuugugacagaaaucuuacuuucuaaagggaauacagcugggauaaggcuccugauaguauuugucuagcauguauugagcccuaauuucacagcacccacgaauguacccacucacccacgcuccugggcaggagcugaauucccugaugagcucaaaaaccugaguucaaauuuaagaaaaugcacugaaugcagaugcacuaucacaaucuuuucaacugcagacaagaaagacuuugauagccagagagaacacaaagaagagaaaaacaucagauugucagacugccugccuccugaguacccagcaccacuggguaaaaagguauuuuauuuuauuuuauuuuauuuuauuuauuuauuuauuuauuuauuucauaugaguacacuguagcugucuucagacacaccaggagagggcaucagaucugauuacagaugguugugagccaccaugugguugcugagaauugaauucaggaccucuggaagagcagucagugcucuaaaucacugagccaucucuccagccccaaagguauuuuauuuuauggcaucaugacuccacacugugcugcaaugcacuuaacucuaugucaaaaugaacaugaacacagcuaaaauauauuaaaucugcaguauuaucucauaugcgaauguaagauguggauggcauaaguauucuaagcuaagcaaauaauuaauuaauggaaaggccugggagccgugguacaggguuaacaguucuagcucuugggaggcagaagcagaaucacaaguucaaggugacccucagcuccacagugaguucaaacaaaucuaggcuagcccuaucucaaaacaaaaaccaaaccccaauacuauguuauuuuagccuuacuccacuucuccaguuucauaucaauaaguagauuuuuaaaggacaacauuuuaaacauuuuagaaauacuauuuugcauaaccaacauaaucauguuuuacaaaaauagcaagaauuagcaggaucacaagcucaagacccaccuaggcuaggguguuccaagacaagcuaagucaacuuagugagauccugucucaagauaaaaagaaggcugagcccggcgugguggcgaaugccuuuaaucccagcacucgggaggcagaggcagguggauuucugaguucaaggccagccugaucuauagagugaguuccaggacaaccagggcuacacagagaaacccugucucgaaaauccaaaaaaaaaaaaaaaaaaaaaaaaaaaaaaaaaaaaaagaaggcuggaagcaugaggcucuugguuuacuuugcagaaucaaaaugaggaaguuucuggaaucaaaacuagcugaaaagucucuaauuacccaugcaggaaguucuagguuaaaaaucaccaagaaggagaaaagggcucaaggguuucugacaacuaucagaaaaacaagaaaaagaaaagaaaaagaaaaagacagggccucagucagcccuggggaagcagagucaaguggaccuggucuacaucgcaaacuccaggcuagccauggauacaaagcagacuuugucucaaagagcaaaagacacaaaaaugacaacccagaaagaaaaauuaacugccuuaagucucccuggcuguagacaggcuucucagcagcacacugcaagagccuuaaugcaggcccucaggaucuccugccucccucccuccucacagugcuuuucuccucuaccccagugguauggcccugagucagagggaauguaguguggcagucaacuagucugcuaaugugaccauuucacuacuuaaaaaucauacuuuaaaguuauuucuguaagucacuguuuucuucacuggcuauuccauggagagaacagccaaguuugagaucaaagaacauuuaaaaaucauuauagcaucaaaaaaucucuagauuaugaaucuuacugaacuauaaacagcauaauaccuuugguacauccaaaguaaccucaauuaucucuucuuagucaaacuaccuggaucaauguguauuuuaauacuucauaggccauaggcaggggcuggaacaauggcuucaugaauaugagcacggguugcucuuccagagaaucgaaguucaauuccgagcauccauguggagcuucacaaauauauguaacagcagcucuauaagauccaaugcucuccaaugguacccaaaaugcauacagaacacagauauaugggcagguagaaccucucucucucucucucucucucucucacacacacacacacacacacacacacacauacacacaaauacacacauauacagacacagacacagacucuuagaggcaguuguuggguagacugguacacauccauaaguuagcacucuugaggcuaaggcaaaggaaccgagaacugcagaccugcauggcgaaacacugccacccagaaagggaaagaacaaagagagggaagggaagaaaggggaaggaaaagaaaggaaggaccagggaggaaaaggaaccagcagaguaaaauagccaagaucacuuagagaaauaagaugaaaauaaauauauucuaugcaucuaugcaucuacagccuuguuuaacucaacagcuuuauaagacaauuagaauucuucuacuuuuauguuugucuaguaaguuuacccaccucuaaggagcuguuuguauuugcuuauguacauaagagaaaauuucuggcaugccaguggucaacuacguuaguacuuuuuaccaaccucuugaauaagcagcacaguugaauaauucaagcucaauguaaccaggagacucuuuaaaagcacagauuaaaaaaaaaaaaaugcugggcaugguggcgcacgccuuuaaucccagcccuugggaggcagaggcaggcagauuucugaguucgaggccagccuggucuacagagugaguuccaggucagccagggcuacacagagaaacccugucucgaaaaaccaaagagaaaaaacaaaaacaacaacaagaauacuguuuugauaguuaagaauucuccugguuuuccaauccacuagaacgaauucucacagggguuaugucucaaaacgucccugccauucauagguucaaauccuacuaccuaagguaacaguagcugggcuuugggaaagugacuagauauugagggcaaagcuuuauguuugggauuggugucauaaaagacccugcuagccagcucuuccuaccaucugaggucagaguggggauggagucugaggaaacacagccucaccaggaaggcauguaaucugccaucacuacaucuggucucuagaacuggaaaaaauaaaugcuaacuuuuuagaugccaccugauuuaugguguuuugcuauagcagcccaacaggucuuugcaggauggaucuguagacaaggcucaauaguuaagagcauuuacugggcagguugugguagcaauaacuuuaaucccagcauugaggaggcagaggcaggaggaucucugaguucuaggcuagcuuggucuacauacugaguuccaggacagccacagcuacauagaaagacccugccuugaagaaaagaaggaaggaagaaagaaagggaagaggagaagaggaagaagaggaaaaggaggaagagacaucgguggcaaaguauaggaaaguauuuacuggucuugcagaggaucagggaucaguuccaggauuggccugcuuggguucuuauauauauauguacauauauauauauauauauauauacacacacauacauauacacccaaauacacaugaguaucuacacacagacauaaauauauaaaauuuuaauguuaagguuuauuuuacuugaugcauacaaauguuuuguaucaugugugccugaaguacaaugaaaacuaaaccuuaauuacgugaugauuugccucuguaacuuaauuaacccaaccaaugaccuuauaaauucugaauauuaacucuggcaaaggcauaaugagcucaaagggugacuuauaguaagcacgagugcuggucuguaucaaacguuccuauuuaacaauacagccccaaaucuuucugggacccugaugagcccaccugaguauacacuauuuuaguuaucaggaaaggaacucaaaggcucccguguuaagaaaacccuggccuaagaguaaaugccacuaugaaagguuacucuugguucuuuuaagguauacugagcauaauccaaagaauaacuguaugugaggaagcccaggcauagagagccuacaaagacacaccucuccuguaguacggugaauuucacaacuccuaguguauauaauucuaucacaauaaacaaaccuagcaauuaugaagaacacacuaaauuauugccaaaauaaacaauuuugauauauaacuuagacauguucaauuaagaacauuaccaacaucaccugaacucuaucuaucuauguucaguacauacaacacugccagaacauuacacaaaacagaauucauguacuguguaacugucaagacgucuacaauaacuuaguccucauuuuacaggcaugaaaguguuugaacuuaggguauuugucuugacaucuguauguuuucuguauuuugauuaaaugcccuuugcuaucaccuaacacugcuucuacagaguauauguacauauggaaccacuauguacgaauaugagaugcaaugggaaggaggggaagucacaacacacguacuuugccccauuuaacauucuacuacugugugcguacuagacuucuugagaaguggaagaaaugaacugauauuuuugaaucccguacauaauaauucuccauuccagcucucaacugaaacaaaaagccuacauagaauggccuaacuucacaaguguuuauaaacacagugauguccuaguacaacuggaaaaauccacauucagacuaacauuuauauccuacacaugcaugugcuuuaacaaaacuuacacacacacauaugccuggacaaagaauaacaaaggagccacgcaagggcucuagaagagaccauugucaacucugcucuacaggagaagugauuaaagacuucuauuucuuaacucaaaacaaauuaaaauaccaaccugaacuacaucuauggucuucuaacuuucagaagaucuaacuacaaguagaaauccaacuacaagaugcuauccuuacuuucuccuacuccgcccccccccccaacacacacacucggagaaagaggggggaggagagagggaaagagagauuaauaaaauguucuaagggaccaggcagugguggcacacaccuuuaaucccagcacuuuggaggcagagacaggcggauuucugaguucgaggccagccuggucuacagagucaguuccuggacagccagggcuacacagagaaacccugucucgaaaaacaaaaacaaaacaacagaaaaaaaaauguucuaagggcccgaggauggagcccaguggcagagaacuugacuagcaggugccaaguacagguacugcagaaauuaaauuagcccuuuacuggcaggaagcauuuuagaaacacaaaaggcaaacugcuccucauaaaauuaguaguugcuuuaauggcagaauaguggaccguucaaaauuggugaaucauaaauguugaaugaaaugugugacaacaauguaaaguacugucauauuggcaacagaaucuccacacauuaacucaaagcaaacaaccaugcaaagaaugcauacauauauguauguaucccuuaaaguggcugauccaagaaucaaaccaccaaacuuuaaaauacuacuuuauucuguuauauagguuaaaaaguuaauucaccauagcgauuuuuugugacaacuuuauagucuugcagguaaaagucuuaacguugcucuauuauuucucuaaauaacugggaaggaacauaucgaauggaggaacaaacuuggcucagcaaaauggcuguagcugggggaucagcaaaccagacuucgggcuccacacuaauccuguacacauauauaaugauuucauuuaguagucgccuucucucaaaccauccauaccccuucuccaaagcaggcagugcugaagggucgggggggggggggaggggguugccuucccaucucaagaaaagaaaagaaaagaaaagaaaagaaaagaaaagaaaagaaaagaaaagaaagagagauugauugauuucaaagucacugccacuuuugcaccaucucccgcaaaccggggcaggcaagggagagaaaauuuuccgaagcuggaaauaaccucugcgcaccgcgggcgagcacugcaacgccuuccccgccggcuacgacgccggccagcagcaaaggcgcagcggcggccggaaacaaggucgcccgcgaacgugggcaacgugaggcccagucgugcgggacggggaggccgagccugcucccauuuugucgccauggccgagccuccuccgcgagguccggguccgugugccuccgcugucgcgcaguaccggacgagcuaggccgcgacucacgcccugcccccgcccaggcucggcguggccuucgcaggcccguggccuccagcccgcgcgccccagcgaccuuaccccccggcaaacagaugcaccagcgugucccucuggcucauucucucuucugcauguccuccgggaguagaggcgggacgcggacccagcaggccgccacggccagcggcgagggccaagaagggggacgcaagggagugggcggagccgccgcugcggaaggccacccgcgaacccaccccacgggguuccugcuccagcgagcuccgucggacugcgcagugagagucgugaggagucggaggucc

SEQ ID NO: 5259 - RNA, 63716 nt, Mus musculus
ggaccuccgacuccucacgacucucacugcgcaguccgacggagcucgcuggagcaggaaccccgugggguggguucgcggguggccuuccgcagcggcggcuccgcccacucccuugcgucccccuucuuggcccucgccgcuggccguggcggccugcuggguccgcgucccgccucuacucccggaggacaugcagaagagagaaugagccagagggacacgcuggugcaucuguuugccgggggguaaggucgcuggggcgcgcgggcuggaggccacgggccugcgaaggccacgccgagccugggcgggggcagggcgugagucgcggccuagcucguccgguacugcgcgacagcggaggcacacggacccggaccucgcggaggaggcucggccauggcgacaaaaugggagcaggcucggccuccccgucccgcacgacugggccucacguugcccacguucgcgggcgaccuuguuuccggccgccgcugcgccuuugcugcuggccggcgucguagccggcggggaaggcguugcagugcucgcccgcggugcgcagagguuauuuccagcuucggaaaauuuucucucccuugccugccccgguuugcgggagauggugcaaaaguggcagugacuuugaaaucaaucaaucucucuuucuuuucuuuucuuuucuuuucuuuucuuuucuuuucuuuucuuuucuuuucuugagaugggaaggcaacccccucccccccccccccgacccuucagcacugccugcuuuggagaagggguauggaugguuugagagaaggcgacuacuaaaugaaaucauuauauauguguacaggauuaguguggagcccgaagucugguuugcugaucccccagcuacagccauuuugcugagccaaguuuguuccuccauucgauauguuccuucccaguuauuuagagaaauaauagagcaacguuaagacuuuuaccugcaagacuauaaaguugucacaaaaaaucgcuauggugaauuaacuuuuuaaccuauauaacagaauaaaguaguauuuuaaaguuuggugguuugauucuuggaucagccacuuuaagggauacauacauauauguaugcauucuuugcaugguuguuugcuuugaguuaauguguggagauucuguugccaauaugacaguacuuuacauuguugucacacauuucauucaacauuuaugauucaccaauuuugaacgguccacuauucugccauuaaagcaacuacuaauuuuaugaggagcaguuugccuuuuguguuucuaaaaugcuuccugccaguaaagggcuaauuuaauuucugcaguaccuguacuuggcaccugcuagucaaguucucugccacugggcuccauccucgggcccuuagaacauuuuuuuuucuguuguuuuguuuuuguuuuucgagacaggguuucucuguguagcccuggcuguccaggaacugacucuguagaccaggcuggccucgaacucagaaauccgccugucucugccuccaaagugcugggauuaaaggugugugccaccacugccuggucccuuagaacauuuuauuaaucucucuuucccucucuccuccccccucuuucuccgaguguguguguugggggggggggcggaguaggagaaaguaaggauagcaucuuguaguuggauuucuacuuguaguuagaucuucugaaaguuagaagaccauagauguaguucagguugguauuuuaauuuguuuugaguuaagaaauagaagucuuuaaucacuucuccuguagagcagaguugacaauggucucuucuagagcccuugcguggcuccuuuguuauucuuuguccaggcauauguguguguguaaguuuuguuaaagcacaugcauguguaggauauaaauguuagucugaauguggauuuuuccaguuguacuaggacaucacuguguuuauaaacacuugugaaguuaggccauucuauguaggcuuuuuguuucaguugagagcuggaauggagaauuauuauguacgggauucaaaaauaucaguucauuucuuccacuucucaagaagucuaguacgcacacaguaguagaauguuaaauggggcaaaguacguguguugugacuuccccuccuucccauugcaucucauauucguacauagugguuccauauguacauauacucuguagaagcaguguuaggugauagcaaagggcauuuaaucaaaauacagaaaacauacagaugucaagacaaauacccuaaguucaaacacuuucaugccuguaaaaugaggacuaaguuauuguagacgucuugacaguuacacaguacaugaauucuguuuuguguaauguucuggcaguguuguauguacugaacauagauagauagaguucaggugauguugguaauguucuuaauugaacaugucuaaguuauauaucaaaauuguuuauuuuggcaauaauuuaguguguucuucauaauugcuagguuuguuuauugugauagaauuauauacacuaggaguugugaaauucaccguacuacaggagaggugugucuuuguaggcucucuaugccugggcuuccucacauacaguuauucuuuggauuaugcucaguauaccuuaaaagaaccaagaguaaccuuucauaguggcauuuacucuuaggccaggguuuucuuaacacgggagccuuugaguuccuuuccugauaacuaaaauaguguauacucaggugggcucaucagggucccagaaagauuuggggcuguauuguuaaauaggaacguuugauacagaccagcacucgugcuuacuauaagucacccuuugagcucauuaugccuuugccagaguuaauauucagaauuuauaaggucauugguuggguuaauuaaguuacagaggcaaaucaucacguaauuaagguuuaguuuucauuguacuucaggcacacaugauacaaaacauuuguaugcaucaaguaaaauaaaccuuaacauuaaaauuuuauauauuuaugucuguguguagauacucauguguauuuggguguauauguauguguguguauauauauauauauauauauauguacauauauauauaagaacccaagcaggccaauccuggaacugaucccugauccucugcaagaccaguaaauacuuuccuauacuuugccaccgaugucucuuccuccuuuuccucuucuuccucuucuccucuucccuuucuuucuuccuuccuucuuuucuucaaggcagggucuuucuauguagcuguggcuguccuggaacucaguauguagaccaagcuagccuagaacucagagauccuccugccucugccuccucaaugcugggauuaaaguuauugcuaccacaaccugcccaguaaaugcucuuaacuauugagccuugucuacagauccauccugcaaagaccuguugggcugcuauagcaaaacaccauaaaucagguggcaucuaaaaaguuagcauuuauuuuuuccaguucuagagaccagauguagugauggcagauuacaugccuuccuggugaggcuguguuuccucagacuccauccccacucugaccucagaugguaggaagagcuggcuagcagggucuuuuaugacaccaaucccaaacauaaagcuuugcccucaauaucuagucacuuucccaaagcccagcuacuguuaccuuagguaguaggauuugaaccuaugaauggcagggacguuuugagacauaaccccugugagaauucguucuaguggauuggaaaaccaggagaauucuuaacuaucaaaacaguauucuuguuguuguuuuuguuuuuucucuuugguuuuucgagacaggguuucucuguguagcccuggcugaccuggaacucacucuguagaccaggcuggccucgaacucagaaaucugccugccucugccucccaagggcugggauuaaaggcgugcgccaccaugcccagcauuuuuuuuuuuuuaaucugugcuuuuaaagagucuccugguuacauugagcuugaauuauucaacugugcugcuuauucaagagguugguaaaaaguacuaacguaguugaccacuggcaugccagaaauuuucucuuauguacauaagcaaauacaaacagcuccuuagagguggguaaacuuacuagacaaacauaaaaguagaagaauucuaauugucuuauaaagcuguugaguuaaacaaggcuguagaugcauagaugcauagaauauauuuauuuucaucuuauuucucuaagugaucuuggcuauuuuacucugcugguuccuuuuccucccugguccuuccuuucuuuuccuuccccuuucuucccuucccucucuuuguucuuucccuuucuggguggcaguguuucgccaugcaggucugcaguucucgguuccuuugccuuagccucaagagugcuaacuuauggauguguaccagucuacccaacaacugccucuaagagucugugucugugucuguauauguguguauuuguguguaugugugugugugugugugugugugugugugagagagagagagagagagagagagagguucuaccugcccauauaucuguguucuguaugcauuuuggguaccauuggagagcauuggaucuuauagagcugcuguuacauauauuugugaagcuccacauggaugcucggaauugaacuucgauucucuggaagagcaacccgugcucauauucaugaagccauuguuccagccccugccuauggccuaugaaguauuaaaauacacauugauccagguaguuugacuaagaagagauaauugagguuacuuuggauguaccaaagguauuaugcuguuuauaguucaguaagauucauaaucuagagauuuuuugaugcuauaaugauuuuuaaauguucuuugaucucaaacuuggcuguucucuccauggaauagccagugaagaaaacagugacuuacagaaauaacuuuaaaguaugauuuuuaaguagugaaauggucacauuagcagacuaguugacugccacacuacauucccucugacucagggccauaccacugggguagaggagaaaagcacugugaggagggagggaggcaggagauccugagggccugcauuaaggcucuugcagugugcugcugagaagccugucuacagccagggagacuuaaggcaguuaauuuuucuuucuggguugucauuuuugugucuuuugcucuuugagacaaagucugcuuuguauccauggcuagccuggaguuugcgauguagaccagguccacuugacucugcuuccccagggcugacugaggcccugucuuuuucuuuuucuuuucuuuuucuuguuuuucugauaguugucagaaacccuugagcccuuuucuccuucuuggugauuuuuaaccuagaacuuccugcauggguaauuagagacuuuucagcuaguuuugauuccagaaacuuccucauuuugauucugcaaaguaaaccaagagccucaugcuuccagccuucuuuuuuuuuuuuuuuuuuuuuuuuuuuuuuuuuuuuuuggauuuucgagacaggguuucucuguguagcccugguuguccuggaacucacucuauagaucaggcuggccuugaacucagaaauccaccugccucugccucccgagugcugggauuaaaggcauucgccaccacgccgggcucagccuucuuuuuaucuugagacaggaucucacuaaguugacuuagcuugucuuggaacacccuagccuaggugggucuugagcuugugauccugcuaauucuugcuauuuuuguaaaacaugauuauguugguuaugcaaaauaguauuucuaaaauguuuaaaauguuguccuuuaaaaaucuacuuauugauaugaaacuggagaaguggaguaaggcuaaaauaacauaguauugggguuugguuuuuguuuugagauagggcuagccuagauuuguuugaacucacuguggagcugagggucaccuugaacuugugauucugcuucugccucccaagagcuagaacuguuaacccuguaccacggcucccaggccuuuccauuaauuaauuauuugcuuagcuuagaauacuuaugccauccacaucuuacauucgcauaugagauaauacugcagauuuaauauauuuuagcuguguucauguucauuuugacauagaguuaagugcauugcagcacaguguggagucaugaugccauaaaauaaaauaccuuuggggcuggagagauggcucagugauuuagagcacugacugcucuuccagagguccugaauucaauucucagcaaccacaugguggcucacaaccaucuguaaucagaucugaugcccucuccuggugugucugaagacagcuacaguguacucauaugaaauaaauaaauaaauaaauaaauaaaauaaaauaaaauaaaauaaaauaccuuuuuacccaguggugcuggguacucaggaggcaggcagucugacaaucugauguuuuucucuucuuuguguucucucuggcuaucaaagucuuucuugucugcaguugaaaagauugugauagugcaucugcauucagugcauuuucuuaaauuugaacucagguuuuugagcucaucagggaauucagcuccugcccaggagcgugggugaguggguacauucgugggugcugugaaauuagggcucaauacaugcuagacaaauacuaucaggagccuuaucccagcuguauucccuuuagaaaguaagauuucugucacaaauacuggcugcuucuggaaagauucucguuggguauuuacuuguggacauaaacauauuaaauguuuuugcauaguggaaaugcauucagcuccaaauacuucauauguugcuaauuuucacauuuggcuuuuguccuaguuugcuuucuguuguaugauaaaugcaugaccaaaagcagcuagggcaagcaaggguuuguuugacuuaaccuguccuaaucacaguagaucacuucggaaagccagggaaggaauucagguagggcaagaaccugaaggaaggugugaacucaagcagaggccauggaacacuguuuacauugcuuacuguccauaggcuacugauuuugcuuuucuaaacaacccaaaaccaucugcucagggguggcaccacccaccaugggcuagacccucccacaucagucauuaucaagaaaaugccucuacuugcccagacaugcccagagggcaagcuguugaaggcguuuucccauaaagguucucucuuccuauauaacucuaguaucagauugacaaaagacuaacuagcauagcuuuuuaaagauuuguauucuugagaguuucauacaugugcagugaaauauauuuacuacuaauaaaccucccuccaacacccccauauuccucucaguacaguccccuaauuucaugcaugcacacacacaccccaucuaguuggggcuaccuuucugugcauggguguuggaccauccacuggaguguggaaauuguuccaguagccacagcacucaaauuuuaaauguaauuuuccuuacucuagcagcugucaacuaccaauaguucuucaguaagaaugggaucuggacacuguugcauaugccagaaagauuuugcugaagaagacccuguuauagcugucucguaugaggcuuugccagugccuggcaaacacagaaguggauguucacagucaucuacuggauggaacacagggcccccaauggaggagcuagagaaagcacccaaggaguugaaggggucugagcccuauagguggaacaacaauaugaacuaaccaguacccccagagcucgagucucuagcugcauauguagcagaagauggccuaguuggccauuauuggaaagagaggccucuugguauugcaaacuuuauaugccccaguacaggggaaugccagggccaagaagcaggaguggguggguaggggagcaggggguuggggggggagguauaggggacuuucaggauagcauuugaaauguauauaaaggcgggacgugguugcgcacgccuuuaaucccagcauucgggaggcagaggcagguggauuucuggguuugaggccagccuggucuacaaagugaguuccaggacagccagagcuauacagagaaaccauggggggugggggagaagaaauguauauaaagaaaauaucuaauaaaaaaaagaaugcggucuggagaucaucuaccucacucauuucaggauuuggcuggcuugaccuuuuguagcuaaccccaguuuacacugcuccacuuccuuuaguuccuuugcucuguacaguucuccucagcuguacugucagacacgcaugucacucucacuugauuuuagaguucauuaaguuuuaucccaagagcucucucagaucuccugcaggcagucuuuccaaaugacuuucccuugguggccacaaaucucacuucugcccuucuaguuuugccuuuuccagaauaucauaaaagugaaaaucucauauaauuaaagccaugcguggcagguuuuuucaaggagcauaauguuugagauuuauccuagguuuuuuuauuggaggauaguauucaauuauagauguacuacaguucagcaguccuugauuaauucagacauuuguaugguuuuucaguuuuagccacuguagguuaagcugcuauaaacguucauaaauaggcauuucagcaagucugccugucugucucuggccagucagaacccaggagugagguuacaguuuacaugcaucucuaccauggaaagugucauucuguuuucugaugugcuuguuccacgugucagccuuuuacauuuuagcaauaaauagcuguguaucucauuacaucccagaugacagaugacugaaaacuuucuguguuuguuugaauacaccugucuaucuuuuguaaauucugcuaaauaucuuguuaaaggguuguccaguuucugaguagcuguacuuacuuugucagacauacgauuugcaaaguagccuuggcacucuuuccauuuucuuaacagauucucucaaagagggaaaguuuuaaauuuuaguaugauacaacuuuucaguuuuaauuuucuuaauggcacauaguuauuaucauacuaaaguauucuuuguuucauauuuggagugguaggccucaaacccagagcuacuccauguggucacauucuggauccugaaauaauuucuuuuuaaugacuuguuauuugaaauuuuauuugagugauacuaaauauauuccugugcugggcugcuuuucuuccuuuuucuaaugcccgucuucuauauaaccuuguauuccauuagcucccguuucacauaaauaaguagaucucugaucaguuguuauucucaggaccucagcuggguagcuagcuuuuagugcugucaggaaaaauugucuccauuuuucugugugacuggaguuuucaguuuguaaugucuuuugagacagcgucuuauuguguguccaagcugguuagucuaggguuauaggccugcgcuguauggccuugucuagcuuuacaugggagcugggagcuccacucggucgucaugcuuguacaucaagugagaguacauaugugacuguccuacgcuuguacuuagagaauaauugcuuagauuauuacuuaauuuuuuucccuuaacuggcuuaaauaauacauuuugcuaugaguauuuuguuauucugaggaucagccuuuauauaaaaugaauuuuguuauuuauuuuuuucacuaauccugccuguucugcacacauggacauaacagauaaugccugugaaacugugcuuuguaaguacaguccuuugaguguuggaguacuuaaaauuagaaauaaguaugguuauucauaaguaauugaucucuguccuaucacucagaauuaguucugggauuuuuuuuuuuuaagauuuauuuuauuauuauaucuaaguacacacuguugcugucuucagacacaccagaagaaggugucagaucucauuaugggugguugugagccaccaugugguuguugagauuugaacucaggaccuuuggaagagcagucagugcucuuaaccgcugagccaucucuccagccccaguucugggauuuuuaaaggauuagaaauuugaaagauguuacacacuguagauuccaacagugcucugaguugcccaugggcaaagagcacuaaccaccucuuacagccuuaauucaguuugucagucacuuuuaguaaaagccaucauuggaaucuuccuuuaccuaauuguacuuuguguguaaauuauuaagcucauuuuuuccauauuuuauucugauaauguggguacuagggcuaccaguuauaacaugacaguguuucccauaguucccucaguucuuuuuuuuuuuuuuuugcgggggggcgggggggguuccagacaggguuucucuguguagccccggcuguccuggaacuuacuuuguagaccaggcuggccuugaacucagaaauccaccugccucugccucccaagugcugggauuaaaggcgugcgccaccacaccuggcugccucaguucuuuuuagaaaguguucauuugcagugaagugaaacuuucaaaagaauuagucuucaacauuuuaaauuguaguaagcuugggucggagcacuagguaggaguguguauucucacuggcugauuagaugccuacuuucuagacuuacugguuuuuuuguuucucuuguagaugugguggcacagugggagcuauucugacauguccacuggaaguugucaaaacacggcugcagucuucuucugugacacuguauauuucugaaguucagcugaacaccauggcuggagccagugugaaccgaguaguguccccuggaccucuucauugucugaaguaagagcaaaaagucauggguuuuguuuuugaugcugugauuguagugauucccacaugcuuaguuuuuauuuuuaucuuccauauuuuaaaagguucuuuagaaaacucagaagucagaaguaugaaucguacuucuuaauggugauaggccauaaaggaguagagcaguuaauuauaaagauuguaugaaauggaauauuuucaaauuguauauauuuagaauauuuuucuacauuauccaguggguuucuuuucuaaagguaucauagguuuguuuuuuuuuuuuaauugguuaauuuuuuuguuugauuuguuuucaggcaaggucucacuauguaguccucccuggucuaaaauucagccucuaaaacaggccugccucuguuccacccagauggcuguucuguuuaccuuugaaaugaaaguagugugguacuauuaugugcuuaauagucacauaugugcacaaguaccugcaucuaauugcuggccgucuguuucauuuacaaaauauagaacauauaaccuaaacagcugcagcuugaaacagcccagcuuuuaaauaucuguguugucauuuucugauuuggaaaaaauguuuauauuacuagacuuaauuaauucacauucaagacuggcuguggugacacaugccuuuaauccuagcacuuggaagguggagguaggcagaucucucugagugugaggcuagucuggucuacagagcaaguuccaggacagucagggcuacccagagaaacccuaucucaaaaaacaaaacaaaacaaaaaaacccuacuccgaucaguuucugugacuuuagauuuguauuagaaccccgagucugccuuaucagcucacaugccuuuaaucuguuugaauuugcucgcaguguuuguuuuguaggggcagaugaucucauccagguguuuacauuugcuacuaaauugcaucacacuuguucaacuugguuacccaagaacaugaaagguagaauaaaauucagcaauuuugaauuaaauuaaaaugucacaauuacagaaaaguauugauugcugugggagauuuuuuuuuuaacuuagucguguauuuuauguauauggguguuuugucuacauaugugcacaccagaauaggacaucagauuccacaggaacuacgguuauagauggguguugggaauugaacucaggaagaggagcccgugacucuuaaccacuaagccaucccuccagucccaggaaauauaucuuugcaucacaauuaugacauuacuguugauuaggucuuaaaauucucccuuagucgccugagauauauuuuguucugguuuucaauaauuuugcuuuuacuucaucauaagaacuuucaaaucucucuagauuuguuuguuuuuaaauauagauuucuuagguuuguuguuguugucuugaaacaagguuucacuauguaacccuggcagaccaggcugacuccaaacucaccacagaugcaccugcucuugccuacucaguaaugggaguaaagccaagcaccaccuccaccauuuucuuaaguuuuuccuccucuccuuuaaucucuuuauaaauuagucaccaaagaacccauuaucacuauacugacuaguuuucuuauuguaaaauuaggaucagugaaaaguuaacuuuuuucucagguaacgacuuggacuucauaaagaaaagucuugucucucugcccauaccuuuaauuauuacauucaucugccuuuaagagcucuuucuuuucuuuuuuucuuuuucaaggacaggguuucucuguguagcccuggcuguccuggaacucacucuguaaaccaggcuggccucgaacucagaaaucugccugccuccgccucccgagugcugggauuaaaggcgugggccaccacgccugccuguguuuucuucuaucuuuuaauguaguuauaagcugcuuauacacuaaguucucaauauaguaaauugaccgaaacucaccaagcauuccagugacccuuaggacguuagggugauagauuuuucaguagcagcuccuagaaaugauggaacuugauacuguggaacuugaggguauuuuccaagauggaaaacuucaaggacugggcuguggcucaguggugcaggguuuacuuucuacagaggaggcuugagucuggucccuggcacucagcucagccagggcuccagaauaaagccuugucucaagacaacaaaccaagaaaucuauauuuaaaaacaagcaaacaaaucuagagagauauugaaaguucuuaugaugaaguaaaaagcgaaagagcaagucagagccaacauauacuuccuaacuuuuucuguuaccguguuagaggguuccacugaagcccagcuugacuugaaacucacucugaaguccagguuagccugaaacuuaggauaguccucuugucucagccucccagguguuagaauuacaagcaugagucugcaugcuugguuaaacccaucauuuuaaaacauuuugugcauguuucugugaguacauucaugccacagucuacauguagaaaacagaggcuaacuguguagagucuguuuucuccccaucuuuaccugagcuucaggaauccaaaccagauccccaggcugcauggcgagugccguuacccacggagccgucuugcuagccauuuuagaaauguuuuguuacauuagcaugucacuugagucuucaguacuuuuuccugggcccugccuccugcacaagagguuuuuauaaguaaugaaauggaccugaaaaauacauuauaggugagacauuggcuuugcucuagcauauuaguaaagggugauagaagaacauugcuuucuaauaauuuguucuucucuuuucagggcuauccuggaaaaagagggcccucgcucguuguuuagaggauugggccccaauuugguggggguugcucccuccagguaaaaaaaaaaaaguaauaaguaagauucuggcugucuuuauuucaagguauuuggacauaaucauuugcagaaacaauguacauuucaguauucucaggaaguuaguugaguuucuauugcuaaucagaaggaaucuccaaagaaaaccuugguucuggagcuaacagaaauucauugugcugugaacagaaaggaaauguuucauguuguaaagagacaguguaguguuugcuuuaaacugugagugcucauacuuggaaagggaaggguagaauaaaauaguucuaacugcgguaacucuuaaauuucaaaaaacaaaacaauaucuuuaaagaaaauaaagggcuugguguauguguguagaggagugucuuuguuuuugauuugagacagucuuacugggugguccugcuaaccucaaaauuaccaugcuccugacuaacauaccugaguacuagaguuacaaaggcuuaccugacuauaaauaagcauuuuuuaaaaaaaauguauuuauuacauaugaaugcucuuccugcacaaauguaugacaucaugugggccuagucacaacagggaucagauccccugcaacuggauucuuccaugguaaguaaaaugcuguucaaaaaagcucauauuuaggaugaauaugcacaccuaguucuguacuucaaacugcauaccucauucacagccuguuacuguguuucacuuucauuuuaagaaaauacaguugagcuuguuugccuacaccuaggcugagcaacguugucuuggauucaaagccagagcuuagcuacauaugggggaaguucugggugaauggguguugguagugagauagcucagucuguaauggaaggaacuuauuuuccuacaagccugaugacuuguauucagcacucagaaccaacaguggaaauaaaaaaugcgcuccuaauucucuggucucuacagacacacaggaacacacacacacacacacacacacauaaaauaaaaauuaaggauuaguuuuugaaaauuguguauguguguguauacuugcaugugugcacacacucccaaauugguauguguacauucguacagguucccauggccuccagaagaggguaucagaucccguggagcugaaguuacagguaguugugugccacccagcaugagugcugggagcccaacuaagguccucugcaagagcaucuucuuaaacauuuaagaagagaagaaaauccauauuuuacaucauaaaaaugaaggguagaaaagguagcauagaguuucacuuuccacuuuaaauauauugccuuacugguugcauuuuaugcacaccauucuuuuccuccuagauagccacuauuaauaaucaguuaaguguacuuuguucuaauaacuuuccugagcugucaugaauaaaggcuugugcauauucauuauuuacauaaaugaaucaugggaaauacuauaacuugccuugaagcuccaugaucugugauacuuuuaauaauauauccuguacauaucugcaugcgugcauagauaacucuggaggccagaagaaggcaguagauuuccuggagcuggaguugugcucuuccugacaugggugcugagaaccagaugcaggauuguggaaaaacaccaugugcucuuaaccucuaacccaucuuuccagcuccuauugugacagugguuuucugaauauucccaaaccuuuaccuuauauaguuaaagacauuuauuagauuuauuuauuuauuuauuuauuuauuuauucguugagacaggguaguacuauauagccaggacggccucaaacucaaaauucugcuucugccucugggauguucauuagugcugcaaagauauauuuuuuagaaugacuaccuaaguagaauuucuggauaaaaggaagaaaagacauugaaaucuacagauugcuaauuuguccucugaagacacauaccaaguuuuuauuuucauacagugaacucauuguucuuaagccacauacuaaugaaugcuggcuacuguccuuuuuuaaaaaagaaauauuuuaugaauaugaguacacuguugcugucuuccaacacaucagaagagggcaucagaucccauuacagaugguugugagccaccauaugguggccugagccauuucucuagcccucacuauccauucuaaaaauacuaacuaaaugaacuaaaauuuucuuuugguauuuugacauguauuuaauuuuuguguaauuauacccucuuuauuagaaguugaugcuuuauuuuucauauuuccuauauguauauuccauaccgauuucucuuuaagauaucuuuuguaauuucuucuugggaaugaguuuauuccccgucauguuuuggaauuauauauccuaaguuuuauuauuauuauuuucuucauaaauuuaaugcuuuuguuauaaauuguuaaauaaucuccuuguauuuuugaagcaggcuuucacuuaguagauuagguugcccuugaacucaugauacucaugccuuagccacugccuuaguuaggguuuccauugcugugaagcgacaccaggagcaaggcaacucuuacaaaggacaacacugggacuuguuuacagcuucagaaguucaguccaugauggucauggcagaaagcauggcaguguccuggcagacaugaugcuggagaaggaacugagaguuuuaccucuucagccaaaggcauccagaaagaggcucucuucauugggcagagccugagcaucaaaucucauagugacacacuuccuugaacaaggcaacaccaaucccaacagggacacaccuaauagugucacucccugugcgcuaagccuucaaacacaggagucuguggaggccaaacccauucaaaccaccacaccugcuguuuucugggauugcagauuuaagcaauuuggccucuuuuuucuuaaacacaguuuuuaaaaaauauaauaauggaagcuagagagaugaugguuuaaugguuaagagcauuugaugcucuugcagaggaccugaauucaauucccagugcccucguggaguuuccuaauccucuguaacuccagagcauuuagugcucucuucugguguccauggcucugcaugcaccuggugcacuugcuuacacaucgggcgggaaagaugcagucauaaaaccccccauuaucaguuauugggcuacuuuguuaacugaguuauaaaucaggguuguugagauaauguaauguuugauucaccaagcaagaauugaguacuugaaaggcuaaaagccucuaaauucaauggaguauuuacagacauugcaaacauagcucgaccugacggaccuaaugacauugucagcauuguuuugucuuaagaauaaugugggcaagggguagaaagggaauagaggcuugguugggaucuccagugccaaaaaaguagaauauaggaauauucugcauauucuuauaguguagaauauauacaaucucaaauugaccagguuagacugacuagauuagcucuaccucuaaaauuaccuucaccugaccugguuacguacacugacucugaguuagcacugaaguacaaccaccacagcuccacugcauagacucuccuguugucaggauguuauacaaauucuuuuugcuucuuguaguugcuaagugguugucaguauugagcacggcuuaggugaucugagaaugguugcuaagaacuaugccuuugaguuuuguuuugguuuuuuuuuuuuuuuaggacuaaauguacuuugugggaaaaauggguaaaccugauguuauguugacuaugacugagucuuuauuccauuuuacuucucuauucuaaaauuaugaagauuuauaucuuacuuaauaacuauuuuguuuuuaauuuuuagagcaauauacuuugcugcuuauucaaacugcaaggaaaaguugaaugguguuuuugauccugauucuacccaagugcacauggcuucagcugcaauggcagguaugcauauuuaauaguaaaaacuccucuaagucuggaaaaguuaaugaugacuucauaucaaauuaagaugguuagugugccucuuaauaauuaaagugugcaaagugguuuuuguucacuugaauaaaacauuugcuguacauaaaaucuguuaucaguugaaucuaugugucucaggguuuaagugacagacugcagauaacacauucauuuugcugugugcugguuaauauuugaugcaucugugcuuuuagagucuagccauaccucuacuggaguuagagcugccacuuguucuccucaguuuccauuagugacuuccugcuccugucuggaacaugccacccgccaauacugggugccguauucauuguguccugugcgcagaugcugcaguugugugagguucauuaugacccaguuauugcaguugguguacccucaagaauaguuuauccuuccucacagccuggacugcauccuggaccugagcuguagacacuggcuuauguguacacacuuguguaggaaugcucccaggaaauuaacgccauggugauacgacucugaaucaaaacagccucacaggucucugccucccuucucaggaugagcgguaaagauuggccauucugacucuggagucauuugcugccaugcauguuagacaaagccuugaauuuuaguucuuaauagaaaugucucccaguuuucugagaauuauuaauuaaucuaccuuauauuuccaaguuguccuguaauuucauaaaacaauagcugcuuuuaucagcuguugaucaauaaacugacuucccauugugugcuuaaggagugccuuaaacuguuaaucauuuucuauuuagaauaguuuaauuugaaccacauauuuaaccacguaaauguguguuugaaauacugacuugugaaauauugauaaccuuugccauauaauaagucuaguaauacuuuacaauuguguucaaggcugugcauuuuacaauuguugacugauugacauuuuggaagggacaguguuuaaagucaagauacuguauccucugauuugccagcuuggaggucuugaauaagauagguaauuccugggaguuuuuaugacauuaucuauccauggaauaacuggauugaucuggauagguugggcuuugagaacuaguucuugguguaauaauauuuaccuaguuacaaacuagaaguuuuuaaugaugcuauguauagauuuugauuauggauguuuuccucuuacuuacuugauugaauauuggugaaaguugggccaauuaguuauaaacccaguaaccauuacauuaggucagaauauuucuugacuuuagcauuugugguuugggggcaaugggguuguuuauaucuaacuccaaaaaauuaaaaagaaauguugauguuaguguaaaaaauuaacagauaaacagucguuuuaaaguugacaguguuaauuauagauuuaauauuacaauguuagagggucaaaguaucuuaccagaacaucuuauuuuauuaggauauaucaacaaaauuuauuaccagcuuuuuauugcaaaguaauuuaguaaaacuuuuuaauucuuuccucaaauguguaacaucuucauuuauacuguuuuccagauugacuuugguaaauugaugagcauguaugcacagacauuguuacacuguguacuuacugugcagucugaaaucuuuuuuccauuuacuuacaguuacauugucuugaaaauuaugcucucuacauuucuuuguacuguuuguuaguauuaacauuuagcuuugcaaguuuuucauguguugcuacauggcuggugaaacagaauggucccguacagauugacuaagguagauuuuuuuucccccauuuauucuuaaaauaaucuguaccagauuguucuggguuuucuucagggccauaguuuuggauguugaagaaugauuuagagguacaaaguucucaaagauaagucauguguaaaaguuuuuaacuggcuguuaaaaaaaaagaaaugcuaaccuugucacuuagguagcaaaaaugcauuaaaagauucagccauaucaccuuggcaguuuugccacuccagucagcacacacagccucucucuucaguuucaucuuacuuauuauccaaaucaacuaaaacauguuuaaaauuaaaacuuaguuaaaagugcuguuuaaaguguuccuuuuuuuuuuuuuuuuuuuuuuuuuugcaguauuauaaguggccacaccuaaaaugguuuacugaaacauuuuccaauuacagagauauuccauccaagcaaugcugguugcuucuggguuuuacccuccuuuccucccuuacauacaacuguugacaguguuuacuauagcuauugaggguuucuguuuuaugucuuuuuuuucuugaaauaaucuugaguaaccuucugaguguaccaaccauggcaccuguugauaugccaaaaaaauguauuaaauuucuucuuucuuuacaguaauucccaauuuuuaaaaguuuaccugacacauacuuucuacauguaacauaaguauaaaggaaaugagcuucuauuuuuauuauuguuuauccauauaguuagugugaaauuucuaguaugucaguaagcauaaucauuuaguguugucaguguaucuagugaauaguaucuacuuacagaauauauuauuuuuguugguuuuuaagaaugcauuuuuuucaagguauuuuuucugugauuuuuaacuucaugauuugaauguaagguuagguguuuuuacuccuuaaguagaaaguuuacaguacucagccaaaugcaugguuggacagcugcuguguaugcuuauuugugaacauuuuuccuguuuucuguuuuguagaacacaagaauuaauacaaaauaauccaaaauauuccauaaguauggaugugcaguauuacugcuagagucacaggugacagguacuacuguuagcaauguguacuuuauuaguuacgcaaaguuccagacuuuaauauucuguuggggcucuguguguuucuguuuguuuacuuauuuuauucacuagauuaucugauuuuuaaagaauaaaaguguuuacaacucuuucaugguagauaauagugguaggaaaugggacauagaaucccuucucgguuuguuuguuuuuuuuuuagauucucccuugacaagguuagcauuuuuucuuuaagacaaaauugaucgucuuuuagguaaguauuuggacucugaaucugcugaagauggcgggauugucaguacucuguguacuuuuauuauaaacacaaggcacauucugauauucucuuaacuuaaaaauuaaaaaaaaaaucucacaguaaauauuucuuaacuccuucagugagauucauuuuguacacaugugucuaugaggucacugcuuguuguuaugauacagaaagccugugucuauuuuaggcauuuacuguacauuucucccgagaaaagagugagaucgugucaucucaugcuccccauccgcaggucacuuccuguagaaauauggacuaacuuacaccucgugaguacucaacugagcgucucuugcagccucuaguauaagaacacacucugggauggauuguauaguagcuguagaaggcgggacguggauugcaauaugugcauuguugaguguuucauaaagauuuaacacugguccccuuguuaucuuauccuucuagaaggaagaauggccuacuuuuccaguuaccauguaaacuugagguccucagcuuggccauaauagccuugaccuccacagaaugacaggaguauauguuaauaucuuagagaguuuuaguuuuaguaugcuguacuacagcuguuaaauaguaguaguugucuuuuguguuugccuagcuaacguuuagaagucuaacacagugcuuuccacucucaucuauugguacuugguuacugcucuuuuuuaaaagacuggugucucuacuuucuaagaaauucaggcuguagugaauaaggucuuagcugcuuuaguguaguuauaauuuuuauaauaguuugaguacuuuagucuuaggagguuguauaugcuuuauacuuucagagcuuaauugaaauaaguacugaaaugcaguacugcagguaucacucauuuaagcaugcucagugaguuucuauaggugggguuuguuuauguuuuuaauugacuuauauuaucaaguagaguuuuauuugauguacaacuuaaauuuacauuuaaaguuuucuaaaguuuuucaguaaaacacugauacuacuaacuaaaugccucuauuggcgcguugcuuugacugauucuggaacaauacacauuuucaaucuacaaguggaucccucacuguacuuuccauuguuuuaauguuuuauuggguguucugaaugcauuagucucuuauuaaaauguaacaaaacuaaagugcagaauuagaaacagauaggcaauuucuaaacuuuaggguuaccaugcccaacaucuguguuugcuuguuguaaacguagcaagaaaacauguuuaguuguggcuaaccacaaacuuccuuaccacauaauuuuguuuuauuucuuggguuaauagguuauauuuuuccagauuuaauuagccuaauaaugucuguuuugcuauuuaacuauuuuuuuuuguuaaagaaaguaauacuguaaagaaccaguuagcuuuuuuuuuuaagauuuauuuguuuguuuguuuguuuauuauaugugaguacacgguaccugucuucagacacuccagaagagggcgucagaucucauuacagaugguugugagccaccaugugguugcugggauuugaauucagagacuucagaagagcaguugguguucuuaaccacugagccaucucuccagccccugcuuuuuaauuuauuuuuuuuuuucauauuuaaggaccaacagcuaaaaccuauagauaaugccuagcuucuuuauccaagccagugagugauuugcugauuagcuaguugucuguacucugugccagagcagucacaguaagcagaacuuacaguaagauaacaagauagcauucucuagcuuaccuaaauuuuaauguuggccuauuacacauuguaucuggaaaugaauuuuaguuaagugagaaauaccuguuguuugcuuucugaccuuguuuauuaacagagaaauauuaaaguuacucuuugaguauuaaaacuuuuguacucugaguaauuuaaaauauuuuuuauauguggugaucuuaaagugagggauuuugugacuuggaaagcgaucaagggcauaaacuugaacuaaaugugguaaucuuuucaaaaaaguaagcugaaugaaaguuuuuaauuggauagcuuuauuuuuagcuaaagagaauaaauucuaugccuuuuaaguuaaguuuuauaagaagacagguuaguuuuccuaggaauaauuaaaaucauuauggauaaugaauaguguuguagauuuaugcugcuccuuuuuaauuagaaacucuuacucuuacuguauagacaccuagcugauguacauauuuuacccuuacuguauagacaccuagcugauguacauauuuuacucuuacuguauaggcaccuaucuaauguacauauuuuacucuuacugcauagacaccuagcuaacauacauauuuuacucuuacugcauagacaccuagcuaauguacauauuuuacucuuacuguauagacaccuagcuaacauacauauuuuacucuuacugcauagacaccuagcuaauguacauaucuuacucuuacugcauaggcaccuagcugauguacauaucuuacucuuacuguauagacaccuagcuaauguacauaucuuacucuuacuguauagacaccuagcugauguacauauuuuacucuuacuguauagauaccuagcugauguacauauuuuacucuuacuguauagacaccuagcugauguacauauuuuacucuuacuguauagacaccuagcugauguacauauuuuacucuuacuguauagacaccuagcugacauacauauuuuacucuuacuguauagacaccuagcugacauacauauuuuacucuuacuguauagacaccuagcugacauacauauuuuacucuuacuguauagacaccuagcuaacauacauauuuuggugauacgauucuuuaguaaauaagaacugggauuagggugugacuuuguaguuagaccauguguguagcaguugugaagcccugguuucaguccccaacaaggagucauuuaguugggguguuuugaccuguauugaugucugaaaguguguaauuuguuaaguuuaacuuucuuauuuagaaaaauaagauucaaaggaagaaaauaacagugugcauucauucucagacuaagcguauaagaaaaauauuuaaacuagucugauagucaacuuuuuuuuuccaccaagaguaaacucaugagaaccucuuauuaaaaaggauauucuuugacagucuguuccauauuucaaauugauuauguuauuaccugcuaaugccaaaguuauuggucucauuucucucuauguaguauuaaaagcacuuaaggaaaguagaaacuauauuauauacuagucaaaauaguauuuaaaaguuaauaagccaaacuuuaucuugcuaaauaggcuuaauugggacacuucuuugugugagauguggcuacuuuuacaguguuaaagcagggcuuaaaagaaguaaaguuugaguaaguuaauuaucugauacugcagaaagggaaagaacaguugaguuagaucauuccacuuaauguagcagcuuuaaaagccaaagaaaguuuaugacuggcucuaauaacuuuuauaguaggauuaaauacaucacagcauuuuucucauauuaaauguguuggguauaguaugucuuucuaaaagcaacccgcuugacaugauaguauuugauagaagguauuaaaauaacuagguuccuuauuucucuaucugaguuuauguaauggauguaaaggccaguugaauaaauguaguucugugaaguuuauguuacugaucuuauuugggaaagcaaacuaaauacucuucuauagaugaaacaucuuuauaaauucuuguucauaagauagcauuuucuaugcuguuuugcuaaaaauuaaagauaauacuuggucccagaagcacacugcuccagcgauccuaauuugcucuaaagcugagccaccccgccauggccacugcugcucugcaguggugucacuaggugacuguagugacagagggcugccuucuacccuacucacuuucuucauugucuguagaagggaggagagaauuccggucuguaacuuuuuggacaaacuuuuuaagaguuuauacuuguuuaauuggguaauaagugaccccuccuguuaauccuagcagaaaucuuaccucuguguuaauauuauuuaaaaaaaaaaugaugggccaaacuucugguccacagaccaaaauauuaguauauaaugccauuuauguuggauucucuuugaauguaguguggcagguaauagauucacccccaggcaacuguuuuagaaugcauguuugugaacuuggauuauaggggagaacaccauguuuucauguagauuaggagaacacuugaagugaggucagucugcuccugacagaaucaucuagaaaggccagaauugugaacagguguucauggucacuagaacauaaaaugaaaagugugaagccuguaucaguuaauaguuucaacauugcuagacauuuucuuuaauauagauucauauaauguaaagauccuuaaugugaauaauguauuuccucucuacugacacauuuuaaauauauuuguuuagguuuuacugcaaucacugcaacaaaccccauuuggcuuauaaagacucgcuuacagcuugaugcaagguauguuuuuguuuguuugguuuguuuugguuuugagacagggucuuacuguagcccgggaggagcacaggcugcccucaaaugcaaaugcauguugaucuuacugccucagccuuccaaguguugugcuuacaggugagucaccacaccuagcucaauauaguuauuccuuuuuuuuuuuuuuuuuuuuguaaauaaguguguacucugucugcauguacacuuguaugccaggagagggcaucauaccccauuauagauggucgugagcuaccauguuguugcugggaguugaacucuaucucuggaagagcagauagucuucuaacugcugagccaucucaccagccuuaaauuaauuuuuuuauucuuaaaaaaaaaagccaacauggauuuagcuaauuuuuuauguauaaauuuguauuuguaauugauuaaaacaggcuuuaagcagggcagugucccuuuuuggcugcuaauuuuauacacaaaagugggauggcauuacauuuucacacauggacaggaugcauuucuaauacacacacauacacauacguucucucuccuguuccauuuucagugauacuagcuccauuucuccuuuugucuuucgugugugugcugcuaugaguuucuuuaggauuauuuccagaagccauggguaagaguuuguuuuaaagaggguaggccccuuaaaauagcuacaccacuaaagaaauucuaugccccaucaaccuuuaacuauacccaaauccccaggagagagcggcacucuaugaaccccuuccacucccucagcagugcugacaggacaguuauguagagauccugcucagggcaucacagcugccacgacucuagugccauccucaugacuagaaaucauucugugucaucccccugucucuucccuucuuccagcaguauuugcugagucuuggaagagguuaugcagacaacccacuuauagcugaacaugcaacaguuguugauucuuugucucuugacagucuguagucacagcucaccuuugcaaaaagaagcuggcagcagccuccuucuguggcgugagcauggcacugacagccaucugacgggccugucauguccauuuagcagcauccuucuguggcaugagcauggcacugacagccaucugacgggccugucauguccauuuagcagcauccuucuguggcaugagcauggcacugacagccaucugacgggccugucauguccauuuagcagcauccuucuguggcaugagcauggcacugacagccaucugacgggccugucauguccauuuagcagcauccuucuguggcaugagcauggcacugacagccaucugacgggccugucauguccauuuagcagcauccuucuguggcaugagcauggcacugacagccaucugacgggccugucauguccauuuagcaaucauuuccccauuagucacgggguuugaccaguuuuuagaaccaacugugaaacuuuuccucuggagcaagccucugucugauccagucggaaagcagaugggcauccccugaaauaggccugccaguguuacgccaguagguucaucuugccuagccaaucaguauugugcauauugaguccacagcaaguaaaucugguugaaacuccuuccccagccuucugcauagcacuuucuagcacugagggccacuauugaguauuuguuggugcuucuguuucauuugaaauguggaucuccuaccaaaagcaaaagcuauauaauagcugauaaugagacagucuaaauaagaaaacugcccguauuuuggaguuuuaugugcugcuuauugggggaugauagguuaaccaagccaaaguagugauuauuaccuguauagcuccuuguaagggccuccuaacagcuaaauaaaugaccucauagcuagucuagagaaaggaccauugcuuaacccagugaccuauguccaaaagcgcugagcugggaggccgcagcccuauggugguagacuuccuuaguuaccacugaccucagguuuaccaagaaaaaguuuacucauucaacagagcuauguugagcaaguacugcuucauguuauaagauucaccuggagucacugggauuuauuuuaaauggauagaucaauggaugauucuuuuuuaaagccugcuuuugguuuuucgaggcaggguuucucuguauagcccuggcuguccuaagugcugggauuacaggccuacaccaccacugcccugcuuaaagccuguuuuaaucaagaaccaauaagaauaaaucucagagaaucuaaaauauaagacuugggggauguuuugucaucugagagcagacuagaggcagcagugcagcugagguauuccaucucagcuccuguuggccucaguggagaaaagggagaguucacuuuuuuuuuuuuuuuuuuugagauuauacuucuuaaauagccgaucuuaucugguuguauuagucaggguucucuagagaacagaagauuacagguaaaaggcuuguugauaguuucuagguauaggucuggauuagcugggcagugccguuuccugaagguacuauucccuuuauuccccuuugaaucagaccuuuccuuaagcuuuuuuuuuuuccuuuaaagauuuauuuaugcauuuuaucuauguggguguuuugacuauauguacauuugcacacuagaagaguacuggaucccauggggcuacaauuacagauggcuaucagccaccauaugugugcugggaagaucagccaguguucuuaaccaccaccuuuccuaccaccacgacccuuuuuuggagauaggguuucucucuguagcccuggcuggagcucccucuagggaccaagcuggccuugaacuaagagaucugccuaccuguuccugcuuccugagugcuagaauuaaaggcauuugugcuucaccaccaccgcccaacuaaacuuuuuagucucuuugaacaaagaacuugguuccaccugguauaacuguccuuugagauacucggccagagucugaccaauacagaugcagauguucgcagccaacuaucagacugagcacagggaccccaauggaggaguuaggggaaggacugaaggagcugaagggguuuacaaccccauaggaagaacaucaauaucaaccaaacagacccccagagcucccagggacuaaaccaccaaccaaagaguacacauggagggcccuguggcuccagcagcauauguagcagaggauggccuuaucuggcaucagugggaggggaggcccuugucuuguggaggcuggauuuaccaguguaggggagugcuaggguggggaggcaggaguggguggaugggugagggaagcacccucacagaagcaggguguagagggugcaauggaggguuguagagaggaaaccgggaaagggagauaacauuugaaauguaaauaaauaaccaauaaaacaaaagcaauaaaagagaacuugguuccaacauuacauuuccuggugcucuuuuuuuuuuuucaacuguaucuauauuucucuuuguucugcuugcccccuuucugcauaaagugaucacuuagucuguccugaaaucuccuuuaccagugauacugacccaaaacucuuuaaccccagucgcauuuuuaggugaagggaaaagaucagccacguaucacaagaauggaagaauguacccuuuagggauagcuacagugcccucaugcggcacugaaagagauuauauuuggaaauguagggacagaguggccauuuaccaagcugcuccaagggagucugucaggcauuugucugauagcuuuucagcugggccuuugugaaauugaaaaaaaaacuaauuaugauccuuacuuuaagaugcaguaucaugggcuggugagauggcucaauggguaagagcacccggcugcucuuccgaaggucgggaguucaaaucccagcaaccacaugguggcucacaaccaucuguaaugagaucugacucccucuucuuagugucugaagacagcuauaguguauuuacauauaauaaauaaauaaauauuuuuuuuaaaaagaugcaguaucauaauuuaacaccucccuuggccuuugggggugagguuaguuuguuugguuuuuuugagacagagucuuaauuauguaguucuggcuggccuggaacucacuguguagacuaagcuggccucaaacucauaaaagauccacugcccucugcuucccagaguguuguugagaugaugaugcacacaacacagacaaugccgacccucauugucucaugucaguaacugcaaaggaaauuuagccuccuuggaacugaauguucacaguguaagacuuugggguuugauacuuuuugagucuugcuugggucaacauuugagcauggcauggaguuccauaaaaguagggaaagaauaaagagugccauauuuaagaaauacauauuuuguuaacuucgauaaaaaucuuccaguacuuaaugccaguaauauuuucccuuuuauuugcaggacucguggggaaaagcaaaugggugcuuuugaauguguucguaaagucuaucagacagacggacugcgaggauuuuauaggggcaugucugccuccuaugccggcauaucagagacuguuauccauuuuguuauuuaugaaaguauaaagcaaaaacuacuggaauguaagacugcuucuaugauggaaacugaugaggagucugugaaagaagcaucggauuuugugagaaugaugcuagcugcugccaccucaaaaaccugugccacaaccauagcguauccacacggugagagaauagcugggccacaaccauagcguauccacacggugagaguauagcugggccagagcagugcaucacccucuggggcauacaacacucagcugccauauaagaagaugcugaucuuaauaguaguuuuagggcuggugagacggcucaguggguaagagcacccgacugcucuuccgaagguccagaguucaaaucccagcaaccacaugguggcucacaaccaucuguaacaagaucugacucccucuucuggagugucugaagacagcuacaguguacuuacauauaauaaauaaauaaaucuuuaaaaaaaaaaauaguaguuuuaagucuagucaugccaucauguuuaaauggaaaacaagaagaaauguuaaaauuguaauuugcccaaggguaugucagaaauggaucccagauuuaaagucuuuaaauuacaaggacccaagcaauuuuauauuauuuuauauugccacauuaagcaugcccaccaaaaaauugcuucuaauauauccuguauucaucuuuacuauauuuaugaauauuauuuguucaucaggcuguauuuauuauauacccuuauauuuuacuuaguguauauggcuguauuaguuugguguuuauccagucugacuggucucaggaagcuagcuauacacugaaucacugucaugaguuuauagugacagaugagcucugugcucgguaaggaggaggguaaaaagguugcaguaaaaugauuuucuuugcugggcggugguggcgcaagccuuuaaucccagcacucgggaggcagaggcaggcggauuucugaguuccaggccagccuggucuacagagugaguuccaggacagccagggcuacacagagaaacccugucuugaaaaaaaaaaaacaaaaauaaauaaauaaauaaauauuuucuuuuguuuuuccuauacagaaguuguaagaacaagacuacgugaagaagggacaaaauauaggucuuuuuuucaaacauugucuuugauuguucaagaagaaggcuauggaucucuuuaccgcggucuaacaacucaucuggugaggcagauuccaaacacggccauuaugauggccaccuacgaacugguggucuaccuucucaacggauagcagcaagggcugccauacugcagagcaggaagaccaaaagaucacaguggaccauggaaucuugaagccagccagcaugguggacagaagacaguaguugggaaacauguaacuacuauggcugaguggaaguuugguuuuaggaaguaagguaccauacgacauuaaucuuucagugaguaaacccugggccgccucgucaagaaugcuuugaaaagcauuccuuucucaaaauugccauuuucucuauuguucaccagcuccaguuuguuuuacugguuuaugacauucagaauacaguguugauuccaugagcauuuuugguuguuuaaacaaaaucauuccuaaguguauacuguacuguaauuuuccaaagaugguagugacaauuacaaaugacuaacuugaacgucugcaauacuguaaaauaacaagucgauccucaguaacacuuccccaggagggccugccuguuacaguguuuuauguuaucugacacccauaaucacuguauuuugacagccagugaaguaguaucuaaauacuucacauuuucaacaucaaaauguuauggucacaucuaaaagaucuccaucauaauugaacauaucaaacaaacacacacagcuaaugguuugggacuauaaaauaagcuaguggauacugacucagugacuuagcauccucauaccuuuuccaauuaugugaugcagguauggauauaauuuugauucauaaugugauuaucacagucucauaccuacauauuauuuacuuuaaaaguagaaaacuaacaacuugaauuuuuucuacuuacuuucacauuaagaauuuuaaccuuugaauuauuuccacaucuguauaaguuauucuuuguugguagaggaaaugguaauuuucaguuuugcccuuuauaggcuccuugaagugauauuaauauuuaggacaauauaaauauuacaaaaagacacgcucagcuaucagauacaauaaaucuuaguuggcagagagccuguaagcgagugugcuacauugcacaaauguuauuccuaguucccuaaaugcucucucauagagucaggcuaguuuuaguucauuguguuaacaagauaauaguuuuuaaauuuugcuguugagucaacaacauguuugaauacuuuaauauauauggccauuauaaagguauuugcugcaauacuauagauuuuccuauggauguugcuauacuggcauaugaaacgucuacaauuaaacucuaguguggugcucaucagaggaccuucacuuuacacuuugugcaauggcuuucucuucagaaugacuuugugaaugcacuuuguggccuuuugaggggguaagggucaggagagaauucauguuaauuucuuuaacauuguuauguauuaggcagaagcaguguucauaauauuuuucuggauuuuagguauguuuuggagaucuuacaguauuuuaaguaugcuguguaaugccacauuauuauggaaaaaaauagccgcaugccauugaaagcuuucucugcugucaccaaugaaguuuaaucccucuuaaauuucucaccuugacuuccuuguaaucaguaacuggauguuuuugaggugcucaauuggaauuaaaaauauuccaaucuauuuggagaccaaaggcacguuuagauccguuaccuuuggaauuauuguagcuuugacaucuaugacauggaacauaccaaaaaauaaauccccacgcagggguuuaacuuaaauguguagagaaggucucaggcuauaguguuugccucuucaggugccacugauacugccuaauacagcgccauuugcucugugaagaucaauaacaauuauguugaaugucagacauguucuccuguguuacacagaucucagaugaugaagaaugacaugaaaaccagcagccaaggaacagcuuguguugucguagcaaguccacaauaaguguccuucagggauaacauguagcagucgguauuuuacaaguaaaacucacauuagccucuagugcuuuuaaaguuagcgugugaucugcaagaaacgggguuuuagagucucagugguuacuuguaaagcaaccgcuggaaaggagcaaggagaucuguuuuuuuuuuuuuuucccugagcauuguguaccacaguuuacuucaugacagagauaauccaaaaaaacggaaaucauauauauguuuuauauaguuugucuaugaaguauuucuuugaagauucuaauuguaauguuuuuuuuuaagugcauacucagagcauuggauuuuuuuaaaacuuguuuucaauuagauaaucuuuuuuuuaaugucuuaaagagcuaggguggaucuuguuguauacuuuuguugcagucuucucaaaaaagugaacucacucagccgggcuagagcaguagcuacuagaagcaacccucacacagcagcagcuccuguggcucaaaugcuugaaauuuggauaauccagauggugaguugccaagcugucaugggauaccauacagugcuuuaaguugccuggguuggcuuuuacuucaacuuuuguuuguuuuauuuuuggacucuuguugccugagaugacccugacuccugcuuccccugccuuugccuauaaguaccagcguuacaggcuugccccuccacgcucacggaccuuguuccaguucucauuguacaacuguguggaaccaucccgacucagaggggcucgagcuagcuuguaauucugauaccaugacagcguuguuaggucacacagccugguccuuuguccacuuuugguagccuuauuaggaugagcacaacaugggguguccagaagagugaaugucaccgaagucuaaacauggggggcuuuaaaaauccaugaaaucauuauuucaguuugaagaacuuaagugguagauaucagugucccccuuccuccaaggcccuuccuucguauuucucaguucacaugcucuucuguccaaucugcccgucugauagggaccccugcggcugaugcacagcucgcucuccuucuuuacugugacuuccaacauuccuaaggagauccacacaucuggguaaagaagacagaccuuuacuauaauauaaaaugaagagugcuuucugccccucacauccccuauaacuuuguuucucccuaauugcaccuggguuuuuaugcuguccacuuuagaaaauaaaggacuaguucugaucagcuaugcuaaccuuucugaauguaccccaguggaugugaauuaaauuauaccaaucacucacaguguagucagcuuuaaaagagcugaugagcuuugcccauucaugugaguguugcuauuguugcgguuuuuguacauggcugcaaauuaugugcauuuauguucuguuuauguuaacuagcugacuuguacuugaauuaaaauucaaaaaauuaaaaugugcuuuuaaaaauguguaucuuaagauuuuauaauggugauaucauuguaccagcauuaggcuguguguagaacagacugcauuguucugaguuacgcaaaaaaacuuucugccuguuaaaccugauaauaucuggguauaaaaaggucagauaguguaauuccuucauaccuugaaucuguugguguguggucuuacaaaucuguugaucuuugaauucaaugcuuuucaucugucaaaacauccaauuuguacagcacugaacagugagucugguuagaguauuaaauugauguacucuaucuagguagugacauuuucacacuaacuuuuuuguccuaauaauagauuucaagaaaguuaauauuuuuuuaaaccagagagcuuauagagugaccaggugaauccauacauaguaggggauauggauuaaaaacgaugguaguggacaggcaagguggcuaagcagaugaggugcuugcugccaagucugaccaccugagugggguucacauggugggaggaaaaaccaacuccuccaauuauccuuugaguuuccuugcagacugugacacuugaccucucacauaaaaacacauuaaauaguaguuguuuaacugaauugugcucuuguuuccaccuacuucuuucaguugucauguuuuaaguuuccaaguuuacauguucuuauaggcacagaagccagaugagaucuguccuguuguauagagauugguaugauuuaguucaugucucauguuaagggguauggguguguguuuuacuaaauguuaaggagaggaauuuggauuuaugcuuucucggccuuaguguggagguuuggucugcugcuauguugaaugcuuaauucuguaucuguugcuucaaggugagcgaauucucaugccagcuuuuguuguacaaauuuuguuccuuaauauaaaacuauugguugaauaaagaugccuguagcuaagcagaagagguagguggggcuuugguuucacaggcuuuugggggucugaggagaggccaagagagagaaggaagaagucaccauggaauagauagaucaugagcacauggccacgaagacuggccaauuggaaucugagcagcccagaaggaacaaggaaagugauaucuugggauuauugacagagauguagacaaaagaacagagaggguggauaucugcccagcucuagugcuuuuagguuuuucuuuuuuuuuuuuuaagauuuauuuauuauuauauauaaauacacuguagcugccuucagacacaccagaagauguugugaggucuuuggaugcuugugagccaccaugugguuacugagauuugaacucaggacccuuggaaaagcagucagugcucuuaaccgcugagccaucucuccagccccaugcuuuuagguuuuacuauaaguauaaaggcuuugugaauuuuauuugggaacuaaugaccuaaggugugguagaaaccccugaauauuuaccacaccuuacugucacauuuguauaacucguaaaacuuaaggcauauucauuauacagauuuuuuuucaaucuuuguuagauuuuuccccuucaagauacuuuuuaaacuauuaugaauaaaauuguuuccuuuuauuuccucaaguauguuuuuuuaaaggauuuauuuauuuauuauauguaaauacacuguagcuguuuucaggcacucuagaagagggugucagaucucauuauggaugguagugagccaccaugugguugccgagauucaaacucaggaccuuuagaagagcagucagugcucuuaaccacugagccaucucuccagcccaucaaguauguuucuuacugguauguaggaaggcuguugaguuuuauguuaauuuuguauccaaccauuuugcuguguucaacagguuuuguuguuguuguuuguuuguuuguuuguuuuauuuuuuuauuuuuuuuuauuuuuuaaguacacuguagcugucuucagacacuccagaagagggagucagaucucgugaucggaugguugugagccaccaugugguugcugggauuugaacuccugaccuuuggaagagcagucgggugcucuuacccacugagccaucucaccagcccuguuuguuuguuuuuaaagcgugugccaccaccaccggcuuaaaagaauauuuugugucagucacaucuuaauguauuuuuaacaauuuuuauauuugagaauuuauuuuauuuaugaguccacuguagcugucuucagacacagcagaagagggcaucugguuccauuuacagaugguugugagccgccaugugguugcugggaauugaacucaggaccucuggaagagcagucagugcucuuaaccccugagccaucucuccagcccuguguucaacaguuuuaagaguuuuuuugguaguuucuuuauauucuuuuguguauagaaucauaccaucuacaaauagagguguuuggacuucuuuccugguuuucuuuuauuugucugcuuagguuguggcuuuaguuuaagacuucuaguaugauugaauaagaguauagaaaauggacaccuuuggauuauauuaacaaaauacagguuugucguguaacuuuuucgauacugagguuccuuuuauucugagugcacuugagacuuuaacgugaaaggcauaaauaacauuuauugauauguauauuaaacagucucuaucucuggacuaaaacuagcuucaugguugugaaugaucuuuuuaaauguauuuuugaauucuguuugcaaguagcuuguugauaauauuugugucuauguucaucagggaaauugauguagaguuuuguuucaucuugguucgguaucaggcgaauaggagcaucguaagggaguuugguaaugucucuuccuuuucuagccuaggaacacuggaggaacacuggaaagucugauaaccugggcuuuuuuguuuuuagauuuugaauuacuaauguaaucauaauugcucaucuucauguuauuuuuguaggccauaugcaucuauaaauucacccauuucuuucagcuuuuccaacuuagugggguguuacuuuuuaagguaagaccuaaugauguuauacacuucaucagugucuguugugauggccccccuuucuucuaauuuauuuugcuuuguugagacagaauuucucuguguguaccguaccuguccuggaacucacuuuguagauuaggcuggccuuaaacucacagaggaucaccuaccuaccucugcuuccagagugggccacuaccaacggucuucuuccuuccuuccuuccuuccuuccuuccuuccuuccuuccuuccuuccuuccuuccuuccuuucuuucuuucuuucuuucuuucuuucuuucuuucuuucuuucuuucuuaauaauuaauuccuauuucuucuuuuagucuagcugaggguuuaacaacuacaucuagcuguuuaaccaaauuuuuguuucauugacuccuaguauuuuguuauuguuucuauuucauugauuucuucccugauggcacuauuuuuuucccauggagggauugggauuugauuuguuuuuguuuuuccaaggcccuaaguuguaucauuaaguaaauucauuugcugucuuuaacuucuuacuggaggcaccaauagcuguaaacugcccacuuaagaccaccuucauaauuuuuccauggauuuuggaauguuguauuuucauuuuucucuaggacuuuuuaaaaaaaauuccuuccuggucucaguuauucguucaucguccagcauggugggugcaguagccaugaguuuguacaugcccuauaguuucucucucuuuaaaaaaugauuacauuauuugggcaugcacagcaaccaaggagaagaggagagaauaaauaacaguagugggacgauagucccauuccugucugcacucacuuguuugcuuuugugaguuaaugugaguuuuccagaauggcacccauguaaacuucugcaguacaggugguuaaugcugauuugcaggcuuguagagcuuugucccaaacuccccuugugaccagguguguguuguccugugggagcauaaaacacaguauaggucauguagauugaugugggaccuuaucauguagaugucaaguuaucucuauagauaaacucuuaguagaaguaaugucagccuggagagauggcucagcaguuaggagcuccugacugcucuuauaaagggccauggcggugcacugggaggcagaggaucucugugaauuggaggccaggacuauacagugauaccuugucucaaaaaacaaaacaacaacgaaagacuagucugugacucaauugcagggauuccaacacccuguuuuggccuucauggcaacagacauacauguaguguacauguauguaguauacaugugagcaaacaugcauacacaucagaacuuauuuaaaaagaauaaaaacaucuuccagaaaucuaaaagguugaaugugucaacaccauccucacacacacacacacacacacacacacacucaucacuaaauacauacuuauuauaagcaacauucaaccaacuugauguaguuggcauuucuagaucacucuagacaaugaauauggcguauucaagguagaccauauguuggaugacaggaagugagaauaaauuuguaagaaaccuuagagaggaauguagaaagauaccuggaauagccucaccaauaugcugaaguuaaacagcauacuucuaaguaacacaugaaucaaagaagaaaugagauuuguccagaaaacaauuuugaaguaaaacaauguaaaaaguuucaaagcuuccagaaaagaaugugccccaaaggauagagaacaacuuuuacacuaaggaggagaacauguaaucaaugcuacuugaaacuaggaaaugaucaaauuaaucccuaaauagaaaaaagaaaagugauaaagcuguccacuaagaaaaugagaaacaucuguaaaaucaacaagaguaagaaagacuccaguuagugugaccagaagcaucgaagcauccaauaagaagugcagaugcgggcuggugagauggcucaguggguaagagcaccagacugcucuuccaaagguccggaguucaaaucccagcaaccacaugguggcucacaaccaucuguaacaagaucugacgcccucuucuggaguaucuaaagacagcuacaguguacuuacauauaauaaauaaauaaaucuuuaaaaaaaaaaaaaaaaagaagugcagaugccugaagggccgagagcaagagcuguagcugcucagaggaaauucaaaagucucugaaaugagucggcacagugcaucuccgaucaucacagacuacucaacagcugcuccuuccuuuguguuucagaggcagcuccagacuccaguguguguggcacuuccugugaaggaauuaggaggacagcugcugggaugagucccaaccccaggucucagagccacauucuagauuccccuuagcucuuuuuuuuuuuuuuuuuuuuuaaggaggaaaugauggagcagacacgugugugcgcaucuucuuuuuuuuuuuuaagauuuauuuauuuauuauauguaaguacacuguagcugucuucagacacuccagaagaguggagucagaucuuguuacaggugguugugagccaccaugugguugcugggauuugaacuccggaccuucggaagagcagucgggugcucuuacccacugagccaucucaccagcccuccccuuagcucuuaaugugaguuucagugacacugcacugagugaaacccaaaccucccaaaaaaccaaaaaaaucugaaaggacugguaucugguuacuguaccccuuuuagaaaacgagucugcugucuaguugccauagaaagugggccagaaccacaaguggaucuuugacauaccaucauauuccaaccuguuauuuuaagaaccaaguuccaaucuuucacugaauuaugacagucaguuccauugacuaaaccgauggcucuuccugcuucuagauauacagagccauuguggcaaaucuuauaauucaaauagacacuuaccuuugcagaaauacuucggucuuuggaaaucugggccucuaauuuugcagggcccaaaaggacccugagugacucugccccuugcagaagaaccacauaaucuuucaucuucaguguguauaugcuacuuuugaguguuacuugugugcuaagucuucacauguaccuucguuaaaccauugcaaagaccuuuaaugccagaagcuuaggugugguacaugauacaagaggccuguggucauaguuccaauuucccacacucuucccuuugaaguggcccauuugacaagcagaccacauuccuaguucacaaauggugguccucgugaggcaggcaggaagaaucaaacacacaugaaauucaagucaaguuccuuuagaacacauuccugaaccuucucaaauguaaguugaucgccagcuucucugugguuuccuggccucaaggaaccuaccaugcuuagcauuuagauuucggccuccauuaaaggaagacggccacuagguggcagcaauagcuagauaagaccuguccgaucaugcugauggacccagggaugucuccaucucugugaaguagauuucuuuggucugguaccuauuuugagcacuaggguaggaauugaaguuuuccagaggcaucacauguagaugagccuaucuagguccuguaccuucccaacagcucuggccuggacauaccagacauaucuugguuagguguuuagucuuugaagcugauucuuuguaugcugcuacucacuggauuucauucuugcuuuucagcugcuaaucacugagccuuggcuagagcaguuggagagcuugguaguagcuguccaaguccaugcauaugcgcuuuucaaacgcaugaugcauacucaguguguuugucuccuugguuuugacaauggauaaagaccagugugccucucuccacucugcccacgucuuguucucucuacuucaucuugucuggaaugagaccaucaugcuugaagcuacccagccaguagugacaaggcagucagaagcacaugcuaugggacugaauggaaagaaaggaauguggaugccaggagcauaggggagcuaccacaacccucuggacaacccaccgcucaugcacaagaaaaguaaaaccugcuucaaucacuagauuuuggauuccuguuacaaaggaaaaaaaugagcaagaugcaguucaucuuaauuauauaaucguggaaauguuaauaaaauuguaaauuacaaggaucaccaaaacucucaauaccugucugcacauacaaguaucccuggagguuuuagccaucuguucuccagauuuacacauuuucccagaggguagcaaacaggccguccucugcacacucuucuuucugguuaguuucacuugauaugaaagugagaaaagcugcaggucgauugcauucauggacucguagcaaacaggcuacuccuggcguuuuaaaggucuucggguuucuuuugagacaggaucucuaacucagucuggccaggaacuauuuauguagaccaggcuggacucagacucaaagccaucugcuucugucuccugaaugcuaggauuacaaaucugaucuaccaugccucaaacucaugacauucaaaaaaguaucuguuauacacgugugcccauguauccagcuacuugcagaagucagaggagagaguccgauccccuggaccuggaguuagaggaaguuguguacuguuugacaugggugcugggaaccaaaauuuggaccucagcaagagccgcagcacacuuuaagcacuaagccaucucaccagcuuuauucaugguauuuuguagaaaagaaaaagaaaaaagauaguaagucauaacaaaauuggguuaaucccaagaauuccaggaucacuguuaaauaaguuauuaguguaaauuuacuauaccagagguuuaaugaagaaaaaacaugauccucauggaaaagcauucagcaaaacuuugcaaauuagagaaggggaaauuuuccuugguuuuaaaauaguaccccagcacuagggagauggcuucacuggcuagccagccuagccuaaucacuaagucuuaggucuccaucaugagacccugccucaaaaggguggaagucucuugaguaacuccugagguugaccucugaccuccacaugcacucaggcguuaugaguguacauacacucacacacacauaaaaguccaaaauacacgguagaacaaaaggccuaaacagccuugaugcuuguccagaggugaggagagggucacauuguaguuacaaaguuugggauaauuuaagaccauagggcuugaguauggggauauagaaaaaacaauggagauuaaggcagagccaagaacagacucacaugcuuaaagcagaaucuugacuggaagaugggugugguggugaaugccugcagucccagcgcuuggaaggccugggcaggagauucagagauugaagccagccuggacuacauaacaaaacacuugacaaagaaaaggagaagaaaacaaaagaaacuucauugggucagaaauagcauaaaacuggcuggaccauccaacaaaaugguacuggcucugugguuauccacaugaaaagcuagcaaucuggauagucgucgccaauugauacacaccucauguccuagacuaucccuguagguggguuagacuuaaaugugacaggcuaaccuuuuacaacuguaagaaaucauaggagaaaugucccuguaaacugguggaggaaaaggcuuuucugugcucaauauuaaagugcacgccagacaggaaaugacugguagauuagucuacauuaaauuuuagaaugucuuuuccucaaaauacuuccccaaaaggaaaaucuaauccaaagccuggaaauauuugcaauguauacaacugucaagggauagaaucggaauacauaaaaacuucuaugaaucaguccauuaaaggcaacccaauaaaaaaaucuggacaaaggucaaaagugggcauuuuacaggagaauaaaaccuaauauaccauaauaaauguguguugggggggucaucuuagcaauuaggaaacaacaaguuaaauugcaaugaaaugugauuuuaaaucuuucaaaaaugcagaaucuaauaggacgauaucaaauggaugagggacaaagaaauucuuaggugcugcaguugccuaaaaugagacuaucaacacagggaaaaauaugcauucuacaguugaugcuaauagcauauaagcuggccgguucgcuccuagacacagacccuagagaaaacauagcucagauguuccaggagucacacaagaauguucauagcagccugguugccauagcaaaacacugaaaacacucucucuguccaagaacaggagaaugcagaaauucacaugagggaaaaugaaugaacuccaagagcagccugacuugguccaggagccugguuuugaauaagaaaaguagaucauaacgguaaacagaaaguaagccaaggcugaaagaucaaaaccugaggaacacaaccauguaucuaggcaagcaggugcccgucaauaugauaaaugaaagccaagagaacgguaaacaaguccugaugauagucaucuggggcaggagaaaauauuuuucuauucugucacuguauaacaaauuacucccagacuucacucagauauuaaauaauaggauagucacucaccacuuaguuuccagggacuagaacccuggguccuccaggacucuccgaaguggcauuggaucugccaggaggggagagaggcaauugaggaaggaucagcuuccacacuuucccguuauuacugggcugaggguucuggaucccccaguaguuuguccuugauucccccuccccccucagggaagcucuaaaccccuaaaugcuuuaccacgcugcccauugaaacagccugguguguagcacuuuuggggacccguucucucuagcuccucaucuuuccccauccucugacugcacccuaucugucucuuaggcagguugacuaaccaaucucuccccguuuacaucugggugccugacccaggacccacccagcacaugagcaggggaagcaguguggacuaagagaaaagcuggggccauucugcggugaaauguguugccaugacaaaagaguaaagggcuguaaaguucccaguagugugggguuauaaagaauaggaggaggaggaauggucacauuuaagaacuuuggaauuucagacaauagauuguauauuugugcuugcuugaaauauccaucauugagagaaguuuccuuuuuccaaaugagacuucgcaucuugaaaaaaaucaaaccuacagaaguuuuuaaucuaugcccuucauuuauaaacucauuuguuaacaucuugguacauuuacucugugugugugcaugcacacagcacacacuugugucuuaagugagagucuuugaggauguccacauccuaaugucaggacauguguauauggcaaggagugauucaggcuccuaguccgcagaccuuaagcuaagauacuauccggggcuacuaaggcaaguccaguucaaucacgagugucuuuguaauugggaagaaagagagagaagaaucaggaccagagagagauugugagaaagauucagucagcucuuaccgguguuuuuagaugaaggaggccgugagccaaagaauucaggcaaauucugggagcugaaaaaggccaagaaaaaaagaaggcuggaguuuccagaaaagaaugcagccuaguggggcccaucucagaccccuggcuuucaugacgacaaaacaguaagucuggguuccuuaaagccacuagguuggugguaguuuguuguauuauacagcccuguauugcagugaccugagaaaaaucacuuuguaucaagcaagguguguuuuuggcucaugguuuuagaggcuucagagagccgucacuugguuccauggcaagacagaauaucugggcaaguguacauggguaagaaagcaagccacucccuucauagcaucuggaaucaggaucccagcaucccccuacaaaaacacacccugugauagcuaaucuugguugucaacuugacauaccugggaaaagcuaaucucuguugagaaacuguuuccauuagauuaaccugugggcaugucugugaggcauuuucuugauugcugauggauggagaggagucucaggccucugugggcagauucaccccugagcagguaguccugaauuacguaagcaagcuagaugagcaagccagggaacaugagccaguaaacugguccucugugcucucugcuucagggccugcucugacuucccuccacggugggccauaugcuguaggcuaaguaagcccuuucugccuucaaguugccccaggucagagugauuuauuccagcaacagaaaaaaaaaaaaaggacauauccagugaccuuacuccccagaggccucaucugaugcaaucacaguagggccuuuuaauucaagcuugcaugggcccuucagcacaccugucacacaguuuuggugaugagccccgaaugucuauugggucaaaacuuuauaguaagcagcaagcgguggcagaguggggaaagaggaggagaaagaagagaagaaagcaacagcaaucuugaggaggcuaaauuaccagaaaugagaggaauggcauugcuacugauugauucugcauugacucaaaaagauaauaagggaauccuaagccuggaucgaugguacuuuuuuuuuuuuuuuuacaauuauaugaaaugggacaauuuuuugaaaaguauaaacgaccacaguuuaucccaaaacauauggauaacuggaauagcucuauaucuuuaaaaaaauaauuacuuuccuauuuuaaaauaaagaaaauccuguagugccagggaagaguagugauccucaaaaacacagaucuaaugcagcccacagcagggucuuuauucaagcuagcucggggccccucuaaugcaccgcugucacgaaggaugguuuuggugguagggaucccugaauaucuaucagggcaaggcguuauaguaagcagcaagugggggguaagugugcaagcaucugauugaaaagcugcuguggccuucaacauaauuggcugugcugggaguccuaucauaaacuucauuucccucugcguugcuggccguuaagcagggggugggcuuauaaccuggggugcagauuuguugcgggaauaaccuggagaugcgggggucgggggaggaggguaagccuagagacuggagcuaggcuugggguuuguuguggggcaacaugggaacucaugcuagguacuagccuguuaguucaccugcguuuaaacuuaggucagcuucuuuaaaauggagucugaauuuaaaagauuuggucucucaccggaaggucuaguugccuaggagcgaauucucacaguuaccagcuuuucuugugcaaaccuuguuccuuaauuuacaacuauugguuagauaaaaauggcuacaaccaauuacaggguuggaguuaccggauuggaguugcagagaggggagagagaugaaaggacagggagagaagaggaagcagccaugaggggagauggaccaugagcccuuggccaggagaaacagcaaguaucugggguccaccaccggggauguagccaggccagcaguuauaauaguagaccaggggugacccccgauaauugucaaggccaaaucgaauaaccauagucugagucuuauucauuuauccgcuagaaggauaagcuuacauuggggcaacuagagcgugagggucauuuuuuacucagauuuauguguuuuuacucaguuuccuucuauguuuuuguuaguuuguuuguuguuuuuguuuuuaguuuguuuuuguuuugaucauuucauagggaucagcacacucuuucagucacaaugcaguaaugauguaguucaggaaaaccgguaucaggcaguacagcuaucccuuucguucaacacguauucagucgugccuguugcaaucccauauagcucacagcguuuuauccuucugcaagaucccuuucaaucuuucacuugagacacugauauuuucuagagcacaggcuagcucuuguguagagugacucacacagucuuuuguuuuguuugguuugguuuuuuggagacaggguuucucuguauagcucuggcuguccuggaacucacuuuguagaccaggcugacuucgaacucagaaauccuccugccucugccucccgagugcugggauuaaaggcgugcgccaccacgcccagaacacuuacagucuuauuuuguguguaugcuuacacugaaguuccggagggaggagauaccacaggaaaagcauguuauuacaggguauuuuuaauuucuaauuuuauuuauuguuuacauguguauaucuacaugcacaugaugugugcacaagcacgugugccacagcaugugugauggucagaugucgacuuucaguucucuuuuucuacugugggucccaagaaucaaggucagguugucaggcucccgugggaagggcuuuguucucuagacaucucgaugguacuaucguaagauauuugaagaguugguaauuccugaagcaauuagaaaauaauuaauuaccagggcaucuuuuuuuuuuuaauuuaauaaaaaaugauucagagaaagcuguccgucccaauguccaucccaaugucugucccaaugccccaccuuaguccuaguuuuccuggcuuuagaacuggccugagagagguaccguucucucucaacgucucuagggcgugccagcaccugcugugugguuuggagcugcuaucuggucuucuaguagauuucuuccugcccucaggaucaggcaccaggagcugcagaaccuggggacagcaucgugcauugaucucagaagucugauaaauuauagucacugaaacacaaaggaaauagggaauuacagucuucuguaguaaaggccaauuaaauguaguuugaauaaaaaugucuaccauuaggcauuuacccagugguaucauucuauuaggcuggugugguagcucaugccuguaagcccagcacguauaaaagaucaccacaggcuugagggcagccagggcgugcauacugagcuucaggcuggccuucccugcagugugagacccugagucccaaaacaaaccaaugagcaagaccccacacuauuagcacuguugaauagauccacaucuguguggcauacucaccagucuaugaaugaauguucuaauucagcuggaaugagauuguagugugggaaguagcagccaagaauucccagauuccccagcucucagaaaagggcucuacaaagcaucaacacuguaucuuuaaaagcaacauaauucuuaucuaguugcaacugagacaagugccugcuuccucucccuuuuucccuggaugggaugucacacggacuugagcagaauacugugccaugucacucaggaaaccaaggauuuaaaguaguauuguguuuauuggugcaauuuccucuucguucccuggggguuucaguugaaggcaggugggacagaagagaagagcccaggccuucaguagccaucccagccccuucuuuauccaucacuccccgagacuauucacagccccggggaagcagagaacgcagucguuauuuucuuguuuaucccuuuuguuaugaucagcaaguaucugcugauuagagcuguccaugcagagcuggccagcauuuggaacuucguuccagaacucuggggagcauauggugaaauaccacugaacuguacucucacuauacccaggagagagccagcucuagccagugugccauuuugaggaagagucuggauuuacagugugcuggaguucuuaggaaaugggacaaauaccaaggacaggaaucuggcccauggcacccagcacauuacuauacucaacaaggcaguguuacucuuuguccccaugugaaacauggaaggggacaaagucauucaaacaaccaguaacccacugauggcuuggaucgcaugauuucccaguuccgacaugucuucuucaaacccagugucugucaccuccucuggaaacucgagguuauuuucuguuuccccgacuauaaaacuagaugaugggaaccacaggacugcucacagcauaaaacuugauaagcacuaugcaaaggcuugaugcgcagagggagagccaagcuacagcauccuucauggccccgagugggggagagccugugauguagcuuccuucaaacccgacaaucuuccugugcucucagccguucuuguuuugagaaagaaaauacaaccagcuuuggaaaggggauaaugggucaagaaagcauuuuuucuugauuggaaaaugaaauguguauacacacacacacacacacacacacacacacacacacacauauauauauauacacacacacacacacacaaugagaaaccauuuaagucaguuaauugcauauuuggcaucuauggacaaggggagaaaaacacauaauaauauauaauacacauaauguauaauaaguucaccugucaaaacuucugcauggcccaggccauguugaaagauaaggaugagcugggcacaccuugaauuccccaaaacucgggaggcagggacagguggaucucugaguuucagggucugcaaagugaguuccaggaaagccagggcuacacagagaaacccuuucuugaaaagaaaggaaggaaaaaagggagggaaaggaggugggucggucagagcucugacaggaacagcacaguugcugggcauacugcuucugcuugagcuugcgcuccuggggcccugcaguaagggcugcccaugugacuacacaaggugccugcacuccaaaccaugucucaggaugagcaguugcugccguacauaugccaaaggaugucaugaucagcaagugccaggcauuuucccucagcaaagccucauuagacugugauuugacauuaucuaauugaugaaucuuaugagaaaaaauguguuagcacuggcuagcuguggcuagcacugccugugugucaggauaaaacagacaucguguuaaugauuaugguauuuauucugugcuagaucguuuagaggucuggggcuuaaauuguucagcagcucaaaaacacaacuguucaagcaccagcaaguucccagugucuccuuccuccucugacaaaugggaacgcagagaugacagauucccaaagccacugcugggauccaggucacaaggcauggaggagguggagacacaccucuuguugugagcuuguucugcaggcuucagagaugugugauuucagagaguugccauccaucagggaugucuaucaaggacagggcagugcugaccugccucauacccaacaggaguucuuagcauccccccagaauccaccucgauggacaccucuguucucuauauaaauggaagagauuucuguaaguuucuaaucugugacguguuuucaaaagauguagccccauagcauaaaucacugcaguuggucuuauuagacugaaguuuucugcgguacauuuaucauuucagaaagucacaaaacuuauagcaauacuagcucuguaucuaaauggaaaauaacucauuccugaaauggaggaacccuauauggggugaguuugccuacaucuuagcaucugacugcuacgcuccggcaguuagcccaguuguacccaaacauucacauacugaaguacauauuacuguuaauucugauagucuccagagaaaaaccaaccccaccauuuugggccaaauuugaagcaugucuuuuuuuuuuuuuuuuuauugcguauuuucuucaauuacauuuccaaugcuaucccaaaagucccccacccccucccccccacuccccuacccacccauucccauuuuuuggcccuggcauuccccuguacuggggcauauaaaguuugccugaccaaugggccucucuuuccagugauggccgacuaggucaucuuuugauacauaugcagcuagagucaagagcucugggguacugguuaguucauaaucuuguuccaccgauaggguugcaaaucucuuuagcuccuuggauacuuucucuagcuccuccauugggggcagcaugucuuauuaaauauuaaauacugaccaagagauggacuuugaucaggaccauucucuggcauuucccagcugaauggccugagaugugugcuacaaggguuuauaaagacaagccuacaggacacccuacuuucccaugaggcuuugcuauuuuccaaugacuacaacacccagcauuccaggaaguuaccugguccuugggcagauggggcuuacagguuaauuuugggcauuacauuaccacaaaugacucuucucuauuucucccauaugguacaauuauaguauuacagaugcaccuugacuuaagaauaucaugaccuaugauuuuagguuguuguuaguuuugagacaaggucuuacuguguaauacauuuuggcaugaacuuaguguguaguuuaguugaccuccgauucacuauguaacccacgacaucuucaaacucuuggcucagucuccuaggugcuaggaugugugccaccacuccugauaagacuggggauuuuuugacaaugguauaaaagccacaccuuuucaauagaaagagcacugcagauuuugcauucuggguucuuuccguggccaggcagucagagcugugauagugugcuguggcagagcuggaagaggcagggagcugagcccacagccagccacccaucaugagaguaaacugucacuccugugcuggggggugggguggggggcguugauguccucaacacuggguguguuaaaugcauuccacuuaugcaauauugguggguuuaucagaauauaaccccauuuuaagucgaggggcaucugcauguggauuugaguauacugugcauaauuuuauuccaagaugauuaaagagaacccuacaaacuauuuuucaugaaaggggagguuuuaucaggaaggcuaaaaaucugggagggucuagauucucuacugcuccuggugguuuuuuuuuuuuuuuucuuccccuuuucugccuccacucccacuccagacagccuucccaggcugggcucaaagucucuacguagcccaggaugaccuugaccuucugaacuuccaccauccaccuccgaagcucuuggauuacaguaugcaucacugugccugcuuuacgguggcguuggggucaaaccagagcuucgugcaagguaggaagcaaucuggcugccgagaagugucuccagcccggcuucugaugcuuaucucccugcagcgaaguacccuaauaagugguuuaaacaagacggaguucuguuucucuuucucauaagugaaauccaaggaaaagugauugcagcuggcacggcgguuccggcagucgcuggggacccaggcuccuaugccucuguucccuuaucuuuaaugucaagcuuucauuuucaaggcuggguccaagaugacacuggcccgcaggucgucgccaucacaggcugcgcaggaagcuaggaauggcaggagggcaaagggguaccuugcagcugucugucccuggcuaaggagcuuacccagaagccccauccaacagcugcuguucauccauuugucccgccuccuguuaaaagaggcugggaaaagccaucuugcagcugaagugcauuguucuaugggaugaaaucaggagugauuaaaaaaggaaggaaggacauuggcauggcauuuagugaucucaaugaccugcucagagugucgauaaugaagaaaugccuuccucccaggacggagagcugaugaccuuucaaagaacaaagccugugccauucaagagacaucccaucuaauuguggccccuccacccacugugugcugaccugagccaagugacagccucugagcuauccuuuucuugucuguacacgaaagacagaaauagaaccuacucucuggagucaccaugaacuuuaaagaagagcccugccaaagcccugacuagauucaccuccuccugccccguuacacacuuaacaauaagcagugcugggcccucccgucaggaagcccggcgcacuguuccgcacacaguucagugagcagaggaagcuagucucaaggaaaacacccgccucacaccugucagcucuuggcccccaacucugcgggaaggaugcggagacagcuggguuugguuuuucugggcucuucucugcgauccuuuccggcaggggcagccagcggccaaacucuugagcauagucuagucccuugcagcaucugccucccguagaugcguaaagcucuaagugaggaaucugcgagcuucucaugcccuucccuuccgcaccacauccuuuuuaagggacaucucucccucaagcaccauuuacauccagagaaaccugggcuccugggaaagauggcugacgggauccugggccagggcaggaccgucuauauacaagaagaguuugggauagcucacauccagagagcacagaaaaccagagccgauaaacgggacauacuggaagcccagcuagaaggccaacacuucugauggccaaagacaaaguggcuucugcaucaaaaacaauaaugacuagaauauaugggaacauaugguuuucagacacuuuguuuuuagcuugccuuguguauaguguauguauaucacauguguauacagggggagggggguuauacauguagccagaggccagcgucaggugucuuccuccauugcuuuccaccuuauuauuucucuuuuuguauuuauuauuugucucuuauucacuuuauaucccucucacagcccaccucucaguuacucccucccacaagccuucccccccaccccaccccccgccuucccguucuucuccaagcuggguaucaccuuacccuggcacaccaagucucugaggcuaggcacauccucucccacugaggccagacaaggcagcccagcuagaagaacauaucccauauaucccucguacaggcagcagcuuuugggguagcccccacuccaguuguucaggacccacaugaagaccaagcuguauaccugcuacauaggugcggagagaccuagguccagcccauguauguucuccaguuaguggugcagucuccgagagccccaagauugagaaaggaucuucaccaacccugcaucugacagaagacugauaaccaaaauuuauaaagaacuccaccuuauuuuuugagguagggucuuucacuaaaccccuggcguucacugauucggcaggauugucuggccaaaagcccaggggccccgucugccucccucgcacagagauugcaggugcacaaggaugagucugauucuuuauguaggugcugaagacuugaacucgggcccucacgguuguucaggaagcauuuuacuuacugagccgucuccucugcccuccagucuaacacgcuguaaaaugacagugaacacuuacucugguuuccccauuuacuguugaaaagguaaaugaaagaaucgaguagaaauaugcauucugacuucacuggguagacuauaucccaaaguaaucaaauaauugaugguuauuuuaccuuuauaggauaaucauagcuaauagaugguugaaucagaacucccuggacccccacuuuuugcaagucccaaggccaucauggaucugagccacagccauucauggucugaagcaagcugaggucaugcagugauggauacauccagacgaucgaagccuugagcuuuaaugagccuuaacacuggaaaagcacacugcccuggcgucacgugcuucuaggugagaggccacagaaacuacccagcagccugggaaaccguacuuuaaccugauggaaaccaagccucccagucaucccuccacuuuuaggugugaaagagcauauuaggaaacgguguggggacacaguccuucaaguucugggggcuggggcaucugcaggugaaauggauugguuucuucagucuauaguggggugagaugugauguagaauuggcuguggaugcagauucagaugaugugggaggcgccaaagacagcaugagaccaaggauucucauuuagaaaagccaacagcagaaagacacuuaagaagacaaaaagggaauuaugaaccuggaaaagacagguuuuaauaggcaucacugagaguacaauugugacauuuucuaauguucuuaauuuuuaaauauugaguuagcuaaguucuauuuuauugagacccucacaugaguggcacaucuguaccaccaucccccacccugaaauccuuugugugcccuuucccuucaaacuccaaauuccuguuaucuucuuuauuaugaugauauacaaccuacugcauacauuuaguguugcucauauucauguguccagggcuggcagcucaggauuggacgacaccugcaugugaaacaccccuggagggaauggcuucucucucgcucucccagcagacacuggccacccgcagcccuucacguagaggugggaccauggagaaguuccccuguucacacuggcaggucaccugauguuauuaagccaaucucacugggguuuuuuuguuuauuuuuuaaaaguuuuuguuggaggugcagugauaugauauaucuagguucacuuuaaaaugcuccagcagaaacagcccaugagaggaggcgggaggaaaaauggaagagcauccggaaguuaggggacacacucuccugccagggcggugggaagcugccuguguguacacccugcgcucagccccuccuaggccuuccugggccuucaagggccaugccugccugaggaaugcauuagaccucccaccugacuugagguuacaaagcacagaaggaggcucaggaaaauaaugggaaaauggaagaaaaagagaacugaugaguuaaccccaaacuggauugcugaaaagcuccacacccaacugacccauugaucucucagccccuggucucugagguuauucaucaggaagccugaccucuggaaauccacuaccucucuuccaacccccccccccccgccccgguuccagccaagagggucuucccucucccaauaugaucagucccagaauccccuuucccuuggcugacuugcaucaaaccguaccucuaugauccaggaauugaaagcugugagggggcaacuuggucaguccuccaucccuagagcuacacagcuuccccuaaaccacagcaggcugaguggggcaggcaacagcucacuauggcuaccaaaggggagggacuugaucccucuaucacuucaccgugaccuguccuccacuuccucgucuguaaaugaagaugccuaccugaggucucagugcgcucucucaaguuccugucacucaaaccugggaugaaggaagcuguuccuccauucucucuggugaauugcaucccuucuuuuuguguggacacggaccucagacuucagaguccccuagagccugcauaugugugcaucaccaucuucuccccauccuggcaucagguagccuuagaacuggcaauaauaauuguagcaauaaaacuaggaggcugauguauucugcuacauggaaacuguguaggucaccaaaagguguuuaucgaauucauccagugcgccuggcaaguuagcugugcuucaguccaaguguacucagucaaaacucuuuuuagcaagauuuugcugaaaggacccagauauagcucucucuugugagacuaugccgggccuagcaaacacagaaguggaugaucacagucagcuauuggaugggucacacggccgccaauggaggagcuagagaaauuacccaaggagcuaaagggaacugcaacccuauagguggaacaacaauaugaacuaaccaguacccgggagcucuugucuuuagcugcauauguaucaaaagauggccuaguuggccaucacugcaaagagagacccauuggacuugcaaacuuuauaugccccaguacaggggaacgccagggccaaaaagggggagugggggguaggggauugggggguggguaugggggaccuuugggauagcauugaaaauguaaacgaggaaaauaucuaauuaaaaaaaaagaauguaaaauaaaaaaaaauacuucagugcuggagagauggcucagcaguuaagagcacugacugcucuuucaaagguccugaguucaaaucccagcaaccacaaggugauucacaaucaucuguaaucagaucugauacccucuucuggugugucugaagacagugacaguguauucauauacauaagauaaacaaaucuuuaaauuuuuuuuucuauuacgaugugacugaguugagucaaguagucuggcaucuggcuccaguugucuccacuuuugauaucacaggguacuuuuugcauuaugccuuuucuuugaaucuacaagaagccauaaguuuaccauucaccaucuagaaauaaucuggugaauuagauggagcaugguaggguuugggaaacagacguccugguuucaauccugaguggguuaagcauuccuguaagccaguuuccacaucuaugaccaggugggggugggagaagauuuggcuauggcauuuaaaugaagaaauuggauuuuuccacaaauggccauuuccccucccuuuuguauuccauugcuuccagaauaccaugugccuccgagggcagcaaggcagggcucccugugggaauugagcuauguggcucgcccccuuuguguguguacguuuuguucaccaucuguccggcgagccaaggccagcugccacaugaguuuagccugcuccaccucugccagccugggggcugugcagggagggccuccuucaaaaacaauguccaggaugcucgggcuuuguauaugccuguggccucucucacucagagccaagcccagaugggcucacauggaaaaggaugugggagacagaaagacagggguugccgccguggccugggcuugcccucccuugcuguugagcucagguuggcaaugguugcucacagggugguucugaccauguauggggacugaccugacagagucguguguguguguguguguguguguguguguguguguguguguguaucgaugcuucacauacagcucauucugucucuuuccagguugucuguguguucccugcugggcaucaauuaugcauugugguuaggggcauucauuaaggaaguuccuugacucuuacaguagcaggauuaggcucucuguagagggagaaccuguggaguggugugugguuaugugcagggacaaggaggaugaggggaggaaaagaaauggaaacaaaugagggaaaaggcugguuugaaauacugcaagcggugguuuuccauguguauuuauacgcauauaugacuuugaacacucaggcuuuacuguuucaaggccaaaugagugacgaaagacacaaaaaucauuaagcaaauuugccuucaccaagaaagaaaucaaaugagcgcuuuguagaagauugcugcagacuucauacaucugauugccauugacagcccugugaggcagacagcuucauucccagcaaaacacaggaaacaggaacucagagaaggccagagaauugcccacaaucacacagguggcagguggccgaggcugaggcaggcccagcuuugucugguuccagagccuccguuugccucagcagguaccagacuccugacagacgugcagcugaugcuggcauugcuugcucauggaugggcugugugaccuaguguggcaggcaugggcuucagucuucuucccuggaaaaugggccuuccacucauucugucagucaaggugaucugaagccauaagugagagguuuagauauggacagucacuaguauucccaauguaaaagcugggguagcugagggaucuccuggguggagaaggaaggugugggacagcucuggccagagagcagcaggccaacugugauggccucaagaaaagaaaaacaggccacagugaagaggaggaaaugagggugaagaggugagagaggaaugucuggaacccuggagacagagacacacacacacacauagacauacacacaaacauauauacacauauauauacuuacacaaacauauacaugcacauacauauacauacagacacacauauacauacacacaaacauguacauauauacacacaaauauaauacaugcauacacacacauacaugcacauacauauacacacaaacacauagacacacacauauagauacacacaaacauauacauauguauauauacacaaauauaauauacacauacacacauauacgugcauauacauauacacacaaacacacacauauacauacacacauauacauacacacaaacauauacauauauacacaaauauaauacaugcauacacacauauacaugcacauacauauacacacauacauacauacacacagacacaaacauaugcacauacacacaaauacauacacacauaugcacauauacacacaugcauacacacaaacauacauacacaauacacauaaauauauacacauacacacaaacacaugcacgcgcgcacacacacacacacacacacacacacacacacacacagucugacuguacuuacgaguaucucuaguauaguacugaauagguaugccaaggcugaacucugcucuucccauugucuggagggauccuucagucucucauccgcguugugaguggauuuaaaauaucuuagaaggugucacuaucagguggggaauuuugcuuuuguuuacuuuuauucuuguuucuuuuucccugagagguuuuaaaaaaucauuaagagggaaaugaauuuuauuaaauguuuuuccuugauaaucaagaauucuuuuuuagugugcugguauucugaauuacauugcuugauuucugaaccuugauguugacucaauuugcauuucuggcauaaaucauuuuuuguuaguuuuuccggagacagugucucccuaggccgggcuagcuucuaacuuagcgauccuccugccucugccucccaggugcugggauuaaaggcgugagccgcuaccuccagcucuuuggcauaaaucuuacuugguuuuauuguauuacuauuuucuuaaauacacguuaaaauuaaguuugcuaauuuaaaagauuauuuuaauuuuaaauaaauaaauguuuugccugcauugugugugugugugugugccacgugagugcuuggugcccacagaggcuggaagagggugucggccugggagcuggaguuacagaugauuggguccuugugggugcugagaacaaaacccgcauucucugcaagagcaacaggugcgcgcaacugcugagccaucccugcagccccuaauuugcuaauuuuaaaaaggauauuugcgucuguguucacaacagucuguuuuucuuuucuuaccacgucuccggcuuuccgagugaauugggaggccugccugccuggcugccuuuuccggaggaaucuauguagaccaggcguuauuuucuccauaaaggcuuaguagaaaacacaagugcagccaucugggacuggaaaguuuuugcggaaacauuuuuaacucagaauuuaaauucuuuuuuccagacaguuucucgggaugucugcuuccugcggauggaguugugcacaucgggaucuuucgaggcauuuucccauuucuucuguauuaucaaaugcacaacgcuguuccuaaagcugugcacagggccgugcguuaacuucucaccacugcgacgauuaccugagaagaacacucgagaggagggaagauuuauuuuggcucacaguuucaaagcuuucagcccggguuucugucuccauuguuuuuggucuguggggauugugggaucuuucgucuccguagaaggcuagggugggacagagucucauagcagcuaaacacagacagacagaugggcaugggcgggcgggcgggcagaagggcaggcaggcccagagcaagauaugacccccaaggcggugccuccaaagcuguuuccuccagcuaugcuccaccuccucaaaguuccagcaccuuccuuaacagcucuacaagugagggccaagcuuucaacauaggagucuguaggaguguuguuaaguuucccccaaacuaaacauucucucccagagguucagccagauaacaaaacuuacaagccccagaagcuaacggaaguuacaagcuucacaaguugcacguguuacaauugcugcagagggaagcuggguucagcuguucagggagcacgagggaugcauccucugaccgucaucggccaugcuggauggaucuuuccgcgaugcagcuaccauugacgucacauccuguaaacagccccucgcuguugucauguauggaagccaagaagcucacggggucacuaugcaagauuggacuguugcauguuucuguugugggugccuuaucggguugauagcccuccguucuuucaggaaaaaaaaaaaaucacacacauuuccuguacagaacuaacagugagauaaaagguuuucuguuaucauccugauaaugcuuauaagucucgcuaauuaacaucuauucguuuguuaaugagagugaauuuuucuugauuaguuuggccagaauuuaaacaaucuuauuuuucuu

SEQ ID NO: 5260 - RNA, 764 nt, Mus musculus
caugcugcgcaccaggccccgcagccccugcgucgaccccgcgcccugcuggucaccucagacaucagcacccagcccugccaagcgccgccgccuccaccaggagcccgcgugcccagaaccccuggcucagcccgaguuggaagcgcccgcagagcccaccaccuccgugguguuccuggccgccggcucugcccugcaguugccccuggauggcaucgaccugcuguuggagccugagcccaccucgguccugcaagugucgcuccaaggacacaccauccuccugguccccgagggacucaugacacaaccccagccaggacagccuggauucguggccaucagcccacagggagccgcugcccaggacgggccccaggaucaucuagucggucuccaggaggaaaccugugaguacuucuaccaagaggaugucuguaaugaggaugcagacuuggaauuccuggaacccugggcuaggccuccagaugaucaggccaaugggagcuuuuucuccaucccaggggugcccaguccuuuguugcaggaacaagucccagggccuuccacuggagcagagcgauauucuccuagguccaucugggaacuggacagcuaccugcugggaccccucccuggcucaccacugcagccucugccuccaucuccuucccagaguccccaagagcagcuuccgccaugcccuccaugcucuccccgggcuccuugcaaggcccggaagcgacuggucuaugacugaa

SEQ ID NO: 5261 - RNA, 6603 nt, Mus musculus
caaagcuacccagcaaauacaucacagagccaggaugucagggauauggcugaaacccaagcugacacuuucucccacggcuccaucuugcuuacuggcuccagcaagauggcggcuccacuagcagcagcugaagcucugcuuggugguaacugaugucugccaccuuugacucagcacucccacccuuggcaaacucaguagcagccauguacgagaaagcccaaagcacgguuccgggcaacaguaaagacuaggaaacgauccaaugccucccaacaggaacauggauaaauaaaccacagcguguucauacaauggaguggugccacacagggagaaugaacagugccugucuuuguguaucgaccaggaaccuuucacaaacauauggucgaauuaaaaaggcaagcacaugucuuuuagaacaaccagauaccaguuauagaaagcuacgaaauccagaccuugauuuauugcccaggaguacauacacauguuacacacaugucauaacagguacaggaauguuaaacaccaaaucugccaugaugaucacuccaggagagaaacagacaggaaccaaaggaagaugcagauggggccucagcuguaaaaucucuaccuugaaaagcaaagagguagugggucaggcugcuuacaccgcaaucccagugcucgugaggcagaggcagaaggcacagaagaguuugaggucagucugugcuacauggggaaucccucuccugcaccuuaaaguguguacugaaaucuagaaaacaacuggaaucuaauucccuguugaugggagccucuacuggugcuucccaggaagacagcuuugcauaacuuaccaaacuuaaaaaugcacacaccacaugacacagcuacuagaacauguugcuuuuaaauauauggaugugucuacaaaauuaaguauacaagacuguauacugaaguauugcuuuuaaaaacaaagguuuagaaacaaccuagacacugcuguguuaguuaacuuuccuguuacugggcuaacaacguaucugacaagaaagccuggagagacggcucagagaguaagagaauuuauuguucuuccaggggacccaaguucgguucccagcacccacacugggaaguucacaacugccuggaacucuaacuggaauccuaagguauccucacacacaguggcacacaccacacacacacacauacacacagagagacaaauacacacaccacuguguggguacgcacacgcauaaauaaaaaaauaaaaacuaaauauauauauauauauauauauauauauauauauauacacauaucuucauauguauauauauguguguguguguguauguguguauauguauguauauguguauguguauauauauacauauauauauauuuauguguguguauguguguguguauacacauauauauuugggcuugcagauucaggguauagaguccaccaugguaggaagagcauggccauuagaagcaugagcagauggucacauuguguccacagucaggaagcagugagauaaacgcuggugcucggcugacuuacucccaucuuccaucugaugccuuccucccuucuuuguauccaguccagggccccccaguccgugggaugcccucaugcacaaacaugcucacaguguguuuccuacgugauuccaaauucaaucaaguugaccgugaagaugcacgaacacagccccucucagcucuauaaagaacaugcauugagauggggcaucacgacgcauaucugaaaucugagagucugaaggaggaguaucucaagcuccaggguagccugagcuaagagagggaccccaggggugggagggacugccacccccgggggaguuauauggugccaagcuuggagcacuaguugcuauucuguaacuaggaaaguggcagugugcaggagaaaaccggcguucacacuuggauuaggcauaaaauacaggguucugucagccugggagaggugaaagagagagaaagagacuuuguacugcaagccuucuauauuugggggccgggugggguucaggugaauauauagcucuucaaaaacugauaaaaauauaaaacucugaagcaagacaauguuccuuaauuucccaggcugauacaauugaaaauuaaacaagggccuuugucaucugucccacuguagugguccccagcuugccaaugcuauguauaaagacugugguguacgguuggcuggcacauaccuuuaauaccggugcucaacaggcagaucucagccaaggccaaccuggucuacaagagaguuccaggccagcaaggacuauucagugggaccuuguccuaaaacaaaaagacagagccaggcauaaggaccaccaccaccaccaccaccacccccccccccgccauucuuucuguacuagguaccucugugggcuaacucacaucaugcaugaccauguaugucucuggacuugaguuuccauguccauacaauggcauucuuucuguucagacagaucacuggucuuucauuccuccaagcaaaacaccagagccaaaagguaccuggaacaggguacaccaggauccucaauuauccacugccaaaggaccccaaaugcagacuacuucuaccugugccaccacagcagucugccaguaauuauauccaaucacaaacucagagcccagcaaggcuugaauuagucugcaaagcggccuaaggaaggauggguugcucagcggguaaagcccuugcauaugacuucuucagaguccugauaagaagaggucccuaggggagggcugcuggcuauuggggccccuuacaagacccuguccacaaacccacuuccugcucucucacuguccacaaauccuccccugggagcacuuuccaggacaaggugcagcaucuucaagccguucuagaaccuaugaccauccuugaucaaacacuguagaucaggcugggcuuccaaaagguauccagagucuaguggcccuggccugaucugcaaauguccugagaacacuauugggucucugaucccacagcuuggcagacuuucacaaaauggaauuccccucacuuaaagcaaugacuugggaagccaugaagugggagggcacgcuggcgugaagagacuuggagucuaaaagccgauuuaacacacuucuacuaaaaugcucagagucugaacaaauauuugcaacagguaaacugagggaguaaaggggcggagagaauucaagguuggcgggaagagagauggaugggggucacuguguguuagagagauguuguguggaugcuuaaguuguaggugugaagcuggagguccaguagggacauaaguccccuuugaagcgcuccucuuuccaaugugcugcugaagcagcuugcguagaagagggcuucagccuccugguucuuuucuucuggcgcgggaacucaggccggauaagaagaggaucugaaggacuagcagcuagcagccagccggguggcugagcgucagagcugagcgguacuggggaaacacuagccugccucgcguggcgguccgcgguguuucugcggcagcugcaggaagcucggcccgggagaaaagcaucuucaccggggauccgcgacuugcucacguaggcggcggucgagacuucggagcguuagaccagcuugcugagaggcuucugcucugucccuggcuccccggcaaggcaugggcaggcauuucucuagaggcacaaggagcuggaggcgcugaggaauccugaaaaccccggccagagaaacacggaguuccuccgccuggcucaggaccgaggccucugccacuaaguggauggugcuuaaccuugccagaaugaaacgggugaaaguugugggggccgcacaacggggccgcacaggccuagaggaacagaauccuacuauagucgagaccugggucccuacccagccugccuaaggggacuggguaggagugagaagugaaucaaaguccacccggccacuuccuagagugccugcucuauccaccuacugcuguaccaccgaacaggcaagcacauucgucccagucuucuuagcucuggcugcucacccagggucuggaaggugaucccucggggcgcccugcaguuguguuucccagccuugugcgcacaagaggcacucuuucuccaccugggauuagggugcugauccugcaaaggacagcaagaagucaguucccaggaaugugugacuccuauuuccacucagaaaaaaaaaaaaaaaaagccuaaaagagauucugaucuacaaucccaacacacacacacacacacacacacacacacacacacaccucgggcuccuuaaagacugaaaagggagccgacagaggaauucagggaagcgaugacacaugcaacaauucugucacaccuggcugcugaggaggagcugagcggccggaaauggagccguggagggggugggggaugagacccagggucagcuuggguggucaaagaaagaaaaaaaaaaggaagaaaaaaagaaaaaaaugaagaagagggagaccgaccuccacccucuuuggucccgaccaaagccagauauuuuuccccugcccagaaccaagcagacucagauccagacccauaaccugggcaugccugauggugaggaagaagacaaacaccugcaggcaugcucagaaaacagacaaguauugaagaagugcuguuugucucuugagugugcucagggcggugagggauagcuuagaaaaacauggaggcuacuuggggauacugucaauaagggcuagauguggguauuucucagagaaauuuagagaagccuaccucccuuguauccuggugguuaggccggguuugccuggcugaccucucuguagucaucuuugagauguuggacuacacacacacacacacacacacacacacacacacacacacacacacagaguccuccuuucccuucaucucaaagugggaagcacaagcacacacuguagauaaauggucuucggaccgcuggagccacuggccagugugggcucguggcauucuggagaacucuuaaaguccaagcaaccugaaagaaagagguagaaacaggcacugggauagccaccuagaugugugacuggcacacaucauucauucagaccauuauccuucacaacgugucugaucacucuuccucagccucucucacacuuccaagacugcaaaccuguguuaaggcugagugacagggcacaccugauguugugcuggcacggaaggaauuccucuaaguccguuuucuauuuucggagauguaacuggauccccaccagacuucggcuauuaucuuaaaaacaaggggaaagacuacuguccauucgugacugggacgcgagaaagcgccuccccagccugugguuuuccuuccuuaccuaugcuggaaggagaagaugcagguaacggcuguaaggguaggaaggacaaaggaagacaggaaaaaaaaaaaaaaaagagguuguauccacgaaccauguucauggauacaaccauguacucuggugcuugauucauacaccucacuaagcaaaaauaagcaaauacaagucucacacauuguacauauauaagcauaccuggguuucugaacagcacacuugcgcaguaucacgugugucuuuaagaacagauuuuugccccgugccuuccacgcgugacacuugugcacgcaacaguccccaaagccccucagcaacauccucgucuguguccaagccagaguacaagggauaccacuugaucuuuaaaacacacacccaaauugugggauugcaaggcgaguuccaaggagaaagcuggucccuacauccaccucagcacagagaagcgaaacguccgaugccagugagcgguacuccugggugucucuucccagcgauccucuccccagccucaauugggcucagagagcucgagggacagagcaggccgaagcuucugccuuccgugacacgagcucugagcugguuuaccuccagcugccgcaaaguucggccacuccaccccgguccggcccccuugccaucucgccccucccuaagccucaaagcuagaagucuagccccagcacagcccgaagcacagagcaaaggguuuuguuuucuuucaccugaaagcugcccagaggcuuggaucaccucuccucgcuggggucagcauucccggggcacuggcagggcgcagcgagccccaaccagggcuuuucggcgaagcaaacacccgcagauuuucaagacucguaagagcgugaggcaggcuguuggcugggcccgggaggcuccggaggcucgggaaggccgguccaaguucugccggccguuuaaaaaaaaaaggagacuuagagaugaacucgcccgugcgcugcuggcugccccgcuauaggggcgaaggccccugacgcaagcggaacucugcggagcccauacgaaucagaacggagcgaggcuccuggcgcacuagggacuccaggaggcggcugcgcca

SEQ ID NO: 5262 - RNA, 1847 nt, Mus musculus
agcugcccagaggcuuggaucaccucuccucgcuggggucagcauucccggggcacuggcagggcgcagcgagccccaaccagggcuuuucggcgaagcaaacacccgcagauuuucaagacucguaagagcgugaggcaggcuguuggcugggcccgggaggcuccggaggcucgggaaggccgguccaaguucugccggccguuuaaaaaaaaaaggagacuuagagaugaacucgcccgugcgcugcuggcugccccgcuauaggggcgaaggccccugacgcaagcggaacucugcggagcccauacgaaucagaacggagcgaggcuccuggcgcacuagggacuccaggaggcggcugcgccagagacgcgggucgcgccucggggaaaccgggcgguggggggaggggagagcucagccaagaaaacccaccgaggcggggacuggccugggcggggaggggcggcggggccggagccccucgcuguugggcagacucccgauggccagaggcugacuuccacucccgcagaccgcuccccggggggaaaagagaagagagugagagccgcgcgaggccuccgguccccgcagccugcagaaguuagaggcucugcgccgagcgcacacuccugcgcccgccugcaaggcgagccugcaccaggagagcacagccuccgggcugcccggccgcggagagccggcuuuugucaugauggccagcuaccccgagcccgaagacacggcggggacccugcuggcuccggagagcggacgcgcagucaaagaggccgaggcgucgccgccgagucccggcaagggaggcgggacaacaccggagaaaccagaccccgcgcagaagcccccguacucguacguggcgcucaucgccauggcgauccgcgagagcgccgagaagaggcucacucuguccggcaucuaccaguacaucauagccaaguucccguucuacgagaagaacaagaagggcuggcagaauagcauccgccacaaccucagccucaacgagugcuucaucaaggugccgcgcgagggcggcggcgagcgcaagggcaacuacuggacgcucgacccggccugcgaggacauguucgagaagggcaacuaccggcgccgccgccgcaugaagcggcccuuccggccgccgcccgcucacuuccagcccggcaaggggcucuucgggagcggaggagcggcggguggcugcggcgugcccggagcuggggccgauggcuauggcuaccuggcgccacccaaguaccugcaaucgggguuccucaacaacuccuggccccugccgcagccucccucgcccaugcccuacgccuccugccagauggcggcggcugcggcggccgcugcugcagccgcugcagccgccggcccgggcagccccggugcagccgcgguggucaaggggcuggcgggccccgccgccuccuacgggccguacucgcgcgugcagagcauggcgcugccuccgggcgucgugaacuccuacaacggccuggggggcccuccugccgcaccaccgccgccgccaccgccgccgcacccucacccgcacccucacgcacaucaucugcacgcggccgcugcgcccccgccagccccgccacaccacggggcugccgcgccucccccgggucagcucagucccgccagcccggccaccgccgcgcccccggcacccgcgcccacgagcgcgcccggccugcaguucgccugcgcccggcaacccgagcucgccaugaugcauugcucauacugggaccacgacagcaagacgggcgcgcugcacucgcgucuggaucucugag

SEQ ID NO: 5263 - RNA, 1473 nt, Mus musculus
uggcuauuuuuuauuucuguuuuuuggauuuuuuucagauuauuuuguaugcuguagauaaaauuuauucugacuucuaucaagauaugagagggcgagugaauuuuacaaguaaugguaucacgucuggcgaagcguccauaaaaauaagagauguucagccugcagacaguggcaccuaccugugcaaagugaaaacagccccugguguugccaagacaaccguucagcugacaguuguugguaaguuguuguaguuggucgagagcagccccacaguaacagggugaaaccucacggggcugaagucacaacacuuauggaagacaaacuuggcuuuuacagugauaauugaaucuguucauuuccacuaugcuaggagugaagccugggccucacgcuugcuaggaaagagcucugcccugagccccacccauaguccuaggaauauaaugugaccuucugaaguauuucuaauguccucacauagcuuaaaaugaaaagcuaucacauuuuugcacaagaaaaacaagaaacaacuaacaucuccuuuccaaaauucuugacauauuucaaaauaaaugaagaguuuuauugugagaaagaaccccagccuggacucaggaacgccgugcugcugucugugcuguuguuguuuugaaccuugucuucugaguuuguccugagaauuaaauacguuucaugcccuugguccagaguccacucuaugugcauugaaacauagagucuaaaaggcuuuaaucgccacuguaccagucagagucaccccuucagagcugugugggagugcucugaacuuuugcuuucgcugcacaaagacuaacgagauuucuacagaaaggagcugaguguuuagggggcuggugagagaauagugaggugagugugaaugugugugugagugugaauauguguguauguaugugagugugaauaugcgugaguaugugugugugagugagugugaauguguguguaagugugaaugugugugagugugaauguaugugagugugaauguguguaugugaauguguuugugagugugaauguguguguauguauauauguauguauguauguauguauguacgugagugugaauguguguauauguaugugugugugaguguguguguguaggacagggguggaguuggcuuccuucugauaccuuuacaugucuccagguuccagcuaaggaggccaggcuuacacuggacacuccuuuacccacugaaccacugggccugucuuaaaugccaaugucacagaacacaaaucuuagaauuaagauguaaauauugugaaaguuuaaaugccuucucaaaaauacuaaaagaaaugugaguaaccauuuuagaacgagaucuagaaaagaagauaaaauaagaaauguuuuaaacacauaccuaggccaauuauuuagugaguguacacacacacacacac

SEQ ID NO: 5264 - RNA, 104012 nt, Mus musculus
cagcugcgguggugcagagacgaacacagaaguguuucaaaggcuggacucuuuacaucuaaaugaucguucacaucgcagggaauggaaggccagcugggccgugggaacaaaggggagucugcggagaagcggaaccgggaggugcagguuuucccgaaggcggcgagcugggggcugcagacaccgcagugcucugcgagccaaccccagcgcgccggcagcgcaguaggaacgcggcaccgacagccgcacagggcgaggcuggugcugccuccccucgaggggcggggcuugcgcggugagugggcggggcugccuggaggcgggcgucgggggauuggcccuagagggugggcggggccgggcagcggggaggagagcccgggaggcucgcgcgcgcgcucgcgcaggcgcgggcacggcgguggcgcgcgcgugcuccgucgggcggugcagcggcugcgacggagccggccauggucgugggcggugggcgggugucgcgcugagccccgaaggcagcaagagacugggagcggggcaugcgggugucggagccaggcgggcacggcugcgggagcugcugacggcgcugcgggaucgggagccgguggcggcgcgcggggcaggugagcgcgggaggcggcgcgggcugcggcgcuggcggcucgggcgggcgcuuccugccgggcucggccgcgggagcgcgggcuccgagguacgcggcgcccaggccucgggcggcggacaccgagcagcggagggcgcccggugggcgaccacagagagagcgggcgcggcacggcccagccggugucggugcggacgcccggcggcugcggacccucagguguuucggcgcagcguucaccgcacgauuccgggcucuccgguuucagaccggucagagucccggugcugcggcuaacccgucccgcgcggccuuggcugaaauaccccgaggagacgugaagcgggaacugugaauacucaccucccgggauugcgggaggccgugcuaaccucgcuguaagugcucgguggacgggagcuuuugggagucgcucacugcagcauccuugcuggcucuggcuuguuccuuccuagagguugguauugggggcaaauuuauuuccgaaccgcucuaguguugcaauaagcucaacucgaguugcuuaacgaaggagccuguuaucuuacagcggccagaguaggauucuguagucucuuccuagaauucuguaguuucucucuuggaaaggcugacuuggaaaccugucuuggguacggagugaauuagugcuaagaauccuaucagaaucagaguuuacacaacguggaagaugguggugggacauguuaccugacuuacuuugguauuuaacccaucugaagugacacuuaaauugucacuuguuacagaguauaaacacaggaagaguauggaaacauacuccuuuuuuccugcauugcuacauccgaagggagugacaagugcuuuuguaaacaucguugugggcaguguuacuuacugucuggugaagucaucauaauuaaauuagaugaguauuuauucugaagugcugaauggauguuugggaauaccagucguaaugaaaucuccaaggagucugaguuuccaggaguucauuaucacuugcgggucuugguacugcuuuguaaguuuuuuuguuuuguuuuguuuuauuuuguuuuggaucuuuugagacagaaccuugcgguguuauggaucuuuugagacagaacuuugcgguguuaguccucaguggucuggaacucacucuauagacuaggcuggcuuugauucaugccucuuucucccuugucuuuggauuacagaacucggcauauccagaauagauguuaaaaguuaggguggcauccacuuguagucccauugcuggggaggggcacacaaguagauuccaggaguuugcugguagaccugcuagcuuagcagaaucauggcacccuaggccaaugagagacucuaccuaaaaaaauaagauguguggcaucugaggaacacacaacacacacacacacagauuuuuaaaaaagaaagcagaagacagaacuguguagaaagacuauauaaugugugaaagaucaggguggcuuggauuaggcuauugcccaaguuuuggaagaccaaaaaucugaaaugguaaaauugaaauuguagucacuaaagccaaaaggauuuaagaagcaucuuuaguuuacccucgugauucacacacugacuaggacauuccaccuucaggguguuuuuacaaaguggaaaaaucagguugcuuuucuugugcuaaagaucauuggccugaccacaagucagauguugauuuauuuuauuuuauuuuuuaaaacucagggcuuuuuauaucagggaagugcuuuaugccagagcuuaccuguccccagcccuguuguauacuuuaaaaaaaaaacaaaaaacaaaaaaccaaccccaaacaaaccuaaaauggaauauugcucuauccucaggcuggccuucgacuugcagcguagcuccugcuucuugcaucucugggcaauucugcaucucuccacccuagugcuaggauuccaccauacaccuguaaaccacgccugguuuuaugcugagcugggaaucaaacuagcaggcuuucugcauguuaguuaagcacuucaguacuaguugggccacguccugucucugcccgggcuucccuucucucggugugugaaugcugaggauugaccccaggucuucacacaggguaagaugcucauagcuaauguccccagcccuguuuuccugcuuugguuuuuauuuuuugcagguggaucagucccuaaucaacuuguuuuguauaugccagcaaauuauauggaaagcaaaagugaaucccguagccuagaugauuuuuuuuuaccucuucccaagacaggguuucucuguguaguccuggcuguccuggaacucacccuguagaccaagguggccuugaacucacagacauuccccugccucugccuccaaaguguugagauuaaaggcugugccaccgcggcccaguugucuguuuuguagguuguuguuccugcuacccacagugaaaaggcugagggucagaagugcucuagacuuugaccuaagucagagucgaaagaggugcaguuguagggauucugcccaggcuuucugaaccucggauuuuuaaaugauagacauuagcuaacuauggaagagguggcuuugguggagacucgguaugacaggagacucauaugauggcagggaaccuucuaggccuuagaguuuccaggccuucuuucucucuuuguuucagccucacaccuuguguugaaaacaucccaaauccccgagggccuccuggcugucccucuucauuucuuuaccugugcucauccugaaugaugucauucucuucccucuuuaaauauuaucacauguuguugacucagauuuuuaucacugguccugagcauuaagcuucagcuacaucuagaccuauacauuuuucuuuucuuuuaauuuuuuugggggggaggggaucuggauaggauggagguuuugugguucuggagauggaaucuggcuccauggcccuguuucuaggcauccuuuacauuuuuuuuuuuuaauuuuaaaguuuauuuuacggcuaugaguguuuugcuaagugugugcuugugaaucguaugaaugucagguugucaguggaagccagaaguccucuggaucugaaacugcagagggcaaauuguagagguaaauuugaaaggguuagagaacugguuauguguagaguagagggaacaaugaauaaagagaugauuuaugagcugggcggugguggcgcacgccuuuaaucccagcacuugggaggcagaggcaggcgauuucugaguucgaggccagccuggucuacaaagugaguuccaggacagccagggcuacacagagaaaccuugucucgaaaaaccaaaccaaaacaaaacaaaacaaaacaaagagaugauuuauguauggaugcugccugugacccugacacuuggagggcugagucaggagaauccugaagagccagccuggcugguacaugaguuuuaggcucgcuagaccacagacagagagagacacuagcuuaaaaaaaccagaaacuggacccagggccucugcaagaccaaugggugcucuuagcaaacagccaucccuucaguccaauuuguaggcauuuuaaauguaauauggucaggacuggacauuaacuuaguggacagagcacuugucuagcaugcuugcaggaauugaauuuaauacuguguguguguguguguguguguguguguguguguaugugugugugugaguguguguguguguguguguguguguguauguguuuguauguguauguaauauucaaauagagagcucuuaauuccacucccuaaccuuuuuuuuuuuuuuuuuuuuuuuuacuuguuuugagacagggccuccuggagcccaaguuggcuucaaacuccuggucccucugugucccaagugcugaacgacaaguauauauuuccaugccuagcaaccuguucaugucaugaucuuccucaccccacuaucucuccuugagugaaaauuccaguggccauacauuuugccuugguuuuuacauagugucucuccugcuguggaacucacuguguaacccaggcuggccuugacuucuuggugauguuccugccuuggucuuccaagagucgugauuauaggaguacaucugcaaguccucucugccccacuguuccuucuaccuacacacccagcucuuuaagccuuucaaauucacuucuaagauacaucaggauugaauuuucuucacauaccuucuugccagcaucucuguuccuccuggauuguaauuucucaucucuccuucucuuccgccccucuucagcccuucccucccuugccuucuauguaucuuucugcauccgggucugguuguauaguccggguggcuuggagacuugugauuuccuuucguacaccucccaugguugggauugcaggugugcacuaccccagcaaucagcauuucugccauucuguuguacccguggccucucguuaacagaaaauccaaaccuuauuuucauauucucuaauuguuuugccugcucuguugucugugucucuuucuaugagguagcguuucauuguguuguucuggcuggcccggacuugcuauguagaccaggcuguccucaagcucauugugagaaccuuccauuauauguauguauaugugugccagaaaaugugugugugugcgcgcgcgcacacgugcgcgcgugcaagcuuaacgcacacaugcaggaguguguaccuguaucuggcaguagugugcauaaucuuuucaaucauuuguuucaguuaccacauacugcuuuauuuguggaaaaaugccuaucaucugguuucuacugacuacuuucucgagaguguagucaugcuguauaaagagacgaaucauucacgauuucucucuggagcuuccugaaaugccagaccuggaaauuguacagcagguugguuagcaaagaagggucauagaaaacucagacguggacuaugccuguaaucccagcacccaagaggcugaggcagaaggguugccaugagucaaaggcuagccuagacuacuacaguacaugacccugccucagaaaacgaaaagcaaaauuugaagucugcacguccauugucacgguagaaacacaggggaagauguuggaauguaaagucuuaggagcagaauagugaacacacaugaagugcaaggggggaaaggcggugacucuuggauucuccccucuuccccucccccuguuuuuugggcugguuuucuaaggagagcuucuguuccuggaacaguccaaaacgucccugugcacccgugagaggcccuuccaguaagagaagucuucuguuuuauugcaaucaaggucugccuuucuguaguccugcugucggcuccacucugucuuuuuggaaagguucuagcuaguggauuugguuuugcacguauuccaugauugucucuaggguaaauaauugacucaaaagguuguaguagucagugaggggaagucaaggauuagaugcccgguggggaugagaugucugucuaugcaguucuggcuauccuggagguugauauguggacagaccaggcuggccucaccucauacucauaauagggagaucugccuaucucugcugcaagagugcuggccuaaaaggugugcccgaccacucuuuggugacuaaggagguuuuuuuaaauuaaaagguauuucuuguuacuuugaauugcuuugagauggaucucaauauauauacaaggcuggccuggaacuuauauacccuugugccucagacucugggguguguugacauaggcuuuguggcauucugccuggccauccuuuuuguuuguuuauuuguuuguuuguuuaugcauuccuuauuguguauguguguaucuaaggugagaacaggaugccacagcacuuguguggagggcagggacaacuuucuggagugaaggccaaacucagguugucagguuuggcagguuuaccugcugagccguauccuugccuccuccuucccccaauauaugagaaaucgagauucccauguauucuuuguuagcaccagcuaguguggggaugauguucugaacucagccuucucucgccucuuuuuuuuuuuugagacagggucucuauuggcucuggcuguuaagaacagacacagagauucucuugccucugucuccucugucucuuaugcugggauuaaagacaaguaccagccccaguagguucuacuccuaguggugagaggcaagagacagagggaucagucuccggguuggagaccagccuggucuacagaguuucaggacagccagggcuauacaaagaaacccugucuugaaaaaccaaaauaaaugagcacacauacaaacaaacaaacaaacaagaaaccauaaagauaugcaguacuaugccuggcucagcuuuucuucuucuuccuccuccucuccuuccucucucucuuuuuuuuuaaagauuuauuuauuauuauauauaaguacacuguagcugucuucagaugagccagaggagggcaucagaucuuacuacaggugguugugagccaccaugugguugcugggauuugaacucaggaccuucagaagagcagugaaugcucuuaccugucagccccccccccccccuucucuguauagcccuggcuguccuggaacucacuuuguagaccaggcuggccucgaacucagaaaucugccugccucugccucccaagugcugggauuaaaggugugagccaccacgcccggcaugauuuuuuuuuuaaaagauuuauuuaacgugugugagugcucuuuuugcauguauaccuucaugccagaagacagcaucagcucacauuauagacaguugcaagccaccauguaguugcugggaauugaacucaggaccucuggaagaacagccgguacuccuaaccacugagccaucgcccuagccuagcuuuucuucuugaucucucucucacuuuguguaugcauucugauagcuguucauuuuauucuagcacuuuuuuagguagucaguuuucuagugacugagggaugguacacuaccucugcuuucagggcuuugcaaaugucguuguucaguuucuuacuugaguccagccuaauaugcuuaauuuccuguucuauuacuuccucagaaaauaaauaaauccuugauugguuuuucuggagcaggaaaaacucuccagugggcagggucucuagcuaagcuagucuggaacucauagcuguacaacguuaggauuauauaaaucaguauuggccuauaaaauagcucuuauaauuuuggucagauagccugaggguuggguccuucacugggaauaauauacugcugaaaucuaacaguccuuuuuuguggugucauuaugauccagguuuucaguuuccaauuuccccguggcuugguucaucuagugcugaggucacuggggagaccaccaggcaagugaccauuugccuuagacaggaaugugauccugauuauccaugccugaacuggaggauuaaguagauuaaagaaaucggguaguaagccagaagcuuuauuuuaaacuacaguuuauccacauuccucaccauaguuugucccugggcaggucuaauagcuaagaauauuuucuaacuguguucuauucacaaacuguauucuuccuguugcuugaaguaauggcaguugugaaguggggaaaagauggaaggcauucaagcaguuagaugaccaaccugcauugcccacauaauuuggugcugacuguggucagccacagugauccuuagacugaagaccgaauuccacgaauuccuuaccugcugagccacuuacaggcauuuucaauggcugucaacaagaggucagaacucccuuuggacacauuuuuauaucacugguuuaaacaauugagauuuucagaucugaacaacugacauuuaagaugaucagaauuauaaauauaaucaaaguuggaguuugcuucauuuaaauuaaucuauggcaguuuucauagaaauuaaauucccugaaggccugccugaaguaagagacacucccaagacccaggcaagguaucccucugcagcccaggugggccugacuugugauccuccugccuuagcuucugguugaaaggugguguuuauaaggcuaggucaccacuaccucucauggauuucauguaauagcuggauaauucuuaucaauuaguugacauagguuuaaaguuacugguuuugcaguguugggaauggaauccagguuuuucugugugcuggacaagccacacccucuaacucuaagccacacccucacuucuguauuauuccuguuuuucuuugaagcagggccugaugguuuagcugaggcugucccagagucaggaugaccucccugccugggugccuccacacccaguccguuacuaacucaugcuguggggcuucgcaucuauucugguauuuuuauuuuguguuauugaguaugaacccaaggccucauacacacugaccacuagauacaccucagcccucucugucggugucuugucuugaugaggaaauugugagcugaagguucucaugcugccucugugaugagucagugaucagacuugccacuuguuguguuuggggcgagguggugguggugugguaguggugguguuugcagauagccuugcuauaaccugcagauagacagguagaccuagcugccucucuguguggcccaggcuggcugaaguuucccucuuuuaaucucuguaguccuggguuugcagcagcacuugccuaguuugcgugcuggggacugaacccagggccucaaggagugcuaggcaagcacccuaccaagugagucgcuggccuguauuuuguuuucacauaguuaaggcuggccucuaacugucgcugagccuacccucaagccccugcuccuccugccucucuuucccuuggcuggcauuacugaugccuagcugaugccuagcaccaguuuccucucacaaccuuuaccucuuaaagcuaugucuguguguauagcauauuaggaaaacucccaagugucuccugcuguauaugggacuaagcagacuaacaauaacaaauguuuauuggaugcuuacuugcaugucaggcugugcuaagugcuuucuguaauuuuuguaacaacucucuaaugaagauacgaaugacaucaccaccgaggaaacuggaauuucaggaaguuacauaucaaauggaacaaaguuuaugaguaguagagucagauguaagaaaaaaauaguuuuauguguauggcuuuuuuuuuuaucauuuauuuuuauuucauuugcacugguguuuugccugcauguaugucuguguauaggauccccugaaauuggaguuauauugaggcaguguucuuaauugcugagcugucgcuccagcucugagagucagaucaaagaguauguauuuaaguguaccaguguuuugccugcaucuguguccguaucauguguaccuacugcuuguggagccagaagaggguucugguguuauagguggcugggagcugccauuuggguguugggaauugacccuggguucucuggaagaggagcuagugcucuuagucacugagccaccuaucuagcccaugagaaucaggccuuuaacucuagcucugucugguuuucugcucuccggccccaagucgcuggguguguaguccaggcuguuccucccacaccagaucauugccguuuccaucaucaccaccauggcugugcucauuuugaaccuaggguuucaugcauguuaggcaaacacucuaccacugaguuauagccucaggucuuaaguaugauuaauuuuguuuuguguuuugaaagucaacgucucacuguagccuaggcuguccuggaacuugggguaauccucuaaacuuagucuccuaaaugguggcauuacagguguaaggcaccauacccagcuucuuguuuguuuauuuagguuuuuaggauuuuauuauguagcccuggcuguucuggaacucucugcauaggccagggcgguuucagacucucagagaccugccuccagaccgcugagguugaaaggcgugcaccaccacacccuggccauuuauuuauuuauugugguauuuuucugguaaccauuguagcagcucuguacuucuuggucuguuuucaaguguaauuuacuccaguauacuucugcccagauccuauagacccagaguuuugugcaugcuaaauaagugcuccccucucccaccuuuauuuaaaaauaaguaacuagcaaugaaguguaaugauccagguaugguagcuuauaccugaaguucuagcuauggcuuacucaggaguuccaggccagccaaagcgacauacacagugagacccugucaucaccacccucugcaaaaaaaaccccuaaucuuaaauguaucaugcuagcauaguuaaauauguaugcagguuucauuaaaggguuuugggucagaaggccuugagaaguuguuguuguuuuugccuuggugaccuacuugacuuuccugagcuuaaucuuaaaaguucugggcguagaggaaagaaacagauuuguuguugaauagaugaaccaaugaaauacaauagacaggccaugaaauguaacugacaaagcauuuacuuuaauagagcacuggguauugcuggugcucaccuugacuccaaggacuugggaggccgaggcaggcagauuucugugaauucaaggccagccuggccuacagagcgaguuccaggacagccaggacuauauagagaccaccaccaccaccaaagcaaaugcuugcauuguuagaucuuuuuuuuauucauguaucagaaaggagaggaugugcuaacaucacaucugucaccaguaguacuuagguccauaagggucaucacggcaugaggaaauguauuaaagggucauagcauugggaaggcugagcgccacugcauuggaagaaguaacugcagaaauguuugguuuuguguucuuccaauucuguaucccaaguguuuuauucuuaaguauguaacacggaccccagcagaaauuaaguguuuuuaaaauuuuuuacuuauuuguaugugucugcaugaguggauuggacucugggucucaugguuucacacaaauccuccuaaccauugagacaucaucucugcagcccagaaacuaagauuuccuucugaucaucuguacuggcucacauguaugagcaaaggagaaaaaauaugaauaugucuguguacacagacauuaccuaaguaacuagauguaguaaagaaaaugugggagcaguguugccucgucugugaaugaucuaagcacaguggaugccuccaacaugacauacgcuguuggggaguugacugacuaggguauaagucauuggcauaccagauuccuuccaagggauuggggcucucuugguacacgaguuaaagacuuucugcaacucgcaguacacaguugcugcauuuggagcuucauuuuacaguagagaauagaggcgcagagggcacgucagcugugcugaaggcugcagcgccugggggggggggcucucuuggcuaguguggcaccuugcuccaaucuuccaggcccuucuguaaaugauuuauuuuccuuggagcgaguguucagauauuuagggaauauaucuugguauauugguugaucauuaagguccuaggguagauauauuuguuuaucacauuuauuuuggugcuuguacguguuacugaaaauggaacagcaugcgcccccacacacucugccacugugguagauucccagcccaauuuuuaauauuaauuuauuucauuuauuuuuggugguagugaucagucacucaggucaugucugcccccuccacugaccuacacauuagcccuguuuauuuuauuacuguacuuugaugaaaguuucaaguacucaugcauuuuauuuuacugacaccagauacuuggcguucucuuaguccccaguugcugggguucucccuaccucgucacccucaccagccccuuuaagaacaguggugcaauuguuucgggcagagguggaugcuuuuuccgucagaggacuggagcuguggguguucagaguagaguugccguuuggggucagcuuuccuugcugccguagggcagaccuuugaaggucugaucuacugugucaugccaggucugaauguauccuuuauucuacagcuggcaucguugccaguuuaucaugagcuuucuuuuauacauuucugucagcuaaagaguugguugugggaaugucuacuucauccaccuacacuuucaacauuagagcaugugaguuuuuuccugucaacuucuucauggaacauuuauugagaggauguguuuaugcugugcgaagcauugggguugcaaacagaugaagguucaagagagacaccguagacuggugugguaugugcacucaggagacagagguagauguguccugaaguuuaaggcaagccugguuuacauagugagacccuaccuuaaaagaaguuuuaugggcuggagggaugguucagugguuaagagcaccaauuugucuuccauaaaaccuggauuugauucucagcgcucacagggcgcucacaacagccugcaacuccaugcccacacggcggcucacagcagccugcaacuccagacagauuugggaggaucccacacccucuucugaucuccuuggcaccaggcacauaugugguacacagacauaacaugcaggcaaaacauucacacacauaaguaaagaaaaauaaaaaaguuuuagccaagcaugggggagccugccucuaacuauagcucuugagugguggaggcugaagaucaggaguugauccuuggaguugaggccagcccagggcacaugaaacccuguuauagaaaacccucacaaacauuuccugcuguuguuugacuaugagacccugcuuaguccauaauuccauauguguagaccaggcuagccucaaacucagagagcucucugccuccugaauucugggauuaaaggugugcauagccauguuggccaaaaaagucuuaaugcaaaaauuugggguuuuuguuuuuauaugaauacuuuauuaagauaauauuacuugcuaaaagauaaaguauuaauuacuaaagauuuuaauaaggcagggaguacaaccuaauaguagaguucuuaagaaauugccauguuagccgggcgugguggcgcacgccuuuaaucccagcacucgggaggcagaggcaggcagauuucugaguucgaggccagccuggucuacaaagugaguuccaggauagccagggcuacacagagaaacccugucucaaaaaaacaaaacaaaacaaaacaaaacaagaaaaaaagaaagaaauugccauguuuaaggcccuggguaggacuacaaaauagaacaagaaaaaaaaauaacauuuuucuuuuaaggcaggaucucauuguaauccuggaacuugcuuuguagaccaggcuggccucaggcaugcagugaccuccuccuaccucuugcauggcaggagagcaggcuuucacauugugcggcagugaagguaaauacuaaaaucaguuuuaauuacaauucaguaaagucaguugauagaaccuaaaugauaaacaaacuucuugggucccaaauucuucucuuucauuuugaaauaaggcacucuaugucuccuagguuucaaacaccacagccaugccuccgccaccugagaacugagguugcagcuguggccaccacaucuggcuucccgcucuucugacugcuaaccccuuuuacucaguguagagugggcugcuuguucuuucucuuugggacuucucuguguggccccuacuauauaagcauaugaaauacuuaugcaaaaucaaagauauugauaguaauaaguuuuuaaaaauaauucuuuggcauauaguuauuuuucucacguauuaaagauagaaacaaaauuucauauuaacagguggauaugcuugcuaauuuuuaaugucagaaauauguacagggccacuuuaaaugcuacugaaaaucauaauuuaaucccaagccaaaaaucuauauagccauuuuuguuuauggaacuugagccagaaacucaaaaaacaacuuuaaaaaucauccccugcccccgacagcuguuuauacaugaaaaauguauucuggugauacguuacuuaaagagaacuuuuguuuugguuuuuaaaacaggacuguccuggaacucucuauguagaccagacuggucucaaacucagagauccaccugccucugccucucagugcugggaauaaaggugugcguguguuaguggccccuggggaccgaauagaacauuucaacacaaucuaaagauacaggaaauggugcuuacaugcugaggaguagggagaaauaacaauggaaaguguuugcuuuccauacuuaaaucauuaugcauaugagagcagagagccuuguauauacagggaaagaauucccaacccgcaguagugguggacaggagcagagauggucaagguggcaugaugaccaugguugcuuucagaaccaagguugcagcaguugaaccaagauucagugcagcacaagcugcagacacguagggauccacuaagugauuuccaauuaauccuuggugguuccauggcaccauuuuacugcugccaguuuuucugugauccccagaaaaaacccuauauggagccauaacccccaauuuaagaaacuggggucuagaguuggagagauggcuaagugguuaagagcacuggcuguuuuuccagagaacccugguucaguucccagcacccaguacauggcagcccacacuaucuguaacuccaguaccagggcuucugacacccucacaccgacauacacgucggccuuuaaaacaccaaugagcauaagauaaagauaacauuuuuauuuuuguacauauuuguacauauauauguauguauacacgugcauguacguacacacacacauacuugaguucuagagaauuuuguuaaaaucuuauucccggcuuccuguguuuaaaaauagguaaauuuuagcucauuauaguaagcaggcuauauuucacaugauaaauuggacaaaaguaagaggggauggggacaguuguguuuguggcauauguguauauacauccucguguuuauucaaauguguauacaugaagaguucaaagucauuguaggcuauggcuuucaaaaaccaagaagaaggaagaguguauggagaaaauaaaguuaagccuauuguuagugcaugccuggaagccgagguugggagccacuugggagguugaggcaggaagacugagcuagaggaguauugagcuacugucuuguuuuguuuuguuuuuguuuuucgagacaggguuucucuguguagccauggcuguccuggaacucacuuuguagaccaggcuggccucgaacucagaaauccgccugccucugccucccaagugcugggauuaaaggugugcgccaccacgcccgguuuugaucuacugucuuacagaagguaaaauggagagagauagccaguugguaggggcugggagauuuucuagggaggcacuggggucaaucugauuuguuguuuuuuuuggcaucucauguagcucagacugguuccaaauucacuauguaauugaggaugacauugaaaucauaauaauuccccugucucuacuuaaguccaaugauuacagguguauuguaccaggcugggcaaauaauacuuguccauuuaauagacuuaagagagaguuagugucuuuuuuuuaaaggaauuauuaaauaguuauuauuuuucuucuugcucuggcccugcucacucugguuccacucucucuggccccgcucucuccagcccuaagauuuauuuauuauaugugaguacacuguagcuguuuucagacacaagagaagagggcaucagaucucauuacggaugguugugagccaucaugugguuggugggaugugaacucaggaccuucagaagagcagucagugcucuuaacuacagagccaucucuccagccccggccccccccccccuuuuuaagauagggucuuacuguguagaccaggcuggccucaaauucagagauucgauuaucucugccucaaggugcugggauuaaaggcauaugucaccaaaccuugaauuagugucuuaaguguggcugacaccaugggcaugucaggcuccucacucgaggaggaacugugcuuaaucuaaugcuaagccaucucugucuugaaauucuucauuuuugaaugaguagcccugcaucauucauugauucauucguuuggagacugggucucuguagcccugccuggccucagacucaccgagagauccauguccuccugccuccuggguucuaggauuaaaggugugagccaccaugccugcuuuacuuauuaaaguuuuaaaaguuguauuuuuaguuagguuuucuccuguccuuaggugccugaaugcaggugcccgcagaggccagagggguuugauuuccccagagcuggaguuagcugccugcugcugggacugggacucaaacuuuuuggguucccuggaagagcaauacuagaaauuuuuuucuccagccccaaacauuuuuauagagauaagagauuuacauuuagaauuaggcaguuggacuuuggugaucucgguugugacaguacccagagaaucucuagucaggagacaguugaacggaugcugccuuccuccauuaggcugaacucaggguguugaccugggugauaucagugugaacacagcuuucacauccuguuugaucugguguuugguuggucugaugucuucagagggcauaagugucaucguuaaucuucucucaguggucagaagaccgucaugaccacuagucaugaucacuuagccuagugguuaagcuuccuucugugagaugacuguccaaggccucuggagcuauggugguaaugggccaccagaauggacacagacagacagguggacucuguucagccugugcucugguccucugcacuuuuguuuggguuuagacauaguuccuuguagaacauuucuuuugagacagggcuuugcuguauaucccuggcuggcuugaggggucuugcguuuuuauuuuuuacuacauucuauauaaauuauuuacuuagaguugaucuugaauauguacgcccacucguaaauucccaaagcugagaacauuggaacauagauccuaaacauccuaaguuuuuaaccuugguagaucguugagccaguguguuaaacugugugugcuguaaacagucaagugacacacggggaggaaacacuuaacacuguccauuuugauuaaaacugucugucuccaaccuuuuauuuugcaguucaucuucuaagcugaaaaagucuuccaugaauaauucacauuuaaaaaucauauauuccuagaagacugaaaugggggcuguuauuuugagguaaguguccacaauuuuguagauuuuauuucuuagucuuuuacaaaguugaauauagaaggaaaguaugaauauugguuagcuucuaauuauuuuuuucuaaauauuuucuaaucucuugagacaugguuuguauuuugagucccuaagccucacuuuaaguuagacugagauuuaggguugcuuaauucagagggguuguuugugugcuugcuugcuugcuucuguuuguuugauauuuuaguccaagcuacucugaaauugacuguaaagcacaggcuagccuggaacuugagcuccuuuagucuccagaguucugggaucacagcagugagacuaauacuggaugaaggugauuuuuauuauuguuguuauugguuuuuggggacaggguugcucuguguaucccugacuauccuugaacuugcuguguagaccaggcuagccucaagcucacagagccaugccuaccucugccucccaagcacugggauaaaaggcaggugcaguguugugccugccuuacuauugguuuaaauagagauuucucaggugauggcauugcugagagcagaaaaccuuccuagcucagaugacaaaagcaaagcagacagacugcuguuacuuaccuaugagguugagcacuucuuuuuaaauguuauguguaucagugcuuugucugaaugugucuccaucauaugugcaguguuuuccgaggccagaagauuucaggcccucuggaauugggaguuauagccagugugagcgaccauauuagggugggauugcacuugggaccucuggaagagcagcaagugcuccucuccuaaccucugagcuguuccucagccucagguuuggacauuucaggagcugggugguuuguacugauucauugcccuuucucgugcaugacagcgcugggacacgaaggguagggcgggcuccaccaacagccccaacucuacccauuuuuuauuuuaugugugugggugcuuugcaggcauguaugccuguguaacacuugcacgcuugcugccugugaaggccagaagagggcgucagaccccauggaguuggagugaugcaguuguagcugcuguguagauugcuggaaaucaagccuggguccucuggagagucgcuggugcacuuaaccacugagucaucucuccagccccauuuaucuguuuguuuguuuuguuuugggacagagucucacucuugcuguaccuggaaugguuuggaacuagcuuagacuagacgggcuucacgaucaaaucugucucugccuccugagugcugggguaaaaauugugcaccauuuaugccuggcugacaggguuuugaagcaaucaaauuagggaaauuuugaagaaugaucagagugaguuagggagaguaauaaaacacaugauaugaaaguggagggggaauaccaagaguggaagggaagaauggucaacgugggguugguuauucauuugaaauaugggcucauuuuguagcccaggcuggccucaacccagggcuauuuuccugccucagcuuccagagugcugcagugagaccuguauaccaccgugcccacgagcagggcuaauguaauuuucuaggcacuacagguuuaauccaguauuucaccaugcuaagcacacauuccaccauuaaggacaccugcuguggagugcagcuauuagacuuuccuuggaaaaugaauauuugacaguuguuuucuuuuugugguuuugcuuuuuguuuauugagacagggucucauguagcguagucuggucucuaacucuuucuguaugagacugacuuugaauuccugaucuuucccaaguguugggauuagaggccuaugugcugccaugauuugggcuuuuugaguuagggacauccugucuuccccuccuaagugcugugauuauaggcagguaaccaccaagccuggcacugaucugucuuaauguaaaagguuauguuuuuuaucaacagagcggcccggucucagcuugccugccagaguucagggaagcuggugcugccugcaguucuccuucauugcucaaggauccuucucauuaauauguacuggaugucuaugcaguugcaaaugauguucauaaagauauugagugucuguagaucugguccuuugacagugcauuggcaaugugcauuuugcuuuuacucagaacauagcuggucagaucgucauguagucugccauagacaguuaggauacuaugaaagcugugacugucugcauagcaugaccuuucaaaacuguuuuuuuuauguugccagaaucucauuuagucuuuugauagccacacgauagaggaaguaguggacaaagggcaguauaaauggcugccuuguucucagugcaguuucuaguggaagagagugucaaauagucgugcucuuauauacauaucuuuuaugugaaagcuuagguuaagacagucuuaaaaauaauaauaauaacuuauuagugugugaaaguguguguguguguguggagagagagaaagagcgagagaaagagagggagagagagcgcgagagagagcgagagcgagcacacucaugcauucagaggauaauuugacaguugguccccuccuuccaccuuuauguggauuucagagcucuaaccguggucgucuuuaccugguacugugaauaccuuugcuugcagaaucaugucuccaguucacguugguuuguuuuagauuuauuuuauuuucuacguauggguauuuugcuccaauguauagucuguacaccacacguguaccuggucaacagguguggaacucccugaaacuggaguuauauagccagcugcuauguaggugcuggaaauugagccuggguccucuguaagaagacgugcucuuaacuguugaaccaucuugucagccucaaagagucuuguuuuuuuguuuuuuguuuuuaagugugugugucuguguccgacugugauugugugggaaucuguaagccuuucugcacacaugccagccagacgaugacuugggucuucucuuaccagucucaaccuguucauuugaaacauagccuuuuccugaaccugggcucccauuuucacagcuagccugaaagccaccaaggcaggcaguccuuuacaccugcccucagcauagaugggguacugguauacgguaacgccuggcuuguuacaugggugcugggaucugaacuccggcccuuauaauuauuuaggaagugcucuuauccaaggagacaucuuuccagccccagcauaauauguaggaucuauuuacguguaauuuuauagguugaguuuccuaaucugaaaugcucuguaauccagacuuuguguguauguggucuugaacccagagccuuauaggaucaaguacuauuaauaguguugugagcaacaauuagcaggauacauagccuugcuauauaguccauaaugugucuucugccuuaagauguagagguaaagacaaaaguuauaacacgcagcugggcagguggaugguaggagcuuagcgggaacagugcagggaaagugcagcuucagggagcagagcagucugucggucagucgguaacaccaacauucagcccacaggcugagagacuggagaaugaguucucaucacauggcucuucaagccaggcuuugcauuugcugucucggucaaaauaugcaugcacaaaaggggaaggggcucagcauuuaaaaugcucacugugcaaacagcaaaguagagaccccagaacccaggaaaugcuggguaaacuucucacucagcuugacuguaauucccacacuuagaagguggagcuaggauccccugaguaagcuggcaggcuagauuagccagacugugagcucugguacaacuguagagacccugccucagugacugugaugaagaacacugggagaagacuuagccucagacuccauauacacacaugagcaccuacccgggucaguauuagcacugccucugcuuccuaacccuuugcaagaggcacuuuacugaacuuuaauuuccuuaggauguuuuuauacaucuuuaugcucuugaugaucuaaaaauaauuuuuccuuccuucccuccucccccuccuuuucgucaucaucuucuucuucuucuucuucuucuucuucuucuucuucuucuucuucuucuucuucuucuucuccuccuccuccuccuccuccuccuccuccuccuccuccuccuccuucuccuccuucuucuccuccuucuucuccuucuccuccuccuccuccuccuccuccuccuccuccuccuccuccuucuccuucuuuuuuuuuuuuuuuucuggagacaaucucaauuguguagccucagcuagcuauggacuccacugucuuuaaacucgaagagaugugccugcuucugccuccugaguguugcuaugugucaccauucccagugguuuugauuucacuuuguuguuguuuuuuuuguuuguuuguuuuuaagacaggguucuacuuuguaacugagcaggacuggcaucuauuuguggcuuggaacuagcagugacagucccuucucagccuccugacucacuaugccuaucucuagugauauuuuaacuguuauuuauaguuaaguaaauucagucucaugguauguguccuuuugcuauuuucuccuccccuuaccccuccuuuuuaaaaaucgagacagugucucauuauuccaaacuggccugaaacugaguagcaguucuuuugacucugcccacugauuacuauggauacagaugugagcucucaugccuggcccuuuuuauuucuguuaacaguguuugugagguucauuaauggugguguauauaguuguauuuaauuauuuuuccauauuauaaaacauucaguacaguuucuuguucuauuaguguauguuugaguugagacuucuuuugguuauuaugaaaaauuuuagcuuaaauguucacauaccucuguucuuggguaaaagugucacagaauaaagaauaguggagcuuugauggucuguuuagaaagauuggaguuaguuuguucaccugcuaacagugaucuguggcuaucaagguuuuguuucuuuuucucauguuuucuuuuuuuuuuuaaauuuauuuuauuuauaccaguacacuauagaugucuucagacacgccagaagaaggcaucagaucccauuacagaugguugugagccaccauauaguugcugggaauugaacucaggaucucuggaagagcaguuagugcccuuaaucacugagccaucuuuccagcggguuuuguuucauuguuuugguuuuuauuuugagacagacacuguagcuuuggcucagucagacccaauugccucuacuucccgugcugggcuugaagguuugggcaucugcugccuugauugccguuuuaaucuucauguucuuggugaauauauuaagcacucuuacuguaugcuuuuggguuauuugggcuuuuguaaauuucugcuuauugugauguuuauguuggauucauauuuuguacauauucccuuucacauuggaacuucucacuacuauaaauugugugcuuuggcucaugaccaguugaaguuaggguuugauuaagcuauaucccuaucccuaaaccgugcuuuauuuaaucauuuuguacucaccuguugacuauucuucauucuucuccuggucguguacgucgaggggacaucuuguacccagccucuugcugacauucugccccuguucucugccuuccuggguuccaggcuuaagggccuugcauuucuuaaaauaugcaaggcuucugaugucuuuucucucugcccaguuucaugucugccuuaugucagauucauauucauugcgccucugcagcuguuugugaaaacaguaauucucagaaggugcuaaaagggggagagccaucagccaucgcuauguugguuuccaugggcggugggugcuuuaagaugcagugugcaaaguaauuagcagagagagaagcuggagucagcagugagggcuuugcuagcuucauggaggcacucucuucacucuuccucgggauucuguuuccuguuuggacagagaaggaagaguuuugauacugaaccaccugugacuaaugauaaugaguuuuaguuauagcuugcaacuguguguguuugacuagugaagaccaauuguaacagacugaaaaugaauaaugacccaaaugcaguagacucuccuuguguuuucauuuaagaagcaguuguugguacagagugaucucuuucuuccaucccuggcuccuguugucacuguuguaaggagaaugagaugacgcagguggucauccuacagaccccgcaucugagguuggcacagucauuuccacucauuccaguggagagaccugcguauacugccacagugacugcacagguagcuggaauguauggcuuaccugguggcccacuguggcccacaauuccaagucugucacagugacauugagaucuuauuucuuaggccucagucucuguccuguauggugucccgccccccuguuccucuccccuaccccauacuuggacugaaggugcacaccaccaaaggccuuacuuuuaaaauuuaagauaucgaauccauccgucagggguggugaggcggcucgguaggugaaggugcuuaucaguaaaccugagaacccaaguuugaucccugggaccaacaugguggagggagggaaucaacucucacagguucuccucuuuuacacauguaauauaaucuacaugucugcccuuuccccacuugcucacacaaaaacaaauauaauuuuaaaagugaggaaaaggauauuuaagaaugcauauucucgcugggcgugguggcccaugccuuuaaucccagcacucgggaggcagaggcagaggcaggcggauuucugaguucgaggccagccuggucuacaaagugaguucacaggacaaccagggcuacacagagaaacccugucucaaaaaaacaaagagcaaacaaacaaaaaagaaugcauauucucaagauuuauagcagcaagcuuucccuuagugauaaaggccaagugucucccagcaucuccacccacaucccaugguauagaaauuuacucuguaacaggcgguccuuacaaguucuacccauauucugugggaacaaaauacccauguaaggaguuacagagacaaaguuuggagaugagacggaaggaaggaccaugcagagacugccccauucggggauccauaccguaaucaaucaccaaacgcugacacuauugcauaugccagcaagauuuugcugaaaggacccuauuauagcugucucuugugaggcuaugccagugccuggcaaauacagaaguggaggcucacagucaucuauuggauggaacacagggccccuaauggaggagcuagagaaaguauccaaggagcugaaggagucugcaacccuauagguggaacaacaauaugaacuaaccaguacuccugagguugugucucuagcugcauauguagcagaagauggccuaaccggccaucauugggaggagaggcccuuggucuugcaaagauuauaugccccaauacaggggaauaccagggcuaggaagugggaguggguggguuggagagcaggguguggggaggguauaagggacuuuugggauagcauuugaauuuuaaaugaagaaaauaucuaauaaaaaaauggaaaaaaaaagaaauucaggcuguaacaggcgguucuuacaaguucuacccauauccugaguuguagaaauucaggcuguaacaggugguccuuacuagcucuguuaucacagucaagcuuuugaaguucacuagcuuuucccagauccuagaugcaggcuuuauccuggagccagacuuggcagcccauacuguaaucucaguacucaggaggcugaggcaggaggacugcugcuaguuugaggcuagccagcgaugcacacuaagacacuaucuaaaaagaaaauauagaaacgagacuucauuuagcaaguucucugagauuaugaauuugugcacgcuggcaaacauauugguaccauagcugguuuugaaguaauaagaacugguucaaauagucuguguucuuuaggaagcaugacuguuuuauuuauuuauuuauuuauuuauaaguuuuugacacagcaucuugcuuuguagccucagcuugccucuugccugccucugcuucuggaaugcugggauuaaggauaugcacacacacacacacacacacacacacacacacacacuugugugugugcacaugcauaaauacaugaggguggggacagagagaauagaagagacgagacugauucauuugcaugaaagcuccgcugauucugauuccuucagaggagcguaccuccacugcccggccaugcuugcucccagcagcccuuccaguucaucuuaccacccugcuuccuuggggaguucaagcaggugcuccguaguccuccuucccaaccgucacccugauccugugguugaggcuccuguaggcugaggugcacaucaccgcagugagccaucucagccacguuucuucauagaaggaaugcugcccagcagagauggagcagaccugacucacaguucaccacucagcagacauaagugcucugugcaggcgagaugcagacugcuugcucucuuguuuuuaaauuuuguuuuuuauauguguggaugcaugucuguguaccauaugugugcagugccuacagaggccugaagaaggcauuggaucccugggaauagaguaacaugguugugagcugacuccauguggguguuagaaauuaaacccaggucuucuccaggagcagcuggugcucuuaaccaccuagccaucucuccagccccaguguuuuauguuuuagaucugaucuuuccucaauucaaugugcagugugccuuuaauagagugacuauuuaguaaacacuaauuggacucaggaccuuaucuugcuagguaggcauuccaccucugagcuacgucacuagccucucuccuccuuucugcucagugccuugcacuaaaugaguuuauuguguccucuaaagagaacaggcagcgcacggagacuccagugacagauaccucuuuauuaucuucaguucccuacucucuuuuugcugucaguaauaagggcgaaacaaagcuacucacaaaauccauuuuguuacucauguccagauaucuuaaaaggaaaauugucaucagaggcacaaucaaaacagaaaaauucugugcaaaccaaaguuaaaccauaugcuaaagaauaguaaguccugagauggcuguggauaaagccaguguguauagcuugcucuuuuacacuguauguauuaucgcuuauuuucagaacgacggcagacaaaugguuaagagguccagagcccauaguagagcuuuuccuacagcugaagcuauuuaaaauucuucuccuguugcuauuugccauccagauggcugucuggcccugguucaguuccuagaugugaggccgacgguuacucaguagcacugcuacacacguguacggugggcucaugacucugucacagcguuuacuugugucuucugccacacagaguccucgcugaugguccugguacuuacgaguaagagccacacgguggggguacaccuagggagggccccaucugcucagagaaggggaagggaggauggggcaaggauugugggaggggcagugagcgggauguaaagugaauaaguacaagauaauaauaauaauaauaauaaaaaagaaccagggaauccuuggaagauuugcuaacauucaaaagagcccacuuagaagccugucagacacagccuucggaguaaggaacagaaaccaaccagcgcucagagacuggaacuucugaaaaguuuccuuuuguauaguuuccuuuuauauugaugaagacuuuuccagccuuuugggguuauucugucccacauaaccagcuggucauggugacauacaccuuuaaucuugggaggcagaggugggcagaucucugugaguuccaggacaaccagggcuuauguagagagaccuugugucaaaacaaaacaaaagugguaaugauagaauuaaaaacucaaauauauguuguuguuguuucugagacaggucucuguguagaccaggcuggccucaaacucacagagauccaccugccucugccucccaagucuugagauuacagaggugcaccagaacacccagcuucucucugcuccuucauuaaacccacuugcacucuccucacccucuccuuagcuuccaucuccuaggucccaugugggcccucaugccagucaggguaugguaagcuauaggaaccauggcggauaaucacucaguaagagguuuggcuuuuguuuuggaaauacuucagcaaaacgguaguagaugaugcuugugucugaacuuaggugccuguugucugugucuuuuaccaguacagacuguccuagcugagcaugcuagcagcuucguagucauggcugcuguagauccugugauuuggcuuacagauuaacgaccuacucuuguuacauggcuuuucauucacaaauaggaaaaaagucaugaauacuugucccuuagauaaguucuaagggaagacgugugucacaaggcagaauuucugggauguacacaagcagcaggaguggccuaguauuggaauucacaagauacagugcccuuguaaugggaggaagagucuguaguagccuuugccauuccuucugggcauuugcagcaggaucccgugaguucuaagcaguuguaaagcaguuaugugaauuguguuuguuuuggucagaggaauuuaauuuuaaggcacaccccucacuuggccuucuuuacuguguauguggguguuaacagugcucaugaauagacuuuucccacucucacucaggugugggaacaagcucaggauaccaugcuugcagggcagaucccuugccugcagagcccuccugcugucuugucauucuggccucuuguuugaacugauuuugaauuguuaauccacagugaaugaucacaacagcaggaauggugcaauucagauuagugaaagaaaauggugauaaaugaaguagaaaugcccuugcugagacccacagcaucccauccaaauuguuacucaagaaacgaaacaucuccaagacaugcugcucuaaccgcagugcuugucuaagucaggagaagguuacaggugggcagauuucugugaguccaggauagccagggcuauguagagagaccuugugucaaaacaaaacaaaaagugguaaucauagaauuaaaaacucaaauauauguuuaaagacguauaaaauuagucuuuuaacuucauuauaaauuuacuuuuuguuuugcauuuuguuuguguacacaugaaaaauuuaaaauuacuuuagagagaucucuuucauagcauuacagugcuuuaaaauuauuuuuaaaaugaaaugcugaaguuccacaugauaguaguuauauguaauccauuguaguuuugcugcagucaggagaauuacagugagcuugaggcuagccuagguuacaaagugaaaacauguugguaaaacaaaguaacaaaauggcuuaguuuuacugcagagcaaaguaagugguggaauggggaagaguccuaguagcagcuaucacuuaagucaccucugaaggaagccuccaggcugcaguagcagauauagccuuugcugccagugugcauggugucuuccaguggcuggagaguagggcacacagagaggauaaugacaaagaauccaguuaucagaggaagacagggaaccuugcgccaccagggaugcaugauuaaaauaguaugcuuaagggaaaaggcccgagauuucccggagugggagaaggugggcgcuggcgacaucuagaugcucugcggagaguggcggaacccuacuguuugcuccuuuuccuagcuucgagcacacguuuccauucucaggagggccuuucucucuuagaaacgauuacuauccacaugguccuccggcaucuuuuuguuccaggacagcaaaaccuggaaggcugagugggugucccccuguauauacucaaggcacacauaaaacaguagacucaccuuucuucgcacuuuaucauggaaauaagaaaaaacguauccuuuaauuuucuuucagagcuucuucuauccuuuucggaguuguuuugguugugcuuguucacauguguacauguguguugguuucuccuucuuuccugauuuagagaaguacuuuaguggcuuagcuggcaugcugcuggggaaguggaggucucuauauuguuccucuuucuccugugaacagacacggcuuguguucuguaauuccugucuaaggguucaguggggccaguugucccugcuguguucuguaccccuaaagcuucccugagaaguugucauaccuaaaaauauucuguucucaguguuagaucuuauguuuucauacuuaagauacaaugaccuaagcucuugaagacuugguagcccugugcagaacauuuccuuuaaaggaggugugggaaacauggcuaauugcuuugaaaaaugaaagaauacccuuucugcuccugucccugacuugcuggauagggcugucucugggcuuugguuuucuuaccuuucugugaggagaguaugcuacucuuaagacuccuccugaccggaagcucauaggcuuggcucugcauguagcacuugcucucuggaagaaggacgacaaggcaaaggagaacaaaauguuuuacuuucaauuuaguagcagcagugggaggugcagugcugggccuugaacucagaaccucaugcaugcuaggcaggcccuccccaccauacuaauaguuuacuuccuuccuuccuuaauagccuuucuuucuuucuuucucucuuucucucuuucuuucuuucucucuuucucucuuucuuucuuucuuucuuucuuucucucucucucucucucucucuucccuacuuucuuucuuucucucucuuuccuuccuucccuuuuaauuuuauucuucucuucucuucucuucucuucucuucucuucucuucucuucucuucucuucucuucucuucucuucucuucucuucucuucucuucucuucuuucucucuuugagacagggcuucucuauguagcucuggcuggccuggaacuagcucuggccuggaagagagaucugccagccugugucucccaaguguuggggcugaagguguguaccaccacuaccacccagcugugauuguauuuucuuaaaaguauuuauuuuuauuuuagugggaggaguugcccuuuuugagacaaggucuuuauuucaaagcucuggcuguccuaggcuagucucagacucacagaucugccugccuuugccuccugagugccaggauuaaagguguguguuaccauguccuguuuuacaaguauuuuucuuuguuugagacauggguuuucuguguagccaucuguagaccaggcugagcuuggacucaggaauauucuuauuucugccucuugguugcugggauuaaaggccuguacaaccacaucugccuuaaaguauuucuaauaggaacaaggauggugauguaugccuguaacccucauuugggagguggaagcaggagaugcuggaauucuaggcuacucuggauccugugaaucugugucucucaaauaauaucuccccuugucuuggggauggagcucuauguguagugcuugccuagaauagccaaggcucggggcuugaucaccagcauuuggaaaaauaaaauucuaggcaugaugauaauccgagcacuugggaaacugagaugggaagauuggugugacuguaagggccagccucggcuaacauaguacaggauuuuggccuccccaaccagccccuuaaaccuaaccaaagcagagcaaaccaagccaagccucuacaaagcagaugugauggcacacaauuguuaccuaguccuaugguaaacaggagggucuccauuuugagacuagcuugggcucuauaggauacuguuucaagugaaacccccauagcuaaaaacacuuagaggggaccucugcagaagcuuucccauucccacuuauuguuaggguccauuggaugugcuuguagccaaguagcacacacagacagcaguguccuagaccugagucagugugguuucuagaugugugucuaaauuugacauaguggugacuuaaagugaacuuaaauaacuggugacuagugacuuccuugugcuuuucuuuucuuguacuuauuuuuuuuuuuaacgugugucuguguguggauauauguacauaauuucagaucccuaggaagccagagguguuggaucccuuggaguuacagccguucaagcugggugcuggaaucaaacccaugucuuuugugagagcaggaagaaggggcagccacuggagucaucuccccagcccuguuugcuguuguuuuuaauuuaauuuaauuuaauuuuuuaaaagccagaucucucuguauguagcucagacuauccucaaacucaaugcuucucugauuuagccuccaaguagugggauucuagacaugagcccccaugacugccuugcuuugguuauuuuauuuuacuuuuuuaacaucugauuuguguguguguguguguguaugugucuucccuaagagaagauagcucauaggaauugguucucuuuccauguggguccuuauagcuggucuuuggcuacuuuguggguucuuuuuuuuuuuuucuacccuuguccaucccuaacaccaguuaggggaggaaaagggauagagagaggaaagggggcaccauuaauuuuaacuacuuccuccugauuggggggggggggggaaucaagguccuuagggcaauuuuaaucuuugcugucaggauaucuaauuuguucuucugucuucuuugugcaugacuaguuaaaaaaaaaaaaaaaaacacgaacaacuaacaacccuggcuccuagggccuagcuagcauuuauacacccucugaaaaguccccagaauuccaaaugucacacaguugcagaaacuaucugcagcuggcaaaaucacaccccuacuagagcacgaggcaaaucauagucagcugcuuuagacaaucugaagcagucccauaucccacaccugagauuaaaaugaaaacauauucucauaauauuucuuguguuuuucaaagaaaccaaaauucucacuauaggucuuggugcugagacagcucuccagccuccucuuugcuuuuuugauuuuguuuuuuuuuuuuguuuuuuuuuuuuuuuucagacagaguuucucuguguagcccuggcuguccuggaagugacucuguagaccaggcuggccucgaacucagaaauccgccugccucugccucccgagugcugggauuaugggauuauaggcgugcgccaccaugcccagcuccucuuugcuuuuuuaaaugccacauuuaggggucuggagugauggcucagugacaaagagcauuugcuguucuucaagaggacccagguucaguucccagcacgauacugggguggcuuaugauggccuauaacucaaacuccagauuucaugccuuuggcccccauggauacugucgaucacccugacauacucaaccccauuacuuaaaaucagaaagacaaaccauauuaagcuggucuccugcugcauuaucgucuguauugaauaagaauuaauuguaggggggcuggagagauggcucagugguuaagagcacugacugcucuuccagagguccugaguucaauucccagcaaccacauaguagcucacaaccaucuguaaugcagauaugaugcccucuucuggugugucugaagacagugacaauguacucacauacaugaaauaaauaaucuuuaaaaaaaaaaaaaagaauuaauuguaggagcugaauaggaaucagagguuugagacaauuuccugcucuuguaggaagccuggaucuuguuucuagcacccaauuuggagcagcugaaaauaaucuguaacugcuccagggagccccaugacccucuaagccucugugggcacugagcaugaacaucuucacguagacacucacauacguacauaaaacagaacucuuucuuacagaacuggucguagaugggcagcucuccauuuucuggagguuuguaugcuuugcugcguucuaggcuuccguguuggucugguucuccugcucagugucuccuguagcuucgggcuagaagggcggcccagcaugccuggacgccgugccuuauuguaaagaccgacugauggcuuauuguucccuucuacuugguuccagggcccugagguuaugagugugcuuccgcccuaucaugccuccugcuauggcagacaaccuugacaucugggcaguggacucacagauugcauccgauggcgccauauccgucgauuuccuucugcccaccgggauuuauauccaguuggaaguaccucgggaagcuaccauuucuuauauuaaacagguauguuuauauuagaauuucucaggauuuagcuacuuucuuugcaauuuacuggaaaagacauuauagaaaauaauguaaaucauugcuaaagcagagagacguuucacuuucaggccaucgcaucuuuaaauuuuugauauguccuauuuuuauauaaacaugcuuagucucccaccuuuguuuuuaaccuacauguaacagcaguguuaagauuggugguaaugacuggucggugguggcggugguggcggugguggcaguggcgcacaccuuuaaucccagcacuugggaggcagaggcagguggauuucugaguucgaggccagccuggucuacagagcgaguuccaggacagccagggcuacacagagaaacccugucucaaaaccaaaaaaagaaaaaaaaauggcaguaaccauggugacaugcuauagucccgccuuuaguuugaggaggcagggguggagguggaaacaggaggaugagguauuggagguugaccuugccugcauaguuaaguucaagaucagccuaggcuaccuguggacccuguuguggaaggguaagaaagcugagcccuuccugcuguaacuccugacuuuugagcuugucauacuucuuuuuucugugcgauauuuguccccacacccaacacccuuguuaugagccagaggaagaguugucacuaaaaaucaacugacccgugaagccaccccccaacagaauuuucuucuggccacgacuggcuuagaacucauagcugaauaccucccuuggccuuccaagugcuaaugugggugaggggacaggcacagcaguccaaggaauuucauguguaugauugccuacauguauggcugugcaccacaugugcaguguccaugguggccagaagagggcaucagaucccucaagacuagugacagauauugugaacuaauaugugggugcuaggacucaaacucugguccuaggggacaauuuguagguuuugguucucucccucuuccauguggguuuugaggaacccaacacaggcauuaggcaugguggccugugcccuuauucacagaaccaucuguccugucccagaguugggauuuaauaaagauuucacuuuaagacagaagucucacuauguagucuugacuggccuggagcuuucuauguagaguaggcuggcuuugaaugccacagagaucugcuuccuucugguuccuaagagcugggauuaaaggcuugagcuaccaugcuugccaaagccugcuugggguuggaggguucuuuuaaugguggauaaugaaucuaaaaugagaugaccagauggauccugaaggaggaggggcacacguggcaggauuacaguugauaagggaaagucuagaucucagggcuucaggaagugagcgcaucuucacuguaagcacaguuaauaguuguuugcagucugaggaaaugccuugggaggggcaugaggcccugcccaaggucauguacucuggaucccgaagccugcuccauugcuaguuuaaaauaaaauucuugauaaccuucacagcaagcauugcuaauugucccugucagagagcugcauuuguuuuuguuuucuuuuaaugguauuuaugugggugugucuuugugugaguuguggggguggggcaagggggcuguugguacaugugcaccugugcaugugugcaagucacaggacagcucauaggaguugguuuucucauuuccaucguuggguucuagugauugaagucaggccaucgaauuugucaucaagugccuuucuccagggagccaucuugccuacucccuacagugcacuuauuacaagucugcuaagcaggaaggaaauuaacuaggaacuauagcuaaaccauagacauuuuaaaaaaucucauuaaauuaugugauuaaaccauaacuaaguugaaaguugcauaauaaucagaaaaguugugagauacauuuuauaauaaguauuauaaaauauaauaaguauacaugagaauucuaaauuuguaauuucuaaaguaaaaaggaaauacauaauuuagcuacuguguugcuacugagaguaucuauuguuuuucccuuuuuguuuuguuuuguuuuuguuugagacggugucacacacucacagagaucccccccaccccccaaaccacccaccucccagugcuaggauuaaagccugacuauuuuguuuuugauagucucuuguagccuaggcugaucucuacuuacuguguaguugaggaugaccuugaacuguucgauccuccugucuccucaaguacuggaagucaaaggaguguguguaucccaguaccagcuuucuguguuuucggucaccagugacaagugggacaucuaaucuuuccugagauugaguuaaucauugacacucuccaguuuuuuuuuuuuaaauuaagagauauguaugaaauuaagauuuacaauuuagacauuuuuagauuuuuuuuauaguucaggcuggcuuugaacuuguauacagcaggacaaucuugauuuccugauccucuugacucugccucaugugcuggaauuauaggcccauuccaccacacucugcucaacuuuguuuccuuguuuuguuuuguuuuuguuuuuuuauucaaagcuauuuuuagguauguuaaauaucauugguucuuaauuuucaugggcaauuuucuuugcauauuuugugugcuguguuauauuacauaggaauguagaacaauucccuauauaaccuauuuaauuuacuguuuuguauuggcagagagugaucuauaauggcuauacuauugguuuugaaucagugaguuuauuaaguauguaaauagcaaacaaaagucaaagaacaaauaacaaguaaguuagcuaucagaacaucaccucaaggcauagagaccccaggcagcuggggacggcgcagcagucagggagcucugauggaggagcucccacagcugaauuucugacucccgcucucacugcccaccccucaaggguaacucgaggaacgcccuauuuccuagcuggucucaagaucauggcguuuucuauucuugggcuguuugguucugaguuagguggccagucccaucccuagacaaggcucuaggaguuacuuuugagacaaacagguuugagucuaaaauggggaaggaacaacucaguucucagagccaacuucucagugaguucaaauagcacaggacagcauagcaaugcaaugcauauaacuccuguuuaaaaagagagagagaagauaaaccauuucacuaggcgugguuguuuaugucuguaaucagauauggggaggauacugaauguuugaggccaacuaagcuauauauauauauauauauauauauauauauauauauauauauagagagagagagagagagagagagagagagaguuaguuccaggagagccugagcuaccauuugagaucuaguccaaauauaaaauuauauccccacuuaaaaagagaaccacuaaucucuauggcauaaauucccaaguuggguuuguauuuguuuucacuagcuuauuauaaucuguaauucaauuaucugauccuuacuacuaaacauuuagcuucucuaggaguugacuuuuugugaguauuuauuuauuuuauguguagggguauuuugccugcauguaugucugugcaugacaagcugugcagugccugcagaggucagaagagggcuuggaugcccugggacuggaguuucagaaggcugugagcugagaguggcacuggugguugaacccaguugcucuugaaagagcagccagcguucuuuuucuuuuuucccuuuuucuuuuuuuccaagguaagugucuauguaauaacccugacuguccaggaacucucugaaaaccaggcuggccuugaacucacagagauccaccuguccuugcuucccaaguggagagauuaaagguguaccccuguucccaccaguguugcugauugcugagucgugucuaaccgcacgaguugugacuggcagugggcaugguuguaucuguuucucugugugugugugugucagcguugcagauaaugucuuacuguaucccugcagauguuauggaagcaaguucacaacuacccgauguuuaaccuccucauggacauugacucguauauguuugcaugugugaaucaaacugcuguauaugaggaacuggaagacgaaacacgaagacuuugugaugucagaccuuuucuuccaguucucaaacuagugacuagaagcugugaccccgcagaaaaauuggacucaaaaauugggguucuuauaggaaaagguaacucuuaaguuuccaguaugcaaugcuagcuuuaccuuuguucuguguuagcaugcaagugucuccgaaggcaucaucuucaauaguuaguccaugggcuggaagaaggucugugcagaacugaaggcugaauguaaugacgcagcucgggcuauguggugcugccucugcacccaagggccugcauuucauguuccuuucuuuacuacuggcuuauuuuucuuuuauacaaguauuggucuucaauuuaccucaaguaauuugagaaauucuccaauacacggucuucucuaauggccucgaucaguuucugccucacuguguagaccagcugaggucuuggaauugcuguucacugagugugauccugccuucauuuaauguagcacucugugagguccaggccagacuggucaacacagcaaguuauaggccagccagggauacaaagugagaccccgucucaaaaggacagacagauuaaaauugcucuccuccugccucagccucauggguacagauauuagaggcgugcacuaccuuuuuuggcugagaaacucuuuccuauuagaugacuuuuauuuuuuuuaugaacugccuauaaauacccuaauuauuuaccaauuaauaaucaauaaguugauuaauguuucuauaaauuaacucacguucuuagcaaauuuuuguucuuuuacugaaguuauuuuuaauuagacguuaucuuuguaucaaauaaagauauaugcacaauccuuaaauuauuucuaggggcugaagauaccacucaggugguagaaugcuugccuaggaugcaugaauccuugagccccauccaagcaagcaaacaguaaugcaugcuggaagggucaggagcucacagucauccucagcugcauggcaaggcucccaagggcuacacaagacccugucaaaaaccgaaaaaaauuucuggagaaaauuaaggacacagaggaauuaauucucucuugcuauacaaaucuuaacagacaagauuuaaugucuguccacaucuugcuuuagagaaggugcugauccgacuuaggaacuacaggcacgcgcgggguuacuuaguacaggccuuugaagauuaaucccgaagcagaaggcuauggagcuucuugaguuugauugacgaccugcuugggugagauuaacugcaggaccacaacucagugccaccuccuucaaguuagcuuuucuuuggggacagaaguaaggugcuuagguagcgccucaauuuucuauuacaucuaucuaucuaucuaucuaucuaucuaucuaucuaucuaucuauguaucuaucuauguaucuaucuaucuggguguggguauuugcuuaacuuucccugcuucugucuaucucucccugucucucugugucugugucuaugucuuucucucuuuucucucuguuucugucucucugucucugugugugugagagagagagggagagggagagagggagagagggagggagggagggagagaggggggggagggagggagagagaaagaaaggaagagggagagugagucauuggacaagguuuuugcugguuucccaccaaguacguucuggggauugaacuccagucuucaggcuugggggucagcaucuucauccacuaagccacccuguaggcccaaaucucagauauggauuaacuagccaccacuaacuguccuaagcuugauaaauuuagcaaauaaaaacauaggagauagaaguauuucauagaauauaauauacuugggcuaaaauaugucuucaggauuuaucuguggugugauugagcagagcugacuuuucgucuugcagccuuuacccacccaguacagcgccagggugugaauauaaagcaauaggcuauauuucaugcacugucuuuugacuuacugcaucuguauuuugugucaugugcucugcaaguugaucaagauauaaacaauauuuauagcacaaauuaagcaguuuauaugcuuagcuguuuauaaauauugcuuccuaggggaucugggaauucuuugccaucacacacugaaaguuuuuguguagaagucuguguuucagagcaaguccucacuguucauaccuaacgagucgguaucugcaguugcugcucuguccucagugacuguauccagggcugggugaggucaugccuccugagaaaacaauaaacaauuacuucaguuuaacuucaggaacaagguugcucccuccucuguccaaagaaaacaauagaacuuuuacagcagaauggcccugggcaggcuaaaaauaccauuuccuccaggauggugugcuugauauuucuuuacuguuuauucuaaauaauuauuuaccgaguaggucuuugugcuccgacugcucccucccgugaaagggcaugcucccgugccuugccuuccacagcacccaggaaagcagacucacuggcagacgguuuaucagcagucucaagagacuguuugaguugggucugguuuuggagauuugugaucucagcugcuucggaggccagggagggaagaucacaaguugaagccucaaaggcagucuugcaaucuggugagccgcugucagaguaagcaucuaagaagagagcugcgagugugcuuugguguagagcaucggcuugaugugccaggcugcccugaguucagccccgagcaccaucgccgcucagugucccucccucacuagcucuggguuuuguucuguuugagacuggguuaacuaucuugcccaggcuggucuccaacucuuggccugauugagccccauggcuauacucacuagugcuggaggagacugaucacuugccagcuugccuggcagucuguagaauuguagcaauauuuuuaguaugaucauaguguuuucucgugccuuuuaaguauauuuguuauaugucaugcacuguuuucuguuguuuuccuaagagaaaguauauggaaaguuagauuuaaacuuacuuagcuuaaguuauuaaugacauuugucauaugccaguguuagucccaggaagcaaucccaaaccuucauaaaagagagaaagaaaggaaagaaugcuuuugccucauaagaauuccaccacuuaaccuuagccuuaaauuuaaaaaacaaauuuuuguuguuuugucaauguauggauuugugcauggagagugcacaggcagagucugaggacaaucuggaaaguugcuucucucccuccccucugagucccaggcauugcaugucuacccugugugcagcaagcccugagggugugugugauuguuguugcacguguggaggucagagagcaaauuguaggaguccauucuuuuccuuccuccaugugaguuccaggaaucaacuuuagcuaucagccuuggcaucuuuacuuaaguauauuuuacugagccaucuugcuggccuccaaacuuuugaaagauuuuugcagugguucucaaaauucaggaagcauuacuucauauaaagaacauacauagcccagguguggccuuuagucuuagcacuggugggcagaagcaucagaggagaucuuugugaguuugaggccagccuggucuacauaguacauuccaggacaccuaucacuacauagagagacccccuaucaacaaacaaacaauaacaacaacaaaacacugagcaaaugcuuggacucuccgaacuugggcgacagagacgagagaauccuacaggcuuguuggcuacccacucuagcucaguaagugagcuccagaccagugagauccuuucucaaaggaagggacaggguguuucugagaauaaugcaugacauugucuguuggucccaaccuguauauauguacgcauacgugcauaaacccucacacaugcauuaaagaagauguuauuaccaagucagcagagauuuccuuacuucaauguauguuggaucuucauacuuggaauuguagccauguuguaugggacucacgguuggaaauaauggaccaguaggcagacacuagagugcgguggaugcaucuccuagucaccgaggccggggcaaggguacuggugagugagugaggcugcuagggcaucugaugcuaaacaggcgcugaggaggaguuugcaaaugaagggguuauaggaaagugagcaaaagggagugggagcugaaagguggccuucuugaagaagaacgagaauugauagugguuguugaaagaggccuccaggauaagcagcaaagccuauuaggaauaguagcucagaguagggagugucauccagagaaguuguagacuuacuucuaagcucuugggaaccccuccuccccccacuuccuuuuuugugucauuauaacaaaagacagcaagaugcagccucaucaggaccagcacacugcuuuaugcugaucgguguuugucuugcugguuuacuuugugauggaccauuaagaauagcuucaaaaccaguagcuacaccauuaucucuaucggauccugugaaauguuugagcuugaaagacauggaagauaccaaaccugcuacaaugccuuaaauuccaucuguaauuucaggggagcaaacagacccuggauguuaaucuguauagaaggagucauuuuaucuuggcugagcuggaaauguuuuuccugauaauguaagagaaugggaaaaguuaaacauucacaggagaaaaccucuccgaagagaacaaugacauuugagaggcccguuaaccgaacgcugugaacugggauacuacugucuuaccugagagccagguccucuggaguucacuuuaaucugggcucuaggaacauccucauggcccagauaauggcuuggacucucaucccacuucuguucccugggaaauuuuuaaaaaguuaaauuauggguauuuggguuuguguaugagaguggaggcuaaaagaggguaucagguucucuggagcuggaguuauaggugguuauaggagucaacaaaguaggggcugagagcaagcuugggccugccucugcaagagcaguguacacucuuagcagcugaacuauuccccagccccauucuuggaaauuccuauugaaagaauuuaaaugggaaguaacaugaucagauuugcauuuuggaaagcuugugcagacuaagauuagagagauuaggcuggcaaggccaaccacugggugaagacacuagagauuaagucucacagccugagguaaauucccaggacccacaugguugaaggagguaguggcucccacagaccaucuuuuaacguguguguguguguguguguguguguguguguguguguguguguguauacguacaugugucugugcccuuucacuaagugaauaaacauauaacuuaaaaaaaguuuucaacuaaggagucuguggaaaauguugugauaaucacucgagggagaggugcugaggacuaggguuggguuaaugacugcagaaacagacagguagacaauuugaagacauguagaagguauuuuagagcuggguaugguagugcauccagcagucuuagcaggcaggccaaggcauaaggacugccuucaauuugaauuugagaucagcccaggcugugguaaaacccugccucagauauucccccacacccgcaugcgccauagaaagagguggugcggacauagugaggaggcugguuuuuugcuguuggauacuccuuucucucuccuccccuguuaaucugggcagaagaguguuaacagugcacucuaagacgcucccauuguaggcggcaugauguuaucaccugcagcagucuugcucacaaaccaugcacaaguuuccuccucccccagcucuucauaauguuuuguguuggaucacauucaucgcuauccuggggcauaugcggcuguuuacacaugccugcuggggguggugggggugguguccaaauguuucugcuaaaacauucauagcugauuuauaguaauuuuuuuacagguguaagacuguccaggaaaaucuauggcucuuuuauaaugugguuuaagauuguguauuaugaauuucauuuuuuauuauuacauuuuuacuuuugugaguguaguaugccaugacuauauccaugaguguccugaaacugguaguggcuauccugccuccacucccaaguuuucucaguguuacagguaugcaccuucaaucccaguuuugaugguuguaagguuaauaacccaccgguauuucucuauaauguuuuaaauuuguguguuccagagauucaacagcauguauauuuuauaugugagacccauuuuaucuguguuaguuugucaucuuucaugguagcuuccugucuaguuuuaucugcuugguaaaagacaaaacccaaguuaguuuguauugaagauauuuuguguucuuuucuuuuuuuuuuuuuaaaaaacaaaacuauuuuuagcuaugaaaaauguaacauucacaaaauuucuuuaggucuucaugaguuugaugccuugaaggaucccgaagugaaugaauuuagaagaaaaaugcgcaaauucagugaggccaagauucagucucugguaggguugucuuggaucgacuggcuaaagcacacguauccgccugagcacgagccguccguccuggagaacuuggaagauaaacuuuauggaggaaagcugguuguggcugugcacuuugaaaauagccagguauuguuugauauaauauuuauauucucuuguaaugagccucugauuuuaucugacugccacugcauucuuagaagugcuucuugcuuagaaagcacuacugcaaagaaaacucgcagagucaauagacuuagucuguaauuguguaggauugggauaggcuuuguacagaaauucuugacguguuacaauaguauuuuagaguugucauuuuuagaguugucaaaccacacuucuuaauugucuuuuaaaguuguuuaccuagcacacacaaggccauagguucaaacccuagcacuucucuuccccucccugcccccacaguugguaaaauuggacagaaaucauuaauugauagguuacucagcaguaagguauggaucuuuucauaccaacacaugucucuuuuuuugucucugcugggcaucaagccuaggccauggcacaggagugcacaccuguuauuccagagucagaaacaggcacaucucugaguucgggacuacucuggacuacagagugaaaacuaggacagccagggccacacacagaaacccuguauccaaaacugaaagcaaaacaaaccaacaacaauaauaagccaggccaucaugguaggccugugggcugcugcggagcucuaccgggaccccagguuuuguaauaauuaauuggacacucuuuuuggacacucuaauugaccucuuaucugagaguaaacuucagcuaauuuuuggugugggguuuuuuuuugaaacaaaacaaaugauuaugacauuuaaauaauauguuugcauaaagaaaaaaugucauauauaucacguuuguuuuaucuucauaaaacuaggggucuccuuggauaaaauauuuuuuaaaugaccaguaaauauuccuauuagcaaagacuccaaaccaaagaauaagcccaguauccaaaguauccaggcuggcccagaacuccugagccucugcaggcuggcccagauccugagccucuggcucuacugccuaaacucugggacuauaggagaaugccacuaugcccagcaacuuuagcugaauagcaaucuuaccuucagagcugugauacucagaaugcaauaacauuacuuuuaaauuaucaguguguaaauguuuagcauauagaacaucugagcacacuuguguuuucccggcaaauauaaaauuuaucacauuucugccuucccucauuuuaggauguauuuaguuuucaagugucucccaauuugaauccuauaaaaauaaaugaauuggcaauccagaaacgccucacuauucguggaaaggaagaugaagcuagccccugugacuauguguuacaggucagugggagaguggaguauguguuuggcgaucauccacuaauucaguuccagguauguauagugacugacugucacugcaggaguguacauaggcgccuuuaccuuccagaucuuuaaggaagugccuguagcugacugaccauuuggaaccuacagaaaacuuuacagaauuauauaauaaacaucuguuacuggacccugcuccuaggugauuguuacuaaaguuuuggcaaguguuuuuuuucucgaaguuauguuugcuuuggacagugaucgcacgugugaguuugugucugcguucuuacacucugcuaguggauuaguucagugcuucacauuauuuuccugcagcaugggauccuaacuguguuauguauagcugcuuauuaguuuuuuauaaacauauuugagaguuagauucuggaggaaguguuaaaaaaaaaaaaacccuacuuguugaaauagaugcuuauaagcaucucacagaaaaaguaaagguuuuuuuuuaaagggcuaacaggaugacuuagcaguaaaggcgauugcugagcccugcugagacugagucuguucccaagaacugcuguacagguagacagaaggaacggacuccacagaguuguccucugaccuccacagcccccacacaugcauuacacacacacacacacacacacacacacacacacacacacacacacacacacacacaauaccuuuuaaaaagaaaaggauucuuuuaguuuuuuguuucuguuguuguuucggguauugagcccaggcccuucuguaauuugagcaugugcuuuucccacuaucuaauuaccuugagauuucuucaccagaagguuuggauuugucaucaaggaacuuaaaaaauacuguauugauuugaaaacugaaaggugguuguuauaggagcaguaacugaaaaggggccaagcuacauacagaucaguagaacaguuuaaagccuaggguagguggguuaguugguugguuggauucuguuccauuuugugguaguguuagguuuuugagaccaagguucuacucuauagcccacagggauguaauccugcuccagccuccagcuauugagcuacacacgugaguuagcucuugucaggaguguggaggggccacauauugagugaugucuguaagaaaagaaaguuuugaagucaaguguggcaguauguucaugcuccuagcaguggagaggcagaggcaagaggucuggagucaacaaccaggccaggcuauucgaucccuguuucgaguguccaaagagaaaacggguugagaugcauuuaacagguaacagaauuuuauacugucuugucuguuaaaguuguggcauguccucuuguucaagagggggccuaggauaggacagcuuaugugcacagcucugggguagugagcaguugagcucuagcugagcaggaagaagaaagcaaaagugucaggugagcaaccuggagauccuucucuuccucccagucugucgucuugcacaagacauccuccaucaggcuagcacagaauaagcuggaucaagcuuuggaucuauagaaggaguuuauuuucaggaauucaugggauuuauacauauauauuuguaaucuuaaaaguaggaauggucacuguuuguuuuuuaguuuaucuuuuguggagccuccugguuuuaugaaaauaaaacauuagacugaaagaccagaaggucuuuccuggguaaacugcugguggcgcucgccuagaauccugugcugcaaaagggccaccucaggcguccucuggacuuagaccaucccuggcugauuggccagcauguaacuugggcaucagauaaauagauuuauauuugggucuuagagauacgagguguguuaaguuagcucuucugguuuucauggccacaaccugugaaauggaacuuggucucuugaagacuguuauuaagaauaaccacaauguaaguaucucucuccauuccuagguaauuggguacucaguuaacaguggcuguuuuauguggguuuuugcuguugauggcuuguuugaugauaacaauuggacaggguuucuugcaccugcuaggcaaugaucugaauucaauccuuggcccguagucuucagagacagggccucuugcucauacugagcugagcuacuguuuucuuaacacugaccucaagcuuguggccccuggguuuaguuucccagcaguacaccacaaagaugcaucagcauugcugugcugugcugugaccuuauaacguuuucacuuguucuauguguaguugugugcaccagagugugcuuguggaggucagggaacaacuuuugggaguaguuucucuccugccaccguaggucagggcugaacaugagucaucagacuuggugacuugaugacuuggugacuagugccuuucccugcugagccagcucacugacuccuguguuguaguuuuacauuuacuuuuauauuacguguauggggguuuugcccuuguggacguaugugcaccauguauauguagugccuaaagaggccagaggugguugcaggauucccuggagcauccaggggcugcugccucuccagcuuuccuguguugugacuuuaaaugauuauauucuugauacuaaguugaguaacauauaccuauacuguacauuuaguguagugcuguucauauuaauuuucuuuguugauuuaaaugaugccuguaaaucucuacccucgccucuccugcuacuucaguacauccggaauugugugaugaauagaacccugccccacuucauccuuguggaauguuguaagaucaagaaaauguaugaacaagaaaugauugccauagaggcugccaucaaccgaaacucauccaaccuuccucucccuuuaccaccaaagaaaacgcgaguuauuucuguaaguuuccugugucggccuuugguaaccccaaaaccaugugauuuucaguugugcucucagucucagaccuguuuccuuuacucacuucuccuucugugacaaucaacaucuuugccaaaagcucaucaccauuuacuugaaaaauagccuucuccugcaugguauuuuuagugcccucucaccaaauacuaucagguuagauauuauacuuaaucagcuugagacacaggacacaagauaucugaauaggcagacuauuucuauguuguuucuuuuucucagccuugcuuguggcucugguucccaacuugaggcuuagaaauccccagcgguguaucucauuucuuuucuuuuucuuuuuguaaaagauuuuuauuuauuuuauguauaugaguacacugucacugucuucagacaccagaagggggcaucagaucucauuaggagugguugugagucaucauggguugcugggaauugaacucaggaccucuggaagagcauucagugcucuuaaccacugagccagcuuuccagcccagcauauuucauuucuaucagcuuaaccuuuuaggacaguuuuggggugacuaaggcaguuaaaaccaguguuccauuguggguucaggcuggcauggaacuuguuuagacccaaggcaaucaugaucauccugucucaguuuccuguguucuggaauacagauggguuccaacacgucccccugcccucugccugccucucccucacuucacuucuuagcauuaacagacacaaaaaucaagugcuaguagugcuucauuugauauuuaugauuuuuggcagaggaugguuuuuuuuguguguagcccuagcuaucccagaacucacuuuguuguagaccagacuuuccuggaacuuagagauccaucugucucugccucuggaguucugggaugaaaggugugcuccguuguuccuggaaauaccccugauucuuacuuguuagaucagagcaguuuucacagcuugugcugugugggagcugagagacuugcaugguuaguuaggguuaccauugugauacagugccacaaccaagagcagcuuaaggaggaaggguuuauauccuuacauauccugagucauaguucacugggguaggaaccugcuggcaggagcugaugccauccaugaagggaugcuuacuccccaugccuugcucagccuaccuuccuguagaauccaugaccaccagcccaggggcagcacuacccacaauggccuggaccuuucuacagcaaucuagaaaagcaccacaggcuacacaggccuacagccagauccuauggaaacauuuuccugacugagguuccugccucagaugacuguaguuuuggucagggugacaugcguagcuacccagcugucaugucauagucaugccuuccacugaaagucucuguguuuauuuuguucuuuugcagcauaucugggacaacaacaacccuuuccaaauuaccuugguuaaaggaaauaagcuuaauacagaagaaacugugaaagugaguacuuuuuuaaagaguugagugaucuugaguacuuauuuguauaauucaugaacucugugcuaucauuuguagagucuggcagcuuguuauaaaacuauugagcauucuaucugccuugcuuuuuuuuuuuuuaaaugguuuuuugagacaggguuucccugccucugccucccaaaugcugggauuaaaggcaugugccaccacugcccagcuuuucuuccucuuuuuaaagacaguuuuuguauguaauccuggcuguucuccuagaguuugcuuuucuuuuucuuccccuccccaccccccccccccuuuuugagacaggcucucauguaggucagauuggccuaaaacuuauucuugcaaaaaagauaaccuugcuuggacuccuaaucuucugccuccuacuugccagguacugggauuauaggcauauggcaccauacccugcuuuuauuguuucuccaauuuaaaaaguaugucacaggauaagagagauggcucagugucaaaggacccagauugcagaggacccagauucagcagcugacaaccacuuguaacucuaguucuagauuacccaauacacucucugacuucuguggacuccuguguauucauggugugcuugaauucacauaggcacauacaugagcaugugugaguucacacauguacaugugugcauacacacauaaccacccacaugcacagaaacaaaaaguaaaacuuuuguaaaaaagugucucaugacuuagaacacagcauuguaaggauggagagagaagauguucauugucccuugucaccuucuugccaucaggaggaaauuuaacucaagcccugucacuguccuuuguguuuaagcugauguaaaaaccauacaggaugggcagcaagaguggggugcguuugcuuugucucuugaguguugcuaaugaauaauuuguuuuauucacuuuugaguacaucuuagacauuccuguggauuagcaaauaguagaguuccuuaaggauuucauucuuaaaagcagaaaccaaacauagugguagaaugugguauuaugggccuauaauuacaggaggaccaagaauugaaggcagucuggaaggauauguggacagaguucguacagucagauccuucaggaguuuuccuuacagauacagaauguacauauguacagguggggcugcacccuugcuucuccccucugaggcuacugugugacuuccaaaacuuuuaucaguucuugauuuugguauugguuguuuucugccucuguuggggguugguccugggccuugcacacagugagcaagcccccaucguugagcaggucguuauuuaccgaucaugugugucagugcgcucacaccugcaccauggcgugcgugugaagucagaguguggcuuggucagacauugcuuuucucauuccaccguggaucccggaggucauugugcuuagccgcagacaccgcugcccgcugagccaucuugcuggccuaguucuuugcugcuuuugugguucuuucuuauuauuuaauagugacagcucuuuuucuuucauucaguuucuucuuccagaagauuaaucaagcguucaguguguguuuuauuuuucuccggcacauuauccaucacuucuuuguuaguggaagaaugaguccuuagcaucuuagguucacagcuuuguuguuuuccaucagauggagauugguuguggagagaagaaaugacaugcuaaugaauauguguuuccccaccuaccccucuugucugucugguucucuuguccucccaucucaugacaucauagaauaaguuaaagagaagcaaugacauauuuccugcagaugcagauugcuagaaagguuaggugcucuaguucuguguuaauaaaaaguaaaaaacaaaaaaacaacacuucgcgcaucucucccagccuuuucuuuucugacucccuuggcugagaugugcauuacaaacagaagagacaggugcgugaaugcccgaggguuuccuguaacaacgaacggcuaagagaggaucacugugcaugcuuacaugugacuauugacauguaucauagauacaucagaacacacagauguauuuggcgacuuacuagcaagaucugucuugaaugguuuuggaaguauacaauggcacgucaggaucugcaaaguugacaagcuggagacacaagggagccagugguuuaguucuugucugagucagaaaggcugagaacugcaauguucacgacucaugaacacgaucgugucugaagucuggcugaagaccccagagagucaguguuucagucccagucguauggcaugagaagaacauguguuuuacaaguuacaagacuuaauagauagucuguagguuuucauuuuugcucaugaaaacuacuggacaacauuuuuuucuuuuggaggcugggccaggcaggagucuuacacuguaacacaggaacuugcagaaaccuucccaccucuuacagccucaccauuaauuagaagcauguauuaccugacugacuuacuuucuuaccugcagugccucucauuuguaucaggauaguguuggcccagauggggugagaaggguugggcuggaguucaauggaaugacuugucuggcgugugcagguacgaggauaaguggacagaugggugagugaguaggaauugauuuguacauggguagacaauggucagaugcauaaaguggagggagaauucuuccuugucuauuuucuuuaauuuuguuguuuuguuugcuugcuuuuguuuuuuuaaguuaggguuucucugugagcucuggcuguauuagaacuccauccaucuguugaccuaguuggcuucaaacucugagauucuccucccuuugccucuugaguauugggauuaaagacauacaccaucauagccauaaaauuuuuuaaaaauuuaaauauauguauguaugaugucacaugugucccaguucucuaagaguccagggguuuugaaccccuuggagcuggaguuacaggccauggaaggccacccugcuugggugcuggugauguaauucaaguccuuuggaacggcagcaagugcucuuacccacagacccaucuuuccaucccaccuaccuugucuguuuucucaauaaaguaaugugugguaauuuuucuugcuuaaauguuugagagaauuuacuucagacuaucucauccuugauuuuucuuugugagaaggguggugguagcacaugccuuuaaucccagcacugggaaggcaaaggcaggcauugagaccaguuugaucuugauugaguuucucagauagccagggcuacacagagaaaacuuguccaggaaaggaaagggaagggaaaggggaaggggaaggggaaggggaagagaaggaaaaggaaaaggaaaaggaggaaaaggaaaagucaagucuggguuuguguuacauuuccuuaaucccagcacuugguagacagaggcagguggaucugaugaguuggaggccagccuggucucauagcaaguucuaggcaaaccaaagaaagaaaagaaaacuggauugggcuagagaguuccauucccagcagcaacauugagcggcuguguucacacuggccuguaacucuggcuccuagggaaccugacaccuuuguucuccauagcuucccacacucaacaugcacacgagacaaacacauaauuagcaaaauuucaucuuuaacacuuaacaacaaauaaaaggggugggcuagacgucucagcaggugacugcucuugccacucgaccugagcuugacucccagagcccauguaugugugggcaggagagaaccgacuccuguaggcuucccucuggccugcacaaaugcaugcacacguacaaaauaaaugcauaaagaaacaaauguaauaugaaaauuuaaacauuuguuuaugcacaugcauacacacauacacacacauacauauauauguauauguauguguguguauauauauguguguguguguguguauauauauauauauauauguauauauauauagucacaaguuaauuuagaaauuuuaaaucuucuaaguuucuucaggcuauguaaguaguaaaauuuucuauauuuuuugugcccauuuugguaauuuuuauuuuucagcgaaguaccuucugaucuacagggugcucccccaaacuuucuuauuuuuguuuguuuggcuuugagacaggguuucacucugucucaucagcuucggcuguucuggaacucacuuuguagaccagcauauagccaccacuuauuuaugugcaugugugugcgugugugugugugugugugugugugugcgcguguguuccagaauauagccaccacuuauucauaugugcguguguguguguguguuccagaauauagccaccgcuuauuuauaugugcguguguguguguguguguguuccagaauauagccaccacuuauuuauaugugcgcgccugugugugugugcgugugcgugcgugcgugcgugugugugugcguguguguguuccagaauauagccaccacuuauuuauaugugcgcgcaugugugugugugugugcgugugcgugcgugcgugugugugugugugugugugugcgcgcgcgugugcgcgcgugcaugaacgagcaaaugucacaugcucaugugaguauguauaagcccuguuauguaggugcccaaggaggccugaagagguggcuaugagccgcccuuuuuaggugcuaggaacugagguuggccuucuggaaaagcagugaguccucucagccugaggagucauuugagcuguagaaucccuuuaaagaaucaccagcuaggccaggcucaaugaagagaguccuucugugacgcgguucuuaggaguagcacauguaguccccagagugcaguccucucagcugcucagggaugauucacugcgcucugcucuccagcuuccugcucagucguggcccaguucugaguuuuuucaucuuuuguguauacauagcuuuguuuguuuuuuugugauagugucucaugugguccaggcucauuucaaccucacucacagucaaggaugaccucagacuuuugauccuccuaucucccaacugcugggguuauaggcaugugcugccacacacaugugugucuuauguacacaugcugccagacauguacaucuuauguaggcaugugcugccaugaaaucagcacaugccuuaguucacuugcucaugguacagaagaucacauuaggcaguugaagcauagagagaagccaggagcuacccuaguuggaaagacagccgaaauucaccuuagcuucagucuccuuguuauuuuucucuauuaaauuaauuuuuuucuuuuaucuauuuugcguauuugaguguagucacuugguauuuguguggaggucaggauaacugggaaauugguagguucucuccuuucucugugggaagcauuuuacucccugagccauuggccagcucuguuaguuucuucucauuuacucuagugucuaacuaggcagcaguggcagcagucucuggguuagcuuucaggaugggcugaauccuaaaucuaaagcuaguuuucuuuccauuagaggugcuguaaucccaagaguaugcuacaucaucacaccccuuucuuccugcuuuuugugaacagaaaaugcuuagcguagcuugcacaaaguacacauguauaaaaccccaacuuucugguuggaugagaaagauccuggaguuacaguaaauuacuuguaagauuacagaauaaguggaguuuggaaaguacaguuaacuuucauaugcuguucaucuuauuccuugacugugcaugugaggaccucugccuucauucucagacugguugguaugugcacaugcgcaguagcccuacacaagcacugaaguauuggagcuguaagugacugagaaggcucauugaggugccucagauaaaaaggcagggcucugcacuggaugugcacacaacccagcauuucauuacuaauagacugucugagguacaauugagaaacacuuggcguacaaaaaaccaagaaaacuccagguuguauggucagugacagucaucaaauggaaugcugacgugaugcaggugucacagagacagaauauguaaaggacggaagucucagcugagaaaccaaagcuaaacugaaugacgacacacucguaugaucccauuacuugagagaggaggcaggaugauacccaggcuagccugggcuauagagccuaacagcuccccaaacacaaagaccggaaucaagaagcuaagaggcaggguggcucuugucuauaguccuaguacuuggggggguagaggcagauaaucaagaauugaaggucauuuuccaaugcauaguaaguugaauucuagacuucaauuuuccugggauauuggaaacaaucuaaaauucccagaccuaaagauuacaguauauuauguacaaauuaacugauuugguugcagaauggcgucaagaaggaaguguuaguaaacuuaaagaggagaaccaagagugaugugcagagugcuguggguuucaagggcccacagugaggcaguuccaggaggucugacaggaucauagucugggucucaggaaggaaagagaagggcacaguucagaaacaccacaccaccuaaagacguagucaugggaaccuuuucauauuggcaaagggucucagcgugcagcuuccagaggcugcugugguacccuaaccugacacgggcggauucugcauuacauguaggcauucaucacaguaccuccuagccuugugauguggcaauccuaaucaauuaaaauauguguaaguagcaagauaagcucuguccguuugucuuccuucuuuauugucugggacacuaaauacuuuguguggugaguuugcacauuuaauguagccaucaucaccaccaccgcaugccuggguaguuuuccucucuaagucagagcaaagcuucccuugacagauugugauguaacaaauuaaaauguggucucuggcacagagcuugcaaagccugugucauuuccugaaugacaggagaauccuaauuauggugagcaaguuggccagugugaggguaggauauguagcacaggcuggcuuugaaaacucguucuucccucugucacaucucaagugcuggaaucaugagagcaucacuguaucugacuggaggaucuuuuaguauacaaauugacccagucccuaguucugagagaacuuccaaaacucuucgugucuguguagugguugaagaguuucaucuuguucuguugauauuguuuuuaaauuaaugaguuuaccaguagcuaaaaagccccuaacccuacauagcucuaggauaagggcuaguuaucagaggaaccacuaaugugggcuaaauccuggucucacuugaugaccacaagauuaggcaagagacuagagaccaauguaaugaccaguggccagggauuaauuauucaugucuacuuugaacucuuaaucaaaguucucuaacaagguagguguggaguuggugcagcaguuaagaguacuaccugcucuuuuacaggacucagcuuugguucccagaccccauauggcagcucaugacugucuuaacugcauuccaggggauuuggugcccucuuuuggccucugcaaacaccugacagucauacagugugcuuacauguguacaaggaaauacacucauguauaugaauucaaacaacaaaacuauaguagcuggagagauggcucagugguuaagaaaacugccugcgggcuggggagacggcucuuccaaagguccugaguucaaaucccagcaaccacauggugacucacaaccaucuguaacaaaaaucugaugcccucuucuggagugucugaagacagcuacaguguacacacauauaauagauagauagauagauagauagauagauagauagauagauagauagauagauagaugaagagaacuacaguauacacacauauacuagauagauagauagauagauagauagauagauagauagaucuuaaaaaaaaagaaaaaagaaaaagaaaacugccugcuguuccagaaugccaggguucaauuuccagcaccuagauagcagcuaauaaccacuugugacucuaauuccaggggacacacagacuuaugugcaggcaaacaucuacacauauaaaauuuaauuuaaaaacaacaacaaaaauucuuagcucguaguucacauggacgcuggguuggccacuacuucaucagcuguucaucccugcccuuuuuaauagcuacgaaaagaaaccagugguccugcuucccguagcucauggcccauuacacugaauuacuggauuuggaggcaggguuguggaaccccucgguucauuuccaauugauuagaagcauugagaacugaaacuugaacccugcaacugaaguggggagaaagcuugugaccuaaggcuauagucagugucuguccguacaggggaugcagaaguuugaugguguagcauuugcucugcagaccaggcuaaauucacagagacccuccugcaucugccuccugaguguugagauuauaggcauucugucuuguuuuguuuugaagcuauuguuaaguaguauuuauucagcacauauauggugggugcuugcuuuaauuucauagugaccgugcagaucucagagcaugugugguuguagagcucgggcucucuuucaucagcagaaccuuggaaaacguucauuguuaaagucaucauucacugaguggacuauauuucugaauuaaguuccguguagagaagcuaacaaguacauaacauuuuaaggacacuggaguaagaaauaccauguuuauaauaaauccccacacuggaguaagaaauaccauguuuauaauaaauccccacaugacugauucaaaaugucuuccaugugcuuuacuagugauuuaucuagucacauuucaaaaguaguuuguaggacucucauguuuugacuuuuaaaaacauaaugagaauauucagcuuacaaauaacaaaaguuuugguagguguggggauuuagcucaguuggcagagagcuuuccucccaugcacaaagguggguucaaccccccagccuugcauaaccagcuaugauggagcacacaugcaauccucucacuucaugggggacaagagcugggggguugaacccacggagcugggcgugguggugcacuccuuuagucccagcacuugggaggcagaggcaggcggauuucugaguucgaggucagccuggucuacaaagugaguuccaggacagccagggcuacacagagaaacccugucucgaaaaaaccaaaaaaucacgcggucaugcuucuguguagaacaucaagaccagucugagcuacgugagauacugucucuaaagaaaauguauauauacauuucacacgugugcaugugauaagugccugaugggccacauauuuaggugucuauacacaaagggaaaacuuaguuaugauauucauaaugucauaaaauaaaugcaaucuuuuaugagcuagcaguugaugauacugucaguugaaaacaaguauguuuagugaaucauuaugaaacagauacgccgggugauauacuaagugaauuaguguauuaguguaauguguaaagccauguuuuucccugguagauuuagugugguuggcagugcaguggaauggaaucguucuuggagaccccagccugaugcaggcaagccucgcugcugugugguaguuuuauuuuauuugaauuuuucaaacaaauauaucauguguccuuugaaaacugugucugucugucugucucucugugcugggcuuaggguaggauuagguggaagauacucugcucugcaggguguaguagagcaugacugugcucucagcacuugggaggaggcaggagguucaggaguucaaagaaaauauaaagaggucuggagagguagcuuggugguuaaaggcacuggcugcucuuguaaaggaccugaguucuguucucagcacucacaugguagaugacaucaucguuagcuccaguuccagugaucugacaccucacauauaugcaggcaaaacacuccuaagcauuaaguaaaaugaauaaauaggaaaaaucuauuuuuuaaaagauuuauuuauuuuauuuuauguaugugaguacacuguaguuguacagaugguugugagccuucaugugguuguugggaauugaauauuuaggaccucugcucacucuaguuggcccacucacucagucccugcuugcuccagcccagagauuuauuuauuuauuauuauauguaaguacacugcagcugucuucagacacaccagacgaggacauuagaucuuauuucggaugguugugagccaccauuugguuacugggauuugaacucaggaccuucggaagagcagucugagccaucucaccaguccgaaaaauccauuuuaaaaagugaguaauuaaggaaauaaaaauuuugugaguucaggguagauuuaaaguccuccuugggcacagaguuccuaacuagggguuacagugagcagaugguccaugguacccacucuuuaugccuuuauggagauguacgugugcugucuucgggagccaugaaaacaucuuucagauuucaagcucugcuaucccguugcaguguaccacucccaaaugacuuuacucuuuauuaacaaugcugugucucugcuuguuaaggaucaaaaccugauuuuuauauuagguacauaaauuugauuguaauauuuuaaaaaauaccucaacuaauaaugagauacugucucauugaucuaauaugcuacaacuucuaaauugaauugauuacagaagguauccugucaugucaagauaccaucaaguaacagaaaaccucucuaagaaagauaguuuaacaggcuuuggaaacauuuguaacuuacugacugugacucuggcucaucucaugagaguaaaagguguguaguauugaugagugagggugagauaaggaguggccccccagugcuuaauuaauagcuucucacuugacacugcuccgucagcccuagaccgagcaaacaguaauuagauuggucucagagugugagaggaggggagauaggugcuuggggaguggaagugaggcaaauaacugauggaauauguguuagcugugaaacaggucaugaaguccaggucuccccuaggaagugcuggagugaguugucacagcagguggcuaaaggcuguggugggcacgaggccgggcucccugaguuccauccuugugacucacaugauagaggggagucagcuuccauugauucuauauacaugcucacacacauacauucaugcacacacaaaguaaauaagauauaaaaacaugagauggaagaauuagugaguuguagguacuaggaugugagagaagacaaaauuaaaacgugacuagacuuccaggacagagaaagcagguacugccaggaauuuuggagccaaggaauucagaagcuagacagcuuguuaacuuccucccuuguguuuucugucacccuaacuccgaaaaggaccagucuucuuuuucuucuuuuucuucuuuuuuuuuuuaagacaggguuucucuguagcccuggcuguccuguagaccagacuggccuugaacucagaaauccaccugccucugccucccaagugcuaagauuaaagguagauuuaucuaccauaugccaccaaugccuggcuuaggaacagucuucuuaaagauugguuuauuuauuggcacaggaucucacuguguagcugugguuggccuggaacuugcuauguaggguaggcuagccuugaacucacaaagaucuaccucccucuacccaccaaguucugggauuaaagaugucugccauuauaccuggcagauuuauuuuauguuuaauucacuguguguggugugugcacaugagugaagcugccugguccuaaauaagguuuucaguuuuaaaagucuuuaaccauuuuaaaugcuuccuagaauauuaauuuagaaauauuuaaaagauagcaaaaguaaaaucaaaggucauuuagggguugacagucaccaauauuccuggcauccaacuauaaauuacuuuuauucauguucuuuccagaacauggucacagcacaaauaugcuuuuaauaguaauugaguuacuccauucuucauuuaagauucuacuguagauacauucuaauaaauuuuugguggauugaaagugaaagacaaaaugucuaaauggaugcugaugcuauccuuacgugguagaaaagaucaaugauuauggaaggaaggcuugugcguuuggagaccugccugccgauaagcuugugaugcucagagaguuucucaugggaaggaacagaggagccauggcagaggcuuggggaguuggagcaagguggaccagcauuugaauggucagccuggaauaugugacaaccuacuguagcaaauuauauuacuauaaauguaaucaguaaauuaauacuuuauccuagcuaguaccccaguaaugacacagagagaccaagauuuauuuaaucaagcuuuacugcacaauccugggcagucacugauuuauuuuaauccucuaggcuaauugggcuaucucccaggcaaaauccucgagauacuugcauuuuaguauuggucuggcuuucugggcuucagguguauuuucccaugaugucuccucucucgccuccuugcagcugaaucuaccuuucuucucucuuuccccuccccuggcugauggaaguuccacucgauucucucuucugcucagccauuggcugauuuuuuuuauuguauuuuuuauugacaaggccgagaguaagugguaagugcugcuuacacaaacuugagacaggaguuuccugacauaagcauuacaaugccgguguccuaagugaaaugagggcagagaagacaacauuggaaucacacaaggauaaucuuuacacuaaauguuauaccuucaaucucugucaaaaagaauuaaaucccauguaugauuauuuaaugaguaaauaugugucauauuacauagacaggccuaugaacuugucuucaagucuguggugcugcccugcuugauaccugucuguuggguguuggguccaugcagggcuccuccugggaggccuugcugcacuaagcaguucugcuggccgcugcugcuccuccuccgccauguagagcuguuuuuuuuguuuguuuguuuguuuguuuuuuaguuuuuuccagacaagguuucucuguguagcucuggcuguccuggaacucacucuguagaccaggcuggccucgaacucagaaaucugccugccucugccucccgagugcugggauuaaaggcgugugccacuacugcccggcuuuguuuuuguuuuguuuugagucaguguuuuucuguaguccuggcuguccuggaacuuuauauaccaagcuggccucuagagaucuaccuggccccaccacccgagugcagggagauuuuauuaaggauuugaguuucgucaugaguguugggagagagaaagucagaagugcccagauacugaguacaggcuccucagaggagagcacaucacucuucugaggugcaucccuggagcuacugaccagucaagcugaauuaauaagguccaguuuacccagagaacucauuuuaaacguacaguggacagggaaagaggaagaggaaacuucccaauguaggccucuuccucuagcugcacacacgugagcacacaugcuugcacacacaucuguuuacaagggacuggaugaaguuaauccauuuucauuucucauggcauuucuugugcuggcaaguaguuccuguaugccaugucagggugcuacuaaagauacaggagcaaaggguaaucagagcugcucauuuuaauuuacacacagugcuggcuaucaaacuggaggcucugugcaugcuaggcaaguaucugucaccugagcuacaucccuggacuaguaaaucuuacuagacauuucacgcuugcucugcauccuccugugugugauuggcaggauuguacauaagguagaaugucuuuagauacucggcgugauuguacguaagguagaaugucuuuagauacuuggugggauuauacauaagguagaaugucuuuagauacucggugugauuguacauaagguagaaugucuuuagaugccugauagcagaugaugacgcauucauaaguuauucuuucuuuuguuugguuagguuuucugagauagucucacauuguccauccuggucucaaaguugcaguguagcugaggcuagccuuaacccuuuucucuaguuccauuccuccauggagaacacugguguuuugaccaguauuagcuguuguagcuacuccacuuacuaagggaaaggcagauuaccucagcaucguguauugagugcucucugaugccuguaggcgacugucccaacuguuguuguuacauggcucugccauguccucauuguccuugaguggguuccucaggaugcaguacucaagaugguucucuucccccaucacagguucauguccgagcugggcuuuuucacggaaccgagcuccuguguaaaaccgucguaagcucagagauaucaggaaagaacgaccauauuuggaaugaacaacuggaauuugauauuaauauuugugacuuaccaagaauggcucgauuauguuuugcuguuuaugcaguuuuggauaaaguaaaaacgaagaaaucaacaaagacuauuaaucccucuaaguaucagaccaucaggaaagccgggaaagugguaaugaaauuauaaccagaaaauuguuuauauaaugggacauuuuaaggcucugggauaauugaguaacaaguuaaaucauuuugugugacuugaacucuaagaacuaauuucaagaagauaaugaguuuccgaguucgugucaauuuuauguucuuuucucaaaucuauuugaagagauuucaugaugcagaugcauaaaaccauaggguggcccagaacucauccugcauguagcucaggcuggccuugaagccacugugacaccccugccucagccuaugcauggugggacuagcaaguaugagucacuggacauggaaaguaaagacauuuuuaaaauaccgguccauaguaccuuaaucagaauucuagguacuguguauauuugaaaauuaagauuuuuguuuuuuaaauuuuaggaagcucauagguuguacuucacucagcacaccugaugugacuuucagacacagaagcauaagugaugucaguuuuuaaugugaaaaaucaggccuucucaacacacacacacacacacacacacacacacacacacacacacacacacagaggcaugcacacacauguauuacauguuuuuaaagacagggucuuucugugcaguucagacugcccugagaaucacuagagcucugucuccuugccucucuccugaggaaaagugugugccaccagaagugucugggaaccagcagugguuuuguuucauuuguuuuuccagugcuguggaaugccagggccuccugugcgcucuggguuaccacugacccacaggccugaccuuuccauugcauguuacuagucaaaugauuuacuuccccuuucucaugcucgcucguaugcucucucccucccuccaucccccgcucagcccagucuucacucccucccucucccacaccagauagagucucucauagcccaggcuagcccauagauuguggccaaggaugaccuugaacucucuaaguuccuguccugucauccuugcuuuuguagugagcuugagaccagccuggucuacaacagcccugaagaugggaaggaaggucugggaacuuaagcaggagucucugauuauuaugauauauuccucuuauuaugaaaauaaauuguaaugucucaaacaucauagaagggaugguuccuuucuggguuuucuuaucuugauaauaaaauucucaaagguuucaaaaaauguguauauauauauauauauauauauauauguaaacacacauacauuuauuuguuugucuuaugcauauuuaaagauugugacccaggcuggccuuagcaggcuauuuagcuaaggaugaccuugaacuccuaauucuucugcauucauucccaagggcuagcagugcaggggugagccacuccaccaguuuuaugcaggguugggaauccaacugagaguguccugcuugcuagacaaguacucuaaauccuucaaaaaaaaaaaaaaaaaaaaaccaaaaccaaaaaagucggcaugccauuugaaugccuucgucagagccgugcugcagagugccgcuuguguuguuuucaaggcaggcucucucacugugcaacuugcugugcuacauuuuaaggccaugugcccugcuuuuugaaaaacaaacaacaucucauucuguagagcaggcuguucugcuguguagcccaggcuggccucaaacucguuguaguuguuccuccuuggcugcccgagccaugcaggugugaggcaccacaugugaaaagugccccucucuuaacaauguaaguaauuccugcagugcacagaggcauugccuccucccaugcuaggaucuacuguacacccaucuuguauuaaucauuuagaaccucucccucaguugcagaaauguuucuguccgugugcauacuguuuuauugugguauauuaauuagacugucaaauuguucuuaaaaguuaugaagauacugaaauggcuacuauauuguuuucaauuugcauaaauuuuuggaaauuaccuagaacaucagaaaugucuaguacuuacauugaaacauggggcacggguucugugauuccuuggaguccguucuggguuuauuuaugcagugcucuuuucaacagcauuauccugucgcauggguaaauaccaugguuuuugacuucaaaggacagcugaggucuggagacgucauauugcauagcuggucuucguuuccugguaagauuuguuuuuuguuuuuuguuuuuuguuuuuuuuuuuuaguuuccaauacaggguuucucuguguagcucugacuguccuagaacccuguagaccaggcuggcuuccaacucaagagacccggcugcugggauuaaagguaugugccaccaacacuggcuaagauucuuaacggcagugcuuaguucuggcaagcagcuagugucuuacuggugcacgagucaguguuucucugacucacuauugucauauuucaguaaaaaacuaaaaacugucuugguuauuuauucuuuuauguuguuuugcuuuguuuugagacaagaucucucuauguggcugacuugaaacucacuauuuuggucaggcuggccuuuaacucacagagauucaucugccucugcauccagaauuuugggauuaaaaguguaugccaccaugccuaccuauuauuuauacucaaauugacuuagaguauuuugcuauagauaugaaauucucguguguauaugcauauguauauuauauauaacauauauacaguauauuacauuauguaaguauauuauauaauuauaugcuguauuaacuauguauuauauaugcaauuuuaaugagaguauucguguuuuaaacauuuauuuuuguagguguuagaggaaaccuucuaagcaacagugccuucuuuauagcaagcuuuagugcuuauguuguccugaccggcagaugagcucgccgcagagauagaaaacaguaaaaguguguguucuccaguuagacuucucuugaugaucaagagcaaugaaguccuucucaugugccuaaaggcuuacugacacaguucgcuaaacuugcuuaggugacacaaccuuuagcacauuuucaugaauuccagacuucugauuuuuaaaguucaguuccaaaaacauuuucuuaauuauccaaauaaaaauccagauucuuugcauguucuagaugagcuggaagaaaugcugaaucccauggggacugugcagacgaacccauaugcugagaacgccaccgccuugcacauuacguucccagagaauaagaagcagccguguuauuauccccccuucgauaagguaagcuaauuaaagggccacgaugcacaaagcccuugcauuauuccuaggcgugcauggucacccaaccucagugugucuaguucucuuucagaacuguugauggacagugagauccaguggaagcugugcaccauggcagcuggugugugcuuaucacugaccaaaugaaacauggcgucucuggcguucaggagccguguuuguaaagagagauuuaguuguuugauuucccuuuaagguaaagagccucuuagguguauucgcacauagcuaugagugugcagugagguguauaaaaugccaucaugucgauucagagauauggaugcagugagagaagaggugacucugccugccagguaugacuguugucaggaccuggaggacaguggcugcucagacagugagugccccacucuagccaguacagccucgaacucgcuguggaggucacacuuagccuucugugacagucuucuuaccuccaccuuccaagaguuaggacuccaggagugagguaccaucccuggcagugacuccauagaaucuguggcaaggauuucuguuucagaauacauccuuaguuuauaagcuucaugcauguuucugaaaugagacuguuuagugguggcugaaacaggacuguaacgauuuauauguuaggacagcggaggugucauauucucccuccccucugcuacuagagguugagcccaggucuuggagcugcguccuuagccacggagcaccauccccagcccucuccuaguguucucuuaucuuacuguguuuguaauuuuauguguauaagguuuuugccuaugaauaugaaugccugguguacagggagguccaaagaugaaccugggaauccuuacagacuguuaggagcugccauguaguugcuggccacugagccuggguacucuggaagggcgaugcuccuaaccacugagccaucuaucucuccagccucuaaaauguuuugauuuucaagugugauauuccucccucuccuagguaugauugguauugauuuuuuaaagagauuuauguauguauguauguauguauguauguauguauguaaguaaguauguaaguaugcuguagcugucuucagacacuccagaagaggguaucugaucucauuacagaugguuguuagcuaccaugugguugcugggauuugaacucagaagagcagucagugcucuuaaccaucucuccagccccugguauugauuuuaauacagaaaucuuuggacaaacaugcacaagagauuucuuggcccaagugagaaaaggcugcauuuaaaguacuaaauacuauuuaaauuaaucuacuuacacacuccguucauuuucaugcugagcaccgacagacuuguauaagagucuuguguguguuguagcauugggggagcgguggaccuuagagccucacacaugcuaagcagaacucacaaauacagaacuauguacucagugagucccagagaugguuucuagagucuuaugcaaaauuaauuuguguaguucagugcugcuuuagucauuuguacuuuaucaguuguauccacccaagaaccaauuuauuauuauaaagucuuuaagaaugccuuuuagccagucauugguggcacaccccuuuaauuccagcacuuuggagacagaggcaggugaaucucuaaguucaaagccagccuggucuauggaguuccagaacagccagggcuacaaagagaaacccugucuagaaaaagaaaaaaguucuuuuguccaguauggugccucacagccauaaucccagugcuggagaugccgcggcagggggauugugauuuccaaauugcccugggcuuuauaaagcgguucuuucucaaaacauaaaaaauaaagagcgagcgagcuguggaugcagcucagcggcagagugugugcccagcacaugcaagguccuggguccaagcaccaguuuguaauaagauuaaaauacuauucugacugguaaauuaaaaccaaagaaagaacuguguuuccuaaaacggcugcuauguuaagaacuugccguuuuuauacguacugaggagggaaaaacuaaacaugguugaugugauacauuucugugcuccggaaucuauccuuagaugcgggcuuguucacggccacugcuucaggugcugcacugcagucuucugguaaccguugucagcugugguguuuguucagugucacugagucacucugcacugccacuguccucuuuaccuccuguuuuacaaggggauuuuaugaccaaagcucaauaguagugacuacucucacuugaccuuagaaaccaccugugcaguaggcugggaaugaccauuuuuaacaucccaggcugggacuucugagucucuccugucuccccaacauuggcagguuccgaucuucaagagccgucucuaugaaccgagggaagugagagcugcaucagugcuucuguaggacuuuucccgcagcgcuggggaucagccaagcgcuaggaaccacucuaccacugagcugcaccuccaccaagccgccgcucgcagcuuucgcaucugcuuuuuaaauuucccuccuuuccugcucucccgcucuccacucacuugcugccauccuuccuuucauuucacggcaucccucaguagacugggcucagacuugcuguagauucugggccuucaggaccucgcacauacuaggcaaaugcuuuccucuugacuuacacgcaccuuagcccuugauagcugacaacuauaaaaagucaaguguaauaaggcuuacuuguaacuuuuccaaaaccauuuuacagguuuuuugugaguuccacagcaugcacccuagcuggcucaucuuccaccccugucuaugugcucucugcccuuacaacccccccacccaccaaaggaaaauaaaauaaacaaacaaaaaaacaaacaaagcauagacaguauccuggaagccguagugcgucacauugugucucacacaucuuagcuuguaaauguucacugcaaugagucauuggucugcuuccaggccucuggcuucugauauuuuaucaauaccggguccucacucaccaggacucuuguuggauauccuauuguuccccugugucacggggauccugcagcuuuggaucagcaagacuggucuugaugugccugggcacuucauaaaugagguagaugcugggaugggccaaucaaagcccuggaugugggcgugggugguagcuaaguggucagcucaccagcucucccuuacccauaccaccagggcgaacucuguagcccugcccuggauagcucacccaaugccuuaaccagcaagaaacagggugagcucucccaugcucuccggaugacucgccugcacucaugucacuagugccagcuccacugcguugcccaggugugcucagagccugaucuccuaagugcugcugcaagucacucaacaguagggccaggccaucagcacucaugaccccagggccagcucuccagacuccagcugauggggaugggagaaacacacaccaccuucguuuccauguugccuuguggcagaugaguggcuggcagagucaacucucaugcucacagcucacccaaggcccuguuaccagggccaguuccacucugcugcccggguggcugccagaccagggacaucugcacaucucuagugguaauaggagccauggacaucaacacagacccggacauggcccucagguggcaguacuggcugggaccucaccauggccuuggguggccgggcuggcugcucaggacaggcuguuccuuucuaccccccgucuccaguuccagcucucuucauaugcugugcuucuuucucuuucuccacacuuguccaccacauacuugcacauugcaguggcucccacugugggcaggccacguggcuggugggccucugggugcccuccucugcccacuccacagcaagugggccucuguguauacagcacacccgugccauguggcugcaggcugcucucuggauguucuccauccacauugccuggcagcaggugggccucugugugucuucuaccugcucaggcugcuggacaguguaggugggacucucccuuaggaccuuuuaaaauauuuuagcuuauuuuuauuuuauauguggagucuuuugccgacacacauaucuguguaccguaugccugcaguucucagggaggccaaaaaugacaucagaucccugaaacugcauuuacaggugacugaaccaccaugugaguucugggcagcacaugccaccacuucagcccccacccucgugaccccuccuuaaccugucuaggagcagucugugagcgagcgagcgagcuagcgauggccuugcucugcaguccccucagugacgccauuguuugaagcccuugggggacacugauuuagggucuuguuucauuuguuaauuuuguuuccauuuauaaaagcuugagugccaagcaugugcagucucuuguaaucuaagugcaaacauaguuauuaacuggaaauuuuacaaauaucaggauaaaaauguaaauuuuuauuuuuuccaacagaucauugagaaggcagcugagcuugccagcggagacagugcuaaugugucaguaaguaccaagcuccaucugguucucacugcagagcucugugauaggaggggccuucaccucaucuguuguaaggaaugugugagagauguaacggggaagcagucugugaguguggauaagugugcgcaucccagugcugccuaaauguggcucuguugguggcuuguaugacuugaaugggaagcccguuucugcauaaauucagggauggcccacgguaguugcuagugcacaccacagaauuccaaugcuaucuuagugucagcuagcuaaggaggcuguguucuuucaaguagcaaagaggaagagggagggcagaaggaggggauggaugguugguccuuuuggacuuggagaacaagaagacacgagguaggcuggaggcuguuagaguggcggaucugccacugaugauuuccaacuuagaagaguuggugaaauuaggauucuagguucugugcccagcgauugugcuaucuguugauucuaaacuaagguugcugguguuuuccuucuugugacaauacagcugagcaugaggaaaagguaacuggcuuucgagaguacgccucagcuaacugcuaagugggauugacagcagccagccucgggaaggagagagcgaauucaaagcucuagaaagacagagccagcuucggcaggacgggcuuuggcaaaaggcagacauguagucucauguacugagcugggaacagacugagaccucugccagcgauaguguguguuguuuuuugauauuauaugcuacacaucuucauauuccuuauauguuugggcuaucuugggguagggaacugaggguugguagaaaucaggagauggugaguuggcucaggagcgauaguguguguugguuuugauauuauaugcuacgcaucuucauauucguuauauguuugggcuaucuugggguagggagcugaggguugguagaaaucaggagauggugaguuggcucaggagauaaaagugcuugccaccuggcaugacuuuaaucccagcacuugggaggcagaggcucacuagccugaucuacagagcaaguuaaagaaaaaauuuaacucaaacaauaacuuuauaagcuauuuaaaugguacaauauauuuaaccuaaaagcaauagugccaucuaguguuugcacuuggauuuuauacauaacucauaaccuauuaacacagaacaaugcagacuucuuaaaaggagccacguuagugaaccuaguacagaauuucaguugguaaagcucacaauuauaaagucauuguauauaaauuugcugaacgguugcacaguuaaauuccauaauggccauuuuacuuucuuaaagagucgugguggaaaaaaauuucuugcugugcugaaagaaaucuuggacagggacccccugucucagcugugugagaacgaaauggaccuuauuuggacucuacggcaagacugccgagaaaauuucccucagucacugccaaaacuacucuugucaaucaaguggaauaaacuugaagauguugcucaggugacagaaaauuccuugucccucccucucccaucucuuccuucucucccuccacuuucuuucccccaaauaacaagugugugugugugugugugugugugugugugugugugugacucugauuuuguguaaaaugucuuuccgcagaaguauuuccauuuguuggauguuuuguuuuguuacuauguaaccuuagccucucucaaauguccaguccuccugucucagccuuuaagggcuccacaucucacagagccauggcagaguuccucuucugaagaccuggguguggccacagcuaugucuucacaugcagcuccagcucuugcccagggagucuugucgucuaauguccuguagcauuuauaacaggauuuauuagccauaaacagaauguaggcacuguucaguucucguggaccacucacuuuuauuucugaucugaggagcucgagcuguucuggcuaauaaaaagucuguaaaguaauagauuucuuuaaacauucaucuaaaggcagaugggcuuggugguguguguaccuuaaaucucagcacucagaggcagagacaggcugaucucugaguucuagacuaaccuaguguacagacagaguuccaggacagccacagcuacacagagaaacucugccucagacaaacacauacauacauacuauacauacguacauacauacauacauacauacauacauacuuuguaguuuuaaaaugaguuauugacuuucuuaguauauaugucuuuacuuagcuugagacuuggcuuauuuauaguuguuuuguucuuaaauuaugcggugguuaaucacuguagauaccugcagugucuuacuuuguuuuugguaggcacagaauaaccuuuuaaacguacacagaauguuucagaaacaaaggcaaccuuuguuagucugcaucugccaggauguuugaggcaucaguaguuaaauuuuuuccuuguuuugacucaucugugcucccaugugccgggaaagguaaguuacuuuuguccaccaaacuucugacccaguuuucauuuuaaacagcuucaggcgcuccugcagauauggcccaaacugccccccagggaagcccuggaacuccuggauuucaacuauccagaccaguauguccgggaauacgcuguaggcugccuucgacagaugagguaucucuuuucuggcaccaucauggggcaaggaguuaccagagugggcaaggaaugugugugagcacugguggccaggucuugugugggaucuuagcgcccucugcuggcucugcggugcagcccuuacugcugcaugaacacuuuaggugugggaaggccacuuuccccuuucacuacaggaccgaguucugaaaccuugguuuccaagcgccugcccuuggccaacccuggaggccagcacuucuaaacugagcagccaugccucuguccccucuuuccuuccccauagucuauuaauugccccaaauaagaaggguugguauuuuaggauggaggcaaguuuauuuauuuucacaugggaucugcccuugaacucaccguguagcccaggcuagcuaguugucaagcucagacugaucuuccuguccccauccuggcuauggucuuuccuugcuuuuaaaaucagaucuauuuugaauaguuugauaggcagaaggaacuauguaaccucuguauuagucugagauguagaauccuaugacuaggagaagcagccucccacuuuauauuuguuguuucuaguagcuauagguuuuuauaaguggacauggagaaacuuugucucagaacccugauguccuuauugaccccuggaaccuaucuagacagauucacuccaccacauuguccucugaacacugguacacauaccacauacaucacacacacacacacacacacacacacacacacacacacaaaauaauuauguuauuugggggcagugggcacgacuccuggcaguuuuuauguauaaucacgugguacagcgaauguaagcacaugacaggccugguccaggagacccacgcacaugagccagggcaugugacaguugguagggaaggguccuuucauguuacagguggcugaguuucucucccuuuuguuucuuucagugaugaagaacucucucaguaucuuuuacaauuggugcaaguuuugaaauaugagccuuuucucgauugugcccucuccagauuccuauuagaaagagcacuugauaaucggaggauugggcaguuucuguuuuggcaucuuagguaagucuuugcuauugcgauuugauaccaugauguucucuaauaacuaacccggugugaugucagacagccaguggacuagcagcagcuucuccaggugcuuucugauccauccgugacauuuacacuguuuggugccuucucuuaucuuuugauaccuaaauucuguuuucaucauuuggcaaaguauuucagguaaguauucuaugauacuuucuagauuuugaacuaaaacuaguaacuguuauauuguaauauuuucuaacaacuaauuuuuguuuaaaaauauugauuaaauauuuauacugugugugugcucugaucaaaucuaccccagccacuccucuccagcuccuacugucauuuuucccucccagcuucaugcgcucuuucuuaagaaauguuuuuauuuuauguacauuggugauuugacuguguguaugucugcuugagaaugucagauccccugggacaggaguuacagacaguugugagcugccgugugggugcugggaauugaacccagguccucuggaagagcagugccagcgcuuagccucccagccaccucuccugcccguguuuauguguguguuugcuuuguaguggcugggcuagaccacagagccggcacguguguggucauuucagccuucuuaaccuuuccucucacacuucuguucaaacugcuugucaggaaaaaaaacuuuccuuuuuaacuaagcuuuuaaagaacucauggucugugguauuaauuuuagcagauuuucccuuacuaaagugguuuucuuguugaugcauauuuuuuauacuuugucuccucguccaauucaguacuauuuuaaacccuccagagaaugacaaaguaaauauuuuuguuguuuuuuuuuuuaauacauacaugccauuguuugagaaagaaaagaaaacuggggcuggcaagaugcuucagugagcagugggucuggcugugcaaaccugccaagcugaguccacaugaaguggaagaggagacccagcucuccucucuuguccucugaccuccaugugcccccauggcuagugccccacgcccauuauacacucaaugacagugggaaagggggacagaaaugugguuaggcugacuggcucauuggcggcagucagagagauuuuuuuuuuccaccugagucucuccaaauuccuaaguuacauuuccuuucccuuucaaaaggcaguuuaaaaugugggaauauuaguuuucuuuaagaauugaccacuaagaucucauaacuucugaguccuaacugcgguaugaccucuuacuaguaagugcuugggauggccagcucucagcugguuggcaucagaagagcauuccauggcagaauaaggaggucagugcuuguucuucacgcucugaaguguucgauuacaaaccuuuucaguguugcuuuucugcaggucagaggugcacacuccugcuguguccguacaguuuggugucauccuggaagcauacugucgaggaagcguggggcacaugaaagugcuuuccaaacagguagggacuucuguaauucacuuuagcacauggugaucaaccgaguuuaucaaacggaaugucuccagucacauauuuuauugcccuuucggucacuuacccugaucagugcuuugugggaauggccugagucucaugaagcucaggauggccuugaacucaccauuuagucagagagguccauggucaggagcuccuccugccccagccuucugagugcugggauccauagcauauggugcugugucuaauuuaugcugugcucggggauggacucaaggcuguguacuugacaugcaagcagucuaccgcugagcuauuucccagcuguuagcuuuuaggaaaaucugucaagauaaguuucagaaagcuuagaauuaaggcauaucucauauuuucuauauuaauaggaugaccuacauuuuaauaguguauuucaagauggacaugaaggaggcagacuucugccuccaguguuucauagccuacaucacucuuuucauggaauuguguguuuuuaaagcuuuacgacucuuuaguauaguuuaugaugcauauaauucaucuuuuagaccgagauauagugagguauaaacacaugauuucuguaguucagaguccuugucaccuuuucaagcuauaucuucauaccuaaaauuguaauacauucuugcaguccagaaguauugcugauauuaccauuaaguuauuaaauaauuacucucugucaagaacucauacugcuuuaagcaugcugucuaauugugcuccuuauaauugaccauuguguguauaaaccauaggcugccuuugaacucaugaucccccucccccagauucugagaauguaagagucugcuaccauuccuugcucccuuacuuagcuagagagccuuccauaagcuuuuacgaaaugacugugguauguuuuggaaaggccauggguguggugaaagcagcuaauagagacucacaccaugaaacagcaucauugauccacacugugaaccagugcucacgguggccccucaucugacccauugucuucuacuccaccacccucuacacugggcuucucauucccacccuccccugucugccucuccuccccagcacagccuuugaacaucugagaagugaccauguuuuccagucauauuagucucuuuaaaucccuaacaauaauuguucaugacacugaaaauccggauuuuucuacccagacuuaaaagguccuaguugguugcuguguguccaaccucauuguguaucuguugguugaugugugucagaccucauugugugucuguuggcuccccuugcucauuucucaagcacacugcauauccucuugguucucuggaaguguuuaauacuacuuuucuaaggaggcaugcauaccacucuucccuuccccauuucccugcccugaucccagguccucuuguaccaucggugagcauucuacugcuaaguuccagccccagcccuuuucuaugugcagauagucacagaugcuagaguauggugucagguccucuagagcuggaguuacagguguuugugagcugaccagugugugugcuaggaaccaaacuccaguuuucugcaaacucacuugaccauugagccaucucuucaggcccagucuccaaaucacuccaucccuauuucuaaaaaggucuauuuugagugagacagggucucacugaguugccuaggcuggccuggaacuuuucagccuucuggguaaaaguaacuuccaccaggaccagucaugacuguuuucuugacugaugaauaauaagagaaagacuccguacccuuuccauggugggguggggacgcaggggugaacgucagagggggacuugauggaaugcucaguucuggaaauggaacucaggucuccaggcuuggccacgaguccuguacuuacugaccuacucagccagcccacugugguaccacuauaaaggcuaucauuauaaagguguaaaaugacaauuguugaagugacucauggccacuuaggauacuauucagaaaaggaagaccaggacaauuagcagugacguagcaguucccaacuguacaaacauggcagacauucuaguuugacauaguuuagaaaggucugguuugcauaguccaguguucaucugguucucuuguugccaguauuuguacagcuccugaagcuguuaacaaauggagugccugugguuuugacagauggauaacuuggcaagcacuggccgucuuguuuuuaucauaagcuacauagaaccaucuuaguuuuuuauaugagcgaggucucagccagucuuuggaaacuauaugccagaaucuacauccauacauagucugaaugguuuucuugcacaaaagccaaauuuuaaaaugaaaacaugauacaaaauaaauucccugaaagugggauuacaaaccaauguauauguguaccucauauauuuggcauuuuucuuuauauguguuugucauuauuuguuguuucuaguuuuaaugacauauaaaguuccuccugguuuaugguuauuauauucucauuaguuuuauauaauauaauaugauuggacucccaguuauuaggugauaacaagaacuccuguggagagaguaagguggugucuuuguaauugcccugccuggccaggaacuuguuauguaaaccaaauuguugucaaacuuguagcuauucuccugccccugcuuccugagcccugggauagaggguguucauuacagcugccuaaugcaguuuuuuguuuccuugccugacugauugagugagacagggucucgcuguaucccuggcuaaccugaaacucacuauguagaccaggcuggccuugaacucacagaggucucccugccucugaccacacucguccuucucccucuacccaccauauauacaguaauuaaaagcaugcauuaccaugcuugacuaaaguggcuuuuacaaauaaugguuuugaucuagccauugcuaugcuacaaguacaaagguguuuguuuuggcuuguuuguuuguuugaaagccagaguuuucccagaucugagagaugccuuaguaguuacaagaacuuguccuuguagcaaacccagguucaauucccagcauccaugucagguggcucaccuguaauuccaguuccaggggaucuggcacccucuucuagacucagugggcaccuucaugcacaugguauacacccauauacucaggcauaggcacauagacacacuuaaaaauaagacaagucuuuaauuuuuuuaaagauuuauuucuuuauuuuauaugagugcacuguugcuggugugucugacacaccagaagggggcguuggaucccuuuacagauguuugugagccaccauguggucucugggaauugaacucaggacuacuagaagggcagucaguuuucuuaauugcugagccaucucuccagcccaagacaaaucuuaaaaaaaaaaaaaaguggaaaaaaauguugagacagcauuucucuauguagcucuggcugucauggaacucacuuuguugaccaggcuggccucaaacacagagaucugcccauaucugccucccucccaacccccaaguacugggauuaaagguaugcaccacuguacccagcuucaaagaaucgauuuuaucuuggacaaauaccuugaauuauaaucucuucuuguugucuuggcaguagaaagaaagcaggugauuuuagacaggggaugacagggcccuccagguacauuaacacauagcuguauaguuccuagggaggcugagcagccugggcuacaugaaaggcuaugucuaagacauagagaaaagcacauacaaguaggcacuaaggguucaguacuuuaacacuguuucaggaaugguggguggauucugcacagacccccuguccugugcugggggcuaaauugagcgguucagauugaggugcuccggauccuguuacuccaugaaguauagugccgagugcagguucauuccuauccgaaaaugcccaugguuuauuuaugccugcugacucuucccaaguuuacaacacgucuuuuaauaaaggguuuaaaagugauaccuugacuaauaaauaauaauaacucacuguuuguaaaaaacaaaugaacaaaaaaacccuuuuuuuaaauaaacauuuucagaucuuuuucuuuuaaagauuuauuuauuuauuuuauguaugugaguacacuguagcuguacagaugguugugagccuucaugugguuguugggauuugaauuuuuaggaccucucccugcuggcuccggcccaaagauuuauuuauuauuauacauaaguacacuguagcugacuucagacacaccagaaaaggacaucagcucucauuagaagugguugugagccaccaugugguuucugggauuugaacucaggaccuucagaagagcagucagugcucuuacccacuaagccaucucuccagcccuuguaaaacccuucuuauacucaggguuuuuacuuuagccugauuguguauguguuuuuuagagcuacuggugaaugugacugcauucaugauaucaugauauuuuuaaccauaagugaauuuggggguggggaaccuuauuuuccagguggaagcacucaauaaguuaaaaacuuuaaauagcuuaaucaaacugaaugcggugaagcugagcagagcuaagggaaaggaggccaugcacacgugccugaaacagagugcuuaccgggaggcgcucucugaccugcagucgccgcugaaccccugcgucauccucucagagcucuaguaagugacugucucugcuccgugggaacagcagugcagaagaggcuccugacucagugugcuagggggcggguggggcuggcuguuagcccaaggaagucaaaggaacuacggaaggaaagcccgagucuucagaaacuguuuauauucacuaagcuguauaacuauuagcuagauuucucugugggacuaguaauacugcaaauuaauuucuuucaauguauauaacuuaagaacauauauacguuaguuuuaaaaagauguaauucguuuuaauuggguggcgaguaugaguacaugacugcaggaguucacaguggccggaggcaucagauccccggaguuuggguugcaggcuauuguaagcugaugacuugggugcugggaacuaaacuuggguccucuaagagcuauauaauauaaccacugagccaucucuccaguucaaguuaguuuugauacagggucuuaugaagcccaggcuagccuuagacucucuauguagcccaggcugguuuugaacauauaauccuccugccugcuuaaugcaaguaacacaggcauguaccacuauuccugacuauaauaucagucucuaagaacuggaaauccuggaugagcaaaacauuggaaaccauaacacguuauuuacugacuucccacuuuaaaaugaaauuuaagugcaccacuaaacuguuucucacuuuucauacagaaauagaaaauuauaauuuguguuaauauaguauucagaauuuauccugcauuaugaacucaaggaucugggcuagagauguggcucagcauuuaagagcacuuugugucccagcauuuaccuccgguggcucacaauagcaucgaccccagcuccaggggaccugauggccucuucuguccucuguaguucucacguacacauacacacauaaauuaaaaguguccuuaaaaagagccaguuguaguccugauuuuaauacagcaguauauucuaaucuuuuacccacuacuaaauauuguaacauuaaggaagucugaaauccaaggagggaugacaagcgcagccagaggaaggucagauccuaggcuuggcuucauccuucugagcaugacuauauaucagccagagcugcccuugggcuccuucuuacacagaaguuugcuggcuuucaccugaggagcuugcaagccuggugccucagggcacuuguguagccgugcgcacuguugugugaaguggcugauucccccuugcugauuucaguguugaaaagugcaaauacauggacuccaagaugaagccccuguggcuggucuacagcagcagagccuuuggagaggacucgguuggagugaucuuuaaaaauggugacgguaaguccccaguaugucucagcauguuggaaaaugugugugacagugugauagcaggcaagacgcugccggugcucacggggucagcucucagcacacuccgggagccacuccuuccuggcauugcuuguacaguuuauuuacugaccugauaagccuucccacuuugcucuguaaaauacaaaugguaaaucuuuugacaccaagucuguaaaaagcaaggauaucucaauguguguucauguguucuguucagugccaguagcuucgauagccuugacagagcuuuaggcuuuaacugagcugaugacccagacuugauaaagaagcaacagccaaaggcaguccuagcuuguaagcucuacggccacaagcaagcccuaacugaugggcuuuagguucuucaucucauaccagggucccuaaaggacucugugauaaaauagcuuguuauuaacgcugacaccauugcauacacuagcaagauuuugcugaaaggacccagauguagcugucucuugugaggcuaugccggugccuagcaaacacagaaguggaugcucacagucagcuaauggauggaucacagggcucccaaugggggagcuagagaaagcacccaaggagcuaaagggaucugcaacccuauauguggaacaacauuaugaacuaaccaguaccccggagcucuugacucuagcugcauauguaucaaaagauggccuaguaggccaucacuggaaagagaggcccauuggacuugcaaacuuuauaugccccaguacaggggaacgccagggccaaaaagggggaguggguggguaggggagugggggggguggauauggaggacuuuugggauagcauuggaaauguaaaugaggaaaauaccuaauuaaaaaaaauagcuuguuauuacuuugacaugguuuuaucugaaaguacuuuuugaggagguuggaagaaaagagagguguuuuuauauagcccagguuguccuugaacucacuauguagccaacaauggccuugcacucugcugacccaaccuuuuguacuucccaaguacugggguuacaaguguggccaucauguaggcuaaaaguauucuuuaacuuuuauuauucguuauuauuuuggcucaagaucucaugaucuagccagggcuggcuucaaaauuguugacuucaugcuucugacuccugagugcugagacuggaagcucucauaaagaggaucauaaauagauucgacccuuacaguuuucugggcuccuaaugcacuaacccauaugauucauaaaagcuuucuguaugguauuaaaggcaggaaaaguuaacaaugugguauguguaguagaaauuugguagcucauacaugggaaaugguugaaauuugacuuucugaaacuguacagggacaugccaaucgcugagccuguuugauacagugaccauggcaagauuagaacuggaggggaacuacaaugcuugguaaugacugaaucugacugaaugccugggacugaguuagcgggcgaggggcgugagagugcacguguguguaacguagcggguguuucccuuagauuugcggcaggacaugcugacgcugcagauguugcgccugauggaucugcuuuggaaagaagcuggcuuggaccugcggugagcauuccagagcauuugcuuauuccacacuguuuucccuguuuagcccuuccuucugcuauuuuaauuauuguucauaguaauaguuaagugagcuccucaccaugugcuucuagucacugcccuauugaaccucaucagacuuaaaacuguaugugcugagguuccugggaacggguagguuuggaccaacauccagaaccgcacgccaggguaguuucaagcuugggaggguugguuugagacacgguccauuauggagcucagggugauauugaacuuacucuccagggagagaugaccuugaauucaucauccuccugccucagugccccaagugcugggauucaagucaugugucuucacacucugaugaacucuuuuguacaaagauuugaaaccauugcuguguauugacugacaggcacuuugugggcuucacgcggaucauccccugcaaaccucacggcuccaagugagaagagcugggacaguagugacguuaaagcagaguuacaaaaauaucaaauagugcccgacucaaauccaggauugucaagauucuuaagucaauauauucuguauuuuacuguccuauuaaaguggcaugcaaauucauguccaguaaccuuuguuugccaaaguaugucaguucucaaaaugccuuuaugguuucuucuuuuuaacauuuguguguguacaugcacguaugcauauucauaucccaugggggcacauguggaggucagaagaccuuuuaaggguuggcuuccuccuccuguggaucuggggagcaagagucagauuguggggcuuagcagcaagcauuacauccacuggauuaucuaucucacuugcuaccuuguuuauguuuuaaaggaagaguauuuguuuuuagauccuucuagaauauacuuuuuccaguuuuccuuaaguuagagcaaucaaaugugauuuuucccccuuucauaaaauuguaaaugugauugcaauaagagagaucugaauuuguucccuuuuguugaaaauagauuuuuuuuucccucaaauaacauaucuagauuacaguuucuccccuuucugugccuccuaguuccucccaccuccccccuccuuccagaauuacccuuuuuugugucucauuagaaaacaaacaggcuucuaagggauaauaguaagauagaauauaagaagauauaauaaaaacuaacauaccagaauugggcaaaacagacaaacagaaggaaaagaccccccucaccccaagagaagccccaagaaacagugaccccuccugugcucacacucaggagucccgugaaaacacgaagcuggaacccaguauguacucagaggacaugugggguaaaggaagggggaaaacauaauaagauuaaaaauuuuauaaaaauuaaauauaaaagcccugacacuuuaagacaaauacgcuauugcggucauuuccugucagccaucuacugcugggccugcagccacgcuuaaggguaguucguuucccuagcgagacuuccuuggaacaaacuaaauuuucauguucaaguuuaccaauuggagacagcucuggguuaaauaggaugggacauguauccacuucuuucagcuccaggacccugcuccaaaccuaaaaagaacccagcagucaccauaugucauauauuguucuuuuaacuuacacauuucuuauuaacuacuuuaaaacacaauuagcuuuuuuuucuuucuucuuuucuuccuuccuucuuucucuuuuccuuaauuacucauaaggaauacaccaaucuuuuguuguuguuguugugaccaaauuccuaccaagaagcaacucaggggccagugagaucucucaguggguaaaccugcuugcagcacaagcccagugucugaauucaguccccaguuguccugacggaaggagagccacuguacgacagacacagggugcagugcuugacuggcaacugcagguuuguccagaccaugggccuuccuggguuacagagccugagcugcagacuggcuucuuagucucaucagccuaacugaaaacuccaacccagauuuucucuccauucugguucuguucauucuacccaaaguuggcuugcauuuagcaccaugaacuucauuguaaccucagaaaaacagaggcagccaugugugggagugcugggugugugcucgguuccugugcaauaggaaacacccgaguguccagugggauguugcuggcacuuugaacucugaccuccucucuccucaccacccuccgugacugucucuauaaauaccuacuccaccaugcccgcuguguuuguuuuucuugugggcagcaugcacucuucugugucaaguacuugguaccuccuauauguuacuauuuuaguacuguaacagugcccugcuccuaguaacagaccuguguaugcucaucuaaauucucuccgugucguguuacucuugugucucuccugucaggaguagaacauuuauaaggcauaaauauguugagaugccuuguuuuugcgucacaguuagcacucaguuuuuccugccaacugaaaaguuguuagccucaaaucugucugacauuugguagacuugacagucaccugugccccuugucccagagcuacaugccaaaaagggggcaggggguguaguugucuucauucacauguauaucugaguuuuuuugauggaagguuuuuuuaggcaggcaagagggagcaggaacucucuacuaugcaguccuggcuguccuggagaccagacuggucucaagcucaccgagacccacuugccucccccgcccgcccccaccccaaguaguccuggcucuacugaugggauuuuuucacuucucggagaccaugcaaagguuuaauguaagauguuaaugauauugguacuggcagggaagcaugugagaguaauucaaacgccagguaaaggaggguuugcagugugaccccucacaguggguagaggugcuccgcagacuuggaucugugugguaccuuccuccaucccucuagcauggugugucucguucuagaaucucccaugaagguuagagauugucuuaggucagagagugugaggguaauguugaaagugcuggcuuguccuuuauaaagacuggauauaggcccugaggugaugguggggguggggggugggguggggugggguggggugggucuaagcuuguccccagcaugacuucugucaaaccaucuuucagaugaggauguuuuuuccuucccauugugcaagcccaucuuuaagucacugauugcuuucaucauugcuugcuuuugaagaggaaguuguuggaguuuugcccaguuugggcucugacugggcuccaaggggaugcaggaugcaagaaagcucacuguaacccagcagcccuguuugcuuugcauggcuugugucacaauaggcugaaaggcacuagcaaaaaacuuacuauuccuuaguuucuucuuaaaagaagaaaagaaaguaauaugggucuaaaauaauugauuaguauuuuuggucugccagaaugucaucugacggugguuuuugcauguaaaagaguauauaauaauugaauucuuuuuuagaaguaauuuuagaagcuaauccagcucuuuuauuggauugugauacacacuaauggacucaucuucccccaccccacccccacacaccccaauuucucucucucucugacccucacaugaacugcaggaccccacaccagcuuuccaguaugucacaucuuuuucuaaccuugcucauguguucuuucuggcccuaucccagagcccuccuguccuccccccucaaaaggucuuuagugaauuguaggccuuuucuaaguugcucagguuggccuugaucuuacuguguagaccagacaagccuucagcucucugggaagagggguacagacggggcacacacaagaggccagaggaagaagccagguaucuacccuucucucucuaccuuauuccuuuaaaagagaguaucuuagugaaccuggaguuugguuguuggccagcaauccccaucaauucccccuuccuugucuccucagcacagcuggcuuuuuauguagauuuugggagauuugaacugagguccuuacacuuacacagcaaacauuuuuacccacugagccaucucuuuaucuuagagaucuuuuuaaauuuuuaaaagacuuuuaaauuuugaaucaugacuauuuguguaguuugugcaugugagugcacugcccucaagagacaaaaagagggcaucagauccccccuggagcuggaguuagagguuguacgcugucugaugugcgugcuaggaacugaacuucuuccauccucuguaagagcaacaguccugagcccucccccugccagggcuuuccucagugaccgcacucacauugugccucgugcuucauaagcuuagugagagcaagacugcuuauuucugaaucauaacugauaucagauagaaagugugccacauagcugcacccaaccguuuccugaacccaugcguuaugucuguugguuguuuguuugggcuacagucucauguagcccaggcuggccucagacugcuauguaacaagggaugaaucuuacagccaggccccaccaugcccugcuuuguuccuauuuucuguaguuaauuuaaugucucuuugaaucucccaagauaguacacuccauuaccagcguauucuuuuuccucucuuuguguuuuaagcaaauguuucauggaacccaggcuggccuuaaauccccacccccaagcacuggcagcucaagcaugugccaccgugaccagcccaaguaauucuuaaaacaaugauuugugcaugugccuguccugaggcuuacgcauggaucugaggucagcucgcaggaaucuguucuuccuuccagcaugcugguccaaaggauugaauuccagucauuauuagguuuggcaucaaacacuuucucacugaagcaucuugccuuuccacaagucacucuuuuuauaauauaguuucuagaaaauuggagaaaguugaguguuggugccaaaugucuuaaguucagcacucaggagaaucucuugaguucgaggccggccuggucuacagagugagcuccagcacagccagggcugcacagagaaacugaggccggccuggucuacagagugagcuccagcacagccagggcuacacagagacacccugucucggaaaagaaugauucugguucuggagcuuuagaguaaaaaggggaugaguucuugcuuguaggcuaugcuccucuuuaucaguucaggcaaauugaauauuccauaagcacaauuauacacaaaaugaugcauuuagcugcagcauucugguaaaccauucuaucuguugguccaaguuccauuuuccguaugguauuacugacugacaagcuguuaauaauaaaauucuucucuuuuaaaucaaaggauaaaacuuagaaaauggauguuuccugucauggagaacauggccccuuaugucuguguuccuuuccaggaugcuccccuauggcugcuuagcaacaggagaucgcucuggccucauugagguugugagcaccucugagacaaucgcugacauucagcugaacaguaguaacguggcugccacggcagccuucaacaaagacgcacuccugaacuggcucaaggaguacaacucugggugagugcacccucugcauuucucauaggaacacugacagguuauggugacgagacagaagcccugccugcucagagagcgucugcauugcuucauucagcacagaagccuuuauuauucaugggccuuuauuaaagucuuaaaacuugauggcaaaguauagaagcucuucaguaugcugggacauguuuuuaagacagcgggcugaaguccucuugcuuauccacaucagcuugugugauuaugaacuuggguucucauagguucguucuuuuagaagauuuauuugcuucguuucguuuuuggagauggggcagcucuguaguccugcuguccuugagcgcaugcuuagacuacagagagagauuuucugccucugccccugagcugagaucaaaggugugugcugucaugccuagccuuacuguuauuuuaauuaagugugcacgugugucugugugugcacaugagugcaggcgcccauggaguccagagagggcuuagaugcucugaagcuggaguuacgguggacugugaaccacaguguggcuguggggagccaaacucagguccuucaggagaacagcaaauacucugagccacgaagccaucuuuccagcccuguuagguuaauuuuaugaucgaaguuuauagucugugaucucuccaaacuaaaagaaaaauauuuaaaacuguguuacugaguuggcgauauauaucaguuaguggcguauuuguaaagcccuggguuugaugccugggaccacagacagcuggacagggacacgugccuguaaucucaggauucuggagguggagccagaaaacagccaugagaccccacuucaguaacacuguaagaguaaugcguguuaucuaugguccaugagacccugcuucaguaacacuguaagaguaaugcguguuaucugugguccaugagacccugcuucaguaacacuguaagaauagugcguguuaucuaugguuaaggugauggacugcaccgcucuucuaggaaguaaggaucucacugugaaggaagugcuuuccaggcacugcuggccaaagacuuaagaucagcucaaauggcaucauuuaacaucacguuguucagggcuuccaugagagcggagcaguuucagucuuacagccuucuacaaagagucuguguucucacuucugaccgaggcuccgaagccuggauucuaaucugaggccacccugacuuggaaugguucuuccuguaacccagcaguuaggaggcugacggaggagagaauugcaauggguuuaagaccugacaagcuccauggugauuuuugugcuagccugggcuauagaguaagacuuugccuuccaaaagcuaaaaaccaaaacaaaaguugguaaaaauguucccaggcccaaggaugauacaacccaugguggucucuuacaauaccuuuuguguaaaccuaagaccuccugaaccaggacuccugagacauagagacacguggcuaaggcucugcuaggcaaugccuuggcugccagccugacucgucugcuuucccaagcccauaugcucacucugcuuggcagcuuagugcagcgcucucccugagcaucgauggggcuuaguucucaucccccaaacuggaguucuaacuccugccgcuucucugucugccuccagggaugaccuggaccgagcgauugaggaguuuaccuuguccugugcuggcuacuguguagccucuuauguccucggcauuggugacaggcacagugacaacaucauggugaagaaaaccggccagguaagccgcacugcagaggcugugggucucgugauggcagcaugugcuuuguguuuucuuucaccuuccugccaacccuguagaaucucuuauaagcaucaccugccaguaagaaagccgauggccuugcugcacacaaucccacucuagaagacccuuacuguauguguuguuaggaucuagugcuaaguguuuauuuaaauguuuaacaguggccuaucuuuugauugcacaaauuuguauuuggaccugauuugaugauagguaccuguaaucacagcacucagaaguccgaggcagaagaguugcuuguucuagacccugucucaaacuaauaagugaaaaauucagaaaauaaccaguugggggcuugagcagcuaagacgacucacuaguccuccagaggacccagguuccuuucccagugcccacaugguggcucacaacugucuauaacuccaguuauaguaggagauuugacacaaccuucugguccuacaggcaccaggcauacaugugguacacauacauacaugugggcaaaaacacucaaugcaaauacaauaaaaacgaauaaggucuuuuuaaaaauaaccaaugaugagaaaaauaauaaaaucaggguggaaccugcguaaucugcuuucuuuuuuauuuuaauuuguguaugcuauccugccuguauguauguuugaaugugugcaugugcaggucuugugccuguagaagccagaaggagggaggugucagcuccccugagauggacagcugcucagccacugaucacugauccaccucuccaaccccgagucugguuuuguuuuguuuuguuuuagccaucaaacuugaucaucgcaggaguugggagaagcauagguggugccuaucugagggagcuagggagccaggcgaugugauuuaauuucaaauaaaaacuuuaaauuauucaugcagugaagcacaagugaccaagugcauguuccguuccuccacucuugguccuccacucugcaaaaugcuugugaaagugauugguucuagugaagggauuuccacacacauagcagccugcaugccagaguuaggaaucagaaagaucaagguuuuuucuuauguuuuuaaauuuuauuuuuuuauuuugcacggugugugugucuaugugugcaugugcacaucuauagaagcuaaagucaguucucuuuccaccacauagguuuaggguggcaagugccuuucagaaguuuuuaauagcuguguuggaaacuuuauaagacaauaaaaguuauuagccuuuauagcuuagaggaaagguggcucuagccuucaacagagagcaagcaaagcaaguauaagauggaauagucaacguuuuuaaaguuacguuuauuuuuguaucuauguuuguggggacucaaacucuugucauaaggcuuaguagcaaguuccugagccaucucuccagcccugggauagauuuuuuuucuucuucuaaagauagggacuuauaagguagcccuggcugucuggaacucauguauagaccaagcugacuucagacucacagaggucaccugccucugccucccaagugcugggcuuaaagacaugugcuaccacaucuagcccagaaauagauguuuucaaauauucaaggucucaagcucuggaccucauuuguccugguuuuguugugugccuuuuaaauggguucucacuggccucggccucucaguccccgacauggccucugggaagugacauuacagaccuaugccauguuucucagagaaagauagccaccaaagccagucuaaaccagauaguccacugaaauguuugccauuuucacagauaguuaaagcuguucuaaauaaggguaagaggguggugcuccagcuucuaguggguggagaccaaagaugcgucccacccagcagugcauacaguggaguccuuggaucaggcgaauggcucaagcaggugauauauuuaguuaggacuuugcacuacagaaguuaugccaaauagaaauauuugaggcucacuuggaaaauaaaaucccauuuguuuuacagcucuuccacauagauuuugggcauauucuuggaaauuucaaaucuaaauuuggcauuaaaagggagcgaguaccuuuuauucuuacuuaugacuucauucaugucauucaacaaggaaaaacgggaaacacugaaaaauuuggcaggugaguauugcccgguguccaggaggaauaacuagcacuucugaccagcugccucacauuuccuaaugucuuaguacuuuuccugcugcugugaugcaauacccugauaacagcaacauacaggagaaaggacuuauucggcucacaguguaggggcuugugggaaagucguaggagcaggagcuugaggagggggcggucaccuugugucauggcccagaagccgggagcacugccugcugaugcucacuucuccuccuccagccagggagcagugcaccuagugcucccccugaucaaacacgcucaaggcuaacaguugcaggcacgcccagaggcccaucucccaucugcuccagauccugucaguggucagugaacgcuaugcaucacaccagcugaggacuauuuagaucugggagauucguggucggauaacagaagacuuggguguggggaggaguuacugucagaucccucaccaguucaggaguaaccaggagggagauagaaugcuagaaauuugauguuacgguguuuuaguauacuuucuaccuguuucagaaaauuuuaucccaaaacuaauauauuuaacaggaagaugcugggagagcagguuuuuugauauuguuguguguggggaacaagagaggaagccuggguuugaugaaagcacuguugcuuggauguuuguacuuauauugccucuguuccuuuaucuuaauguggacaaauguggacaaaaggcguugaagaaauggcucagcaggaaauggugcuuaccacuaagcuugggcucaguguuugagccucagaacuccauggugcaaggagaaccauuguccccuggccccugcuacacacacacgcacgcacacacacuagauaaauaaaggcaugaaugaauaaauauaugugaacaaaaguuuuaaugugggcaaaaguaauugaguggugagcagaggugugucacguggauaccagacucugugcucaauaaagacugaucguaauauuucugugggaauugggauggauggcucuugaccacugucgucuuaaaggggaaaaagagagaaacaaacaggacugcacagaucagcuucgacuuuagggacugaagagauuaguaagccggagcccagacggucguucagaaagccuagagacugucacugucacuguuuuguggucagcaguuugcacagaagguacuaaguggucgggcgaauguggcguguggauuguuguugccuugccuauuacuguagaaccuuaauuauuucugguuugaagagagaccuaugguuauaggaagcuugaauuauguaaauuauagucugaggacucuucagagaggcauacauuagcugaaguacacaugcccucgcucuaaaggugucuuguuuuccuuugcaaacgucccgccucccuccaaugccaugcuucggggcgcuucuucaacccaagauuccgccagugcugugaagaugcguaucugauuuuacggcggcaugggaaucucuucaucacccuguuugcccugauguugacugcagggcugccugagcucacaucggucaaagauauacaguaucuuaagguaaauacuguucucuguauguguguuagacucugcacacaggacucaguuagagcgccauucaaaauguccaaaggagccaggcaguggugguaccugccuuuaaugccagcacucuuuagauaggcagcagguggaucucugaguugaaggccagccugguuuacaaaaggauuuccaggacacaaagggcuacacaaagaaacccugucucaaaaaaacuuuaaaaaaaaaaauauauauauagauauauauauguguguauauauauauaucuauauauauauauauauauuuuuuuuuuuuuuguccaaagggaacuggcaagauggcucagggagggucaccugcugccaagacugaagcucugaguucagucccuggaaagagaaccaacucccugcucaagaucugauuuagaucugcuuuagaucugcucuaaaaugcacgcgcacacgcgcgcgcgcgcgcacacacacacacacacacacacacucuccacacagacacacagacaccucacacacugacucacgcucacaggcaugggcaugcacauguuauaauuuuuuuuuauaaagaugacuuaagagauaccaaccuccagucaucuuguaaaaaucgagcauccaaagggaguggaacaaggucauuuccuccgguguuugccaaaaagagaaaaaaaaaaaccugugaaggaguuuguaauguagaugguuucuccacaguggaagggcaugcuaccgugccagcccacacacugggguacuagcugccggcacuuugguuuccacuggucugccuuugaccuucagucaucagagcagaaaagcagcugagugucuugcaguaauuacaaauuaauuucauccucaaaauuccuuugugaagaccaaauuguuguccuuccuugguguucauccugcucugcaggugacauccacauggagacauggaacugucugaaggauggagaggcuggccacaccagcaucuuguagaugauauuugcauaucuccauccagggcaggaaaugucacacacuucucucucucacuuuggguuuuaggacucgcuugccuuagggaagagcgaggaggaagcacugaagcaguucaagcagaaguuugacgaggcccucagggaaagcuggacuacuaaagugaacuggauggcucacacaguacggaaagacuacagguccuagcguccgcccuacucugccgcacuugccuguucguuuccuuuccauuuugcacuugcacuauugaacaugacccugccagaaaugcaaagggaaugaaauccugaagcucagagugaaguucaaaccacggcgucccgcagagccuagucugaaccaccccaugcccacccuguguucccgagcgcuuccaggacucaucgugagcagcagcauggaggccccuuccugcugaccuugcacgcgagggaugcuacuagggacugcuggggaucuuuucuuucuuuccuucaguauuugguacuuuaccagagagguguacauacuucuuuucaguguugugaccaagugcugcgacucagccaacaacuuaccacauucggggcugggagcuguucuaagaaagggaccucccucuccuuuuuaaauuggugagccacaaauuacauugauuauguugaacuuauuauucuucaaagaaaauauuuuaaaccugugaaaacucacuaauuuuguuaauauuuaucaugauggcaucauuucagccagacucgcugagaaucuauugguggggcaaauauaauauauauauaauauauauauauauauaugcugcauauauauuuauaaaauuucuagugggaguucuauauaaaaagauguuucuuugguauucuucagccuguguuuucaaguuuuacagaagcagagcuuuucccuaaguuccucuucgguucacuguagauccaguucuuccagccgcuucagcacugaggcgccaugaaugcgguuucucuguguagcucugagaguucguuucauagaacacaacacuugagcagaugcauccaaggaggcgagcaaaugaaaaggaaucuauuuauggaauaaacucgaaaccuaaauuucaguauuuuaguaauaugccagcuguucuuaauguauuuauuaaaauguauaacaaugugauuuuucaaugguauuaguucaaauugacguggauucaugccacauggaaaucuuuaauuuauuuguugagguaccauauagccagggugcuaggugaugagugguguuagcaugugcaauaggaacuacugguuugcuguguaaauggaugucaggauccagcaaaacuacugcuuucuucuccaaagacaugugggagccuucaauccucaguggcaugggaaacagcugaguacuugccccgugacuucaguuuucuauaggaauuuuauuaaagaguguuuaauuuuguuguccuucuuaauguucucagucaaauaaaugggugguuucaucuguuuggggacaugugggugucuucuuuuugggaagcacagucuuugcaaccugcucccacugggacucuccgaaauggccacgucaguggacaaaccagccuuaggagugggcuugggcucagggccucugcccggcuuccccuugcuuucuuguuccacauggacaaccugggaggccucuuagaccaggaggauucaagccuaagaggaggagauguuucugacaguuugcuguuacaaccucaucuccccugacucugcugcacuacaugugugcaugugcacaugcacacgggaaagccagggcaguguggcucaguagcuagacacugacagugcuccauccauacuugcugaauugcuugucucggucugagaagauggaaggcagaaagcuaacugcauucuggagugaauuaacacucuaggcuguacuaacaucuacuugaacaaagacugauuagccgccaccuugacuuugagcaagcuauauuuuauaucuucuuaaaugccaagcuuguuuugcagcacauuuucucucucuggcccccagccaaaggcccagaugcccuccagguuggcuuugagaccuugguguuaguauuuggaggaugucagacuagaguuaacacagauccccaggcagcacagaugggggaucgucagaucacauguggacggugaucacucuuuguuccugcgugcauguguuaacuauaucucaucguaacugacucagauuagucagauaugagcccgagugcuguguuucugugccucucuaaaauuagaacuucugcccagaggcacccuaaggauaccacucauuguccugugguucggugggugcuccuaaaagaagugucaggucuucagcauguguuuuauacaucugccuugacccccuugggggcguaaagccacacacuugugcugcagccucugccaguggguuacuuggcauucuuggcaaaugccucuauaagauuagguugaaggcaggccuguagggcaucuucuuagugauuggugauugguguggaagggcccagaccuuaggggugguuccaccgugggaugauaguccuagguaguauaagagaguaaacugagcaagaaacauuccuccauggccucuucaguuccugccuccggguuccugcccuguauauuccuggccuguaauguggaacuguaagccgaaauaaacucuuuccuccccaaguuccaagguauguggggguaccaccaacugaaguugauguaauauaauuucauuaccuacuuaauaagcaggcuggaauagaccgaagcaauuuuagauuuuagaguggagaagccauccaaucugggaggauaccaguucucuaaucuccagguuucucugaagcaauaucuuauuuacaauaucuucgagcaccuaccucaagacuggcugauccccacuuccccacgucuuccuuccguguuaccuuccacuugaguaagaaaacaccacggucuucagcaguaugacagugaaugacuucgaucuuuuucuaauucauaaaaugugaugaaguaaagauuuaaauuccaaaaugcuacaugccugcaccaauagcugacugacugugcgccugcaccaauagcaggucauuccccaguccaucauaucucccaucuguuugugggcuuaucuuaagucaacagaauucuaccaaguuaaauuugaguguggcucugcccuuggucuuugaauaaacauguucuccauguaaauuuguuguguagccaguauuacagcugaguuaaucua

SEQ ID NO: 5265 - RNA, 57069 nt, Mus musculus
cgccuucccggcgcgccaggugguguugucccgccccgcugggaggccaucgacugcgucaguucgauuggucagccuggcugcgcuaacggucgcguaggcggggcuuaggccgcgggggcgagcgcgguggaagccacgggcugugaccgaggugaguggcgcuuggggucgccgaggacuuuacgugggcccccuucaggugcacgcccaaagguggcuucuccggaauccggagcgucccacucaccagccagggcccucagaauggagucgccccggcuccuacgcgcuagcuaggaaaugcgcgugcaggugugggcguggaccucccugcggggagcccgcccgucgcuuugugucccucgcuccucacucaaccucuucucccagccgaguguugaaggugugcgaccugguagaggaagcaggaacugagcuuagacuccuacauggaaucggcuggguuccgggcuagcuccaguucucuuugcggcgcugucaggugauagcgauuuggagccaagugggagaucgcggaguaaaggguaggcgaguaccccuccugucagacucauuacaaauuuaaggacuccgccuuuauguggguccacguugauuaaugugaaaaacacagcaaagccuaaucaagguucccacuauuaucaacuaaucaauaauuguucacgccacggugcagacguagagaaagaggacaaccuugggcgucggucauugccucuaccuuguuugagacaaggucuuuuguuuuucugcauacuguaggggauggaggggagagcugcagaguccgaucucccuacaggaggcccgggguuacagaauucucgccuccuguggauucugaggauugcuucucaagcuuucuugggacaagugccuuuacccacugagcugucucucuagccugccacuuuauuuuguaaucauaucagcgcugcaggcauugguuucaaucuugugcauugcauggauuuuuguaaauaguaaauagcuaguaaaugguaaaccgugaagagcaaguugcaauguuguuggaauugaauuguugauucacguuaaggcaagguuucaugcaggccgucugaggacgacauugaauuccugauccuccaaccucugaaaugcugggguuacagcuaaacaccaccacacccagcuauuauauuuauggggguuuuguuuuuuuuuuuuuuuuguuuuuguuuuuuguuuuuugaggcaagauuucuuuauguagccuuggcuguccuggaacuagcucucuagacccagcucaccuagaacucacagagauccuccugccucugccuccugagugcacaccaccauugccuggcuauaaaauuuuaguauguguuguauuuuaacagauccucagauaccuacagggcaauuaaugaacuguugugaaacauggauggacugugucaaaauauacacuuuuccccccaugauggcugucacuuguacucacacucccagggcugagagggauggguugccuaggcuaguucuaggucagccaagguucuguuucaaacaucuccaguuucaucuuuuucucauuuuguuuuucucuuaucuucuuuuucucuuauuuuccuuuucucucuuuucuuuuuccccacccuccuuuucuugagacaagaucuugccauguuguccagguugucuuggaagucacuauguagaccaguuuggcuuugaacuuacaggaguccacuaggauuugcuuccugagugcugggaauaaaggcaugcaucaccauccgccacuaaacauuuuuaccacuuuuaauuaugugcguguucauguguacagguacucgugggggccgaggaguuggaucuccuggagcuggagucauaggugguugugagcugccaggcgugggugaaggggauugaacucugguccccuguaagggauaacaugcucuuagcacugugcuguuucauuucuguuuguuuuuguuuugguuuugguuuuuuuguuuuuguuuugagacagggucucucuauauaguccuggaacucacuguguagaccaggcuggccucgaacucacaagaucugccugccuuugucuccugagugguaagauuaaaggugucuaccacuguguuuggcuucuuucuuuucuugagauaggguuuuacuauguagccugggcugucucauauccuuccuaagacccaaagcugggaauuauggguaugugauuuuuuuucuccuuuuuguaacacuuggcuuuauuugccacguggcuaaacgacauccguccucuacuuccuacucuaggaguccuguguguuaacaacacucuguaaagguucugccuuggcccuaggaugccguuauuuuuuuuuuuuuccugugacuuucaagguuccaaagccgugucuuguuaauagccuggauggggaaaagauuacuacagacgauuagcauguuugcauuaauagguaauacuuugugucaauuuguaauaauuggaagugugcucuugaaaaagcuuacagguuuuuacuaugacuuuuuaaagaacacuuucagaacucagagaaccuuggggguuacagggggugggggcuugaucacggguguaaauaaguucucugcuuccugcuuuuacuugaguacacuugcaagcaaggauaacuacccuugaaggccacauaucagaaugauagauuugaauauccugcacauguuucaauaaagcaauaggaggaaggacaagggggaaaggaaggggggcaucuguggaaaaagcuguucguucuuguugcaguuuucaggcugugguuaucgguaccauagauaccggccuugagaauaacucgaccauuucugugacagguugaacauuucaaggcuuuggcuuguaucuuuuugaaaccuagaucaagauccacuuccggacaugagacucauugggugaucauuuuauugagauuaacuugaacgacagguguaaacaacaaaggaaucacuaugacugagguauguccaauauaauagaugacauguuuuuuuuccaauugaggaaagaucauaaaaaaauuuauugguuauugugauaaaugguguuacaugcuucuugucuaccugauaauucucucaaauaauauuaauaguuuaaacucaguaagaaaacugaauuuuaacgaaguuaaauagauggcaccucuguccugugagguaugcacuacucugugcucuuuguguaucuuugagucuucucgucucugcagugcuucugggagguaaguacuauuauuccuuuguuuuuucuucaugaaaccaaagcacaaaagcauuaguauucccugacuguaugucagaaucuccaggcagucuaauuauaggauauauacgagcucucuuuugguuaguguugauuuguuugcuguuaagauuuggcaggccuguccccaguugcugucugugagcuuuuguguuuauagaaaucuuggauagguaaauagcaguuuccuuagcauugaagccuggccccucagccuuagggacuaaaggcugaagacuccaccuuuggaacgccagcaccgagcagagcagcuacaguuaagcuccugagcuguggcuccuuaacugugaucuugaacucucccagcuccugggacuugcaguccuccuggccucagcgccugccuucgauucuucauagguccucaacuuugacacguuggcuuuugcaguacgccacugucuuuuugugguuucagcaucucgaucuuucugcucuggguuguucucuggaacucuugagcuucuuccuagagugauaguucuuuguaucacgccccuggcuuucagugauaguucagcgugagaggagucuuugcauuuuuuucacugacuccugcggucuuagcucuugguggcuuucagaaacguucuggcugacucugccaggcuagaaguuuguagacuuugucucaucuucgugcaaccaggguaacgaagccuacaaguaggcaagaggucauuugcgagaagacuuuauugagccuaauauugcaaccuggggcuugggagugagguuagcgcauaggagacaagcuccugaguaaccuggaaacgguggagagcggcuuccuguguggccagaagaggggacuguuggggcaugaacugugcuuuuaccaguuaugauggccaguguuguuaacuuggcacaucuagaaucaccugggagacuggcuucuggcaugucuguggggaacucucugaauuacgucgaggagggaagagcaggagcugggugguaccacucccuggauaggaugcugcacgaugcaaguggagaagggagcugaguagcaucuuuguguucauucucaguuucugguuaugaauuugauggaaccuucugcugccuuugacuuucugacauaauggauuauaccaugaacuguggguuaaaauaaccccucucucaagcuguuuguuuuugagaaagggucuguguauccuuagcugcccuagaacuugcuaaguaacaaauaacaggcuaaccucacagagagcugccugcuccugucucccagaugcugggauuaaaugugugcaccaucacacccauugauaaauugcuucucaaaacauaccacaggcguugcacaccuauaaucccaggacucaggaggcaaagucaggcugggguuacauaguaagacugucucaaaaccacaaaaccaauauuuaaaaagcaguuagauaaaaauacauuuacuuguuuauuggcugugugugccaauaugcuaaugcuucugcacacauggagcucagaggacuccaaccuucuguguccuggguucauggacucggguugucaggcuuggccucaaguggcuuaacucacugaaccaucuugucagccccuuaagauggcuuuugucaaaguauuuuaucacagccacaggaaaagaaacuaagagaccaauuauacccacagcuucaugguaucuaguuccauugaugacauauguaccaaccgucuuccucgauugggaaucauucaugaacaaauguuaugccaaccacagcuccuuggcagccucuggggaguugcucccgcagggagagcagaaucagcuagaguuggccacgccccccuugccuggagcgcagucucagaugccuucugaagcugcugaagcugcuguggucuagaaaggccuccagaugccuggguugaagcucugacagcauuggugacuauaguguuaucgcggucuuagcaccuggaacaguucuucagcgugauuauggaguacucccaagagcagacuguccugagagcucucauuaaagcacuugauugauuaauaguaacuccuuaacucaaggcagcuaggcauaaaauaaaucccagccucccaaaugcugggauuaaagcaugcaccaccauugccccggccaacuucuuuuuucuuuucuuuuccuuucuuuucuuuucucucuuuuucuuucuuccuuuuuuccuuuuuuuuccucuucuuucagacagggucuucuguagcccuugcugaccuugaacucacuauguggcugaggaugaccuugaaccucugaucuuccugcuucuacuuuguaugcuggguuuacaggcaggcaucuguacauuccauaugggaaagucaggcuagaucuugauuuuauuuauuuacugauuucacaaugaugaguuggguuuuuuuguuuuuaccaguuauuuugcaaucacgccccgagucuugcacauucuaggaaaguaccguaccucugagcuauauucccaguccuguucuugaucuucugaagacacuuguuuuuacauuaucauagaugcaguuauuugcuggguuuuaguugauuauagugaucgucauuguuaaaacuuauuuuggcuacugggaaucuaucuacucaguaagucuugcauauccuugcguauccuuggcuguccuggaacucgcucuguagaccauguuguccuccaacucagaaauuugccaguuucugccucccaagugcugggucuaaaggugugcaccaccacugcuggcuuuuuuuucuuuuuuuuuuuuuuuaauacagaguuugauuauguaguacuggaacucacuauauagacuaggcuaaccucaaacucacagagauccacuugacucugccuguguuuccuggcuucucguauuaaaggugugugcuaccaucacaggcaagauuuguuuuauuauuuuuuuaaagauuuauuuauuuuauuuguguacacuguagcugucuucagacacaccagaagagggggucagaucucauuacagauggcuaugagccaccaugugguugcugggauuugaacucagaaccucuggaagagcagucagugcucuuaaccacugagccaucucuccagcccgauguguuuuauuuuuauuuguguguacauauauguauacguauguauguguguauaugaaugcauguauguagaacuguggguaucagaggagaccagacaaggauaucguaccuccucaagcuggaguuacaggcagcugugugcugagauaggagguuucuggaaucugaacuuggguccuuuagaagagccacaaauacuguuagccgcugaguuaguucuguagcccaaaguuggauuccuuggggguggaguuacaggcagcugcaagcugcaagcaagggugcugcgagccaaacucagggccucuggaagagcacgugcuuuugucuggugagccaugucuccagccccagccauguaguucuucagugagcacauugaggaaugggccaaccccacauugaguauuuguaggaucccugaauaaaaucagcaagguuccuucagcuuuggaguucuccauuucuuauguucugauucuuuauuuuugcauuacaauuacaaaaagcuaucaccauuugugauggucaauauuaucaacucaacaggaacuagaauugcuuaggagacaagccuguggguauaguguggggaauuaccucuacuggauuaguuuugcuaugguugguacauuucugugggcugggauccuggacuaaguaacagguuuccuguccucaggcugcugcugccgugaucucugugguuuguacccuugaacugugagccaaagccagugcacauuucguccuuacgccucauccuuacguuucauuugccagcucuuuucauaguaacaaggcaaggagcuaaucuaucauuugucacccguuuuuuagacuuggaucuccgucccccaccccuaguguguguagauugaacuccggauucaugaauauuaagcaagcacucuaccgcagacuauaccuccaucaacaaagaaaaagcuuuuaaauaaguuuuaauucacaaguguacucaauucucaggugucacuggcaauauccuguaccucucuaguugacucucuucaugaggaaguaugccagcauaaaggaaauugcuaagugguacuuaccuauuaacccaaugcugaggagugucugccuugaagaaaaaugauuagaccuugaacauuguggacauuguuguuuucauuauauaugccuaauuauuacuacaucagaagccucguagaagauaacuuuuguuuguuuucuuugugacuucuuaugcuuuuuucuuuuccuuuuuuaauuuuuuuagauauuuaucuucagcccaggcugguucuggagcucguuauauagcuguccugcuugaguguuuggguuuuguuuguuuguuuguuuguuugcuuaguuuuuguuaacuugacaaaaguuagaguuaccugagaagaggaagcuguaguugagaaaaugccuuuuuuuuuuuuuaauuuuacucaaaugccauuuuuaauuauuuuuuucuuuuuuuaaaauuuuuaucccaauuuuauauuuauuuuauuuuuuacaauuuuuaaauuggauuuuuuuuuucauuuacauuuggccuguuggcuggccuguggggccauuuucuuaaagauugagguggaagggcccaggccauuguggguggggccaacccugugguccuggagugcauaagcaaguagguugagcuagcugggaagagcaagcccuccaagaggcugcccugacuuucugcagucaugcagugugggagcucagacgaaggaaauccuuuccuccaccuguugcuuuuggucaagguguuuaccacagcaauagaaaccuuugcuaagcccagggagaucucaaacucguggagauccuccugccucagucuucugagugcugggauuucagcuuugagccuagaggcucuuuuguaucuuacuccuugucugcuuugguuaucuuggacaguuugcuaagugaggugaaacuuuuuuuuuuuaauguuaacaauuccaggcccucagagaggcucucacuugcuucugccaagugcuuggacacacuauuuauuaguagagggguggaauagucuagaagagagaagccagaaucuagguuaguggagaaccuguuucucuucuuauccacaccgugagucuaaggcacaacuuuaaguuggaauggcuuuuguauuuuguauucauuuucucaacuugacuuuuauuaaaugucuguagaagagaagaaguuuuaaaccuuuaucuuauuguaaucucuauuuuagacugguugucuuguugcccaaagcugaucuuagacuuugcuauguaagguaauccuagacccuguuucuccugccuguacuuccugagcugggguuauaggcauuuaccaugcuacaccccacuuauacagugcuaaggacacaacccagggcuucguaugugcuagggagaggaggaaauccugcgugaauguguguuuugauaugagcaaggccuguugaggauuuagagaccaguuggcccaugggaaauaggcggcgauguuaacugugugggucaggcugaaguuuuccucaggagucaggagucacaaugccugcucaggaaagauuggccaguuuguacaaugacuagcaacuggggcuuucuccaguacccuuacagccugagacugcuuacauagagcuaaggcuuccccugugcuguaccuaauccgcgcgcgcucugaggcuccaggcuguagugguggugcuagagaagccaccagauuccagcugcauugcaugcggagcucugucuguccuuuauuuccucaccaccacuacgaagguuuccaagccucaagccucaaaggucagagcagagcuagcuacacuucuagcccacuucuuuucaaugacagauuucucagcagaucuacagugucugguuuauauacuagcugggaaccugggacaguucuucccaguagcgacagcaucacucccuucucccucccugacgcgggugguugauuggcugcucuguguaacugcugcuccugcuccagggaucuuuccugacuuagucaacucuccuucacaugguccugcuagcaagggaguuaguuuuaaguaauuuucagauucuaugaugcuaaugaauaugaaauuuuuuugcuccuggaaaguuuuaucuacauauaaaagaaaucaaguaauucuuuccccccagaauaguaguuuuauuuauuuauuuuuugugggccaaacagaaauucuuguuccugacuuuugauauacuuagaaauaaagauuguguagcaaaguuuuuggugucucaccuuguaguccagugaacugauuagaaacuggauuagacaaagcccuuuuagauuuuugaauagaaauuucuuaauguuaacaguucaguagccucacaaucuuuucaaaauaucuuaggcuaggcauguuggcacauaccuguaaauucuagcaccuagaggcagaggcagaugaucucugaguucaaggccagccuggucuauacauaguaaauuccagacacccagggcaauaugcagaaaacccccugugauucaugugauguguguguguguaucuguauuuguauauguguguauauauauauacauauauauauauauauucuuuuaaacagcuauuucucuuuuuuuguaugaauuuuuuuauuccauagaacaguauaagauaggauuuauuuauauaaaucuuguacaggcauguuaucuaggaaguaaauauuuauauaaggguaaucugauuuuuuuucuguaggaauaguggaaguggauuuuuuuuucuguuuuguuuugggguuuuuuuguuuuguuuuguuuuuguucuuuuguuuuuugagacaagauuuccuggcugcccuagaacuugcucuguaguucagacuggccucaaacucacagagauccaccugccuucgcuucccaagugcugagaacaaaggugugcaccaccacugccagcuaauuaguauauucuuuuaaauauauguauuugggggcaaauuauuaaaagacguuuuaaagacaguuuuuguuuguuuugaugaggcaggccuugaaaucaaauccaccugcuucugcuuccuaagugcugggauuauuaaaccugugccaccaugcucagcguaaguagaauguaagcaugaggauuaagaaggaaacaggcacucgacaagaaaguaaaccaugcuugagaacgugggcguugguuugucucagugaggguaacccuacguacaauuuucuuuguggcugagaaugacuuugcaguucuguuccuccugccgccuccuccugagaccucggaguauaggccaccauacuaguuuuaugcagacagagauugaacccagcaccguccaugugauagacaggcauucugccuacugcgcugcagccccggaccucuuguaacuucuguugcacuuuuucuuuuuucauccagggaagucaaauauuuuuauugccgaucucuacuucagauucuacaaaagaaccgcugucuccaguagccucuaaagcccaggauccuagccuuuuaucaaacagacucaugauugaaaaacagguaaacucaaaauauuuuaggucacuauuuuucaaaguauguucaaaagacugcuaggugugcaaauaugaaaauuaugacuuuaaaaagacuggugggguuggggagauggcucagugguuaagaggguguguacuguuuuccuagagaacccaaguucaauucccagcaccuacauugugcagcucccaaucacuuguaacuccagcucuagggaauccaacacucucuucugggcacuacacucacuugaacauauugucccucccuccacccuguccccaaacacauacacaaguacauguaauuaaaauccuuucuaaaaagauugguuaaauuccagaguaaggacugucauauuuuuauugguucagauuauguguguguggaggggagguaugcauaugguuccuauagaggcuggaggcaucgaauccccucugaagcuggaguucaggcaguugugagcugacauggguccuggauacagaaguuggguccguuuuaagagcagaggaguaaugugcucuuaaccccgagccaucucuucaggucuauuuuuaguaucuguaaacagcaguuguuauauuuuuuucucuuaagacacaagauauagccuggaaagauggcucagugagaaagguguauaagcaugaaaccugcauuuaaguccccagaacucugcaguggucauggucauuucuguggugccaucagggaugguaggugggcagauggguuauagacacaggauuaccagaguuugcuagccaccagucuuguucaagguuuagugagagacacuauaguagaaagugacagaccaagacauuuaaugcccccaccaccaccacuggccugcacauguguacacauucauguuauacaguguacaagaggcaucaagauaacaucacauguguacacauucauguuauacaauauacaggggcaucagauaacaucacauguguacacauucauguuguacaauauacaggggcaucagauaacaucacauguguacacauucauguuguacaauauacaagaggcaucagauaacaucacauguguacauauucauguuauacaauauacaagaggcaucagauaacagcauggacuauuuguucauaugaaaugugaccauaagcaaaaacauuuuguuuuuauaauuuuaguagacagaaauccuuugagauagucacacaaugauuuuggcuuuuaguacaucagugauaauuuuaguccuuuaucuaccaaaguagucaagcugugugaccagagaccuuaggaauacgugagagaaaaguuguguguggaaauagaagagggaaguauaaauaaucauuaaagaaagcugucuuuggcugugagucaugcuaggaaaccaucagggcaacuuacuccauuucuucaguccuaaagaauacguguauguuugugugccaacauaugugugugcaggagccuguagcgguaaggccagaggaggcauuggaucucuuggaacccaaauuacagaugguuaugggcugccauguggguguugggaacugaaccuggguccucugcagcagcaguaaaugcuuuuaaaccuaagcaaucucuccaggcucucuuaccccuggccccccuuuugagauaggaucugacuguauaguccaugcuggcuuuccacucaaugaggucugcuucuugccuccugagugcuuguaucaaagguauaugcuaccaugcacagcacuugcugaguuuuuuuguuuguuuguuuuuguuuuuuguuuuuuguuuuuacuuauaccagccccuaccuagguucccucacaccaguuagccuuaaaaugccuuugcuaacauaaugacugggcaguccugaacugccccugcaacccuagacauaaucgaauagaguggccacuguacacuccaacugaaaacucaccuggcugguuagcuuuucuccuguugcuccuccacccucuucuuuuguucucuccauucucucugcauucuccugcaaaacucuuuuaagugucccaccccauccucagccauugguugcuaguaucuguauugauagaaacaggaccuuagcaucagaaucacccccuucauagguguuuguagucuguacuuuuuauuuauuguagaaaaaaaauuuuuuaagauaggguuucuuuguguggccuuaguuauacuggaacuugcucucucucucucucucucucucucucucuuuuauuuuauuuuuuuuugguuuuucgagacaggauuucucuguguagcccuagcuguccuggaacucauuuuguagaccagguuggccucgaacucagaaaucugucugccucugccucccgagugcugggauuaaaggcguggaacuugcucucuacaccaguaaggcuuugaauaacagagauccacuuuccugugccuuccuaauguugaaauuaaaggcaugugccacuaugcccagcuaaaaaagaugaaauucuuaaaauuuucaaugugaccaaaaaugaaacaacuuaaaaaccuuuaaagguagagcuggagagaugacucagcacuuagaagguagagcuagagagaugacucagcacuuagaagguagagcuggagagaugaugacucagcacuuagaagugcuugcugcuccuggagaagacucugguucagguggcacgucacugucugccauuccagaucuaggagauucagugcuaucuuagcuucucacaaacgugcuuuagauaaaacguauucaaacacacacauauacaaaguaaaaauaauaauuaagccuuuaaaaaauuuaaagauguauggaauaaaaccgggauuuaacauaguuauaguuauacccauuugauggcucacaacugucugcaacucuaguucuaggggacuugacacucucgucugaucuccucaggcaccaggcaccagguacagacauaccugaaggcaaaacacucauauacauaccaaaaagaugucucuauguuaaaauaauaaaacucauuauuguauuggcacagaauagcucuuggguacuguuaggagccaaugaguagaagcuaaaaacuagcaggugaucuuccugagauggguucaccuuguauuaaagucuacaauagucugcaaggcccagaauaaauucauuuuaugaaagacuccugcuacuuauaugcuuauccuguuauuauaaauaacaauucccuacguauuagccuacccuuuugagcagaucucuguagaacaaugaagauauacugccuuguauauaugcuauguagacaaauagacuauuucuuaauccuuaauaugauccuauaagaauuccuaaaauuauaguaauuauuaagcacuuuuauaauaacacugcuauuaaauccuuccuaauagucaaaacugcagugagaacucuaccagucuuuagugucaccaguucauugcuucugagauggcuagcaggcaucuacuacucagucacauuccaauagguuguaagaccauuaaccaaaggucauaaaaagggaacuagugauuuacuauaggugcuaggacagaagauaaaauauugacugaguuuaucuauacaagacuucacuaauaucuugguaacaaaaguuaugguccaugaaccugcagagcuggugacaggugauauacuccuaauggauaugcauguaaacauccucuguuguaaacuuauucgauuuuauuuugaauuuauguguaaacuuguagugaacuuuuuaccaugugaucauguauucugaaagauguauaaguacugaggacaaagaggagacagaaguaaacacaggaacuuggaaguaaaggcacugggaguaagagcauuguuacaucagagcaggaggagagugcaagauuagaagaagaaugcaaaguggaauaacuuagaaaauauaaggcaacuuaaaaaauuaaaagagugauaugcaaaaugcagagggaaagaggaaaaaagaagcugcagagaaaguggaaggagcaggcaggcuucuccuuaccaugggacagaacaggucuuuucuuaauagcaaagcaggcuuagucuuacuaaagaggacaaagauuucuucuuacagacuuggguuuauucauuuagcaauaaaaggguagaagcuuuuucuuucucaaugcaauaaagauuggggcacauuuuuccuccagaaugagugaguucugcacuggggcuuugucuuuuucuccauauacauaaguaaguauggguguguguguguguguguguguguguguguguguguguguguguguguguaaguaugcaauuacgagacaguaugaaaacugggcccaacugguaggaauggagauuuaugaauguauaagcaugaaucuuuauaugaauuaugugaguuuaauccauauuugcuuguauaaaaguuuuuccuucugugagugugauucucuucuccugguucaauacaaguuuauugcuccaaacuucccccuagccugacaagcuaaaggcaucuggacaagagggagaaggcucuagcagcuaauccuuuacuuaguacccuguuguuuccugaugagguguuaaaugccagacuugcaguuucugaccuuaaaaggacucaggcaggucagcuacaguagcuaagugacuuagacagguaaacguuuuauuacacagcaacccuaaauaccuccuaagaucaagucuuaaucccccaaugcccuucccccuccgcugccuggagaaagcagaagaacaguuggggcuggcccccagcaggauaccugcuuaguuggcaaaaagcaagcaauaagaucuucaguuccaccuggcggugguggcacacaccuuuaaucacagcacucgggaggcagagggaggcggauuucugaguucgaggccagccuggucuacaaaguaaguuccaggacagccagggcuauacagagagacccugucucaaaaaaaaaaaaaaaaaaaaaaagaaagauuuccuauucauuuauuccuguuggguggcuaagccagaagcugauagagaugguaagccagcauuugcucugccauacccugcccugcccagcccagccucaggaguggacagauucucagcugauggcucagcuacuuuuaucucucugccaucuuguggcuuagagcucuuugggcauccccaaggauaauugauguugcugggugugauaucuauguugggugacuguugacauugggucucaucucuuugauuuuccuugccuuuguugccuucuucuccaugcugucuuuggugaagagagcccuguagaaucauggucuauaacaccauaaauagucugucuuacugcucuggcuugcucuccugcacccugaguauuaacaaccucccccacuucucuccacaggaggauuugaaauacuaugguugauacucauaggaucuucuugugugggaaacuuuaccugggguagggccugaguugcuggguucucugauccuuccuucuuuaccccguucucauuguugggguaauugcacggagaaccccugugagguggauauauaucaucauguauaauuggacuuccugucuugaacuggaacuccacagggccuguaacauuugcuucuuccccacccuuuuuuuaacaaacuuuuuuuuaucaaacuugagucucuacuuccaaaagguucuucuugggcuuuuucuuuaugucaaucucuugggugcauccaucaucuuuggugucauuucuguugauaaaaaccauauccauuuccuauagugaacugauuuaggauccuagugccucucuuguccccugcugcugcauguguaguuaccuauggagccuagcuuggugucuggggguguggaggaaggguggcugcugagucucuguuuugcuguucauuuuugaguugauggugauuggguaggcucuggcagcugugguuccucuggggguugacgagcagugauggucgggagacuggaggcuagguguggcugcuuagacaucucccuggcuuacgguuauagaucaaaaugguuggucagucaauagcagaaacacaucaaacaucacagagcuugggagcauugagugacugcacaguguguucacaaaugccuucuuugccuguucuuggacuuugaggauggcaccuucagaagcaagcaaagagacuucugagguagcccaagcuugucugaacucacagugagcaagacgauuuccaggaaugauccaugaaguuucuaaacaucaaaauccaguacagaacauuaagauauagguuuugaaaugugaacaaauaaaacgauuaauuuaaaaaaaaagcuauagacuuauaagcaccaacaguggcuccuuccacuugugcuuguucagcuggcaagaucuggggguagguagguagguagaucagcugagccccuccugucaaugcacaaaaggaugacucugguauuaaauuguggugaaaagaugaacuuagaaaguuacuguuucucuauguugguggaauugggaggaaagaaccuuguguggucuugggaaggucugacucuucauugguguuugccuguagauuucauuugcuaucuacuugaccaucuugacuuuucucauuggcuuuuccuugagcuucagccccacuuugucccuuccuccauuugucuuuggcuucucucucuuuuaaugugcagcucagcaaaccauuucaugauuuguuuguauaguguuuguuugcacaguucaggaucacucuccacaucuguaggcuuucuuuccuuuaaugccccaucccuuaacaauguguuuuuuuuuucugccugaauuacauccagggcacucuucuguuccugauauaagagcaacuuguaagcuuuucccacagcuucaaaagccuuuugugcucgaacauugucuugauuuuugucaggacacaccacuauuacuucucuaucucucacuucaggaguagcugaacaaucucaaaugaguucacauuaaagaggaacccggacaggucaaucuugcaaucugauuuuuguauguagaacuuaaccucucuucuuguuuaaccucccuguugaaggucauaaaagcaaccugccccgagccugccccuucagaaguggucguuucccuagucaggccucacacaacccuugauuucuuuuucaucauuguuaaagggauacuuguuucagagugccugguuuuaguuuucaguuguauccucucaguauggccuaauuugaucuuauuuaauuagacuucucuguuucauugaaauuacaaguuguuuuuguuuuaauuucccacuaaggccuacaugugaauauuuuguuuaauguaacaacucauuugcauauuucuauucuguugcuaauuauaguaaaaaaaaaacccacuaaauuuaauuuaauucauauaauuucauauuaaaaccaggcaugacacacacaucuuucauuccagcacuugggaaguagaggcagucacaucucuuuaaguucaaggcuaaccuggucuaacauugccaguuugaauccugccaggguuauagugagacccuaucuggaggaaagacacuuauaaaaccuucugagugcuggaaagguggcuuacuggucucccacagaacacagcagccaugucauguggcucaccaccaccucaagcucaagaggcugccgcuuguccaguauguccauacuguccaguauguccauauuguccaguaugcacauauuguccaguauguccauauuguccaguauguccauauuguccaguauguccauauuguccaguaugcccauauuguccaguaugcccauauuguccaguaugcccauauuguccaguaugcccauauuguccaguaugcccauauuguccaguaugcccauauuguccaguaugcacauauuguccaguaugcacauauuguccaguauguacaggcacugaacuuaaugugcucguaccuacaugcagagacgcacaugaacaucuagaaaucgaaaguccuggaggaaagguccaauguuuucugaaaacauaggaaaucauauacaagauuuuucuucacaucuuaaagugacuccuuuuuucucugcugugcuuguagcaggaggaagcagaaugggaaagcaucaaugggcuauugaugacacauggcuucaaaccuuuaugucuagucaaaggagcagaucucagagguaacuacauccugcugauuuguuagauacaaaacaugguuuuaagaaguuuuuuguaaaucuuaaaaugguuuuaccuucccuuugguuuuaccaucucucucucucucucucucucucucucucucucucucguguauguguguguaagcauauauauguaaguuuauauaauuuuuuacaaugcagauuucauuguuuuugacaaacaaucaucacaaaaaaugaggcagauuuugaaaacguugauggaagaaacaacacgucagcagagcaugauacgggagcucauagagaccaaccagcaacugaaguaagacaguggggagcacccugggauugacugcaugcacgcuaaacacagucugaagaggagccugaaaugucauuauacuugggggguuuucuuuuuuucaucuuauguguaugaguguuucuguuagaauguauguaaguguaccaugugggugcccgaacccucaguguucagaagaggauaugagauccucuggaacuagaguuaugaaugauugugaaccacuaugcaugcugggaacugaguuuggguccucuggaagaguagccagugcucuuaaccacugaaccaucucuccaacacccugaaauuucauuuguauuaaauguaaaacaauauuuuuaacagauaaaugggcaaacauugaguagauaugacuuuagguagcauuuagcauugacguguaauggcacccucuguuucuucuguuacucucuccuauaagguggacgagacuggcuaugucaggggcaugacugcagaacuauuagaagaucuaggaguguagaggcugggcugcaguucagugcuaauaaugcuaauuuuugauucuuggcaccaaagcaaaauaagaaauauuaagaaugugaagacuuuugggaaaguaagcuguuacauggcauguaugaucugguuuauuuugacacugagggaaggaauugugucuguuaacuagaagugaacuucagcuagaacagaaccgagcggcacaccaggaacagcgagccaaugaccugcagcagauuauggacagugugaaauccaaaauuggugaauuggaagaugaaucccuaaacaggguuugccagcaacaaaauagaauaaaagaccuucaaaaggaauauaaaauguuacagguauuguauugaauuauauagguauaauuguuuucugaugguuaguguuggaacaguucauccuagucccaguuuccaugugccuuccauguuguaugucuguggcaaagaggucaagggaauccaaaugcucugaaguagaagcuguuagaagaaaacagucagcauuggcauaggccagggauguuaauaggugaucuuuucuauuuaguaccccauuuugagauucaucuauguggcugcauguuguaguuucacgaggauuccuaaaagauucauguaugugucuaugugaguguaugccaugaauguaugggugccuuuggaggccagaagaggguguuaggucuccuggaacuggaguuacaggagcuuaugggugcuggaaacugaauucaacuccuguagaagauuaggaagugcuccuaaaccauugagccuuucaccaucucacacugcacuauugcauagcucauuauaucugcacaggaauucuuccugcacuuguaaaucuaagucuacuuuauagcaaacauaguaccauguuuagagcugcuguguccuguauauagguaauagugccugaaauagaucucaaauuggccugcaaugagcucauauuucucuguaaaugccuuauaauacucuauguauaucccauaaugaauauuauagaagucaguuaucugcaaagaaauccuacuacaguguauacauaauaaugucauaacacccagaauacaacucuugcucuguauugagcauauauugcccgguacacagcacacagugccuucauauagcccauaaugcuuuguuuggaguuuaugguguccuuuguagaucuuauagugcaccucuaugugggggcaguuucuuaauuggugauugauguuggaggccccagcccaugaugggugaggccaccuauaggcuggagguccuggguaagaaaccaggcugaaccagccauagaagcaaacuaguaagcaacuguccuucauggccucugcauagcuccuaacuccagauuccugccuguuggauuuccuguccugacuccccucugugauugacuaugauguggaaauauaagucaaauaaacccuuuccucccccaagguguucuuggucaucauguuguaucacaauaguaacccuaagacaacagaguugucuuagcuauuggaaacaugaauagauuucacaauuuauccaauggagcuuaauauauaaauacaccuauauaauaaagugcauggcguuauguagaacccguagugccccucuggugaguauauugugugccaccgguugagcucauuucaacugcaugaaguucagaguacaccuuuuuuaguauccauacuaccauauuuagaggucauaggccauguggaaagcuccuggaauucucuguagaacucauaguccacuuauguagcacucccagaucagacuucaucuuguacauaauuuguaguauucuuuuuguagcccauaaagacuguuaaagauuucagaguacucugcauggagcuaagacagccuuguucaagucucauagugccuugugcauuucucauagugaaccuguauggaguucauugccaugauagugaccuguguagaauucaauacaucuccacugaguuuauaucacguaugacuaaagcucaucauguaucuguuuagacuuuauaaucccaaguacacaucuuacagugcacacacacacucaccucuccuuuugugugugugucugauuuguauugaacuuauaauguaucuauauaacucauaguguccuuuauaaacucauaguguaccccugaauaguucaggauggucuugauuaaaggacauaugauaucugugagcucauaguauccuugauggaccccaagugcccuguacagagcucuuagugcccugaauagaguucacagugcgugugauuuagagcucauccuggaguauguagaccacacugcauccuuauauaagcuuacaagguucuguagagaugccacagucuccucuguauaucucccaguacacuuauaugcagcacacaguccuggcagggaucucauauugcauguauguucaucucuuaggacacuuuauagaugucauaagggccucuuuaauaaaagucacaaugucuuauauguagauuacaguccccugugcuguuuagcgcucacaguguccuccuuacagagcucauaaugucuuauauggagucguaaugcucacguguagagacccauuucuaccuguuaaacgcucauauuggaaauguauugauuucauuaugcccuaugaggucauaguucccauuaugaaucuuaguacccuauguagagguuucaguggccaguauagauaucauauuucccuuucuaugguuauauuaccuugaaccaugugcaguaaagcccugugagcagaucauaguggguuuuguacagagcauagauuaccuggacugggagcuucuggggauuuuccugccuuuggucccauuuugccauauguauggcggaaauagagauggaugcuacugcaucuggcuuuauguggguuuggagacucaacgugcagguccuccugacccacugaguucucagccauauaaugaaaaaugaaacacuaaaauaaaaauaauaaauugaaaaagacacuauaugaugaaagucuuccuguucacaguuuauggauugacagaauuagaaagugguuuuauuaccaaaagcaauuucuauaacaacuaucaaaauucaaaagacagucuucacagauauggaauaaacagcccuaguaugaauaagguaacaguuaaggcccuugauggugagagcaguucuggcugcaaguaacaaugcuggagauaguacuuguauuagucaggguucucuagagucacagaacuuauggauagucucuagauaguaaaggaauuuauugaugacuuacagucggcagcccaauucccaacaaugguucagucgcagcugugaauggaaguccaaggaucuagcaguuacucagucucacgcagcaagcaggcgaaggagcaagagcaagagcaagagcuagacucccuucuuccaauguccuuauauugucuccagcaaaagguguagcccagauuaaagguguguuccaccacaccuuuaaucccagaugaaaggcauagcccagauuaaagguguguuccuuaacucggagauucaaucuucuggaauccauagccacuauggcucaagaucuucaaaccaagauccagauaaggaucuccaagccuccagauaagggucacuggugagccuuccaauuccgaauuguaguucauuccaaauauugucaaguugacaaccaggaauagccacuacaauccaccccuugucaacuugacacaaauaauaucucauguucacaugaaacaauaacaagguuguaaauacgccuaacaugauauaacuaucccucguacaaucgcaaacgcauuaguaaauuuacaaugggcauucauauuacuuuauaauccucguuucugcaacugguuacguggccuuaauugguauuuauaacuaccuuccucuacuacccauucuguauuuccuucaccuucagccagcaccucagcaggucuuggcucuuuuccuggaggauugacccauaccuucauuccugaugggucugcguccuuugucauccugcuuggauuaggcuguuguaguuucccauugacuuuaaucacaggacaugguaguacuaagagacgcccuaagggaucuccugcacuccagacauaaucuugcuuaccaccauugugaagagguaauccaauuuccccaugguaaucuggaucuaucaccccuccuaacacuguuauuccuuuuuuagccuguugguuuaagggcauuagaagcccaaaaugaccagggggaagucugagcuuccaguucaaugaaauguuuguuguagcuccugguaggagcacuccccucucuggagccaaaacuucuaagccagcagaaccuagaguuauggggacaggaagcaaaaauuuuccuagagggucacuaggagugauaguaaguggaacuauuccguuuuccaccccuugauuccuggacccaugaauccuggcuaugggugaaacuguaccauauaucgagcgcugauucaaagcauauacugccuucugaagaacucugccccagccuuccaagcuguuaccaccuaauuggcgcuguaacugcgucuucaaaaggccauuccaucuuucuaucagcccagcugcuucaggaugauggggaaugugguaagaccagugaauuccaugaucgugagcccacugucguacuucucuggcugugaaaugaguuccuuggucagaagcaauacuguguggaauaccaugacgauagaugaggcauucugucaguccgugaauggugguuuuagcagaggcauuacgugcaggaaaggcaaauccauaaccagaauaaguaucuacuccaguaagaacaaaacgcuguccuuuccacgaaggaagugguccaauguagucaaccugccaccagguugcuggcuggucaccucgaggaauggugccauaucuggggcucaguguugguuucugcuguuggcagaucuggcaaucagcagcagcuguagccaggucagccuuggugaguggaagcccauguugcugagcccaagcauaaccuccaucucgaccaccaugaccacuuuguucauguacccauugagcaaugacagggauggcuggggagagaggcugacuguccacagaacgggucaucuuauccacuugauuauugaacuccuccucggcugaagucaccuuuuggugagcauuuacaugggacacaaauaucuucacauccuuugcccauuuggagagaucuauccacauacuucuuccccagaugucuuucucaccaauuuuccaauugugaucuuuccaagucccugaccauccagccaauccauuggcuacagcccaugagucagugaauaaucguacaucuggccacuucuucuuacaaacaaacuguaauaccauguguacugcccgaaguucugcccacugugaagauuucccuucaccugugucuuucaagguugucccagaaagggguuguaaugcugcagcuguccacuucuggguggugccugcauaacgugcagagccaucaguaaaccaggcucuagucuucuccucuucggucaguugaucauagggaacaccccaugaggcuauaggugcaugcuuggcagcagauggcauuguaacaggaguagaaaccauaggcauuugagcaacuucuucauguaacuugcuugugccuucaggaccugcucuggcccgaucacguauauaccacuuccauuugauaauagacugcugcugugcacgucccacuuuaugacuugcagggucugauaguacccagcucaugauggguaauucaggucgcauagugacuugguguccuauugucagacguucaguuuccacuaaggcccaauagcaggccaagagcuguuuuucaaagggagaauaguugucugcagaugaugguagagcuuugcuccaaaaucccaaaggccuuuucugugauucaccuacaggggccugccagaggcuccaaacagcaucucuaucagccacagacaccucaaguaccaucgggucugcugggucauaugguccaagugguagagcagccugcacagcagccuggaccuguugaagggccuucuccuguuccaggccccacacaaagcuagcagcuuuccgagucacuugguaaauaggccuaaguaacacacccaagugagggauguguugucuccagaauccaaauagacccacuaaacguugugcuucuuucuugguuguaggaggggccaggugcaauaacuuaucuuucaccuuagaaggaauaucucugcaugccccacaccacuggacuccuaagaauuucacugagguagaugguccuugaauuuugguuggauuuauuucccauccucugauacgcauauguguuaccaaugaguccaaagugguugcuacuuccugcucacuugguccaaucagcauaaugucaucaauauagugcaccaaugugauauuuuguggaagauccaaacgaucaagaucccuucuaacuaaauuaugacacagggcaggagaguuaauauauccuugaggcaaaacugugaagguauacuguuggccuugccaacugaaagcaaauugcuucuggugguccuuauggacagguacugagaagaaggcauuugccagaucaauagccgcauaccaggugccaggagauguguuaauuugcucaaguaacgaaacuacaucugguacagcagcugcaauuggaguuacuaccugauuuaguuuucgauaaucaacugucauucuccaugauccaucuguuuucugcacuggccagauaggagaguuaaacggagauguggugggaaccaccaccccugcgucuuucaaguccuugauaguggcaguaauuucugcaaugccuccaggaauacgauacuguuuuugauucacuauuuucuuuggcaaaggcaacucuaaaggcuuccauuuggccuuuccaaccauaauagcccucacucuacaguucagggaaccaauaugagaauucugccaauuucugaguauaucuaucccaauuauacauucuggaacuggggaaaucaccacaggauguguccggggaccuacuggaccuacugugagucggacaucagucaaaacuccauuaaucaccugcccuccauaagccccuacuuuaacuggagggccacaauguuucuugggauccccugggaucagugucaacucagaaccaguauccagcagaccccgaaaagucugauuauuuccuuuuccccaguguacaguuacccuuguaaaaggccguaggucccucuggggaagaacuggagaaaggguaacagcaaaaccuuugagugucuuaucaagauccuuccucagcggaaccuggccaccccuucauucaagggguucuggaucugcaaacugucucaagucuggaaauugauucacuggccgagauugcuguuuaccacgaucuaauguagccuuucuuucauuuguuugagaauuuuucugcuuauacagaucaaacaaauaugcaguaggcuuccuauguauuucauuccuggaaacaccaugauugguuagccaguaccaaagguccaaccgagucaugccauuauaaauuucaccucuccugugcugaccauuacuggguauguuauuauaaacauucuuuugucuacgcuguccauuauaauaacuagaaucaccuugucucgggcgauucaaugcugccaccuggcccuuguuaccucggaauccaacuaaacccagugaauuuaauucaucuaauugagcagaagcaucuccaaugcuaagaucuggcacaaggaaaagggaaagaacaaaacccuucaaaugugcuggugccccucucaccaauuugcgucuuauagagcuggugaaaggcauaucuucuggaccuucccauuguggacaauuaugcuuuacacaauauauccacucuagcauugcaauuucccuaagucuuaaaaucccuucaucaacacuaagccauggaauaucaggcaucuccaagucauuuccaguaggccaucuuuugauaaacaccucagccaaccauucaaacaaacuuuugacaccuuuuuuaacuaugcgagcuuccguauuaaaccuagaaucucuacucagaggacccaugucaauaaacucagccugcucuaguuuuauguuccuuccacccuuaucccacacccuuaaaauccauucccacacauauucaccagguuucugcuuaaaugaauuagcaaacucauuaagcuccuuaguaguguagcgaauuuccucauggacuacacuuucuaccuccccucuaggagccuguuuugcuuugagucugguuacaggucuagaagaaacuauuggugggccgugagcagacucugcaaaauuaauuuccucauguggggaaggcauuauuucaagagguggggcugaggguacuacuuccucagguggggcaaacccuugagaaucugaggauucaaaauucucagcuucaacauggucuucccacacauccccaucccauguuguaggaucccauucuuugccaauuagagcccuuacuuuaacugucgacacacucugaggcugagacuugaauuuuugcuguaguucagccaaccuuacaaugagaguuucuguuugauuuucugcaacuugagcucuauugcuacaagagagaagauucuccucaaggacacacuuagcaacuuuuagaucguuuacuugugucuggagccuuucgauuuuaucacacaacuccuuccuuucauucaucauuuuuuccacagauacuaagagcagccagccaguaaaaucauuuuucgauuuuuuccccaucuuguagaaagcuuugugcacugaaucaccuaauucauuaagaaaaucaagggcauuagcuucuuuaaguucggaauauaguuucaaccaugggucuucaaaauucucugagcucccaggagggagagaaucuggagagguuucaauaguugaaagugcugguggaucaacaagccaauuccagaauuuuaaaagauucauccuuguacuucuguuacucuagaaccacuccugguaccaacuucuguauuagucaggguucucuagagucacagaacuuauggauagucucuagauaguaaaggaauuuauugaugacuuacagucggcagcccaauucccaacaaugguucagucgcagcugugaauggaaguccaaggaucuagcaguuacucagucucacgcagcaagcaggcgaaggagcaagagcaagagcaagagcuagacucccuucuuccaauguccuuauauugucuccagcaaaagguguagcccagauuaaagguguguuccaccacaccuuuaaucccagaugaaaggcauagcccagauuaaagguguguuccuuaacucggagauucaaucuucuggaauccauagccacuauggcucaagaucuucaaaccaagauccagauaaggaucuccaagccuccagauaagggucacuggugagccuuccaauuccgaauuguaguucauuccaaauauugucaaguugacaaccaggaauagccacuacaguacuauucugguuuccaguuagaaccacagaacuauaguaacaaaaacaguuuggugggcugcagagauggcucagugguuaagagcacugacugcucuuccagagguccuaaguucaauucccagcaaccacaugguggcucacaaccaucuguaaugggaucugaugcccuuuuuuuggugugucugaagacagcuacaguguauucauauacauaaaauaaauaauucuuuuaaaaaaacacaccaguuugguguugcuggcauaaaauguaucagagaaauagaauacacaaccgagaauuaaacacuuacagccaguugaauuuugggcaaagaugccaaauacuacauuugagaaagagauagcaucucaacacaguacagggagacaugaauauccauauguaaaaaaaugagacuagauccuuaucucuuaccccauacaaaaaucaauucaagauguaauacuucaaauugaaauuuuuugugggggaaaaacagagaaaccucuuaaaauauggucauaggcagggacuuucugaaaaggacuccaauagcucaugaaauaauaucaagaauuuaaaagccucuccacaggaacggaaccaagcaacaggguaaaaagacaaccaguagaaggagagaaaacuguacuagcugucaauauauaaagaugcaggcaggagugguggcccacgccuuuaaucccagcauucaggaggcagaggcaggaggaucucugaguuccaggccagccuggucuacauagugagcucuaggucagccaggacuauacagagaaacccugccucaacaacaacaacaacaaacaaaacaaaacaaaacaaaacaaaacaaaacaaaacaaaacaaaauacaaucaguugauaaauggccuaauuaaugagcagacuuuucucaaaagauugaugguccagugacccauaaauagacaaauaauggucaacacucuuagcccccaaggaaaugcaaauuaaaaccacauugagauuguauuuuacucuagucagaauaccaguaauuaagaaagcaaguaacaacaagugauaaugaggauuugaaaaaaagagaaccuuuaccaaaggggauagaaauuaguguggagguuccucaacaaacuuaaacuaccauaugauccaguuauacuaccaguauacuuccuggguacacuccaaagacuagguuaacguaccauagacacuugcacaucuaugcuuacugcaguguacaugcgugcauguaugcaugcaugucuugaaaguugaagccagacugggggaaugaaaaacaguggggaagaagaaaaggaaagauaugaagauacagaggugagcauugucagaauacaugauacacaaaugaaucucaucacuguuuaaugaauauaugccaagaacacuauccaucucaaugauuacuucuagguuuuggccgacuuacacacuggcauguucaccacuuagcuauugaggucaugccugguuucauggagagccaagguaaagaauggauuacuguauauuucauggucacuaggagaggguauauugccagcaacuaagacuauuaccccuuugaagguugcuaauuuucaauaaauuugaugccuuggacaaaugagcauguacuuggccaugaguguuuuguuuuaaaagugauauauuuuuuuaauaaaucuaaggcacauacugauuauuccugguuauggaccuauucuggauuuauagucuucccccuuuuccuggaugucucaacugacuacaucauuugugaucuacagaucauuuuugauuuuuaaauuuucuuuuggggguuuuuuaaaaauauuuuuaauauaugucucuuccugauuauuguuuuuaucuaaaccuagauauaaguuagggagaauagugcacacaaaacccuagcaauuagaggcugauauauuaguauacaagauggaagccagccuggacuacauaaaucucauaaaucuauuaaaauaaauuauauuggcuucauauagauucuuuuuuaaaaauuuauuuuuauauaugaguacauuguagaugucuucagauacaccaguagagggcaucagaucccauuacagauaguugugagccaccaugugguugcugggaauugaacucagaaccucuggaagaacagccagugcucuuaacugcugagccaucucuccagccccuucauaugaauucuuaaaacccuuacugauuauuuaaccuugaaugcaugcagucaacauaguucccuuauuuuauauguuuucacguuugugacauaguaauauuccuugcaucaauuuuaaacaggcuugaugcuacuuacugaaugaaacagcucaguggagauggugacacagguauaaggagacagcguguccuacaugucugaucauaaucguacuuuuacaauguucuuacagaugaaaugccagcaauauaagaaaaaccgaauggagcaagaggggaccauugcuucuuugcaaaaggagauccacagacuugccaaagaggaggaagagcgcauccucacucagaacagaguguuugcccaucucugcagaagagucccucacucagucuuggauaaacaguaaugccuaguacauaagacgauaauggagcuagauggauuguuuucagcuaauuuuuuucuugagggugguuagaucuuuugcuauagaaaucuccuuuuccccuuuuuuuucuaguucaucauuuuguguguguguguguguguguguguguguguacacgugcgcgugcauauuuguauugugcaugcaugugugugugaauauaauuuuaagaguauuuugaguaauuaauuuauuaaacuuuauauauacagguguugugccugcauguauuuauauguaccacaugccugcagugaccagaaaaggaugucagacaccccuggaacuggaguuauagacaguuaguuguaggccaucuugugggugcuggggauaaaaccuuuguccucugaaagagcaaccagugcucuuagacucugaaccaucucuccaacuccuugaggaaugggucuagacauuuauuuuuaaaauauuaacuauggauggguagguauaguggcacaugccuuuaauuccagcacuugggagggagaagcagauagauagaucgcugaguucuagaccugccagggccauacagugagaaccuaucucaaaaaagaaaauccaaacuaaacaaaaaauacuuaucaguuuugugugugugcaaguaugugcacauaccugaguguguguauguguguguguguguguccauaugguaugcuggaaucaaacccaggucccaaguaagagaagcaaguucccuuaaccauugagccuugggcagauauuuaugagggagauugccagagauaggauuguugggacaggaagacuauguauuuaauaaagugaaacaugcuuauaaauauaguaauagaagauauauagauauagaucagugcaauacuuguuucuggcaagaauuacugaaaaauuuuaaguuugccagacaauccgugcuaaagauuugauuucgaguaauguguauguaugcauguauguggguauaugugcuuccagagccauuggaaaccuccagggcuggaguuacaguggcuuugcccuacccuauguguacugagaacugaacuugggucuucugcaagaguaguauauacuuuaaaaaauguuuaggccuggagggguggcucagagguugggaguacucgguacucuugcagagaaccaggguucuauucccagcacccacguggugucucacaguugccuguaucucuagcuccaggggauuagaugcccuucuugguccucccugggcacuugaacacaaguuguacauacacacauaaauaaauaagucuuaaagaaaaaaguuaaaauguauuuucuauguaugaguguuuugccuauauguauguaccacaugugagccugugccuguggaguccagaagcaagcauuggaucccuuagaacuggaguuagggaugauugugagucacuguguagguuagaaauuaaaccucugaaagagcagcaagucucucuagcccugcaguaugcucucuuaacugcuaagccaucucuccauccccagucuguauuuuuaucuuuguaauuugaaauuauguaggaaguuugguaaauacuaccuuuugaaacuaacugaacauauuuuuuguuuucuagauugcugugucuaauugauuacuaugaauguaaacuuagaaaacuucauauacaaagguauaaauaauauaauuuuauuuuuauauuuauacauuaaguuucuguuguaaucgcagaaguuugaagcgcaggguaaaugaggugcugugcacugcacuguuagccacuuacgcgcuacaauuuuucuucagucuuuuuauuaagacuuggaaguaguauuaggaaucaacaguauguguacaguguguuuuuaaaaagaccaggaaauguuccauuuauauuuuguuuguucauucaaguauuuuucauccacucuugugucccgugacaaaguuuucugguccucacacauucuaagaguuaguaaacauacugcucuaagauuagauagcuacugugaugugauacuauucuuuguagaacaagugggaaccugggauuuccauguuuaaguuauuaaaucccuugaauuggcuucaguuuugcuagcuacauguucucuuugaggagaaagucccacaagauguaguguguuugucuucccacaggcaguuugaggaagacagucagucagaagaaaaagacuucacaaaccugggugccucaccaaauuauaaaggcguucugaugguauggagaccagagcacugacaaauaccuuuucauaaagcaaaauaauccccuaagagaguuccuuauuuuacugugaaaugcauugcagucguuacagaagcaacucaaggaauccaaauccaggaucgacgugcugguaggugagaagcugagccuccagaaagaucuggaaaacaggugggagaaaugcuuagaaugucagacgagucauuccugcccccuuucuccagaacugaacccgagcaccugacccuccugugcucccuuugacuggucguauguccuggcaaauggugaccgcaguaagaauccauagggaagcaaggggagcaagaaaacaggaauccauguuaggauaaaauuggcuaagaccuuugaggagauucaggguuuuggguucuuuguuuguguuuaugugggugugaaguugagugugcacaucugugcuccugagcugccuaccuugcuuuaugagacaggaucacuccuuaagaccugcugggagcuuguuaauuagaccaggcugccuugcuaaugagccuuggagaucugccugugggaucaccucauucccagggcugggacuacaagugugugcccucaugccuuuuuaguagauucuuggguuugaacucuggucuccauguuugcaugccacucuuccagacuuagcugucucucgaagcccagguucagucuauguuuaguuuuucuuuuaaaauuagcuguagugagggcuggaggguuucucauuuggaaaacugucugcuaugcaagcaugugagagcuugaggucagaucuuuagcacuauugugaaaaggcaaauuguagcagcguguaccuguaauugcagcauuggaugcaggagugaagacuggcagauuccuggagcucacuggcuggccagccagccuagccaguugauggacacuauguccagugagaaaacauaucucaaaacuaagauagacagcaaugaaaaugauccccgaugccaucucuggucuucacacauauucacacacaugcgcauguguacuuguaugcaaacaugcaccugcucauauccacacacacaaacacagucacagcuagcugcagucauguaugguugaugcacaauauauuauacacaguuugaaaguguugauauauauugacccuugugaacggucaccacugagaaaauucucccccggauuuuguguuuauguaguuuuauccucacauacuuaucuuuaccucagacaaucucugguguguuuuuucuuucuuagauaguguauaaaugaaucacaguguuucuuguuuaucuuuauaacuucacauaacauuuuuaauuuuaauuuuuaaaauuaaaaauugacaaauuauaguuguaguugucacaggauacaaaguuaugugauuuaggaacauaguguggaauacuuacgucaaacuaauuaacaucaguuacuucaaauguuuacuauuuuucaggugaaaacauuugaauuuuaguaaccuaaugauuuugaaauguuauacucuaugauuacuuucuauaacacauucaauuucaguggguuucucauuccaaaauuacuuuuagcuguuuuuucuuaacccugugguuauaggagcaaaaaagucaauuguuucuguuacagaaaauagacagcauaauuauaaaaagaaaauacuacuugguggugguauguuaccuggaaugagcauugauaaaacuuuaauuuuacucaauaccuuuuauuguaagccagaaauuaucccaaguuuugggauaaaacaaugaccaaaacaaaccucccugcucugaaagacuuauaacuuaaugauaaaaaauuauguggcggacucauagcauaaagucugaaaacuuccuguggaccacagaaagauggaguaagaacuucauguuugggaaucaugaacuguuaaguucaggacagcaguaaccugugagagagacaggagugacguuauagcuagggugucagagcuaggguuucucuggccgggauaaaacacauacauggccagaagcaagcuggggagggaaggguugauuucacuguacagguuagaguccaccauccaagaaaggcaggguaagagccuuggggcaggaacugaagcagaggccauggaauuacgggguuacugcuuuguuccucguggcuugcucagacugcuuucuaggaccuugggcucaggcgugggcugggcccucccacauaauuaucaucugcaaagucuugcuugcgggucaguuuuacuuaggugcuguuugcuuguuuguuuguuuuuccagugcagugguacacugccuuuagucuaggcagaggcagguggaucucugaguucaaggucagccuggucuacagagcaaguucuagagcaaccagggcuacacagagaaacugugucucaaagaaaccaaaagauuucaucuucccagauacaucuagguuugugucaaguugacaaaagccaaccagcacagaagaaaacaaguuuuaguguaaaaaggauuuaauauccuuuguuaauauccaaauauaaacaaacuaggugauagauggguauaccauagacaagauacauaucaucucaaaagugaguaguaacuuuaaggaauuauacagaaugaaaucaaaaugccuaguaaacaccuaagaguuaaagauuuaauaaggggcuggagagacggcucagcagaugagagcacggucuauuuuccagaggacuggaguuugauucccagaacucacaagcaucuggacuccauucccauaggauucagugcugcuucuggcauucacaggcaccaggcacacaagugauacacagauagauuugcaggcagaauaccaauagacauaagguuuaauuaaaauaguuuaauguuuauugauaacaugauaauuuuuuauuuauuguuuaguauguguuuuucucucuuugauacauuuaauguauucaucaugaugucuccucuacaggcccacagaacaugaauuaagacuuuauaaacaacaagugaagaaacuggaaaaaacccugaagaaaaacauaaaguaauuauauuuugucagacuuucugcuuauaguugggucuuauguuuuauuuuugcucuuauauuuaucagcugcuguguuuuauccuuggcuugggcuaaacaugcuagcuucaaucuauaaaucccagcacugugaaguaugggcaggaagaucacaaauaagagaauagccugguccauauagcaaagcucaguuucaaaaaaaaaaaaaacaaaaaaaacaaaaaaaaacaaaaaacaaaaaaaccaacaacaaaaacaaacccaaaguaaacaauggaaaaggagauauuucugauucuaacaguuuaaaagcaaauuggauuugacuuuguguuuauauauucuugagaauuucaugcauauaugaucauauacauagguacuuaggcagcauuuugacagcaagaucauuuaucagaauaguaguggcagcuucuauccuaaggccucugagcuccugagucaugaacguuugacaaggguuaagcaccaggcauucaauucccucuuguggaacaggccuugaauccaaccagaaagcuguuaucccaggccacuguuagaccagcaggcgucucuuuugugguaggucagugcugcagcauuaaggcccagcugguuauuaaggcccagcugguuagggccauugauuccuuuccagcacccugcauagcaccuccgggcacucugaaagcuagccagcauuaggaaguuucccgcuugguuugagauuuauuucuguauggugccuucagcaauaauguuuagagucuuguaauacugugugguggggccaggggcaaugagaacagccugugcugacuuggagaccucuugggccucccugaccauuaauuccuaggaaguguccaugucuuacccauguauucugggaguggcacuguccacccaagcagguuauuuccauuaaagagguauuuuuuaaaguuguaauuucaaaccagcuacuuagcuaguggacuuccauaggcuuuuuccuauaucuuuaguuuugguuaacuuguuuucucuuuaacccccuaacccucaugcuuacuuaacccuuuaacaaccaguaauuccccucuucuuuuauuucacauauauuuuucugucccuucaauuuuaaauauugaguuguaagauaguagaccuccauaugguuuuucauguaucccuuccuugggucagcccccuugucuaccuccuagguacccuauacugugcaacccuuccugguuaagccuguaugccgcacucucccaccauaccacuggcauuucaccuaugaccuauuauccucugcccuuacuguguagccuucaaaaacccuuucuagcuugcuggcuucacuuaguuuccaaguuaaauacacaaaauauuugacauuaggaacugcauaugagacaaaguguauaauauuugauucuucuaggccuggacuuggucuuauuucuaccucaauugagugggaaaaaaguauaggaagaaaagaaaaaaaaugauuuugaugaaaauuaccuuuagaaaugggaaaauuauaggagaaacagaaauuauggguagcagauccuauauuuuuguuguagguaaguuacaaucugaaguuuuauguuaauuuuuguguuagagauugaacccagggccuuaagcacggaaagguaaaggcucuagcacugagauggcucucagcaugaucuaaaaaaguuuaguaaguuuugucauuuaaaaacuaaaaguacuagaaagcacauagugaaccaguccuaucuaacaccuuuuuuuuuuuuuuuuuuuuuuuuuuuuuaaagaguuauuuauuuauuuauuauauauaaguacacuguagcugucuucagacacuccagaagagggagucagaucucgugaucggaugguugugagccaccaugugguugcugggauuugaacuccugaccuucggaagagcagucgggugcucuuacccacugagccaucucaccagccccccuaucuaacaccuuuaacuccuccuccugcuuuacaaaguaaggucugaggcauuuaaaacgaugaucuuaaguagugauggugcauccauaagauuaucuaguauauucauugauucaaacgacuaggacuugagaaauuugugaagcugugggauugauuauuuugaaaauuguuaguauaugcauuaaauauagaucaauucauuuguguuguugguaugcauaguucaguuuuccagugagagcugcucuuucuccucccuguggaaacacuacuaucccaacugaaaaggcaaggaaaaacaaggaaggauucauugucuaucuacuuaaguuuggggagaaaaacuagacagaauucuagggaaagguuuggaaagguugcauuuagucagugaauaucccuauuguugcuguguuuugucugcacaguaguacuuccuaguaucuauguggcguucuaaacacugggguugcaaaauagaccucauugagaugacauaagggagaaggaucauaaaggaauagaaaaggcaauuuugauagaaccugaauacaauauuaauagugguuuugauaacggcaagcaggauaguguggugggcagaggcaccacaagcauuacauuguguguggcugucgaauucuuuuuccaccaauuaaauaauuaaagggcaauaaaggauccaaaguguagcacagguaauguuuaaaucaaagcaaaaauaguagguaagaacagaguccucugaaaggauagguccuggaguucacaagguaucuuuggcggaguuuuuuauauugauucagucaguaccuucauuaccaguuuaacuggaacucucugauaugaugguuuuuuuuuuucccagcucaggaauuagauggugggcuucaguacucaggcagggaaguuauuuugauuaguugggguucuggauccacgagguagcaagacauuguccacaugccuugcacuuucuucuaaacaugucucucucuacaaguacccauucucugauguaggccaugcuggaauagaagguuuguuuuuuggcccuggccccuccuuuacgauauucaacauccauuuuaagauauguggaguuaacauuauccuggucuccuuuucucucacucucuaccuaacaagugaacuuccuaacuccuacuuucuuucaucaaccccucucaggagguaacccuaacugcagucagcugacagaacaguagucagggucccuccagaagggccuguuuaggagcccauagcagaaaggccuauguggugguggguuggccugucauuuuaguuccacauggugauagcuuucuuucauuguccuauguuuuugguauuuguggcaacaucuaaaacauauaauuaaugagauuaagggcauuauaaugaaggugguuaggagagucuguugcaucucaggaaaggucauugaugagggaaauauguaugauagccagccacagaaccuuggcaugguuggucauaggugauaacaagcuaaggaugucauuuccucccuuguccacuguuaaguguaucuuauugaguguuccuguugacuuuucugagaaauuuguuugccuuauuauuugccagauguaacugagucucaggccauuguacauucaugauuuuuuuuuaauuuuuuuuuuuuuuuuuacauucaugauuuuaaugucucaggguguauuuacaguuagcucuagggauaacaucaagguuaucauagguuauaaauggaccauaaguaggucuguuuuauuucuuugguauugcaccaaauuccagugugagggagugugugcuuuguugucuacaggagaaggcugaucauguuacaguuuucuuauggguuacacccucccagcaagcauuacccauguaccaaacuuuauuccuaguuggaacagagacuaagggccagacaugggagcaaucagaauuccauuucuuuuagggacauagccagacagcaccuuuuuguucacaguuggagauaaagcccacugaagcucauuuuggaggauuguccaucucuguccagugggcaugaugaaaauggccucuucaguuucccauuaguccaguuaguuguacaauaggagauuugcagauuuauuuaaucuaggaaccugggcaguuagagcacaaugacuuguguugaauuuaguaguaauuacuuucuagagcauaguuacccauguuuuuucuauaguuuuuuggcauguggcucugcauuaaggaugguuggccauugucccauagcuaauuaugauuccaucugcaucaacauaguucagagucacuguugaguuaggguacaggcccuucacaguuuuggguuagaaaguaauuuuguaaggccugccuaguucaacuuagccaaucaauuggguuagaauuuucuucugggaguaucucccauacucuacuuuccuccugugauaguaacucuacuccauguccuauucuuuuucuagagaaugucuccucucuguuguggcucauucaguuugucccaugaaucuagugccuaguuuauuaaaaaagaucuacuuucuuuuggauugucagucaguucugagaagucuacccagaauguuggcuccacugaaggguuugaggacagccaggguaaugagaaugggccccaaauauaaaaaugucccaguguaggguugaucaaguaaaaauaacucccauguaggaugaagucugagugugccauaacaguucccaguguuuuccaggccuaaggaugguauuaguacucaaugggauguuggucuaccguaucauuccaauaaguuuagaguuuuuaguuacuggggauucaauaauccaucaucagcuaccagguagggaauuuggggcgggggaggggagcaaugaaugguauaacaguggaccuugcuuaccuuugcaaccuuucuuuagaaaccucuggugaaauguuauugauagcaacacaguaaugagacugcugucuaauaaguauugucuccuguuucucccauagcugaggagaaaagaccagauauuuuauuuugguuauguuaaaggggauuccuaaaagguauugcuuuauugauugaaguuccagauaucccugaaaaaugguccccuuucuaaagaucuagaguaguucccucccacucuaaaaauuggggcaguccugaauuugauucaaaucugauaaugaagaaacguccauuuuggaggaagaugaaagcccuauauuuuccaaggucuugugaacucagguuccuggguaggacauggacuauggggaggguggguauuggaguagucaaaaaaaucaucugggaguaaagcagagugauuuaaggggucaucccgaauuaugggaaaaguuacaccacaaaguaagguaggcacaggacaagugagauauaaacuaaaagcuacagcaacggugguaccuacauaugcugcugcuuugcacacuuaugaacuuaucuuuuguuggaagacaguuguuuaaagagcagcuuaagguccgcaguggcucaugagaguaacuggaaugaguuggacuuggucucaggauccauugauaguguaggagaaucagggaaaguaguuuauguuuaagacuaguguggugaauucaugcauccaguuuugcuguucaugcugcuguaauaaggauagaauaauaggauaugggcccucccacagugggugagugagauauucauuuuaaugaggaguuuuaacuaaguccccagaguagaagaaguggagucucugcugcuauucuugagaaagcccaacuugagguucuuggcaguaauugcuaggauuuugcuaauuggaaaacaugggaaauuacauguucuggguccaacgccauaucaucaguaagaaauggccugcuauguaguaccucaaagaggauuaggcucuaauagggguguuuuuaagccugauuagagguguaaggguaauuuagucuaaagagaucugguuuccuggaugagccuuuuuaaaugccucuuuaaaagcuuauuucccagagccaacaugaaaacugcaacugagggaguaagagugguuauagaaaagacaaaaagaagaugcaagagacagguauggagggcugcaggcuaauaccaugccagcaguuaguauauuuucucagugucuuuuaaaggcaagcaacagaaaacaugagcaauuccaauuggccaugucucuuuuucagagaguuucaagaaaacucaaacccaagccuaugcuuagauugaauggaucucugaaucaaaggcaacuuuuaaacauaaagaaggccuuaacuggggagcacuagcacugagacugcucacucaagucaacuuuccccucuauguaaugagagagagagagagaauuauuagaggucacaaguacuuuuagccuugaccauaccaaaggauguaacaaagaugggucaggaacauguguccaguacagcuucccuguugccauagucagggcacucggcaggaucacagacagcaucauucuuuguccaagcaucagcauaucucaccaauugcucuggcagccacccuaaucaaucaaucucucuuucucucuccucucucuuucucuucucuccucuccuccuccuccccuccuuccuccuccuccuccuccuucuuccuucuccuccuucuccuucucuucccucucucucucucucucucacacacacacacacacacauauuacauaggguggaaaguugaguuggguggccaauucaccauacccugagauccaaaucauauaauaucuucugacuccugggaaggccuucaauuauuuuagagucuugggaaaugggaaggacagaauugguuggcuauguucuagcccuaggacuuggauuccuccuguuagauaugaccaggauaagcaacucuggucugguuuacuuguaccuuguccuaugucacccuuuauccccuuucagcaagaggguuaaggagagguucugugguccaauagaaaaucuccuuggagaagccguagagaagaccaucuguguauuagaauacaauauuggaaugguccaggauggccccauuccauuaaaucuugggaggagggcugacccaaaaaagaauggacuaucuugaaaccuuugcaggagcacaguccauguggccugucuagcccuuugaguaaguccucaaagacauaaggagguuggccgcugguguguaugggaaggcaaagugaagcaucauugcuaacacacaguugugaauggugcagggaggaaucugaaucaggagggagagggauuggaguuacggaguagagagagacugcuucauccaugcgucuaagagcuuggcucauuuccacuugcuggauucccuuccuuacucucaagauaggguucuuagauggauuugaucauugaauuaaugaucccuguuuccuuaauauuuuauuaugaaguauagggguccauauuuuucaugauugggccaauucagggugauccuucauauaaaagaacaauauggcaucuuagcccauuuucugucuugaguggaguguugguuuguaauuuaaacugccaggaggccaggauucccagucacuuaguggguauucuggccaggucugguaggguguaggguggggaauccucuccuuaaggcucugaccgucaaucuuacuccaguuuuguaagagacacagcaggguagaauuugaugugaucuuggacaggaucaaaucuaucuuaaaacaacagcaauaggagcauuccacagagagagacaccuucuccccgucuccuccgcccugugccuggagggcugccucgugccuuuagagauuacuucuaacuugugaccuauuggaaggaacuuucccagugacaguauggcuuauauuuuacauccaugcauauguaaaguuugcacacauaaaaguaaaaagauaagagguuuuggggaggccagcugccucacugguguaaucauuuuaguuuacuaaaaggcuaaggaagcauuuuuauuaccuugauuuuuuuuuuccuucuuuagauuacaagaucuuauuggucaaaaaaagucugaugacacggagaaaaaagaugagcccagcaaagacagccaucagcaggcucucauugagcagagcuacuuucagguauuggcuggcugaugaaagacugguguguguggugccccuugauugguugcagugugauacaucaccccuuuauaaggaaugauugugcugcuugguaucugugaguggcugguucugugguacuuacagaugcccaagucugcaaaaucccucauauaauggcauugugugucuugacuugaaugugaaaugucccuuagaaguucauguguuugaccauugauuuccauccauuuagaaaggugguagaacccuugggagguuggagccaggcuaaggaagagagucacugggaucaggcccuguuggauagcuuguccucguuucuuguuuauucuuuacuucugaauguggaugcugugucaucugcuagucuccagcucuugccaccaugccaccaugccaccaugccuuccaugccugcugcuaugucuuuccugcuaggauggaauauaucuuucuacaccugugagccaagaauaaacccuuucucccugaaguugcuuuuuucaggguauuucaccacagcaacagaaaacuaaggcacauaguauuuuccuguaacccaccuacaucgucuuuauaauaucuacuacaguguaaacccuguauaacuauuguuuaagauuuuuauaguuuuuacucucaucauuuaagcuacuuacccuuuuauuguucugguugugguauuguuguuauuauuauauaaguaaacuuucagaucuuuggcuuucauuuagcucaaacuauguaaugugaaaauuaacuuuacuguuuauuggauaaauaauuaaucuaguaguuuauugaaugaagugggcuugaacugaaacauuuuuuguuccccauagauuuuugucucucuucucuccuuucucuucuuucucaugccuuuuuuucauucuuucccccccucucuuucccucuuucucucuucuuucuuuccuuuuuguucuuccuucuuuucuuuucuuuuccuccgucccuccuaccccacccucccuucuuuccuucuuuccuuucuuccuuccuuccuuccuuccuuccuuccuuccuuccuuccuuccuuugacuaggcuagccucaaacucacagaaaucuaccugccucugccucuugagugauggaauuaaaggcaugccccaccaaccagccauagggcuuuccauuuugaauuaauugguuaugaacagguuguauuuuuaaagucuuguaauguuucaugucaguuaugagaggagaauuguguuucccuugugagggcggagcuuguggccuugagaagcuacacucgcaucugccuuugucucacucugcuaugccuguacugccucccucugugcacacuggagucuguagccuuagaaucgaccauguccccccuaauuuacugacaugacacuuugaucagacauuaucucuguuaacacacaccuuuauuucuaaauucugucgucugugccacucuucucaguuaguucacccaccaccuuccuugugguuggugucagagaaaagaggauugucuuccugcuuugguucauaacuuggagaagaauauuuuuuaguuaauuacuuauagaugaguuuauaauagaauuggaauguugaaauacuuaucaaugaacacaaaacaaaaacuuaugaacaagccugagaagucagguucucagagcaccuguuugcuguagcuuuuccuggacagacaacuaccaguauuuccuacgagcucuagaaacccuguacaggcauucuuggagaauccugccugggggaggacuuacagcauuuaugaagaauuauugggcuggcuggccaggacuucucuauagagugagugugugaggcuuuguuaguaacucucuuuaccugaaauuuuaacugaaauugugaagcaaauaaaaaagacccuuuaauaccauacuuagcuuaaauaugagaagacagaaacacagaaacauggagacuuagguaaugaugucuagaugguuauuauucuguguggauuauaacagucaaugacagcuuucaaacccaauuaauuauuaauuaaaaauuauuuaguuuuccuuagaauuuaugcauuccuguggagacugcauugccucugucacaggugucuggaaaugauuugugggcaccugacacacaccuuuguuguaccucacuuugucagacacagacaacucucauagcuacaaauacugcccaugcuuacaggugcugugcagcaucaauucaauuguucacaacccacgagcuccagugauuauuuauaaacagagcaaaggaagagccccaaacggcaauaaagauauuggucaagauuguggauuugaacaucuuguuccuauaauagaaauguggguagaugaacugacauccuuaaagguaaguagcugaauauucucuauauguuuggaaaaucuguugggcuugguuuuuguuguucuuuauaaagcuaaaaaaccccacuuuucuaaaauuggaauauuguugcuuucauauuuugcucuguuuuguuuuugagacagaguguaacuguauaguccuggcuggccuggaacucuuuauauagacauguguggccuugagcgcacagauaaccaccugcuccugacuccugagugcuguaauugugggcacgaucgaccaugcuuacauggccuuacauauuucugauccuguaaauugcuuguuuugauaagcuugccuccuccaaaauuccaccacagaaaacauuuagaguuuuucucacugagaguuuguaguggauucaucuuugcacuucugaguucuuccauacccugcauccuccuccugcugagaucugugcugcacauuuccugaccuuugcacaugcucggaucaaugucuuagccucacuuucaucuuaauggggaauauuuuuacaaucuuaacauuuuauuuuucuuugucagaacuggguuuauuucuguuuguuuaaucucuagagaaguuguguuaagaagcaacuaggaaauuagauauauucacauuugauuuauagaucauuuuauauuuauuguguaacuugagcuuauuccaauuuuuuauuaguuuauugagaagugauuuguuauaaaguuaauaguauuguauuuaugccuuggauuuuuucaguaaccuauauuauauacaauucuacuaugguuaauaaagauaugauucacugacaacauuugucagcauuuugucuuauuacccgaagacacuugcuaagaguaugugaccucuuuaggaacaaaaaguuguacuuguucuuauaugccucaaagcucuucaugauacaaauuaauccguauuauccagaauaauuaugguuccagaccacuaaagggguuuuuuguuuguuuguuuucuuguugcuuuuugucuuuguuuuuuguguuuuuuuuuuuuuuuuuuuuuuuuuuuuuugguuuuucgagacaggguuuaucuguauagcccuggcugucauggaacucgcucuguagaccaagcuagccuugaacuuagaaauccaccugccucugccuccgagugcugggauuaaaggcgugcgccaccacauccggcuuuuuuguauguuuuuaaaagauuuauuuauuucauguauguggguacacugucucugucuucagacaacaccagaagaggacaucagaucucauuacaggugguugugagccacuaugugguuacugggaauugagcucaggaccucuggaggagcagccaguguucuuaaccacugagccaucucucuagccuuuguuuuuguuuuuuagagacuggguuucucuguauagcccuggcuguccuggaacuugcuuuguagaccaggcuagcuucauucacagagauccaucugccuaauguuggaauuaaaggcgugcaccaccacaccuggcuugaguuuuuuaacuuuuaaaaucauaccugugcacaaccuaugaaagagucuuggcacucaaccuaacuuuuauuuccuuuuuucccucuuaggguuuagacagagccauacaauauauaagcauuuggucgaaugacaguccugaauuaauacacuacuuuauaugcugaguuucuguaauuuguuucccagaaaaggguagaguggagauggcuucuggacacugcauaucccacucagugcuuggcccagagcucacuguagggauaacagugcuagcucugccuuccuccuuuucagaagaguuagaauagaaacagcccuugccuuuccaacagaaaagaaaaacuagagaaaggaggcaaagggaggaaccaaauuuacagauaccauuauuuuucuaugugugggauggaaaaguacuacaaaacuaugaacauaaaacucagauaacuagacagacaaaacaugcuaagccaugagcuuuuaaguagcucugcaguauauuauuagacauaacaaauagaaugaagauggccacccuggugcacugcaggugaaugaugugggcgguuucuacuccagagucugguagagagggcaucacucugagcaucacccaagcaaggcguggcaagaaugcugcccucugccuacuguguacuuuucugaauaggaggcaagaaauuaccuuuacagguagaguauugucaggacaccugaggcaauuggcuagaauugccacugaaguagcucauggccuuuaguagugcuucuaacauuuacaguacagauuccagauccaacucagcacaugaaguuggaugagccuucauauggagaguucagcauuuggcccuauuacccaaagucaugauacaugagugcucaauuaguauuugucuguauuauccagaauaacuguaguccuagaccaguagagggccuuugaggccuccuauggagaguucauuauaaugaagcaacguucuaguuugggacagacaucucccaagauacuguuuauccuuagggucugaugugaccuaaaagagaaggaugcacuugagagaugaguagaaaggagaaauguagcagugugugguauagacgccucuagauuugcauauuuauuuuuugagacaggccucacuaugcaagccuggccagccuggaacucuaugcagacgcagcuggccuugaauucauagagggccaccugcuucugccucccagugcuaggauuaaaggcauaugucacuaagccuggccuuguauguuauauucuaauuaacauacaaccauacauguaugucagggacagguugacauucuaauacagugaguagggaucuguguugagaacaucagaauucucagacauuuuaaaagaguuaauuuuugugagccuuaguuacccuagugugguauagaacaaugcaaauuauuucucuuauccagcugcaccucugugucuguugacuauccugucuccauuccuucugacucacacccuacucaggcuuugguaacuacuauaagauuaacguuuaaaacauuuaccaugaguauuuguguauuuguguguuuuauuucacuuaacauaaugucgucuaguucuauccauguuguaguaaaugacaaaugccauuauguuuguggcugauauccugcuauaugaguaugcauguauuuaugcacacauacauauuuuucagccauagccauucaucuaucauuggauaccaacacugagcccauaucuuggcaauucuuaguagugcuucaaugagcguguacaagcuagcaucuuugauaucguuucaucucauuuggauguguacacauggcugugggauuguuaggcuaugugguagcuuuauuuuuaguuuuuggaggaagcucuuuauacuguuucauauaaugccuguacuaauuuaaauuguaaucaauaauaaaugcagaggauucucaaaagucagucagucauacauggccacuuuuauuauuucauuuauacaaaaugccaggaauaggcaaauucauagcauccggagaggauuaguaguuacagaggcuggaggagaguggaaaggacugugagugggugggggaauuucuuuuuuaaucuuuauucuuuaaauuucuuauauguauggacauuuuugccuugguguauguaugcuugugcaccauaugauagccugguucuugagaaggucagaagagggcuuuagauccucuggaacuagggaugaauggcugcgaagcaucaugugggugucaggaacugaaccuggcucuucuuguaagacaagugcucugacggcuaaguaugucuccagcucugggugugggaguucuucugagaagacagaugaguucugagcuuauacagugaucuguuuuguaccacugugaaaagaugaaaaccaucaaacuguguacuuaguaaagguuaauauuuugguauguaaaucucauuccaaaauugcuacaaaaauauuuaaaauguagacuagaaauauggcuccaugguaaaauauuugcuguguauaugugauggaaagccugggcuaucuccaacacugauaaaauaauuuuaaaaaacaauauaacuacuuaaauaacauuauuacuuagaacauccagacuuguuuuaaauuggcaaugguauuaaaaaaauacuaauggugguuauuauauagcuauguguuuuuaggcccccaugauuacugugcuauuaguguuacuauauaaacuauucuauaaccaguaaugccauguaguuucuuuuguuaaggauuuguauaaguccuugaaaauacugucugcagaacuggugccuuggcauagcuuaaagaaacuggaugaaaaggaaggugucaaagucggagaucuguuguuuaugguggauaccauguuggaagaaguugaaaaccagaaagagguaacguuugauacuuauauaauuguucucauuuuaaaggcuuaugucaacuauuuaauauuauuucaaauuguaaacuacccuuucgccuucuuucuauagaccagcagcacgccgaacucucaaacuuugcaagcuaucguuucucacuuccaaaagcuauuugaugugcagucuuuaaauggagucuuuccccggaugaaugaaguguacaccaggcuuggagaaaugaacaacgcuguaaggaaccuucaggagcucuuagaauuaggugaugacccuuugucauuuggggaaucgauucuagaauuauucugaauaaauuaaaaagaaguuuggggcuugguuuggguuugggguuguuuaggguuuaggguuauccugggauuugguuguuuuggggggauugggguugggguuggguuggguuuguuggguuugguuuggugacaauguugccuuguucucacuguagccaaagcuggccuucaacuccuggucuuugucuuucaccuuccaaguacucagauugcuuguggguaccaccagaacuccuauuaauuacacacaaagacauacacaacaccaaaaaacaaaaccagcgggagggauguagcuuaguuggaagaugcuugccuagcaugcaugaacucuagguuugauucucaguacugaauaaacagggugugguggugcacauauagaauccaaggugaugaacauccucaggagauggaggcaggaggauuagaaguucaaggucacgggcuguaagagcugccucacugguuaugaggccuugcugggaacuuguaaggacuggaguucaugucccagcacccauauaacagugcagacaugcuaaaucuccauaacuccagcuccaaggacuccagcacucuuuucugguuuccaugugugcaaacacauuugugcgcacauguauacaugugcacacucauacacacuugcaaauaaauccuuuuauuaaaguucaguucaggaucauuuuuugauacauaacugguaggccagccuaggaaucaugagacgcugcuuaaaacaaacccucccugggcugggagauggcucagcggguaagaacacacucucugcaguccugaguaccaaaaguagcaucccaagcuggauagcucacaagugucuguuaccucgcucuguggagaauggaaacacuauuauugagccuagccaagaaaauguggacuccaggcucaaggagauagugugccuuaaagaaauggcaaagggugguagagggcaaacuaauagaaaucuuaaucccucugccacaaaaauaaagugaguacaacugaaccagggugaguguaaugauuuuggaaauucuuuaaaaauaucuuaugcuuucuuuucucuuuugcagacaguucaucaucauugugugugguggucagcacaguugguaaacugugugagauaauuaacaaggaugugagugagcagguuaaacaaguguuaggaccugaggaucuacaaagguauuuguuagaaaugcaucuagaguaaaagcuccaagcucucccagccccugacuguccguguuggcagugacagggcccagggguccuugaacucuguguagaucaggguggcccugaaccaaaaaagagcugccugccucugccuccagagugcugccaccaaagaugugucacauguacucaagauaaaaacuguuggggcuguaagcucacaaagggauguugggaaguuuagcagaacucacccuuggggaaaguuguauauggagaaauuaaaaucuuuauaaccaauucuugaguuggauuauaacauauaauuuauuucuaggacacuaccaaaacuaauaauuacuagucauauuuuuuuguuuagaagauaaauauuaaggauuuuuaaaagacuauguaccaccaauguaaaaaccugauguuuuaaaaaguacauuaugagaauguguuuguguguguauguguguguauguauuguguuuauauauaugcauauauguauaugcauauauguauaugcauauacauauaugcauauauauaaacauauaagacauauauguauauauaaacacacacacauguaucaucuauauauucugcauauuuuccaguaagaacccuuauauaaucuggcaguugaguuuuucauaccgucucucaggccucuccgcuccuuccauuguuuuacugaccacugguaccuucuguucaguugaauauuggguaaagaagccuauuucuagcagauguucuaaagguggugcuuuuuuguaaacuguguauguuuuaaacaguauuaucaagaaauuggaagagcaugaggaauuuuucccagcguuucaagcuuuugcuaaugaucuucuugaaaucuuaggugagaugucuguugaugguggcugacucuuucuuggaagguguugguggauuugaagggguauuccuuagaaauuagguucaugucuuacucuagguguuuggaaaguaauaacuacuuugcaggaagacuugguuaggauuaauuuacagaauagaaaaacagccuauaaagaaauaaaaacuaucuuuuucuuuucuuuuuaaauauuuuuauauguguauagauauuugccugcauguauguauggaggccagaagagauggucugauacucugaaacuagaguuauagucaguuagcuacuguuggugcugggaacuggccccagguccucuuauaagagcagcaggugcuucuaacugcugagucaucucuucagcccucugggacuaucuugagaaauggcauuauuuugugagacucuggguucuaucauuguuuauuaaaacaugaccaagcaaaauaagcuagaaaaauguagagccugcugcuuggaaccuuccaagggauggugucuggcuaagggaaaguacuugcuuccucugagaacaagagcuuuagagagugaauucuggcucagggucacugaagucugauaccuuaggagaaaaaucaaucuccgaaagaaccggaacugcuguguccggaaguucauacaggauaggcugugucccugaggcuuguucuaaggugucccacaccucuuacuggacaaaucuccccaaagaaggcugagaacacucugagacuagaagaaucaggaaggagcacugucugugagaccugcaaaagagaugcaugucuucaaugucuaaugggacucauguuggcuugcccauguagcuguacagagauuuaaagagagacaaaggcaucauaaacacagccaacuggauguguuacuaagccugugucugguaagauuaaugccagucaaugggggcgcugcagauucccugugaauccccugugggaggcagugguagucugcagccaaccugggagagaacccugugcacaacugagcacgcagcuacugcugcccuugugugugaaggcggcuucugcggagagcgucucacaucucugagcuuugcacuggaaacaucgcucccuuucuaauuccuccuuuuccuguuacagagauugaugaccuggaugccaucguaccugcaguaaagaaauuaaagauccuuucauacugaaaacaaaccaggucaacuucacuguguaaacugcauucguaacauucuaagcauuuguaaaggucugauccugagacaaggcuguacacaaucagcucucagaauucauccucucaccccgggucugcucaacccauauaauuuuuauuuuugauuauuuaauaaaauguagcuguuaaguuauuaaaauagugaguuaacuuuagauuccuuaaucguuuccuaagcaaugcuugagugcuguaaaauguaaggaagagauuguggguaacaaaagagacauugcaaaguacagaaagucgcaguuaacuucaagguuuaaugacccuuuggucagagaaaaaagaaugccaguugcuuucuaagcccaacggauaggaagccucuguucuccaggcaaggauuagugggcauauucuauaagaaaacuuacagcuauugcccugucaaagcaagaaggaaagguuuugucuuuguauuaagauaggaaguuagucauggagugaaauagaugauuagguagaaguguuucugugucuuuauuugcaauacuauguaauguacuuuuauaaagaaauaagaucacaaauaaaguuuucguaaagaguuuccaaac

SEQ ID NO: 5266 - RNA, 5042 nt, Mus musculus
guuacuuuuuugcaaugacagauugucuuuauucaaaacgucuuuguucaacaaaugaacagaggaaugagggaaaaaauccuucuagguacauuuccaagacauuguccaaacauuuaugaccauguaggauguuuauuauuauuauuauuauuuuaagguuuuguccacuuucuacuuccugacuucauuaccugacauucugucuaaaaguaaacuuaggugucuaggaguacugcggguacacaaagcgaaaagccacgugguuccuuuuuguuuucuuuuuaucgaagcaaacacgaccauaguaugguuuuaaacagaaagguuucccuuccugaaguuuuaaacuuuuaagccuuucaccuccccacacacaggaagagcaaauggugccuagcugugucugacggcacagcaccaagacucagcucuuuuucuucagugggaaaggaaaaaauauauauauacgcauauucuagauauaauaccaggaucugggaguuccgaguccaaagccuauccgcggacagugagggggacguaaauaaagcaaaacugccuacuuuuuuuuuuguccaaaggggguacagucgagacuugcuuugggagagucgggagaggggaagaagauguguagcuuucuaaauguuugcaaauuucuggcaccagucugugccuuggguccaggaugauggcccuucccuuccccccuggaagagagaggcagagucuggggugggcaaggggcagcggcaggccugacccagaggcaucugcgggccagacuaggugcaaaggaaaggauucagaucucugcuuccacgcuacccaucagguccgggccaagcuugggguuacauggccguagcgugggcugacgaauaagggucuaugccagucuuggucaugccugggaagaggauguaggcgacagggggcugcaggguggaggcagaccaggcgguacaguuacagggcaccacguagcccggguuggugggggacgggugcgugugcgugugcuggcuggggcagcugagacugccgaaggcgccguucugauagcccaggguggacgcguagggcagcgcgcugguggccaacguguggggcacuucacccaucuucuggauggcacuggaacuaaauugcgcaggguccagcagggaguaaggugccgaggcaggcggcaagaaggcccgggcuuucucgggcgcgcucaggaggccgucggaagcccccacgggcaggccggccgccuugagcggguccgugucgcccagguagggcagggggaagacauaccuguccuucuugagcagguucuucggcuugcgccgcggccgguacuuguagucagggugcuccuucauguguugggcgcgcagccuuuuggcuucaucgauguaaggccgcuucucugccucggacaggagcuuccauucggcgcccaggcguuugcugaucuccgaguugugcaucuugggauuuuccugggccaucuugcgccgcuggccccgggaccauaccaugaaggcauucaugggccgcuugauguggucugaagguuuggacauggucccggcgaggcgggcgggggcggggaaugcaggggcucugcgggcgagccugggcgcgguuggccgucugucuuucuguccguccugagcccgggacucugaacuccccucgucucggagccgcagaggggaaaucagagagaagagcugacccugcaaaguuuucaacugaucaugccagucccagcccccaggcagcccccagggggccgaaggguaggaagggcagcggggaugagagggcgcucggccuggagucugugggcaccagagauuggggcccaaguaccagagucuugggauuaaguggcuagguaauuuucuggcaagggcaggagauuccuccuucgcucccucuucaccuucgccuucucuccuucccgucucuccccuggcuucucuggccguggcucccccccucccgugguuuccgggcgcugcuuugccuagcacugcaccuggccgagaaugcggggaggcuggugaacugcagccaaaagcggcgaaguucaaaggcgaggugggccgggaccgcacgcacucugacauaagcgcggggcggcgacuccccaaccugggcuccaaucagcagcagggaaggcgagggggcgcaccugccaacucgcgaguaguggaaacccggagcgucccugaugggggcggggagagguaugagggacagagagaccgccaccgcgaacagagcggcuugauagcucaggauucggggcggggguucacauugucucuggcacugucaaaaaauuaaaacucuucgugaccccuguuuuucuuccccaguuguucaaaggagaaccggugcuucuaauaauauaaagacccaggaagcugucagccaagccagcaagcccagagcucacguagauaaauaggacagucccgucaccaaaugggaagacagcacccucuacccccaccccgcccccaacaacacacacuugucaaagauccuugggagaggaaaagaauauaucaaacucaggccaaaaccaaaauaaacuuuucgcgccagaacaucuacggugcuuugguaucauucucccagguuggcuuuaggcggcgccuccaccuguaauccaggacgcucugcggagcaguucugggucccugggggucggagccaagagcuuugagccgagaccaggaugcuucaugcgggcuucgcagagguuuagaguccugauuggcaagcccuuaacacucuucacuuugggggcccuugccacuaggacucuucacuuugaggguugagugugguaggcagagguccauccugauucuuauucaccuauguuauuauuauuaggcgauuuaaaacucgaagcuucccucaacguccaaacugcaagggcagagggaaggcggggcuuggggaccuuccuggucucucuucugcgccugcagcguggagccucaggcuguacccucuuagcuagggucaauuuuucucagggugccuuuucccacccagugaggaugggggcucguuucucgagucagaugagcauucuucggguaaagaggacgaaauaacccgccgagccaaccugcgagccuguuuucuuugaauaauugccuggccgaugcgaaaugcccuugggggaaauauuuauuaaauggaaaccauugucccggguccugaaggacuggaguguguuccagacuuauuggcuuuugcgcuagccagucucucccgggaggaggacaggccgaaaugcccacggcgcagucggcuaccagaagcugcgaguggggguaggugggcggcaagaagggagggccuuuuuuuuuaauguaguguguuguguuugaaggagagaauuuauuuccgcuuccuaugauugcaaaaacgugggggcggggggggggcgggaaaucggucagcuuuagggcuguucuuaacaguguuggauguuauucccauuucacagaugaggaauaauuuccgggagaacugaucuucauucugauuuauuuagaggcagcuggagccccuacuuucugagaaaacuuucaccucuaccuggggaggcuaccuuccuauuguaaagcagauacacaacauuugaauuccuccaaagguggcccuucacucucagcuucucuccuuucuaccucucuccuucccucccguccccuucucucuccucaccucucccuucucuucuuuccgcuccccccuggcccccaccucccuagagauuacuaaagcagaaguaccguucugcgaacuuccaggagaauuucaacauuuagaagccaacuccugcuuagaucucaccugcuacacuaggggauuggagauccagagauacuaauucuacugggugaugguagcugcuuuggaaagaaaugagagaaauaaccguguuugcagagugaggacucaccagccacacuuagagguuuaggccauuguaguacaacuucucaacuucuuggacauugcuuaaugagggaucugacgcugggucucagguucuuuuauucugagcuggcuuccuagacagucuaucuaguugcccuggagcagucugggacuggagaguacccuuuuccaauucuucuuaguucuucuuucuccucuaguagauggcucucuucuccaauccucucaaaucgagcccugaguuggaacucaauagcuacaauucaagagcuauccuccaucggaagaggacguaacacaacucgugcaggcuggggggaggguagggugggggagggguuggaugcgguuuacucaagaccccuuagcuggaauggcagggguucuugggaucuucaauuccugugacuauugcacugcguggucuuucuaaacugugccuccccagaaagccuagaccucauucccuggacccauugcagaguccugcuccccacucucccacucaggggagcgcaaaaccagaaguuuggggcacaacuuauccagacauuaggacauagguaaucuaaacacagcuucugcuuucccaaagccugaaauucuggccucaagcuaucucucuacacuccagggcuagagguaccucccuccagcccccugugugugcccucccuccucuguguggccuuacacguugccuagaaaauccacacucuuaucaguaugggccucuuuauuccacuccguugcucaagugcuuggcacaccaaccuuagccuaacugggaaacccugaguuugagauaaagggccaagccgaugucuaaguuaaggaagugggcuccgaagucaggagccaacccucuucugcugcuuacagcuguaccaggugcagguucuagcacuccccuaggccucuguugcccuagugaagugcuuuggagcuuugcacacccggccucuaggcuuccuagagggccuucuuucaccagcuugagauaggacuccauggguccaucaaaugcagacugugcaccaucgcccaug

SEQ ID NO: 5267 - RNA, 53845 nt, Mus musculus
cgguugcgcgcgccccgccccucuccgagagcuacgcggcggcgcagcacaggccucgugcgguaacggcauccgggcagccgcgguggcgucccggugcgguccucaggugacuggagccgagggcucggcggagggaaggugagacggccucgcucgcgugcggacacacgcacaguccuuucggucucccggucgguccgcucugccugcuagucucuagucgcuuccucuuuccccggcgaaguuggcccgggggcgccgucugcuggcggcggagcggagcggagggggcggggaggccgcucggcggagcucggguguccgcggugcagcccggugaccccgcggccucuggccugagcugcgagcgccggucggggaggcgggcaggcaagugugcggcgcgcugccucggcgguucuccgcagaaagcccugucggcggucugugucgguguccgaggccgggacgguaggcuggcaggaagggcgcucucaccuccagccgccagccugaggaagccgagaggggggacauccucggggcgcgcccuccccucccccucccguuccggagcaggagagauguggguguccgggggcuguugaggugggguugguccaggaaaagcaguccucuggguugguuucguacuguugucguacggguuuccgugcuaggucgguucaguguuaacagcuggguuggaaggaagcugguuuuuuguucaggguugaggaccguaacaugaccgguuaacgucgagccgagcugaagucacccgaagaaaaauacugcccuuaguuaggaaagaauucacaggaguuaggaaagaacgagaugaagaaaacuuccugaccccaucuuggguggggagcagugagaauccaggguucggccaaaaaaacgggucaaguuuugcaagaagcguuccauuuucaaaagcuuugguagcuugaugaugaucaaucagccuuaacgguuucuuaagcaccuggaaaucaauugugugcuuucagccuuuagcgacgucacaacaugaacagagaaauaguccaaggagaaaguuuugauugaucauuuucagucuuguuuuuaaauagauauucucuucacaucgugauaguuaagucaaagcguaugcguugguugauuaguacuuuuuuuucaucguggccacauguggugcuuucucugggaaaacuucuguaggaauuggcuagaguaacuaaagcguacauuguguugaugucuccgcuguauguaugagcauuauguuugaaaagauuugccuccccagcaagcauuuuaaauuguuuagguuuccaagcccaacagauccguguauuaauaagucgacacguuaauguauugccuuauuaaacauugagugauaguuuaugcugcugauuuucuaauuugagaacuucguucuagaguucaaggcuuguugugauuauuauuguaaauaaauuccuucucaggagaacuugaaaaaaaaugaauuaacucuggcaauguggaagaauggaugcuuucaaugccagaaaaucaaaugauuauuucacuguuaaguaaaauuggaggaaacgugaacugagcauuuaacaaauccaacaguuugacgacaauuugacaggccugccugauucucacuuuaaccuaucaaggaaauagaacuucaaagucuucccuucacaacugaugccccacgccuccaagcugucuuucauuagcgauacauuaguagcaugcuuucaggaacccagacauaaaccuuaacauuguacuguuuuuuuguaguuguuuucuuuaaaaaaaaaaucuuaccuuuguauucuuauauauuguuuuucaguuucugaacuacucaguaacucuaacuggauuuucugccuggaggaucucaaauguguucugccugugcugaucuuaaaauaauacuuugaacauauuuuucacuguuuagacacuaguaauaucuuuccucuagauuccagucuuuuaaggguuuauuuuuauuuuauguguuuuguaguguuuuguacgacaugugcuguggacucuggggacagaacagagauccucugcaagagcucuuaaccacugagccaucuguccuaauacagaaacauucucugcaaacuacuaacuuugcaaaggaaaaguucgcuaagcuuuccuucuuccuuaauuuccuuccucccuuccccgcccucucuucucuuucccucuccugucucuuuugccuucccucaguuuuggggugagaccaauggcuucucauaaaccuuugagguguaucaucagucuaaaguucuauuuuuuaaaaaagugauugguuauuauauuuucuacacccagagucaggacagcuugugaggggucaguucucugucccccacagaggucccaugaagugaacucagguuuuuaggcuuggcuguagguaccuuuaacuacagaggcaucuugacacccauccagaguuacauuguuuuacauauuguuaaacauuuuuaaaaagugugugcuuguauguauguugagggcaugauaugugcacaagaggcaggugccugaaaagggaggccaggagaaagugucagauacuuacagggggucacaagccuccuguuguagggaaucagccuuggaucuuuugcaagaaccauacuugaauuuaacuggagacaucuuuccagucccuagaaauuuaauugugauuugagugaagguugucaagauuuucuguuaccuauguuaaacugagucuuuguuuguuuguuucgcacgcccucuuucuuuuuaaguuagcgcacagagcgguguguuuugugaugacauuugcuuguguaguuauugcugugcuuuuuucuuaaacauccuuuccccagcugacuuuuuuuuuccccuugcuuuuuaauuuuauauggauuugugucaugauaucauggaacguuguugaaacacuggaaucuagccuuuuguuuucuagauugagaacgugaaauccaugcuaaauaucuacugacauguccacaucuugauguuggggcagagcugagacucaaagucaucuuauucaagugucauguguucuuuaugauaccauauuauuaccuugugcaauauguaauuuucauuuuguguuuucccccuagagauccaacacuuuuauuuugaggugggcucucaaaucguugcucuaaauuguugcucaaauuuuguucuaaugugaucuuccaucuccugauuucagccucccaguagcugggauuccgggcauaugaccuuuuaauuuguauuuuucagacuccauauauuagaaguguuaacaaauucaauugucuguguaguugaguccuguagcccccuaagaaguguaagauggugcuagggauguagcuccgugauggacagagggaguuuggauccucagcaccuaagaggaaagacagugaauggcugccuuucagguuuuacuguuagaauuuauuuuccuugucuuauuugguaaaaagaaugacucuuugggggauuugaaaggauauugcaaugguuuggugggagcuuggaggguuuaucauguaucuaaauguuaugaguuaacuaaauguucuuuucuggguguuaaaacaguaacacuuucacauuuugucugucaagaaucaguuuugcagucugcuuguguuaaacacauuguaaaaaucacuuuccauuuuguagaguuagagcuuuuuauuuuuuuaacucuaaaguuuguuaauaaaagcaguguuggguugccuauaaugaguucagugguacaagacagcacagaaaacugccagguaaagguuuucugagucuuuuugccuauccucccuuuuuuuguguguguuaaaagguuucacuguauagcccugguugagcugaaacuuacuagguagaccaggcuggccucagauucacaaaacauccuccugucucugccucccagguacuggguuugaagguguacuuuaccaggccucacugagugcuuccuuuuuugaucugaaaaagauuagaagcuuuuuuuuuuuuuuuuuuccagauauguuuugguugguuaguauggcuuguuuuuuuauuuguuuaaaauaaacugccaaauccuagaacucagacugaggcaggagaauuacagguuugagguuagcuuggacuauguaguacagucuuaucuuaaaacaaaauuacaaguuaaaaagucuuuuuagccugguauaguuauaguggugcauaccuuuauucccagugccugggaggcagagaagcagggugauuucuugugaguuagaggcuagccuuaucuacaaagcaaguuccaggacagccagaacaaacaagagaaacuccaucuugaaaagcaaaaacaaacagaaaaauucuguugaaaaugcugauucuuauuuauuccugaaauuaucuuuagugaugugcaaauuauauauaaauaugguaugggugaugucagcguuucuugagaugauuugaauaaaguauaucagugagaauguguggaaaauuuguuucaggcugguuuugaacuuacucuguaguugagggugguguugaaccuccugaucuucugccuccgcgucccuuaaguggaggccgucuuuguguaugcagugcuggaucuugaacucaaggcuuuguucuugcuaggaaggcacucuaccaccugagcuaugucccuagaucaguuucugaaucaauuucuaaaucauguuguuguguagaucaacucaaauaauagaauaauuuggcacaauguggcaucuuuaaagcauuccagcucuauugcagaaacauaaacaggggauuggaaacauuuccuugggagaggcagaaauuguggaagcugcuaugggcuuucuuucuaugucuuaccaaucuugcuuuuuauuuuuauaucaacuaauaucugaauaguuuuauucccccugccuacuuuaugguucagagcacugguugcucuuccagagaaccuggguucaguucccagcacagacaaggccauucacaacugucugucccucuuuuuccugaagaucugaccuccuugggcacuccauuauguauacuuaacauuuucucuaucgauagacauaggacauugauuauauggguugguauugugcaauaaagguaugaagaaguguggucaacagaccuguggucccagugcuagggaggcugaagguaagaagggcacaauuuuagggcaauuguguccuguauaauaauuucaaggcuaaccuggacuacaccuugagaccagaccacacacaccaaaacagcagcaaaacccuagccaaaacagauagauaagugugagugcugauuauuucuucagcaugcugauuucaguuccuucaaguauauuccuagaaguaggcaugccggaucauaccauaguucuuguuuccccaggaaccuccacacuguacaguccugugcaugccuacugugaugauuuaaugacaaaguccccgauuggcucagauaguuuaguacuugaauccuacucugugcugcuguuuggggaggggugguacagccuugcuggaggaagaaugucacugggugggcuuuugcaacacccauuuccaguuuacugccucugcuucuuguuugccauugaauaugugauuaguucuuagcuucuguuccuguugccaugccugucauuuuacugcaugucuuuuuuccaugauguauucucaccucuuuggaaccacaaaccaacagucuuaguaaguuaccuggaucacagcaauagaaaaguaacuaauacauugccaacacuaauuucucagcucacccucaucugugccuacuuguuuucuuuuaaucacaugguuuugauuugcauuucucuagugaugaacgaugaguauuuuuuauguauuuguuggcuucuauaaauccuccugagaauuccuauuuacaacauuugccuauuuauuacuguuuguuuauuuauauauuuauuuauuuuugagaugaagcuucauccuguaucccagacugaccuugaauuaaucuuuuccccucaaccucuggaguguuggaacugugggcauucucuugcaagccagcuaccugcccacuuuuaauuguaauauuugagguugaauuguuugaauuuuuauguguuagaggaauaguuugccauuguuuucuuccauuuuguagggcuuuucauuuuugguaguuuccuuuguuacaaugaaauuuuauuuuauuuuucuuugguguagucagucuuaguuuuugcuuuuguucccuguucuuuugguaucuuaucuaaaaacuaaaacaucuugcucggacccauguccagaagcauuuuucuuguauuuucuucuaguguuuucauaguuuuaggcuuacauuuaaaucuuagauccauuuugaauuuuuuuuucuuuuuuuugagacagaguuucucuguauagcccuggcuguccugaaacucacucuguagaccaggcuggccucgaacucagaaauccgccugccucugccuccugagugcugcgauuaaaggcgugugccaccaugcccggcuuuuuuuuuuuuacaucgagaaauagggacagauguuuuauuuuuaggcauuucuauauucagucuuccaagaaguauugauuaaagagacuuuaccuuuuuucuucaguguacuugccuuuguugaaaauuugauguuuaguauguggucuuauugauuuuuuuuccuaguuaauuuguauauauauuuuuaaaaaguuagguuuuguauguugauuuuuguuguuguuguuguuuuuuguuguuguuguuuuguuuuuugagacagguuuucucuguauaacaguccuggcuguccugggacuugccuuguagaccaggcuggucuugaaaucccagggaucggccugccucuguuccaaagugcugggaucgaaagugugugccuagcagaguuaauuuugauauccuauagcuguaaugaauuuuuuauaaucucuagguuuuucuauauauaaaaauguauucucucuauugugguuacauuucuguugauauacagacaugcuaaaaugcucugaccaaaaguggcucagaggaauggauuuauuucagcuuguagguuauucucccauuauugaaaagucagggcagaaacucaaguaggaauuuaaaguugaaacuuuagaggaacacuacuuguuaguuuauuuacuggcuuaacgcuuagcguguguguguguguguguguguguguguguguguguguauguuaauaggaccacaugccacucaacagugguuuggaccuuccuacaucaauuaaugacuaagauaagcuucccacaaacuugcccagaggcuaguccaaucugggcaaccccucagcugagacucucuucucagguaaaguaagcuguguuaauaguuaaggcuaacaaggauacuuccacaagaugggguaguuugaaucccuuacuuccuauuuagauacaugcuguuucucucuuuggucuuacuuuucugugacuucaguaguguauugaugaaguguggugaaaguagacagcccacuuuguuccugaucacagaagucauucuagcuuuucccagugugauacuggcuguggguuuguuauauguaacucuuauuuguguugauggauguuuugucuuuacuuaauuuuuaacuuguuuuaaaucauaaagagacguugaaguuuaucaguuucaauaccuuuaugugccaagaaaggugauccuaugacuguuaauauuauuugcuguguuugaagacaaacucaggggcucaagccugcuaggcaaguauucugcaauggagcuuuguaacucuagguucuaaucacaucuauggugucuauccuuuguuuccauuuuuuauucuuucccuuuacuaguugaguuuguuuuguucuuugcuaguucuuuaaauugcauacuuguuugaaauuuccugaauuuuuuucacaugugugaguguuucaccugcaaguauguaugugcaccaggcgccugggucuuguuguugucagaagaaagaguuagaucuucgaaacuggaguuaagaaugacugugagcuauguucuuggugcugggacccaaaccugugucuucugcaagagcagcaaguggccuuaccugcugagaugucucucuagcuccaaaaaucuguuucuguugauguuagguugacacuacuauaaacauugcucuuauuuuuauuaaaaaauauuuuuauguuccugaguguuugucugcauguauguauaugaggguguuggauucccuggaauugguguuaacaaguggugggagcugccaugugggugcuuugaaccaaaccugugaggucuucaagagcagcaggugcaguuccaaaauuuuccuuaucuuuauuuauucauguguacguguuugucuguggaugagugccauguauguuagguucuccacagagaccagaagaagguggugagaccccuggagcugaaguuacaggcauuggugagccacuggaugugggugcugcgaacugaacuugggcccuucaagaggaacaagugcucuuaccacugugcugugucuccagcccccacauuguugguuuuugaugaaaaauuauuauuauuguauguauguuucguguguguguguguguguguguguguguguguguguguguguguuugcuugcugcuguguguaugggaggucagaggaugauaacuuuuguggaguugguucuuucacuuuuauauagguuccagggauucaucacauuguuugauuuucauagcaagagcuuuuaucugaugaauuuuuucauuucuuagaaguuucucuguuauccuuuguuuggugcuggguugaaccauuaaacauacauucuauuguugaguuuacugaguucuaucucccaggccuggcucuguguuagacaguuugacuacuaaaugcuauaaaguuuaaaauauaauaauaauuuaaaauaauauaauaauaauagcaaugaugauauuauuguuauuauuuugaguagguuuucuauguuuucccccuuccuuuuaagcacaaacugaaugcuugcuuacuucaggguuucuaagucuggagguuuuucuuucuuuucucuuucuuucuuucuuucuuucuuucuuucuuucuuucuuucuuucuuucuguggcuuaagucugacuagauuuuuucaaaagaccuaucuucaaaguaagguauucuuccuauugguuuuucuaaugaaacucucaacuguauuuuauuuguugaguuuucagugccaaaacuugagguacugcuuacugauaugcuaggcaagugucccgccacugagcuauauucucuagcccugaguuuuaaaaauugguuauuuuauuuauuuacauuucaaauguuaucccccuucccccccuuuccgguucuaugagggagcuuccccaccacccauccacuccugccucagugcacuagcauuccccuacacuggggcaucgagccuccacaggaccaaggacuucuucuccuccugaugccagauagggcacagcucuguuacauaugcagcuggagccaugggucccuccauguguacucuuugguuggugguuuagucccugggaccuuugggggugggguagggggaaguccugguugguugauauuguuguucuucauaugggguugcaaaccccuucagcuccuuccauccuuccccuagcucuuccauuggggucccugugcucaguucaguggucgguugugagcauccacaucuguauuuuuagcccugauuuuuuaaaaacgauuuuuacuugaugaauuuuucacucaguguaauuuuuugacaguuuguugguuuccuuuucuuuggcacuuucuaaaaaaagguuuuuguguuccuuuggaagugucuuguuaacauauuucuuuaugcuucuugugucccuguguugguauuuugugcaucugguagguuaguagucucugccaauuuuguuaagaguggcuuucauacuaaaacauucuuggcagugcuuccuacuuuuguuuggauagacuguauuggcuuugguuucagguggauacuuuagcauagucuuuggguguuuuuuuuuuuuuuuuucagcucuaauuaguuugagaaugucuauagaugucuugggacugagcuuaggcaguggugggaaugcagcaccagauaagaugucacucccuuaggcaucuuauugccuuaucuuguuuaccgcucuugaugugguacaucuagaugugguacaucuagguuguaugggaggucugcugcuuuccacugaucauaugaaggcaagcauacccccagggggguuggugauauagcacagccuguuuuuuagagggguaaaguguugugucugccaguguguaaaugcugccugguagcuaauuacugaccaguggguaaagauagagcauacauaaggucucuuguaggaugacugcucagggaacucugcccaccuucccagguuggguggaugggacuaagcauaagcuuagggucaguuuucugauccauagguugcaggcagagagggaacuaacugggaacagcuuuugaaacgucaaagccuuccaccaaugacacagccccucugucaaguccacaccuccuaauccuucucaaacaguuccugagugguaaccaaacauucaaauauauggccuuaugaagaugauucuuauucaacuaucacaacuuaguuucuguuuuagugcuaugcagugucuucuucauauucccgcuauacuucaaaaguacuucaaauauuucagugaaguaguugguuuuuugcuuguuuugguucuuucuaucuaagccagcuaacucccuacucagccaucuugauuaaaucaucuuaauguaaaaccuagagagccuaggggaagcguaaucgugaagaacugaaucauagaauauaauaaauccuauugcucuugcuuugucaucuuagugcagaacccaaggggcucauauacuuucaagaauggagaagaaaaggagcuuaggacaguggaauauaccugaaaccuuauguguuugggaggacagaguuugggguuagccuguguuacauaaugagauuuuuuuaucucaaaaagaaacaaaacaaaacaaaacgggggaaggaaauuagaagauaaaguccuugccuguaauccuagcugcuugagaggcuuuggcagugagauacauuugcggucagauguaaaacucacauagugagggggaaauggggaauggaggaguuucaaagugcuggaucguuaauguuuuuuguuguuguuguuguuguuguuguauuugcuaugcaaaccucuaaggucuuggaguauauugguuuugaaauaccaaagaaagaacucacuuuuaggauucagugagaguuuguagauugaauguuccuggaggagcacacuggauggggacaaggguucucacaacuccuauaagagcagcaguauuuauacauaggcaaaacagagaguccuagugcucaaagacuguauuugguaacuucugauuucuaauggauacacuuugcugucuucaaaugaaggauuggaaccuccuucaacucaaacacucaccauuacagacuauagaggaccugcaaggacagcagagugucacuaggauugcuucaggagcugacacaaagugguucuuacagcauucauuuuuuaggaucuacuauguagccuaguuuggacuuggacuugugucccuuuuuuuuuuuuuuuuaauaauuaugugauuuaaagauuuauuuauuuauuauguguaagcuauaguugucuucagauacaccagaagagggcaucagaucucauuaugggugguugugagccaccaugugguugcugggauuugaacucaggaccuucggaagagcagucagugcucuuaauugcugagcccucucuccagccccuuguguuccuuuucuugcuggacucuuuuuuuuuuugggggggggugguuccaagacaggguuucucuguguagcccuggcuguccuggaacucacucuguagaccaggcuggccuugaauucagaaauccgccugccacugccucccgagugcugagaucaaaggcgugcgccaccaugcccggcucuugcuggacucuuauauguugaguuuagagguguuuaauagcucaugccuguauaagaaguugcuccagacagugaaugcauuucuacacaccuaucugucuguacacacacacgcacgcacgcacgcacgcauagacauccuuguauuuucuccaacaucuauaagaaauaagagagagaaggccauaaaucagcaggcgagacagcagugcaucuuuauaggagauuguguuuucagggaauggcaagguggcucagcgguaaaagugcuugccaucaagccugaugaccucgguuccuuccuuagagcucagauggcagaaggagggaacugacccccauaagauguucucugacccuacccucguaucacgaagcuuguuccauuucucgaaaagaagaaaaagaaaaagaagauguacuagagguaguacuuuuagguaagccccuauguuagagaucauuggacagcccagagaggucaaccagcaccaacaguuugucuguaguugugucuacugagauagcuaaaguuguagagguagaggucagagaagugcacucaaugggaagagcuaguaguauacaguacuagccaucagaauagguagcaguuaucuugaaauaguggggacaucuggggauacccacuugauggauaugaaguaaauacaaguguaugucagacuuaaccuggcaagcuuucagugcccuggcuugugugcauauauuccuuuaaaaaaaagucccugaaaauuauucuucucccgugguauuuucaaagcccugugguuuguuuguuucuguaaaaggauguguuaucucaaaggacagagcaguauuaagggcugauuuuacugcgaagcugcucaguaccagaugggagggucuugcuuccugcuuuugcuuugcagauuagacuuguggacccugguugucaauaguacacuguauuucaggaaacaagugucauuuuaaaaguuuuauaaaaauuuuacauaacauuuccuauaauggaaguauugauuuuauuauacuuucuggaacucuuugggaguuuaauagaagauauuuacaugaguccugauuuugccaugauauugauuaaaauaaagcuacccgaaguuuuaaaauauaccaccucacaaagcagcugaaaauaauaccaagauguagaugcucacuuuguuauuauuucagaugcucaucaccugaugaguuagugaaauguauaugacacuauggaauauuauucagcauuaaaaaguaaugaaauacugauucauauuguaacauuguugaacuuuaagaacauugugcuaugaaagaaccuagucacagggcugcagagaugguucaagauuaaauaaguacacuuccagguucaguuuccagcaccuaaaugguguuucaaaacuguuauccugauuccgaggauccaacaucaucaucaucugccacuccugaccuuaaguaugcaacugauagacaaacauacuugaagggcaaagcaugcacauauauaugcaugcuggaauuuauuuuauguaaauaaaauaaaaagaaaaaagucacaaaaguuacaacauuggcauguguuuuaguuuagauagaccuugaaaacuauuuuuaaaaccccccacaaaaugcaugauucuguuugugugacgcuuccaacagauuuaaaaaugaugguucuauaguuuucugauuauacuaaaaucaucacacacuuuauuuuuuauuuauuuacacguguauauaugacugugcauggaggccaggagaugauguuagauauucuccuauaauauucuuccuauuccuuuugagacaaagucucuuccugaaccuggggcuugugcuuucuuaucuaggcuagaagcaaacaaucagaguuaggaugcuaagcaagugugggauguucaguuuauuacacgggugcugugaugcgcagggucacacagugagugcuuauaacacagggcucacaaguaccaagccaucucuucaguuccuauugugcauuuuaggcagguaaguuuuaugaugugugaauuauaucucuauaaagcuauuaaauaaaagcuugaguugaaucagauauucuugucaguugguacaggugagugacucccuacuuuaaugccucagcaggacuuaaaacuuauaguuuaaauaguuuaaaauguaucuuugggggagaagaugggcauuaaacauaacugaagaccagguagccuagaaaaaugugauuaaggcaaaguacucaguacuguaacccuuuuugagagcucuucucuuuugcuccugguguuuuggcauuggaguagaaauggagagaaugcauuccaggaugugguuauuccugccaggaauccuagcaucuggaggcagaaagaugccaaguucaaggccauuuuggacuacauagugagauucugccuaaagacaggagagaagagaugcuucucuuaugaauccaaagggagcaacuauuuaacaacuuccucgggaauuccuuuuccauuugagcagacagacaggaucaguagauauaugaggcaagcugugcaaagaagaaagugaagcaaauaggaaaaaaggaaguaaccagaauaacaacaaaaagcugucaaacuguuauaaaacaaggacaaaacaauaaaaggaugaaaguuauuagugaccuuucacaaaggaaguaggaaaccaaugauaaaauauaaaaugucagccuggaaagucaauuuccaaauaauagaaauguugaucauaucauuaaaacuuagaaaaagaaauuaccaguaaaauguugaagaauuccuguaguugaagaguaagauuuuguacgguacauuuuuaaugacagcuuggauauuggaauacucaacuuuuguuguagccaaugagagggauaugccacuaaugguaucuaaaucauacaguacguacuuuaggauggggacaaaaaucacaacgauuuauuuauuuauuuacuuaguguaugugagugcacuguuggugucuucagacacaccagaagaugacuucagauccgauuacauauggguugugagccaccaugugguugcugggauuugaacucuggaccucuggaagagcagucagugcuuguaacucugagccaucuuucuagccccccccccccccccccgcuaucuuuuagaaauguaauuugccauacuuugagcaauguucuugaugucauuaggauauuucacagauaacuucacuuaagauaauuagagcaaacauuuccuaagucuuucucauuuuauuaaauguaauuucuuccuuuaccaugggcuggccuugaacuuacauagaucugccugccuuugccuccagaacgugcugagaguuaaagaugcaugccaccacacucauuaaaugguguuucugccuggaagucaugugccauaccugauaccuuucuuuucaguauucuaguccauacacauuauauuuagaaauacuucuugaauucuuuaaaaauuuguuauuauugugugcauaucugugugugugugugugcucaugaguguguguauacaggauguguguguguguguguguggggggguggcacaugugccaguucauguauagaaaucagaggacaacuuugugcaguagauuuucuucugucucuaaauggacugggggcauugaacucagucuccaggcuugugugacaagugccuuuauuuaucugcugagucauuuugcuggccuuugaaggcuuaauuacuuguuuagcuagggucucauaacccugguuggccucaagcuuaauauucagcugugggauuacagguaugcaccaccauaccuaaguuuauguggugcuugggaucaaacccaguguuugauccgcugguggucaacauuuugaugaaugguugacucuugcuuacuuguaauuucugcauucuaggcagaaauucuaaauuaugcauucuaggcaaacacuucugacuggcugcauuuucuauuuauaucaguauauuagucaacugcaggcuacuaccagugauaucuucacuuggauuguuggggccuccugguguuguguuaugguuauuuuuuugguguuaaauauaaaaauuuuacagccuuaagguuuuucucccucuuuuucuuuuuuaagaugagaucuuauuagucaaggcuguucuggaacucaggauucaccugcuucaguuuuaacuacuuucaaguauauaguuuaguauuacuuauuauauucauguuguaggguuuucaucuugguaugaagacucuuuacccauuuaaaaaaaaguccccauucugcuauccccuagcaacuacuuucuuuuuuuuuuuuuuuuaagauuuuauuuauuauuuauuuuauauguaaguacacugucgcugucuucagacacaccaggagagggagucagaugucauuaaggaugguuguaagccaucaugugguugcugggauuugaacucagaaccuucggaagagcagucagugcucuuaaccgcugagccaucucuccagcccccgcaacuacuuucuaaucuguuuuuuuuuccuuucaauaaauuuguuuaacuuugcaaguggaauaguagaguuacugucuuuuugugacuguguccuuuguuagauugugcaaaaguucuauuuauaauauuuuuugggaacuauacuguuaagguucaaaaaucacugaaggaagacuccagaaucaagaaguaugccaaggcaaagaaguuuguucugcagaaauuaccggcaugcaggggucaaccauucauuaaaauguagucaccagaggggagcaggcuccccuuccugcagggcuaggggaauuuccagaagguuagguaaccucuaauaugauugauugggagccagcaaagcaaugacauuagugcauuuuugauuggcugcuauguuaguuucacuauauuuagugauaccuugaagaauuuuuagaaaccagcucuguuuuagccuuguuauccccuugagccagugucugaggagcugacucagcucuagacuuacccucccuaagucaggucugucacuggucaacaacaacuuccucuaaggagccuagauugcuuccuggcgaacugaaaauuuuuauuccuaagguuuuuagaccucucaauaguguauggaggaauuuuaauccagcaacauggcugcucugccaagggaucacauccaaagaccuucuaggucugugcuaucuggcuggaaugagucagagagagaauaagucaacugucaugaggucagacagaaaagagaggcugcuucagagcagcacggggagagaguguaguucauggaguucagggacauuuuuuccaagcagagcaauccagucagaagcugagagaagccauuuugaaucaguuagcuuagaaaggaguuugagccagaacagcggauuugaaccagacagccaggguucagagagagcuagaaagagagaguuuauccagcaguaagucuugaaggcugagacauucuaggccuagguuagcagacgggaucuggaagcugaagccuucuagguucagagcugcagaagaugagagaguauggaaacuagaagccuucaggccuaggaacacucugggcucagcucaggucgaguguuugcacagcuuggcucucaucacuucaccugaggaaauaaaagcaacauuuacaauaauguuucagaguuauuguaauaauuuuaggcuaucaauaauguaccuccuguuagauuuguuuuguuuuuguuuuuuuguuuuuuguuuuuuguuuuuuguuuuuuuuuuuugagacaggguuucucuguguagcccuggcuguccuggaacucacuuuguagaccaggcuggccuugaacucaaaaauccaccugccucugccucccgagugcugggauuaaagacgugagccaccacacccgacuuagauuuguauuuuuuaauuagaaaaauauaauuucucuuuuuuuaaaaaauuaggcaauauucuuuuuguuguugcuguuguuuuuguuuuguuuuggggucaggguuucucugcauaacagcccuggcuguucuggaacucucuuuguaaaccaagauggcuucaaacucagagauucaaguccucuaggagccaggaggaggagggaguggggacuuaauggaaaagaguuuuucauaccaagaugaaaaaguaaaggagaccuacucuucuacaguaugaauauacauuuuuauuuuucuucagaacucuaguuuaggcugacuguaacucacuguagccccuggccauaaacucauggcagucauucugccuccuccagguauuggauuauaggcaugagccaugaugcuuuuuggcuuaaucagucuuuuuuuuuuuuuuuuuaaucucuuuauuagcuuuuaaaaaauuauuuuacacaccagcuagagaaauguuuuuaagauuucuauauuagguuaugauucauuacugaguccaacaagccacaaaucuuagugacaacacaggauuucauacuacuuucagauaucacuguugucugagguguguguugagguaacuuugcuccaugcacuuacuuagagacauaagcucuucugucuuuuuauguuaccaccacaaucagcaauggcuucugauguugauuugaaaauggaaaugugauaggaagacuuaagguacuggauuggaagugguauuuaucgcuuuuauccauauuguauugguccuagccaagucauguuuucuuuguagaaauuuaugcauuucuaaaaaauguaggauagcaguaagcugaugaggagagcauagauauuaaugaaugauagcaguagcuguaaugguggguauucaguuaugacuuccucccuuaaaauccuuuugagcauauguauauguauucuugugugugugucacacauacucguacacacuugugcauguggaggccagaggcugauguuggauaguuuccuuuauuguuaucguccuuauuuauuugaaguggggucucuuacugaacuagaaacucacugaaucaguagacuggcuggucaguaaaccagagauccuucugccuucauguccucagaaccgagagauuacaaauacacacuacuuuguccuuuuuuuaaauuuuuauuuauuuauuuuuaaaauaugggugcugggaucugaacucagaucugcauuuauguuuugugcauccuacugaaugaaccauuuccccagcacccagucuucgucuuuuaauucaagcauuauaucuacagggguauuauugaaagcuauagucugacuccuuucuuguuugcuuguuuguucaccuaagaaguuugcugccuuacuaaguuaaggaugugugauucuuuguugcuguacuuuucuugccaggaaguuauagaugcugagccauuaagcaucuauaagcugguggcugcugaggggagguuuggccaggcuaguggugaguaggaacauugguaccugaauugcucuucugaagccauagccccauacaguagcuagcugcugguggagauagccccaacaucugucaaguauagacgugaggugggaucugagaaauguguagauguguagugguguguacagaggcuuaggguuguaagcucugucagcagugauugcuaacaggcuguccuguuccugaacuccagcugaaugguaccacaagcauucacacacguagccagguagagcucugguaacugaccugaugacuuguuuggugaaguggacacuuuuugcucagcaauauagccaacaaauuguaagggcagauugcuucaauauuggcacaguucuuaaccaaaaauauguagacccgugaacaucuaagucaauucugaugugaacuacauacaaauagacucagagugaauaccauccagauacuuggacucaaaugacagcaguuuaacaaugguguguguguguguguguguguguguguguguguguaacagaauucccacaaugguuaguucucuugauuauaucacacagaucccaugucacgucugcuuuuaccuuuucuugguauucgcauugccuuuuuaaguacuucaguguguuuguuuucuuuugaauauuuugaucuauuauuggcuccuaaaagaguauaacagaaaaauggagggagaaugaagagagagagagagaauaugaauucuuuaaauuuccuucaaucugagaaggaaguacauuugggagaaauggaauguaugacugccaagguauugagcagguagucacugcccgcagaaugagcugaaaucaacucagauuagcaauaccuuguauuucauaacuuugcacugaaguugccuuguacuggucucuauuuaggauucccugaauagaucagaccagaccagauuaugcuagugcuaaucuagguuuggagacauucuugugacuuccucuuuugccaccuuccuagaauuuucucaugacuuuaguuucucucguguugaaagaguucuugucuuuguagaguuuuaaggaccacaaaaauaauaaguucauuguaacucaaggcaaauucauuugaaacuucauucaguuuaacucucaaggccacuuaguaaauaguaaaggaaaaauucacguuuccagcuaacuuuuucuaaaaaugacaauuaaauucuuccaaauagaagaaagugagacugggaacaggagaccacuuaaaggaugcuucauuaucuuaguaagcugcuuggcuccuuauguauauggccagaaugcuguuacuguacauucacuugaauccuguuaaaaggauacaagggcagcgaguugagagggaggugacugaauaggguuuauuaauccagaucauuggcuuggucauacaguuaacuggguuuaggguggguugcaacaggaaauuucuaagaaaggcaaauggaggugucugacagaggaguagugcugugaaacgugcuaggauuuuaaaguaauaauagaccaguucccuauacauguaauuaauaagucauagaauguauagguguguguguguguguguguguguguguguguguguguguauacacaucgaugcuggugcuugcgaaaaccagagguguuggaucccuuggagcugauguuaauaggcaaauguuagccacaugauauggguguugggagcuaaacucugguucuuugcaagaaugauguaugcucuuaacuguugaguugucuugccaauccuggaauuuauauuaaaaaguguuuuuaguaauucuuucagaauuucauacauuguauuuugaacauuuucaucccucuugcacaucuccucccauacccacaagccauauccacccaacuuugugucuucaccuuuuuuuuuuuuuaaacccaugaagucauguuaguacuaccuaucuacuacacugaguuauauggccuuccacuggcacuaguuagaccaccuaggggccacauccuuaaaacuaaaaccacccuuuccugguagcugucauuuaccaauaguuccucaauagguuuaggacuuugugucccuccccuccacauugagauuuuguuuggcuugagcuugugcagaucuugugcguguuguuacgacugccaugaauucauaugcagcugccauauugugucuggaaaaccaguuuccuuguauauugccucuggcuuuugcagucuuucuguccccucuucuuccauaacccuugagccuuggugagauaguaagucugagguuaggguaucagcagaguucuugagagccuccucuucuguauguuaacuuuccuccugucuugggcuucuggauaacugcuuucucuuuaagugaaccaaacuucucuuacaggaacaccagucauacuggauaagggccuguugguaaacucauuuaucucauuuacauucugaagcuacccagauagccauauucuaaggugcuggggcuuggauuucaacauaggauuuguguguguguguugaggauugucuccagcuuuacaugugaaauuuuaaguagaaguaauucaguguuccuuguugguaaauuuguucuuguuuugagaugggucucuuuuaacucauccuggcuuuaaacuaaggaugaucuuggauccucugucucuaccuccccaguucuggaacuacaggcaugugcuacuacaucugguuuuauguggugaugaugauugagcucagcagagcuucaugcucuaggcaggcgauauacccagagcuacauccuugaccccaucaguuauuuuuaucucauucagaacacuuuaaaauggauguagucaauugugauucuauuuuguuucuuagccauccaguaaccuaaggauuaggguaauaacucuuuaacuaauaacuaaugucuuauauuaaugcaauucuuuguuauacauuuucacaguuuguauuauaauuguaugauuguaauuuacuuuagcaagauuguuuacuauuuuacugguugcuccuuuaguuauuauaaaacauaauccucucuucagauuccagaauugguauguucuuuuauuuauuguuuuuuaugugcauugguguuauugccugcaugucugucugucugugugugagaggaugucaggacuggaguuagggauaguugagagaagccaugcagaagcuggguccuuucuguggcagagcagccccugagccaucucuccagcccgagaggauguaaucuuggguaaauuuauuuuaauucagagaggauagaaaguaagauuuugugaugacugacaaaaucaucauauagggaauguguuacucuuguguuagucuaaggcguguauaaaugaguugaagaaacaggaguuucacuagaauuccuuuuauuagcagaauacuugauuucucuuccuuuguuuucagaacuugguuuguucuccuaguguacauuuauucaguuaauauuuguugaaugaacaagugaauuuuauaugcacaauacccuuuuacuuuuucaucuuucuuguuuucucaucuugguuauguauccaaaguaaucauucaaaccugaauaaaauaugauaaaauuguucccuaucuuuaaaagaaccuaaucgugcugagcauggugauacaggucuaaaauuucugcauuugggauuggagguaggaauaucaguaguucaaagccaagaucauccucaccuauauagugaguuuuaaggccagccugggcuacaugugauuacaacugaccaaacaauaagaaaauaaaaccaaaccaaacucaacaaaacaacuugauuuaauccucuauuucugaugugcuucuaauuuuuguuuuguaaguaguagaguguuucauuaguuagaauauuuagcaauauaaacuauaugauguuguggcuuaaaauguugauuacaguaaucuuguaaauuuccuucucuuuaugccugcuguagcauaucaaaguuauuguugauuuuucuccuuucauaguucacugagagauuguaacccaucuaaacuuccugacuuaguuacuuggguacuguuacuuagcugauucuuaucagaaacaggaaauugucaagugaugaguuaaagcacagcagacuguauguguaacuagcaugguagauuucccuguagaugucccccccccccuuccuccgccacuaguuguuuucagacaggaacaucuaacuugccaaaaaagggucccauugcucaugaccuaugccaauggcaaacauucuccuuccucagcguuuccugguuagaugguuugauagccuuucuuugagacagggucucauugaguagcccuggcuguccugggacuuucuauauagaccagguuggucuugaauucagagaucugccugugucucuuuugaguacugggguuaagggcauuugagaucacaagugacugucuugacaaacuuaauauuagguguucuuaauuaauuuauagaaauaggugaaguauagauauuuuggucugguguacucauugauuuagauuuguaguugacuaagggaucuauaaagacaaggcaauuuuauaauaguaggaugcuaguuucucuuuuacuaugaauauuuaguugucuccaaauuugauggcugucacaaaaaguaugaacaguuggaagguauauaaaauuuagugaguauugaauaacaauauaagauuauguaugugggagacugauucuguguuuuaagucaucuugguagcuguuugguuccauacuuaguugauuuacauacaguaaagcccuuuuugguguaacuaaguauuaaaauacaagccagucaaagagacaggcauaauuauauuggaaagaauaggggucuaauuaaaagaaaaucucuccucaaagugcuuguagcaguccaguguuaaacgggaaaagaaacacaggcaaggacuggggguuuucauugaggcaauccaggcccucuaugcuucagaccauucauuaucugagguacagacagauaaagcuaugugguugcuuuugcuuuaaaauguuuauuuaaccuguuguugaguuccaagguaaguaaauuugugagugaguguguuugugugugugcuccucagaagcuguccugaggaguuuaugacagcaccuuuuaccaaucuggaaugcacuaauugcacuaggcuggcugacccuggagaucugccuuugucucugccuucccagagcugggauuacaaguacaccaccauuuccauuucugcuuuuucuuuuuacauggguucugugguuugaacucagguccucaugucugcaggaggcaaacuauguuuagagcucucucccucuccacuacuauuccauuucuaugagaauuggcccuaucaucuccccacccccucaucccagaucccucuuagagcacuguauuaucuaguuagcuguuuauugcuguguuuguacauagauucaguuaaggacacuuggaagcauguaauuaaaaaggagcaugcugauguccuggaaaggaauuccaguagcagaacacaggaaggcaccaacauugggacacagcuaauagcgccaccugguggaaguauaggugaauguuuaagaacuccuuucacgugaauuuuccuaguuuuuguuuucucuugggagugcugagaguucaguucaauuuugacuuuacuucccucuugccagucauccugugcuuugaucccucuuagugagauaggcauguuccuguagauaaucuuaacucauguuguguggggaugugauauggacaguaguauguguuuaaaaaaaaaagcaaauuuuagcuaaauuugauagaugagguuuagaaaacuuaggcuaaguuuaagcaaaaggguguugaacagaggguguagccaggugugcaugccuuuaaucccagcacuugggagacagagacagaaagcacucuggaaauucaaggcaaaccuggucagcgaagcaagaacuacauaauagagaaacccugccucagaacaaaacaacaaauaauaggccauaguuacaaguuaauauugagagugcuggagagaugguucagagguuaagaacacugcccuuccagucugaguucaauuccuggcaaccacaugguggcucacaaccaucuguaaugggauccgaugcccucuugugguguguuugaagacagcaacaguguacucacauaaaauaaauaaauccuuuuuuaaaaauaaguuuaguucugucagaacauuuaagagaauuuguuuagaguccuuuuuuauguaaaccaaugaauuaccguugugggggaaagcauaucuuuuuuuuuuuuuuugaagguaguucuuucuuucuuuuuuuuuuuuuuuauuacguauuuucuucaauuacauuuccaaugcuaucccaaaagucccccacccucuccccacccauucccauuuuuuggcccuggcguuccccuguacuggggcauauaaaguuugccugaccaaugggccucucuuuccagugauggccaacuaggucaucuuuugauacauaugcagcuagagucaagagcucugggguacugguuaguucauaauguuguuccaccgauaggguugcagaucucuuuagcuccuuggauacuuucucuagcuccuccauugggggccgugugauccauccaauaguugacugugagcauccacuucuguguuugcuaggccccggccuagucucacaagggacagcuauaucaccguccuugcaacaaaggcuugcuaguguaugcaauggugucaucguuuggaggcuaauuaugggauggaucccuggauauggcagucucuagauggaccauccuuuugucucagcuccaaacuuugucucuguaacuccuuccaugggugauuguuuccaauucuaagaaugagcaaaguguccacacuuuggucucucguucuucuucaguuucauauguuuugcauauugcaccuuauaucucgcuauacuaaguuucuggguuaauauccacuuaucagugaguacauuucauuugaguucuuuugugauuggguuaccucacucaggaugaugcccuccagguccaaccauuuggcuaggaauuucguaaauucauucuuuuuaauagcugaguaguacuccauuguguaaauguaccacauuuuuuguauccauuccucuuuugagggacaucuggguucuuuccagcuucuggcuauuauaaauaaggcugcuaugaacauaguggagcaugugaccuucuuaccgguugggacaucuucuggauauaugcccaggagagguauugcaggauccuccgguaguacuauguccaauuuucugaggaaccgccagacugauuuccagagugguuguacaagcuugcaaucccaccaacaauggaguaguguuccucuuucuccacauccucgccagcaucugcugucaccugaauuuuugaucuuagccauucugacuggugugagauggaaucucaggguuguuuugauuugcauuucucugaugauuaaggauguugaacauuuuuucagguguuucucagccuuucgguauuccucaggugagaauucuuuguucaguucugagccccauuuuuuaaugggguuauuugauuuucuggaguccacccucuugaguucuuuauauauauuggauauuaguccccuaucugauuuaagauagguaaagauccuuucccaaucuguugguggucuuuuugucguauugacggugucuuuugccuugcagaagcuuugcaguuucaugaggucccauuucucaagccauugcuguucuauucaggaauuuuuucccugugccuauaucuucgagacuuuucuccacuuucuccucuauaaguuucagugucucugguuuuaugugaaguuccuugauccacuuagauuugaccuuaguacaaggagauaaguauggaucgauucgcauucuucuacaugauaacaaccaguugugccagcaccaauuguugaaaaugcugucuuucuuccaauggaugguuuuagcucccuugucaaagaucaagugaccauagguguguggguucauuucugggucuucaauucuauuccauuggucuacuugucugccacuauaccaguaccaugcaguuuuuauaacaauugcucuguaguaaagcuuuaggucaggcauggugauuccaccagagguacuuuuauccuugagaagaguuuuugcuauccuagguuuuuuguuauuccagaugaauuugcagauugcucuuucuaauucguugaagaauugaguuggaauuuugauggggauugcauugaaucuguagauugcuuuuggcaagauagccauuuuuacaauguugauccugccaauccaugagcaugggagaucuuuccaucuucugagaucuucuuuaauuucuuucuucagggacuugaaguuuuuaucauacagaucuuucacuuccuuaguuagagucacgccaagauauuuuauauuauuugugacuauugagaaggguguuguuucccuaauuucuuuuucagucuguuuauucuuuguguagagaaaggccauugacuuguuugaguuaauuuuauauccagcuacuucaucgaagcuguuuaucagguuuaggaguucucugguggaauuuuuagggucacuuauauauacuaucauaucaucugcaaaaagugauauuuugacuucaucuuuuccaauuuguauccccuugaucuccuuuuguugucgaauugcucuggcuaggacuucaaguacuauguugaauagguagggagaaagugggcagccuugucuagccccugauuuuagugggauugcuucaagcuucucaccauuuacuuugauguuggcuacugguuugcuguagauugcuuuuaucauguuuagguaugggccuugaauuccugaucuuuccaagacuuuuaucaugaauggguguuggaucuugucaaaugcuuuuuccgcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguuuuuggauucgguuagcgagaauuuuauugaggauuuuugcaucgauacucauaagggaaauuggucugaaguucucuaucuuuguuggaucuuucugugguuuagguaucagaguaauuguggcuucauagaaugaguuggguagaguucccucuacuucuauuuuguagaauaguuugugcagaacugggauuagaucuucuuugaaggucugguagaacucugcacuaaacccaucugguccugggcuuuuuuuggcugggagacuauuaaugacugggaaagcauaucuuacaucuaaaauuucaaaaaacaaauagaaaguagggaaggagcagucuugaaaauuucaaguuaauuauuucuuagaauuuaauuuucugagauuuuaaugguacagaauugguagaauugcaauuuaggaauuaaguuguauuucuuuucuuuucuuuuuuuuuuuaauagagacaacaucuuucuuuaaaauucccuagauauauaucaugaaauggaaagucuuugaacacauuacuguaagaaucuuuguuuauaagcuaaaaacauauauauacauauauauauacacacacauauauauacacacacauauauauacacacucauacaugauuauaacuuuaaagacauuuuauuuacuuuuaagaauuucauauguaaauacuaauacagugguuuuguuuugaaaaaauguuuuuaauguguauggguauuuuaccugcaaguaugucuuugcaccauggacuuguuuggugccuauguaggucagaagguguaggacccucuguguggguucugggacuagaacccagauccucugcaagaauaagugcucauaacugaugagcuaucccuccagcccuuacuuugaaaugagggugaauaaagcaaauuuaguuauguucuacgccaaguuaagaaacucaugauuggcuauuauauuggagccuguuuauaacuuaaauugcccuuacacaaacuauuacccuacccuaguuuuaaaaauuaugagcaaauauaaccccuaaauauuauaaaauuucauugauuuauaguuucucuaaauuauuggucuauguuaggugaaaauguauuuuaaguagucucuguagggagguuugcauccugaugcacaugacauggcauauguguggaagucagaggacaacucuuuggaauugauuucucuucuucucauuuaaguaguuauaguuaguaaguuaguuugagacaggauccuccuguguaguucuggcuagucuagaacuuuuauuauggugaccuuccugccucuaucucccacaugcuuugauuauaggccaaacucaugaugggggaugcacuauaggaaagaugaaucuaguuucuucagaaaagaacauggaagaguaaagaaaaagaauggcaaagagacauaaaauauacuagcuagagagaauuuugaagguucaaggccaaccugggcagcuuuacugagacccugucucaaaagcuuuuaaacacacauugaugugguucauugguaaaauguacuuuguaugugggaggcccuggauucuaguaccaccaucaaucaccaccaacaaaaaaaaguaaaugcauuuuaguuuuguugauuuuuuacuuuaccugguuauuuauguguauacauuugaaaauauugcuuaguaaguguuauagguuucaccagacuauuuuaagcuucugacccucagaaaaaaaaaccuguaagauaauaaauuuguguuuucuaaaauuacuaaauguuaacgaguuacagcagcaauacacuaagugcuaaaugugcuaauuuuuguuuuauguuugaacuuuauuuugagauaauucuaaauccacauguaauguaagaaaccuuagaauuuacugaaagaccaaguuauucuagugguaacaccuggcagaauuauaguacaguaucacaaucagacuauuaauguugacacagucaacagacaguguauuucuuuuaugaagaaaaaaaaaucugucauguugcugauuugucgcugcugugauuucuaagccccucaaaagucuguguguuaaaagucuugcuuucuugcugggcagugguggcgcacgccuuuaaucccagcacuugggaggcagagacaggcggauuucugaguucaaggccagccuggucuacagagugaguuccaggacagccagaggcuacacagagaaacccugucuuggaaaaccaaaaaaaaaaaaaaaaaaaaaaaaaaaagaaggcuugcuucccagcccucggugcuguugggaagugaugggcccuugaagugcugaggccuagggagagaucuuugggucauuuugaggcuggagggaggauauguucucucagaggcuuagcucccuuccuuucucuuuugcuucuuaaccauaaaauaaguggcucuguuccuucauggcaccaauacuagcuaauuaugggcuaacucaaaauugugagccaagauguuugagcucaacauaaguucucucaguuuuuuguuuguuuguuuguuuuuaguggucagagaaagcucugacuaacaaaaccaucauacccacaauucucuuguccccauuuucuccuuuuucuuuuaauuuuuaaaaaaaauuuaugugcauugguguuacuugcauauaugucugugugaggguguaugguccucuggagcuggaguuaauagacaguggcgaguugccauguaggugcugggaauuaaacccaagucuuuuggaagggaaucagugcucuuaacugcugagccaucucuccagcccccuucccauucucucauagcuuugguaauuucucucuagucacuagcucuaguucuguaacauaucauucuaagaauuuuauguaaauggagucagaguuagcagucaucauuacuggcuuuuuuccacucccuguaauucccuuagaacuuuauccagguuuuguggaucagucuugcucacuuugguauggcuuuacuaguuuuuuaaggcagucguuuguuaaaggauauuuguauggcucuuuuugaauauuggauaaaggcuugguacaaacuuuugaacgcaaguuuuauuuguuuuauugaaacacucaggaugggaagaguguguggugguugcauguuuaguguuaguagaaacugacagucuucuaucauaucuguagcauuuuauuuuuuaucagcuucauauuaaugagccaguuucagcauacuugucugagcauuuaguauuauuaguuuuguaaguaacuguuuugauagguauauuauguagugacaucuuaaugugacuuuaauagcuaauaaauaucuucuuagguacugaugccaccucuacagauucuucaguggaugaauuguuuacacacacacacacacacacacacacacacacacacacacaccuucuuuuuuugacaguaucuuccuguuuagcucugucuggcuagucuagaauuugcuauguagauucuggucuauuucauuaugacaccuguuucucuugaagauuucuucuuugacaugcggauuauucagaauuguauuguuuaucuucauuaaggauacuuuccuauuaucuguauuaguuuggugguuuuuuuuuuuuuaguguugguguuuuugcuaaaauaaauacuuaaagcuuaggcaguuuauaaagaaaagauguuuauuuaacucuuuguuuuagaagcugaaagaauaaauuuauacagccccauugguuuuuacuguagacucccauugaccauaacacauggcgaaugacaugguuaggagugugugucagaggaacauaagguaaacugugaaggcaaaaggaucuauguauguaccagggccacuugcuuuagaagacuucauggaaguuucauugagaacacauuagaacuccauuagucucuuccaagggcugcacaucugacauaauuaucuucuacuagaccccaacacuuccaguuccauuaccuuuuaguacuuucauauuagagacuaagccuuuuugaacccuuaaaagauaaauuacuuugccacauacuuucugcuacugauuucuagugugagucuguuguccaauuacugugugauucaguuuauuaaaauuuguuggguuuuguuguggcuuaagcuaugguuuaucuuucuaucuauucccuggcacauguugaagcauauguauuuugauauuuggugggcagaggauucuauaaauguugguuuauuguucccucuugguugagcauguuguguaggucuuugccugccugugugagaugcucuagcuguguuccuuucucuuuucaggguugguuuguuuguuuuugugcugaagauugaacccauucugcacaugguuguuaggugucagcuuugguagagagagggguuuccagucucucugcuauuuuuaaugccguucucucuccuacucuccugacacaguaucuaggaauuucacuuuacuuaacaaaaggacaguacuccccuguaguaaaaguuccuguuuagguagaaaccugggacuauuuccccuaaaggacagauuacucuagugucaguuauucauuaaauaacuuacucuaacaugauuugcagugcuacuccucauaugaaacccuucuaguuuugaaugcuuuuauacaauaaaaguuucuuaacugacuugucugauuaggccugcucauuucugcuaaugaagaguauaacgggauaccuuugguacaguucuguucccaugaauuaaaucugcuuacugaaaguuuaagaaccuucauuuauuaaauaaacagugcuaaagaagguuauuuugugaaaaccaaauugauugcuuuagaaagauuuaucaaagaaaguugcuaaaaucacuuucuuuugaauuaguuggucugugugaaacauuuagauguuugggagaaggaaaaauagaaauauagacaaaucacuuaaauguuuagaucaccaguaauuugaaguacucuacuuuuuaaaaaccuaauaaauuaaaacuuacuuguauacugggaauaaagacuucuaaagguuaaguguaagcggcuguguguuaguuguauugauuuauauguuucugcuucaauauugucuuaaauuacuuuagcauuuuugagcacauuaugauaacugguaaccuaccuauaaugugaccuaacugaaaauaacaguaaaagaaugaccuaaauugccugagacaauggacaaucuuccuguuauuaacuccaggguccuggagguucaaaggcuggcaucugcaguuguuuguuuguuuguuuguuuguuuuuaaaucaguucuggcucauuuccaagcaacggucuuucuacuuucugucaguuucauccuccagcugauaaaauaguuccggucucauccugaaacaauuucuuuuuguuucucaaaagccguucaccuuuucucugaaggcucuuuuccuuucauuuaauuggccuuaaaaguucaguaagugaaucugauauccugauggggcuuugauuaauccaguugcuugaagcuaaaguuagucucccaaguuauauugcuaaaaauaacaauagguucuaauagaaggauaauccaaguaugcuccaaacaggagacauuaaauucuggaauauauaguuugucagcaaauaauauuuuuccaaauauucauuauuaauuuuacacacuuuucuagaaaaaaauucaagacaguugucaaguaucaaaauaaaguccauuaagcuuuuauaaauuaggugugguguauaagggagaagccauaguucuuuagccuaucuuugaaaaauaucccugcuucuaguuuuccaguguuucagaaagcuggcugcucauuguaaaaucaaucaaaaucucucucucucucugucucugucucugucucugucugucuguaugucagagguugaguugacaacuacaugccuucuuuaauagcucucuaccuuauauuuaagaauuuaagaaaagguuucucacugaaccuagcuagacugcuagaugggcuggcauuaaauucuggaaugcuaccuccuaggaauuuucugugcccaacucugggauuacaguugugugcugcuacaucuggcauucuuagguaucaaauucuuccccugguuugcauagcaggcacauuagcaccuccucagcuuuuauucuaacuuaaaucacaacauaugucaguaauaauuuagauucuuugugcguaaguaauuucagaccgucaaguugcaguaauacaaguagcguccccucacucccucccccaaauuucucugcucaucuauguuuuucucaugauggcuaucaaacccuugaggccuugugcauucugggcaagaauacuaccacugauacuaccaccuuccuaguucaucaguguuucuuauacaccauguugucucuuuuucuucuuuuuaaaagcauuuuuguugacuuaagugauucccuuacaaagcauaaaacaauguguggcagauuuugaggcuuuugcaaauccuuugucuguaucuaucuuguugacauacuuagcaaaaggauguugaauucuggauuaaaguacuuacuucauuguugagaaaacugacaugguagucaauacccaaaauaaaaggcugaauuuauuugcuugcuucaugaggcauaucugcuuuuaugaaacaaucucucugaagaaagcagagugagaucaagucuaaacuuacguuucaggacaguguuugcauauauauauauauauauauuuuaaaauaaugcauauaaguuaggcagugguggcucaugccuuuaaucccugcacucagaaggcagaggcagguagaucuauggcaucgaagccagccuggccuacaagagugaguuccgggauagccagggcuacacagagaaacagugccucaaaauacaaaacaaaccaacaauucaacuaacucauucaauuauauuuuuuuauuuuucauagaguuugaucauuguauuuuauuguccucagauuuauuuauaaaguuguuuguguuacuauucccuuugacuguuugcaguauacaguugcgguuccuaguauuugcauguucuuuuucuuuuucuuaauauuuccagaauugucauuuuaauuagagaggggcuuagagauuuaacuccugaguguuaaguggcuauggcuaacagccccaacuuuaacuaaacaucuccuucauaaauucuuuugccaguuacaugaaaguuuaaaauaauuuuuaagccaguuuauaaaguaaugggcuucauuauuccaguuuaaauauuuauuuuuaauauuuuuaauuuauuugguguguguguguguaagagagagaaagagagauaaagaggagagaagagauggaguuacaagggguuguuaaaauggguugcuaguugccugagguagggagucggaaccaaaucuugguucucuggaagagugggaaguacuuuuaauagcugagccauugcuccugccuuuauuacuucauuuuucauacacauuuauccguuauacuugguucucaguccagagaacacuauaaaaggagagagauguuuuugagaucugaaauguugucuaggccucagaguugugaugcugcugccucagccuccaggcgcugagcuuacggcuaagacuuuguuuagccucagacugaugguuuuuauguguuccauauauguucuuuuguuuagaaguaacauuuuauauaggccgauuauaucucacuaauacaguguuauuuauaaccuugaugcuuuugucuccuugauuguuuuguuaauugagauaaauauguuaaaaauuaucccuuauaauaaugaaucuguuauuuucuccuguaguuauaccaauauauuuuaauuuuguacuuuauaacuuauaugggaagacaaaaguguucagaaagcaucuguuauuuguuguauacaaguuugauuuuaucuacuuuaagaggaauguucaguugucuguguagugaauuucauugcuaacggugguuuuaaauguaaguuaguuuauauaauaccaaauaggaacaaguguuuuuuaaaaauuaguacuugccuguuagcauuuuucauaucacuuuuaacuuuuugauacucuuaaauuuauuucuuuuuuauaguauugggaauugagcucaaagcugugcacgggcuaggaguaucuacuacugaacugcauagugccccgcccaucuccuguuuuguauauuaguuuugagacaggguuuuacucuguagcuuauucuagcuucaaacuuaguauguagccaaggcuagccucagccuuaugaaaguccucuugccucagccuuuugaguguuagguuugcugguaugagucauaauuccuggccucuuaaauguuuaagcaugucuuuuuggacaagcauguagacaauuacacuucagcaccauuuaaaacauguucuauguguuacaguguugacgcugcugaaagauggcugaagaagugguggugguggccaaauuugauuauguggcacagcaggaacaagagcuggauaucaagaagaaugagcgauuauggcuccuggaugacucuaaauccugguggcgaguucgaaauuccaugaauaaaacagguuuugucccuucuaacuauguggaaagaaaaaacagugcucggaaagcaucuauuguuaaaaaccugaaggacaccuuagguaaguuguuucuuauugaaggagaagcaacagcuuucauuuuagaucuuaguuuuggcuuuuuuuuuuuuuuuuuuuuuuuagauuuauuuauuuuauguauauaaguaccagaagagggcaucagaccccauuacaggugguugugagcuaccaugugguugcugggaauugagcucaggaccucuggaagagcagucaguacucuuaacuucugagccaucucuccagcccaacuuugaccuuguuacaacagcuccuguggaguuuugauuugcagaaaguuugccacuaguugagaaaggaaaagaaugccuggcguucagacuugguuccuuuguauccuguuaaccuauguuauguggcacauuauugaaccuuuuugacacgcuaaugaaucucacuuaaaaaacaaaucacuuuauuuuauucuaacugaagagaguuuuauaccaguggguuauugcuguauauucgcaucuauaggauuggucacuuugcacuuuuguugacgucuuucuuucucuaacucuguguguuugguucagauuuuuucugccuuuauuaaguaaggcagauggggggagccuacuucucucuggccuugguuaagcugaaggaaggaaguauguaggaggaagccuggccuccucccuuuucuuaaguuaucuuuccuuaauggacaggaaggaauugggagggacagaaauuuaauugugguguucaaggagacagacauguaauugcuuaauaauucuuugccuguuuguaaaaaaagagggaaacaguuuuuuuguggacaguuugggacuaaauguagcaugacugacauacuauuauuaaauaguauuuuaaaauuucaaugcacaguuaauaguuuaguauuuuaauaauuauuggcaauauaagguaaauguuucuucuuuuaaacuauuuuaagcugcaaaagcuaaaauauaguaaaaagaacuuccuaaaguauuggguuuucaguuucuacacugacauuucugguauauucaacauuuuaauuaaucugcaguuaucauggcauuugacagaccaguuaacuucuuaucucuuaauuuugagaaacaucaguuaacuguacucagaauauuacaguuauaguugucuucauuccccagaguuugggaauacuguauuaaauuaguggucacaucuaaaugauaugaaucuagguuuuguguucaaauaucuaaccuccccuuuccccagaauuucugcaccccauuuugauaccuuaaaacucauauaauuuaaugaauuuguuucacaauagcugugcuaguagagacauuguuuggaagucaagggaaaugaagaauguauguauucauuuuuaacuauuagaaacauacuagcuuuaauuuuuucuguuacaaugagugaauuacaacuccuguuuuugcugcugcccugaguuacuuguuccacggguuauuuuauggcuuaaggggagaaaacaguauuggaaaaagagaagccucaguuuugaaaacuuuucuauugcuugggugugggccaggucacauggauugggugugggaaguuucaguguuacagagcagaccaggaagcucacugaaaauuaucccggagcugugucaacaaacugugaaaagagaacacagaauuuuuauucaaaauggauugguuaaacaucuuuaaagauuuuuucaguaaguuauuuuguuuauuaagucuguaguuuucuuguuccagauuuuugaguuggauuuuauuuucuuugugaauucagagggaaacuuuauggaaagaacucaguggguuuauguaagcugguacuuuaugcuguuugugaaauagaagguaaauggcgaugauauuuucacugcuguuaguuugaucugguaaauuauuucaaaguguuucauugugaaugcuuagcaaauagggagaggauauacaugauuuggaugugaaguagaaaguuguaccacacacaggcauuugaaguaaagcaagucaguugugaacaauuuguuuacucucaaccuuugagguaacauaauaggguuuuuuuuuguuuguuuuauuuugguuugguuuuuguuguuguuuuguuuacugaauuuuacuuaagcuuuguugaaauaaugucaagauaacauuuaauaagaguucuaguaaacuacaaguauugacuuacaaguaaaccacuaugcuaacuuaacuuggcucugcugguagcaugguugcgauaauugugugcuugauuguaucucuuugaauauuugcuaagugucuuuacaaaagugaagagagaaauuauucuagaagucucuuaagagucagaaagccuaaggaaacagugaucuaaugagaguccaagagaaaggcaaaggcagggaguaagcacuguggaagaggacguggccauugcagugugugggcuuuugucuccuccuuaucuuugauggcugaccgauuccuacauucucccuucuaacuccuauuuacuuuuuagagaacaaauacaguuuuagaucuuugagauuccaguuuuaagcuaauuuucuuuuacacauuuguauguauguguguguacaagccugugugcauguggguacauguuauagaggccgaaagcuaaccucaggugccauccucaggagcaccagccgccucuuuccagggagacaaguucucucauugguuuggagcucauaauugugcugccaacacaccccagguguuucgucagcucagggauuauaaaauuggguuaacacacuuggccuuuuuuaccuggguucuggguaaaaaaugagguuauugugcucguggggcagguaguuacuaacugaggcuccccucagcucuuuauucauuaauuuaugaacacauuuuuauagagaaucuaaugcaagcuguauaaaaaccagcucgaugguuuggcaagauuguucagcacuugucaucaagccggacaacccauaugaucccuagaacugcaugguagaaggaaagaacugauuucuacaaacuguucucuuacuucagcauauucaugugcacauacauacacguacacauaucaaaauaaaugaacaaauaauguaauaaaauaauuuuuuaaaauuuguaugaaauauuaacucuugcagaaucuguuagggaguuagaugaucguaauuguuaauaauguagguggguuucuaucuagguguggucaugagugguuuuuuggcuuuuuuuuuuuuuuuuuuuuucugagacaggguuacucaguguguuccuggauaucuuagaacucacuggccucaaacucacagagaucugccugucucugccucccaaguacuagaauuaaaggcauguaccaccaugcuuggcaugagugguaauuauuaauaaaccagaaaauauauuaaaagaugaugcauauaaagcauauucaguccuaacuguaucuguaguccaaggacuaagauuuuauaguuuuguaagcaaaauauuccuuuccucaaucccuauaauauugauguuuauuuugcuagcaaccuugucagaguagagacagguuuucauucaccuaacuucuaaauggacuugaaaaauagagaaaacaggauuauauguucuucauuugguagucaggauacuuugaaaacaaaaauuacaauauuugucauuuuagauaaaauaauuauaaucugugauuuauuucauguagacagaugaagagaugaagugcaaaauggucuguaauauauauauuuguauuuauaauaaauuaguucuacucucagauaaacuauguauuagcuuuguagucuuaauacauagcuaaacuguuuuuuuauuuccuguuugggaaaaaaaucaacuuuugggcaagaccagaugauccuggaaagucccuuccagcucuacaagucugacagucuugugugugucgugggaaucgggggaaguccacaagggagaagcagguuugaagacgugagagcagaagaacagagugggaugauaauucagggaggaauuagaagcggcaauacuuucucugaacccauucugucgagcauuuacuuagugauuaagugaaagaaagcuaguauuggaagcaaaaccuaauaaaaaauugaaaagauugauaaaaaucagccugggaauggcugacacaaagaaaaaaauuuaguaagagcugcugugguuguguuggugcagaacuccaugguggccuugauucaagucuuagaguuacucaggugagggccugcagcagcuuucuuacauauauucuggccagcuaaacguggcaguuuguucacuugguaucugaugcuuucagacucugacauuaaguuuauuaagggauaugaaagcaguuuauauaaggaagaguuauuaguacaaagauuugccugagaaagaauaacacuaucauagagauugaguuaaucuuuuucuuuaagcaagguuucacuuuguagaacagcuuggccucacuucagaaaucugccugcuucugccucugaaguacugagauuaaaggaguuuaccaccauauucaguugggucuuaaaagcuuuugaggaaguuauaaugcauuguucuuguuaaaaacauugcuauagggaguuagagagauggcucaguggaugagaccacugacuacucuuccagagguccuggauuccauuuuuagcacccacaugauggcucauaaacuuuuauagcuagucccaugggaucuguuguuuccuugugguaugcaggcauacauguagacaaaaacaaaacaaaaccccacauagacauuaaauaaguaaauaauaggggcuggugagauggcucaguggguaagagcacccgacugcucuuccgcagguccggaguucaaauccuagcaaccacaugguggcucacaaccaucuguaaugagaucugacucccucuucuggagugucugaagacagcuacaguguacuuacauauaauaaauaaaucuaaaaaaaaaaaaguaaauaauauuuagccagauaaggugguacaaaccuuuuaaucccagaaccugggagguacgcggcaggcagauuucugaguuugaggccaaccugaucuacagaagaguucuagagcagucagaacuaccuagugagacccugugucgacucccucucccucccccacaaacauacauaaaauuucuagagaagaccauauagacagaagcuauacaaacauuuuugaaguaagaacaacaucaaauaugacugcuucagaguuaucucccuccucaguguauauaugugacuauuucccucccaacccuggccagguugguccaacugugucaugauaauaaaggcuuauauaauucugaaaaauaacaaaaaaaaccugacaacuguuaucuauugagugccuacuaugugcuguguauuauccuaagcacuaauauauacacuuaaaaaaacucuacaaaacuuuguaauauaguuuuauacauaucaauauuuuauaaagguacugaaguuuaaaaauuaaauaacuuguuuaaauuaaauaagaugacaaggggaaaauauaaauuuaagucuuuuaaguuuucauaauagaccccuuaagacuuacaaucagaauaagaguagcaauggaauaaaauaauuuggggaaaaaaaaccaaauugaagguaggaugauugugguaaacuaaaaugcuagaucaagaugugcuaugaauguagugggguuuuuguuuguuuguuuuuaaaacaaacagaaucucacuauguugccaaagcuguuuuggauuccuugguucauucaguuuuccuuaauaacugagacuauagaccaugagcuaccguguaucagcugugacucccagaauuuacagguugaaaccuaaccaucaauggaaugguauuaagauguggaggagcuuuagguagugacuagcuuauuaaggcaaaaaccuucaugaauuagauuagugccauuguguaaaacauuugcaagcuugcuuauuuaucucuuacaccaugugagcacugaacucuaaggaguaaaaaccucauuauuuagucuuuagcuuggacuuccagcuuccagaacuaugagaaacaaauauugguuaacuguaagcugugugacuuacguauuauaaugagcaggcagaacaaaggaagauagguggaauuuugggggaaaguaauauugauucugaagcugaucuaaaagaaaggaucuaauccuugguaauuaucacguaaaugguuaggugacuuaauacuuuaaaaauuauuuuguaaaauauuuuuguauuaaccuuuguugauagcagauuguaauguccauuuucugguaauagaaacaaaguuguaaagcaggaaaauacaaccuacuguuacacauacauuuguuuagaaaaauguauuauaguuauuuauugugugugcacaccaugcacgugcacaugagcacuuguuuguucaugugcauaccgcagcacagauaaguagguuagaaaacaacuuauggaugcuuguuccccauuccaucaugccggaucuccauuccaucaugccggaucuccauuccaucaugccggguccccauuccaucaugccggauccccauuccaucaugcuggaucuccauuccaucaugccggauccccauuccaucaugccggguccccauuccaucaugccggauccccauuccaucaugccggauccccauuccaucaugccggaucuccauuccaucaugccgggucuccauuccaucaugccgggucuccauuccaucaugccgggucaaacagggucauuaggauugguaggaaguacuuuuacucacagagccauuugccuccguuuguucuuuuuucugguaaagauuaauggaacauuuaauauaggcgaggcacuggggauagagaguggggaaaagcaggaugcucggccuguauuuagcauuaaggugaaaauaaaaaaaaaaacuguaauaguaaaaggagaaacacauagacucuuugggggagaggaaaggaaaucuucagugaguaaauacauuaucucugccaaguuuugaagaauagaugggaguguucuagugguuauaagaaauuuguucugccugugguauguuauaguaguaguuggagaggaggaggcauguuguugaagacauguucacagagauauggagagccucuaguguauggaaacuguaccaugcccuuagauuucuuccuuuaaauauuucucaucucuagauuaaugcagauuguuuuuaauguguucucauuugagauauuaguuguugaauuuuucuagaaauucuuuauuuucugguaauauguaaucagaaugcauauauaauuggaauaucuauaacuaguuauagauauuuucuuuaggauuaaaagucauuuggauuaagaauuuaauuuucagugaaaaguuuaaaauauuuuauuucacuguacuauuuacgcuguauguccgcuccauauacaguuuucgaugguguagugcaugcaaaagauuaguaaaccaugaacacuccucacugaaagauaugccuuguauuugauuuaaaaacaaaauaaaacaaaaaacucaguacaaaaaaaaaaaaaaaaaacccaaacuauuauacaguuauuugugaaguacaagauccgggacguuuuaacaagaagugcuuaaauguccuugggugggaggguagguugguuugaaucuagguauacuaucagugaugaagagggacuuucuuccuuuaugccuccccaucuuaauuccucuauuacugcuuccuuuguguuucauuucuuacaaugugcuguuuucuuaaucuguuuccuuuuguaguuuuuagguuuuccuuggaaacuacccuggaaauuacaauuagcauuuuguuuuuaacaaguuuaagucauucccaaugugguuuggaugguauaaauaacuguuccuuauaucauuauauauuaucucuuuauacacugccuacuuacuuaggcugaaaauaugauuuauguauuuuuaaaucauauaggaacaaaggaaaaaaguugggcuaguacugacuuuauauuuaccauuguuguuuauuucuucucuguuuuuaaaauuuaugagcuuuuaauuacauuuccacauucacuuucuucccuccaacacuucccaagcacccuugcucugcacccuccuugaaauacacggucucuuuuucuuuaauuguuggugguguugguauguguguguguucuuaaauauuuaauacaaucugcucauucuguauaguguuacuccuauguauguuugcagggcugacaauuuggcauuggagaauuaaccagugugcucuucuuggggaaggugucugcucucagcauuccuuaguugccuguauguuguucuuuggcuagggucgaggcuucuugcacuuuaguucacauuagcuugucucuguuggugguauucuuuuuucuugcuuuguaugacuucauuuuuuuucuucugucugaugucuuuuuuauuuccaucuagaagacuauuuuuuacauuuccuuaaaaagcacaaguuuauuggugaugaguuaagaaugucuuaaguucuuuaucuuugaggaauuguuugauuauuuuuuguaaagucuuuauucuuauucauauggcuaaugaaaucuguuucauagcuaguauuuugacauuguuuucuuaaacauacagaaccaaaagaaaauggggaauggaaaucuccauuuuuauaguuuggcuguaugcuuguauacucuuuuaauauuuggccaagccauuuacaauucugucuuggacuuuaccuacuaaguuguaggucagcagagauaaagaucaagguggguuuuuucucuagacuuuuccauagcauccguccagcccugaucacauuugugaucauguugguuccugagaacauacaggagcuuuuaaguaccucauuuccccauguguuaccuuucuuacuaucuuccuuuuccagcuuuuugauuuuucuucauugucccaauccaccuaggaagacaaccuagcucuggaaucagagguccgaggucuguuagguagcuauccucagaguaacugcacugggggagggagaccaguaggaaggccucuuuccugcuucagcaucuuaacagaagcagcgcuuucuucacugagccuugcccugccacuucgcuuucuucaccagauuccaugauuuacaaaauugauacugacagugcuugccaucucauuaacugaucuuuagaggaaguccugaaauuucuacucugccauuuuuagugaugucacccugcuguaaagauuucucauaaugaugaccucauuagccagaaguaaggaaauuaaggacacaguugauuuaaagguauagaaggauauuuuuuuuaaaggagggaucauuuuuauuuggacaugaauacagguuugagguguugguuacaucuaacagugucuguugauagaacucuuaguguuaagauuccagauagagcaaggguuuaaaucuucaaguaaaucugaaaaaaucuauagaaguuaaaaggaaaguauaugggguuuuuuuguuuuuuuguuuuuuguuuuuuaauguagagaaggccaacuaugccaucuuggaaaaauauuuucaacuaaggacuuacuaguucauucaucaauuacuuucuccugcucacuaauauauaaacuauaggcacugaagauaaagggggaaauucuaguuuucugucccuaggaagcugacucuucuauuaggaagcagacaaguaauagaguauaagacauuguuacagcaaggcucacaggggaccagagaaacacaggagugagcaaaugucacgguaagaggggcagcaugaaaacauggagagcuugccugugaucuuauuuuucauaugaaaagaugaaaaggccaaagaggcuaauaauuguguguuacauauauaacacauuauaugaucuggcuuuggaaacuaagaaauuaguaaaugagauuacccagauauaauuuuauauguacacagguacuaauuuaaauaguuguuucauuuuuauacagcucguuacaaaaucuuggucaauaaacuaaaauguccaagugugggauuauuagagugucugucuucuuaguuguagcuaugaaagaaguaaaccauuuuaacacgagaaaauucaacauggcaacuuuauuauuaugcaguuauuucuuggcuuuagcaggagaaaagaagauaaacuuaauaguuuauuuggcuugguuauggaagaacaacuuguauuucauuucccaaaagaugauccaucaugucauagucuguuugcuacauuuagaggcuuggguaagguaagugaaucaaguugaagcuauagucuuauggccuccucuuuauuuaaacagguauuggaaaagugaaaagaaaacccaguguuccagauacugcaucuccugcugaugauagcuuuguugauccaggagaacgucucuaugaccuuaacaugccugcuuuugugaaauuuaacuacauggcugagagagaggaugaguugucauugauaaaagggaccaaggugaucgucauggagaaaugcagugauggaugguggcguggcagcuacaacggacaaauuggaugguuuccuucaaacuauguaacugaagaaggugacaguccuuugggugaucauguagguucucugucagagaaauuagcagcaguugucaauaaccuaaauacgggucaaguauugcauguuguacaggcucuuuacccguuuagcucauccaaugaugaagaacucaauuuugagaaaggcgauguaauggauguuauugaaaagccggaaaaugacccagagugguggaaaugcaggaaaaucaauggcaugguuggccuggugccaaaaaacuacguuaccauuaugcaaaacaauccauuaaccucagguuuggaaccaucuccuccacaaugugauuacauuaggccuucacucacugggaaguuugcuggcaauccuugguauuauggcaaagucaccaggcaccaggcagaaauggcauuaaaugaaagagggcaugaaggagacuuccucauucgugacagugaaucuucgguaaguugauuuucaaaggaaaugaaaauagagcuccaugcauuaauaaauaagguuggaaagguugaguggcuggcuuccuuaagccaaacugaggugugaucauauuguucuuuccagcgugccuguuuugaguaagauauugaguacugaauaugcuguauuaagagacuuucuucaguuguauuaaauuugcauaucuggaauauuucugucccauuaaacuuaaaaauggggcaggcugagcauugguuucuuccuggagaguaggaugaugcaaauuaacugcuacuagagauaagaaagccgucacuguaguucuugcaggaaaucucuuaaauauaaaaauuguuucuuuauaaauuaguuguuugauuaaaaucucccucuuuuuuuuuuuuuuuuaaaugagagaaugacucauuguauaacucggucugcccugaaacucacuguguagguagaccagggugccuugaacguauagauuuacuauaucugacuuaaauuauucaccucaaccugcuuaacaccauuuaaaauauauuugcaauaaaagguaaauuauguugcaguaccagcuagacaguaaagccauacaaauugaaaaaugacaucauuaauaaucucuuaaaaguguuccuuugaauguuaaaauuugacaguuguuuuuuaaaaauucuuuuuccugauaaaucacugcuuuucuguuuaucagaucaugguuaguacugguuuuuuguaaauacauuguacagaagguugaaugagauacagugguguguguaugagacugagauaauugaaccuccugaugaaaauugggagaaaucuggccuuuagccucucaggagucagaggguugcuaacagacaagauaaugggaguccauuuucuuauuaaaauccugauaugcagagcauaccauuuaaaagucacuauucgugacuugacauuauucagaaauauuagguuuaaaaugacaccugcagcugccaccaccuaauuaagaaaaaagccgggcggugguggcgcacgccuuuaaucccagcgcuuagggggcagaggcaggcggauuucugaguucgaggccagccugauauacagagugaguuccaggacagccagggcuguacagagaaacccugucuuggggaugggggggaaauuuaguugaauuuuuauuuguccauuauuuuugaaaauacagaguauuauauaagucaguuacuguucacucugaacugauaggagauggagugaaagucugaaauuucugauguuuucucuugggcuucugaaaacuacuuuuuguguucacuacuuuguggguacuguagauaacuguuaggagacacuagcacccuauuaccagguaauggauccuaggcaugcucucugagccuuauuuuucucauuuauauaaaaaggguuuauuuugaggaauaaagaagaguauguaaauaauuuaguauagugucuuguacuuauuaguaaauguucagauuucagcaguuauuuuuuaucuuaccuucugauacauggcuuucaaaaugcuuacuucccccucccccuuucucuuuuagccaaaugauuucucaguaucacuaaaagcacaagggaaaaacaagcauuuuaaaguccagcugaaagagacuguuuacugcauugggcagcggaaauucagcaccauggaggaacuuguagaacauuacaaaaaggcaccgaucuuuacaagugagcaaggagaaaaauuauaucucgucaagcauuugucuugauagugcucgucagcagugacuguuccacagcuuuaacuggucauguaacuggagacugagaaagugcugggccaauuguacuugcuuggaaagugcuguuucuaacuauaugagaauugacuauaauacaugaguauuuuuguuauaacucagcccauacguauauacuacauaugcagugcaucucuauagaagaguucuuuauucuuggucuuacuguuuucuuugcuguuuuucucuuuccuuccaacaaugaagguuuuguauucugaaacgaauaauuugguucaaaaucuuuauauggaagaauucuuuuauugcuguuucuuuauuuccuuguaaagauauccuguucucccauaguuccucuucacauaaaauuauaucuauauggcauaugauaaaggacauucuuguaaaguguuaaucuuuucugugacuaaauagcaauaauaaacagaaaauaagaaauuauuuucagauauugcaucugucacaagccauuguaaauaucaaguauguuguuugugccuuaauuuuuaacaauccauucauuguauccaaaagacaccagauaauagguuagaaaacauaauuuauagccauuuuaaacaaaaauacaagaauuuagggagugucccccacaccucaaguacccccuuucacgggauuauucaugagaagagagcaguuugggcaguuggcucuugaaaugaaaugaauguuccuuagguucuuugaucaaguauggucuauagauugugccauauuuaugccacugugaaauaagccauagucaaguuuggggaauacaguagacaaugagauauguaacuuuuuuuccuuucuaaacaucacuaauuccucaugucaguaauuuaagguuuucaacuuuucaccauccugauccaguaucugaucagauuuacuggaaaacaacaacauuuuucgacacuauugaauauuaaacccaaggauacacaugaaaagcagguguucugcgcugaguggguccccuagccccucguuacuuaucuucuaguuucuuuaacugggagacacacugaagugaugugcuaugguuagguaaacaguauuaucuaaaauuuucuguuugucaucuaguacuuugugugugugaaugagaaacuaaaauacugagucugcuguuggucacacuugucuuccuucugaaauuguuaauguaaguaaaguaacaggagccccugauggcacagaagcacaaggacagauguugcuguucucugcugguuuaaacacucacuguaccgaauuuacagcugguaaaaauaauaguuguguaguuucaccuuuuccuucauuguaguagcuuaaacauuuuaauuuaaaucuuuaaccauuggaggcugauguugccacuggguggcagcccuggccucucccacuaagaaguccacagauauaauuaaagcacugauguauaauuucaaucuuuauaacaccugcuuugaaagcuuuuuaaguuacguuugucuuuaaguacucuuuuuuuuguuguugguuuuuuuguuuuuuguauuuuuguuuaagguaaaugguaguagauugguuuaauauaaguaaagauuauauauaugauaccuuuggagguguaaaauacugugacugguuucagaaugaguaaguaggcaguaagcaaucuuagcguuugaugacacuuuauuuuuugcuuucucuuuguaugucccccuccacugaacaaaauggaccuuuauaaaaagaagcagauaacuuuaucauggacauagcuguuacugugccugcagcacaagugaugcuuugggaaggcagcgagcagugccgagguggaauacauacauccugcuguagcuagagcucgcagagagcgggggugcaucaguaaugucugcacucuuaacuuagaaugaaacccaacuauauacuguuauuuuguaccucaaacauuugauugauuuuuuuuaaaaauguuuucgacuuuucaaccaaagucuguucauaaagcaugaguuuuccuuggagcaauuuucuuaggaauuagaacaaccuuggaaaauguguacauagcuaggaagaaagacuuauaaacauccaaaaccuagugcuguguguaucuugacacacuacguucugugugcuaguuuuagacuaagaaguggguccugggaaauugcuauuacaaaagcuuucuucugaauaugaagacaugguuaguucucaaauuuugauacacaucgcaccuguaguucugccuggcuugugucuacaaaaacuucucuaaaaucuuggaagagguuuuguucuuaaacagcuuuacguaugggugcaagcuucaugacaaaccagccccccccccccaaaaaaaaaaccaaaaacaacaacaaaaaaacccuauaaauguuaugucucuuauuuggucauaaaucuugggugaguuguauauuuucauaauguguauugcauacaaucacuauguuaacacacacaccuaagacuauuaaagcuguuuuacagacaucauugagcaaaauacaaaauacccagcccagaauuauaagccuauaauuuuggcugcccaugaggcugaggcaggaggacuaugaggcaugccuggguaauuucucaagacacugucugaaaaaagaguugggauugcaguucuguagcagagcaugcuagaagccuggauucucucccaagcaccaccaaacaaaaaaggaagccaagccuauugccagaguacggacaccuaccaaugagcaacuuagguucuuagaacauugcaugcaaaucaugucauuuuaguguucugccauugcagucuaggguugcaaauauauauaugguccaugaggcgacugugggaauuaggaaaaggcauuuucuccucauacaucccaugccuugucaaaaaguguugacuuuuacccacuaaugguguagccaaauauagaaguauuguucaacuuauguaguauucaacuugacagcacuuaaaacagauuucagauaacauuguaauuuaugguuuaaaaauaagcuaacaaugugaguugaauucccuagguaguaaucaacuuggaaccuaauguggauggucucauaguacacaugugaaagacauucaagcagaauaauaaaagucuuccccaacucuuaacccau

SEQ ID NO: 5268 - RNA, 2553 nt, Mus musculus
caacuucgccggggaaagaggaagcgacuagagacuagcaggcagagcggaccgaccgggagaccgaaaggacugugcguguguccgcacgcgagcgaggccgucucaccuucccuccgccgagcccucggcuccagucaccugaggaccgcaccgggacgccaccgcggcugcccggaugccguuaccgcacgaggccugugcugcgccgccgcguagcucucggagaggggcggggcgcgcgcaaccggugggcggaccguugcgggcaggaaacccgcuccacgcccaaucuaauaggcuccaucgccuccugcgcccgccccugacgcuucagcggaaugcgccgcuccgggauugggcgagcgggcuugucaaucaagcgcgggcccugaguggucccugagcugagacugcgcggccuuuggacagaaggugaggagcgccgggccccaccgcccuguucuccccuagccuccucgguggcugcuuacuuuccgccucucccacugcuacuaaaaccugucauucauuuuaaaucgcucauuaaugucgaacagcggucccgaguucaacccagacuacucuggugccugcaucugaaagggccgaccagcugcagaucuuagggacagggagcgacaaagaaaaugaagccucgggggaaaaauguaagauguuuguuaaugaaaaccacaaccaaaauaagcuuugcgagcaacuuccgagugcccuggcgcguggguagccuucauucccggcuuccaguccugugaaaaggacaguuacuucugcccuaggggugaguauggcaguggcacagucccagccaccugccaaggaaggcaucaauaaaucggcucuccuuccuaacuugccuuacagcgacucauaaccugccucacuauuucccaaucaccuuuguugcuuaguguggguguggcaccuaaaagaaacauucuagguuagguaauuuuauggaaacacgaguuuuugccuccagcguagcugcacccauauaccuagauugcaaagucuauuaaaagaacuguuucacccacgcccaccucgugccuagcacaucauccucaacaaucgaggaauuaauacagcuuccuuucaucuuuuaaaaauucauuuuuauucuuuguguguucgaguguuugguguacuuguguuauacuuguguauaauuuugcugcccauggaggucaaaugaggguauaggaucuucuggaacuggaguuacagaugguuuugaaccacccugugggugcugggaaucaaacucaggccccuuggaagaccagcgcucuuaaucacugaaucucagccccuuccuuuagcuauacuacaagcccuaccuguaaauccuaaaaaguuguuuucugcuuuuaacuuaauugcauguuaauaaauacauggguggccugcccuagguaaaauacaaguuaccuguagccccuuuuaauccugaguuuaguugagaaaaguagaacauaaaacuggggaaaggauacucugccuauuguuaguaucaaaaguaaguaaugcaaauuauauauuuaaaaacauacauaccgaagagaagggggugaugcaugcagaagcagguggaucgaggccagccuggucuacagauugagugugaguuccaggacagccagggcuacccagagaaacccugucucaaaaaacaaaaagacaaauauauauauauauauauauauaugcagagacagguucaaguucugcaaguucaaggccacccugguuuauguagcaaauccuaggacagucaaggcuacauagagagaugcuaucucaaaagcaaaaacauacaggcagcugacccccauuaacuccaaaggaggauauuugggguaauaaaggaaauaagaauccuccauaucuuaagaccuuucccaguaagcuauugacagcuuauauaguuagaaugaccuaguuuagugucccuaucauacaguaauguuuaggaggaagaaaauccuaccuaucugcuaucaagaaguuaucacagacuugauauugaaguguaaacauuagugggcccuacuaaauaaacuuaacuucuggauuuaguauaguuaugcuguuauaggaaagagucuaccuuguauggaaggugcuaaaauaggcacugcagaucuugaguccacaccagugucagauauugagauuuaaaccaaccuguauuauuucugugcuaaccauaucaacaguuguauguagggacagaugggcauuaagccacaaugagagggaaauguguaguaagacuauuugagcaaaaagaagggcuugggagggaguuaccaagucuaaagacauuaagcaauuauaguaauguugauggagcagacaguggcuagauuugaagcaauguguuaggaaagcugagguccuuagaguuuauccuacaagaaaugagaaagaguuguuucacuaaagaguuguuuuucaguacuuuuucaguagaucauucugauguuuucuagcucuuguuucuacugagaagcaaguagcaauuca

SEQ ID NO: 5269 - RNA, 2036 nt, Mus musculus
uauagaaaaaaggaguuuaauuugccuuaugauuccagagaucuaagagucugucauagcagggaagugugagguccaagaauucaauauaugaaccuauggaaaacagaucucuuucaaaccaucaccuuuuuuuuaaagauuuauuuauuauuauaucuaaguacacuguagcugucuucagaugcaccagaagagggagucagaucucauuuacagaugguugugagccaccaugugauugcugggauuugaacaccggaccuucagaagagcagucagugcucuuacccacugagccaucucuccagccccccaucaccucuuaauuauacacaaacaauagacagauuguugauuucaguuaauuccuggaaaauaagaggaacaaauuacuaauaguuguaacucagauaaaucucucaaaacaaaacaaacaaacaaacaaacaccacugcagugauuaagagcacagacugcuccugcagaagacuggcauucaguuccaagcacccaugccaggcaguucaggcuugccugaaacuggcuauguagaccagguugaccuugaacucaaagauccaccuauuucugcuucucaagugcugguacuaaaaguauacaccaccaagcccaguuuauuuucuaugugugcgugcaugcccacagagaacagaaggugguagaauauuccuugaggcuggaacuaagaggcauaugugaccacccaauguggguggugagauccaaacaccaguccucuaauaaguaaugcaagaaccauucuuaaccuccgagcuaucucccagcccaucuuuuuaaccugccuuaaagaaagggcgugggggacaucgggucuaaauaccuacuauguuugaguaacacaagagaaacuuaguaucaguuaaagagaaaauacaauuggauuaagcaaaaaaauauuucaaauuguggucauacuaagaggaguaccagugugcuuggaaugaagaugaggcaaggacacaggagggaaaagcaggcagaggucacagguaaaggaagaggaggcagggacacagguaaagggucacgagaggcaaugcagccaccagcucuagugaaauucaagcaguacauaugagauacgcuugucacagaccucucgucucauguggugagagauaaggcuugcaggacacaugugggaguugaggucucuagggaagagaagacaagcagccugggcagcaggcacgagaaugucagcaaaggaaacggcggccugucacacugguccagaagcugcugggucagugccugaaaguccaaagguuccaaccuaggccuucaccucaagaagaaauagagaaaagucagggauaaaugucacgcagaauugccagauccauauuagaaaaaggaagaguguuaagaggcuuaggagccacucagagcuggcccagucaccagcugcacaggcuaccugacuccuccagcucaguucagaaaacuugguaacugccuuccagaggcauugugagaaucggagauagugccuguaaacaccuggcauccagcuacugggaacaggugcuaugccuacccuggguaaaguuaacaaacagcacacacaugaaauuuggaguuaagcaguacuaagcucaaauucuugcuccacugcuuacuagugugaucccagauuuccaagcuauaggauccccugcacaaugaaaccucucuaacaccaagcuauuuuaagauuuaaagaagacaauguaaauagccaggugguguuggcacucaggaggcagaugcaggcagaucuugaucccagcuuggucuacagaguggcuuccaggauagccagggcuacacugaaaaaacccugucuugaaacaccaauuaaaaaaaaaggaggagauggaagaggaggaggaggaagaggaggaaaaggaggaagaagaggaaaaagagggagaggagggggaggaggaaaauaaaaucuuagagccaaguucuuuguaauaaaaaguaguagcacuugggaggcagag

SEQ ID NO: 5270 - RNA, 2527 nt, Mus musculus
augucagggacaaucauuggccugauuuuuuuuuuuaauuagugguugauaguuuaaacuuacuucauucuuauaaaaaauauaaauuauguguaauaaaaauuuagaaucugggcagacaaaauuucugcacaaauggggguagggcccccaaggucccacccuugccagaggagauucugguggucauugcugagggaagaagacucacuuuccuguagguacucacuuugccagugguagcuuucccaggccccagggaagucccacacacgugugcauaugaguaguacuaacuggaggcgagaggcagggggaugaaaaggacacuacgguugggagagagacaggauaaaggacacuuggaguuauagagucuuaaugguagauguucaggucauaauacaauacauaaagguaugguguuuucaacgaauacauuuuaauacaguaacuuuaaagagcuuagggguugaggaugugcuuggcuuagcacauacaggccuagguuugauucccaguaccacauaaacuguguccaguggugcauaccuuuaaucccaguacuaggagcaggaggcucagaaggucaaggccauucucaguuauagagcaagauagaguucauccugggauaccuaaaaacuugucucaaaggaggaaagaaagcaaaggaaggggaaagaaagaaggaaagaagagaaguaacuacugauacucuugcuguguaagauuauuaugguuaacuuuagcuuuagcaaaugaaaacaaauuuuuuaggaauauuucucacuaacuguacuucuuauuuauauuuagcuucaucaaauagaauuauugaaagaauauuuucuggagcaguaacaagguaugaaaauuuaaauuaugaauuguauuuagugggcuagcaaaacacuuuaauagaaaaauaaaauaaaacaacuugaguuucaaaaugaacuauacuauugcauuuuagcaaagcuuucugcaugauuuggcagggcuacuaaguuauuauuguaucucaaaaccauacaguugugccuuaauaaaagacauuaauuccauaauauuaauccaacauggcugaguggugguggcacaugccuuuaaucccagcauucaggaaguagaggcagacagaucucugugaguucaggccaaacuguucuacagagaggguuccaggacagccagaccuacccagagaaaaccuaucucaaaaaaaagaauaaaacaaaauuagucuggagucuaaauauaaguaacaauaucuguugccauuaauuaucaaaugggaaaccagggccagaccuaguacaugggccuguauccccagacgccuguauccccagacgccuguauccccagacgcuuacaaggcugaggcacaagguucacacacugaagcuuucuugggcuucagagucaauucaaagccugucuagauaacuuaauaagaccuuguuucaaagcugggcgugguagcacaggccuuuacuccuagcacuuaggagacagaggcaggugggucugugaguucaaggucagccugaucuguauauugaguuccagcuaccaaaagcuacauagugagcccugccucacaaaaauuacuuaguuaaauaauaaaaguaaaagaaggauaaggauguaccucggugguagagcacugccuguguuuaggcuuuaagguuaaagcaacauggauuuuuuuuuccuuaauuuaggcaaaugucuucuaauuucaccuuguaggccuuuaaaaguuuaaaagugagauaggccuacaaagggguugcccuuucugaacuauccagccuuaugaggaaucuaucauuuuccuuuuuuuuuuuuuuuuugaauuuguaaauuucuaaagaguguuacuuuauuucuuaauugcuuagaaaauuuuauaaccauguguuuucuucagaggaaaaacuguacaaaaagagggaagaaugagcuaugcagauuuuguuugguuuuugauuucugaggaagacaaacggaacccuaccagguaaaguuuuguugucgagauguacacauaugcacaaagcugggaaagaacaaguguauacuuguaaacugacccaggcuagccacagaggaugugucagacugucuguccuggaggagcucaggcuaggaaaggagaggcacagaaugcauggucauggggugggaagugaaaggcuguugcacacauaaagguaaagugaggccugcuccucccaggagugagagacagagcugguguuuauagugagugugggauagauucugcagacuuuaguucuuuuauaaucugcaccaguucuguaguaaauugaagaaggaaggaaaagcaaauugugggacuagaaagauggcucgguggauaaagccauucauuccaugcagcuugaggaccagaguucagaguccagcacuacauaaaagccaaggucugaggacccuaccugcaauucuaauguccaggagacucagacagggcauccuuagggccagaguc

SEQ ID NO: 5271 - RNA, 1047 nt, Mus musculus
cauggcaguucccgagacccgucccaaccacacuauuuauaucaacagucucaacgagaagaucaagaaagaugagcucaagaaguccccguaugccaucuucucccaguuuggccagauccuggauauccuggugucucagagccugaagaugaggggccaguccuucgucaucuucaaggaggucagcagcaccaucaacgcccugcgcuccaugcagggcuuccccuucuacggcaagcccaugcauauccaguacgcaaagacugacucggacaucauugccaagaugaagggcaccuuuguggagagagaucgcaaacgagagaagaggaagcccaagagucaggagaaaccugcugucaaaaaaggcuguucaggguggggcagugcccccguggugggugcuguccagccuguaccgggcaugccaccgaugccucaggcaccccguguuaugcaccacaugccaggacagccucccuacaugcgaccaccuggcaugauccugccaccaggccucccuccuggccagauccccucuagggccaugcccccacagcagcucauaccugggcagaugccgcaugcgcagccucucuccgagaauccacccaaucacauccuguuccucaccaaccugccugaggagaccaacgagcucaugcucuccaugcuuuucacccaguucccuggcuucaaggaggugcgucuggucccugggcgccaugacaucgacuucguggaguuugacaaugaagugcaggcuggagcagcacgagauguccugcaaggcuuuaagaucacacagaacaaugcuaugaagaucucuuuugccaagaaguagcaccuuccccuauggaguaccccaguccccucccccauucuuuggcucagucccugaagguaagucccccuugggggccuucucagagccgugugagugugugguugccacacagcauuguacccagagucuguccccagaaauugcaccuggcgcuguuagguugugauuaaagugaguuuuugagguuuggguuuuuu

SEQ ID NO: 5272 - RNA, 4741 nt, Mus musculus
cagugggugguagcucacuguguccuugaaggagagguuguugccacaucuugagauagaccaacuucuccaaagggaaagagcuuucgcuuuuucaaaauacuugaguugggucagggagauagcucagucgguaaaaugcuugccucgcaaccacgaggaccgggguuugauucccagaaacaauauaaagaaggccagauauguuggccugcacuuguaaucccaaugcuagacaagggcauaugccuggggcucauggucagccagcccaaacuacuuggugggcuuguggccaauaacagaccccaccucaaaacaguguggacaacuccugaguuaagguaagagaggacaggaugggugucagugugugugugugugucagagagagaaagagagagagagagagagagagagagagagagagagagagagagagagaugcucaugugagaacuuaucagcauuagugugcaaaacuaggagacagaggcgacuagguggagaaaguccuuaaguaaagggacuugaggcuugcuuaucuuuuguguguguuuguugcagagggugagggauggagguguaguucugaauuucaaagagcugguuugggagucugggaguguccuccucugccaagucuggagcagaccccaggggcugucagcagcagcuguugacugcucccucucgcauguaaaguggccgugccagccccgcuggcgggcagccucaagcccuucugccaccuuguacuguugggccucacugaacauggagcucggccugucaucaccacucccuccaucucagcagguggcugggccuuccagaagagccacccugggcaaggaagugacaacuugucauggccagcucuucuugguugagaagccaggggcacacugaccucugggggcagaacaaagggaaacacagagucaggggagcaagggguugugucuucccacccaaggauuuuaaauuucuccucugucuguuuauuuguuuguuuguuuguuuuuguuuuuguaccacacaggugguggugucuucucaagcucaaugguaauuacagugccggucacgauuacuuaacuuaucucugguuguaugacaggaaaucuauuagguuagaggaugcugaccagccccaugaggggacagaacaggaaguugaugacauugcagcaggcaaggcauucacaagccagguaggucuugcugcuagaagaggaaaucuggaccugaagcuaaggccaguccauccacaugucugcaaagugucguaagggucccuuacuuuccaauguagguauuaagaaagggcacagagaaacagugacuuucucugcuggguguuagguaacauaaaagagaauucuuagcaugcugaagaauacggagguucaguaggaaggaaucaacauccuuguggacagagaaaggcugaagagacccuugcuucuggaccaggcuuugcacagcauccuguaucacuucccccagagaugcugaggguacgggucugcacacugcaggcaaugauauauuacuccugcucaucuuugcugugaucaaaugccugacagaaacaaguucccagaggaauccuuuauuugggcuugcaguuucagaggugguaauccaucuuggugugaggggcggagcugaacaacucuuaucauggcuggcaagaaacagaaaggcacacaggaaaaggccaggguuaaaaacaacuuccagggaccaacuuccuccaacuagaucccacagaacagaccucuaugcaguacccauucuguccccagccggguacaggggacauagcaguaaugagacucagcuccuaccucaagaagaaaaguuuaucucugcagccacccagucaauacauuuuuuuugucauggugaggacagauacagcacacagccuucugcucucacccacucuaugaagaagggcggcuuuccaaggccaagcacuggucucaggacucagcccccugcugagcacucaucuuagaggagcuuccacgugacuggcauggucaugaugucucucuccaccagauucugugagagaaagucucugugggaucacacgggaauccaggcacuaaagaauacugaccguagugaccacagacuuagucacaaaaugcuccaaucauggugcaggcaucucuuaaaguuugaaaaugauaggcuuaugacuaagagugucacacagugggucugaauuucauaagccuacugcuccaaaagguuuauguuauagaaaauacaucggaauuuuaaugggccaugcauauaaccuauugaucaugcuauuguuaucauuaaagaaagaucuacuaagaguuaggaguuggacuaugucacccacaagaagauacacccaucuucuaaccuguuauugugucacuuggauucuggaggauauaaucaagaaaagaugaggucaucuuguauuggaaucuggcccuaaauguaaugcuggcuucuuuauaagaaggucgugucagaaagggguaagcauccucugaagaccugaggcagaggugcaaguggggguucugcaugacagacaggucacuucuaggaauaagaaagaaaagacauucugcucucuggccuuaaagugaagcauggucuuaaggaaagaggaaccucuggcuuauagccuccagaacugagaaacugaauuucuggucuuuaaagccagauuacagaccccaaaaucaacugacagggacucacaggaacucgaagagaucagggagccugcugggauuagaucuagguccucuacauauaugucaugacugaagagcuugguguucuugugggaauacuaacagugggagcaggggcuauccccaauucuuuugccuauuugugggaccccuuuccucagacuggguucccuccuccaguuuugaugugagggcaugugccuugucuuauuauagcuguuaugcuguguuugguugacaucccccugcuauuuucuaaagcgagacaaaagggggaugggucugggggagacaggaagugggaaggagaggcuaggggagggaggaaaaaccacaguuuggauguaauauaugagaugaugaugaugauaauaauaauaaagcuggauuauuuuacuuucuuuacagcaacugcaggaggauaaugcaugggcuacacauagcgguauuaggcagcuauuuaaaaaucacugcuccagacucuuacaaaauauugcuauuaacgagugguacuuggggaugagggguacugccugacaccuuauuucaaagccucuuaauuaaucuucggccccaauaacauuuauucugugcuguauaucagacuccagccacaguccacaccauagaggacucuuuccuagcacgcagcaaguccuaagaucuagguagcaacuucagccaagacugccacacucuagauguucccaacacuaaaggcaagguaugcucuacaaacccaaguggccaagcccaagagugcucaggauuaucugcccgcugcagucacucaaaggacgucuuuauugcacuaaccaucccagauacugucacuuauguagaauuccugggaguaaugcucaagguuaguagaauuaacgggaaucggaauuagauuagaaucacggguagguggcuuuaauaugucgacaagagugguucccuagaccacagaaggggaugugagcccuggccagcaaugugaguuagcaggaggcugcacaugcauagcaaguauuugucaauacccugcuaaaucuaacacacucuuaagaaaagggaacagagggcaaguuugccuugcaugucaagagucacucuggagugggcagauuggacacaccccuugaggcagugagcauccugacuguaguugaccagccugggugaggcagccacccaugaaagcagcucugugcagugcuggguagacaaguuggggcgcagaugggcccugucuucagaacacaucuaugugauacgcucccccgcuuccuguuccucagucgcugucugcuacuuuggaccaaaaaagucagaagugagucuaagugcuaaacgagaaaaguauuuuaaaaggaguggcuggcaucaaagguuugggcaagcacaccaacccauuuuccucaaacuaauagguaaagugauuuuuuuuuucuagauaagaccagaaucugucaagcuucugcuugcccccucccucccggcucuuaacagccaguggaaaaggcuccuucuggcugcugaauugcaacugagccuauguaacaaagaggugcuucccaggaugccaggaaauugcaggaaaaauggucucuccaccuuuggaaagaguucaucuggcccugcugcugccuuccuucuagaggccaagcucuuguuagagacacugcaauuuauucccuugcugaggacuaugaugcaggaaauggagaaggagaaggacucugagcauuugguuggcugcugggacaggugagcuucugagauggugaucucauuugucuugcaaauaccacgcacacacuacccagaagaggggcugggagacaagccaccaagccucggugacugcagauggaauuguuucuaaacagaauguuuuucaaagcuucucuugaagcauuagcugugccugcaaaaugaaugacacaauguauuucguacaaguaauaaaauaugugauuugaauaacuaca

SEQ ID NO: 5273 - RNA, 14108 nt, Mus musculus
ugaugccccgcgccccaccacggcguggagccuagagccacguaacuuuggcggcccgggaagacuacacaccucuuucauggcuucggcgaacacccggcgaguuggcgauggcgccgguggcgccuuccagccuuaccucgacuccuuacgacaggagcugcagcagagggauccgacgcugcucuccguggcgguggcucuccuggcggugcugcugacgcugggugaggcggccggcauucacggcgagggcaggguggcucggcgccgcaggccagggaggcggacggcugcguucccucuucuacuacucgucuuccagacccagcaguguggaaaggggacgcugaagugaccugggucuugggacaggacuuacaugaggcggcccugugcgcuugagcgcugcggccgccaucguucauuccaacuuugagccacuugugucugaacugggcucugagauacugggguacuaagguagaguagaaauccaccaaucaaauguagcaagccacuaauuuuucccagauccaucauucuguguauacuuuuagucuccacauuuggaugagggaaauagacgugaaaagguuuacaguugauaguggcuggcgcuccgugaguuccuaacaaaacugacucuaauccgugugacaaugaaaguaguccagauggacgcuuuguuuuuuugucguaaaugccuacuaauaaugucuuuagaaaaugaaggcugccuuucucuucucugcaguguucuggaaguucaucuggagccgaaagagcagucagagagcuguucucuucguuggucucugugacucugggaaaacguugcuguuugucaggguaaugcuuugauuuucaccucgguuagacuuaagagggauggguaaggcauuuccguagcccugucaucuugcaguuuauuugguacagcaaguuuaggacauguuuuuaaaaauauuuuuuuuucuuuuuaauuauauguauguguguggguauaugcacaugagugccuguaccuguagaggccagaugugucagauuuuguagagucggucuucaaagcugccugaugugggugcugggaauugaauucaggucccuuugcuagaagcaggaugggaucuuauccaacuuaguugagucuccagcccugggaguuaauucuuuuuuuuuuuuuaagauuuauuuauuauuauaucuaaguacacuguagcugucuucagaugcaccagaagagggagucagaucucauuacagaugguugugagccaccaugugguugcugggauuugaacucaggaccuucggaagagcagucggugcucuuaaccacugagcuaucucuccagcccccugggaguuauauaaaaaagacucuaggaaaaccuguaaaaacacacacacacacacacacacacacacauacacacacgaugcuguuagaauacguggucuggggauggggaggugacucagucuguuuucuugccuggcaaaaaaaugagggucugaguuuggaucgguggcacauacgugaaagccagguccagaaguucuugucagcaaucccagggccuaggagguauggaucccuggaauuccuuggcucaccaccacccaugcuaguugguuuucuccccggguucagugagagaccacagccucacaaaagguggcuggcugugugguggugguccaugccuuuaaagccaacacuugggaggcagaaguaggaggaucucuucaaguuugaggccagcuuggucuguagaaugaguuccaggacagccagagcugcacagagaaacccuaugucagggaaaaaaaaaaaaaaaaaaaagcaaaaacaguaaauaaauaagguggagaaagauuaaggacucccgacaucaaccaaccuucaguguacauacaccuguuaaaaaaugcauuaccaguuucuugggcuacucagaauauaaugguuauggacauacauuuuuuuguuuguuuguuugauuuuguuuuuuuccagacaggguuucucuguauagcccuggcuguccuggaacucacucuguagaccaggcuggucuugaacucagaaauccaccugccucugccuccuaagugcugggauuaaaggccugugccaccacugccuggauagacauauauucuuaaguguagcuugcguucuuauucuuucuuuaaacaaucaauaaaggauaaaggaagcccaauaacuuuugcugauuucugugacuuaaaauagucccagcauggcuaguucugagcaauccagcauuaucacaaucaugacaaaaauuacccuccuucgacagucuuaagcuagagaggccucccuuuacuaacacuuaguuuuauguaagccaguguauuuuaacugaacauguuuuacuauggagaauuuacccucuuccuuuggaggguauaaauaauaauaauaguaguaguaguaguaguaauagcuauuauuauuuuaauuguguguguguguucauucauguguguaagggcugguacgugugagccuuggcacaucuguggaggucagaggaccagaaguguuggucuucucucauugcugugccaggcaagcuaguaugaauuucuggagauuguccugucucccucccauuuuccccauaggaguacugggcuugugaauguguguacuacuagaucuggguuuauguggguucagaggggcugaacuuaggucaucaagguuacacaggaaguguuauguccacugaacaucuccugaggccuugaguugguuuuggugccuaaaaucuuuacaggucaguaauuuggccccuugcuguuguuuaaaaauaauacuaauaauguugggcccagggugccacuuucugauggcacugcaaaaagaaggaauaaagcuuguaauuaauuauuauuauuauuugguuuuucgagacaggguuucucuguguagcccuggcuguccuggaacucacucuguagaccaggcuggccucgaacucaaaaauccgccugccucugcuucccgagugcugggauuaaaggcgugugccaucacugcccggcuguaauuaaucacuauucuacaaguuaaaaauaaagcaguaugaucguuuucagcuguuucaaguagcauucguucauuugaccuuacucuccacagaaugaaaaugucauuuuuuacauugcauucaguguuauuguaacucgcuuacccugauuugucugucuugguuuuguuuuguuuacaguugcuaacuggccaguacagagacacacagacuuccauuaccgauaguucugccauauacaaagucaacaauaacaggguaagagguaucuggaauguucuagaaucugacacucuucuuuacuaaguucuacugucauguguguugcugacccaaagcaacuuggggaggaaaggauuuaaucuguuuacacucccgggauguaguucauuguuaagggaauucagggcaggguccuggcagcagaagccaugcagaaaugcugcuugcugguucacucuucaguucacuuagcuagauuucuucauagcuccggacuaccugccuaaacauggcgccucccacauuggacucaagaaaaugacccauagacaugcacacaggccagucucauggagggacuucuguugaggcuucucuugcauggcuggaagcugugucaaguuaacaaagcuuacuggggcacuguggcuugucaaggaagaaccuucuuggauggaguagucugaagauguagguaccuuuuguguagcuucauuuuacguagaacauauucuguauaacaaacagaucugcccucgauaauauagguagcagauuuaguccugcccacccauccucguaacuuacguacaggguauaagacauuuuauuuuuagguucugucuguccaacauuacuaugagguucaguaaguacugggucuuuuucggguauaaggaggcaguauguagacacaggacaaucauuuggcuaaaaguaguugucuuuuucugccucugcuagccagacuucucuuuagaagccgucccauaguuagauuuuuauuacccagagccuuguuaaugucuagugccuuuuuuuuuaauuuaaaaaauuuauuuauuuauuuguuuguuuguuuuugagacaggguuucucuguauagcuccggcuguccuggaacucacucuguagaccaggcuggccucgaacucagaaauccuucugccucugccucccgagugcugggauuaaaacuuuuuuucugugccucacauauacuaggcaagccacuacccuuccuucaccuguguuuacuauuaagacauccucaacagaaauccaucugacuugcugccugcaguaaacauuugcuugauucaugagcucagcuccagugugcugaucugauggugaagaucuaugcuaugugaaccuggagcuggaccgaauggugaugugaugucacucuugcuguccucaggguaacagccugacucugaucgaccuccccgggcaugagagcuugagguuucagcucuuagaucgcuuuaagucuucagcuagguaagucagggaugaagugacaugggucccuucaagucugcacugcguccaugcgcacgcucacgcugguuccucugccaagacuuuugacacugguaugggaugaaccuuggaguggccauuucuggggugcuagaacucggaagacguaggagccugcuuaaggcuggcuuuucagauugcgcagggggugucacucuacuagcaugauuaaacuucaacuauguguauguggggcaggguaugugcacuugugugagguacagcauaggaagggaggguguuggauccccuggagcugggguuacaguugguuguaacuucccaacaugggaacugaacucagauccucugcaagagcagaacacacucugaacuguugagccaucucucuagccacugacucugaaaauagauuuaaugacauguuaaggcuauuacaaucuggaaaaggaaauuguaaggcuaggauggaucccagaagauacuaaacucaaaacauuaaucauacucuuuuugguuuucuuucuuuuuuugggggggggggggguucgagacaggguuucucuguauagcccuggcuguccuggagcucacuuuguagaccaggcuggccucgaacuuagaaauccgccugccucugccucccgagugcugggauuaaaggcgugcgccaccacgccuggcuuuuucuuuuguuuugauaagguggcaguaucucucuagcccauguagcccaggcuggcccugaacuguaagcuuuuuccauuccagccuccuggcuuauacaaacuaaguggcuuuucuuuccuguccaccugcuugguuuuggcuuuucaagauagagucucagguacugcagguugaccuugaacuugcuauauagccaaacaaagaaccuugaauuugcaaguguugggauuacagguaugugucaccauaacuagcaaggcuuucuuuccucuuaccuucuuuucaccuuauuuauuuauuuauuuauuuauuuauuuauuuauuuauuuuuggucaucaauaagaaauucccuuguguauguguguuuguuuguuuguuucuuuuuuagcauauaaaugcuagcauuguccaaaaaacuguaagagauugauuucuaauugucuugaaguugagcugcugggaguugcccaaagaaaggcuuggcucuauugggcuuuaccucccguguuuggauuggaaaucgaguacaaaugaaaauggaaagcccgccagcaccugacucugccccauuuuucuacgcagaaucaugccuuuugaccccacagggacgaaucugacauucagaauuacugaugauagcaggacaaagggguuuauuguuugcuucgcuuuguuauauuucucucauaguagauucuuuuuggggggucaggguuugagacaggguuucucuguguagcccuggcuauccuggaacucccucaguugaucaggcuagccuccaacucagagaucugccugcuacugccuccugacucuugguuccuggcacuaacagugugcucuaccaugcucggcucuuauuguagauucuuaagccuucaggcaugcuagcuggaguucuuuggcauaacuguuaguuugcauggcuagcacacagcugguauccucagaaaggccuggcuugaguccugugaagcaccaguagcuguacucacguccugggucuggcccagaugcuaaccagagucuggaucagaagugcagcagaacagagugccacaguaccacguggcacagagagguccccucaccccugcaguagugcaagcagcuauggagcuaauaguuuacuaggugcuuuucugcugguggguauggagcuguccacuucauaggaacaaccguauagagaccuuccucacuaucucccucguauaacccagccaaaagcuagaggcugcaugucuguucuuaaaucacacuaaauugauaccucaagaacuauuuuuaguguaaguccucaugucauugauuuuuaaauucuuuccuaaaauuuguauguuguaguuuuaaaugcuuucuucauguuugcugucuaacauuguuaagaaaaguaaggaaaauuuguauuuguauuaauuugucagagugucucaagaacagcuuuuuaaaaaauuuuuuuccauugucacuugcaaauauuuuagaguuuauaguauaauuacacuuuuuuccaaguauuuuggauaaauagaauauucagcauauaaagauaaaacuaaguuaauaagccgggugugauggugcacaccuuuaaucccagcacucgggaggcagaggcaggcggauuucugaguucgaggccagccugaucuauuuacaaagugaguuccaggacagccagggcuacacagagaaacccugucuugaaaaaccaaaaaaaaaaaaaaaaaaaaaaaaccuaaguuaacaaacuucauucagucauaaaacuguuaaaucgaaaacacuuuuacuaugguauaugacauuuuucuuuuuaagauuucuuuuuaaaauuuaggugcaugccccuguucuuguuugugcacugugugugugcagguacccaaaggaccagaacaugacgcugggcccccuggacugcaguuacaagcaguagugagcugccugaugugggugcugggaaccuaaccuggguccucuacaagagcaacaagaacucuuaccaugaccccaaugugacauuuaaaaaaaaaauucuuccuugugaccuaagauuguuuuuccaucuagggauuucaaaguauauuauauuuucuuucuguggauuccugccccauuuuaaaaaacaaaaaacaguaucuaaccaggacccauuucuuuuuuauaaaccaugacaagcaccuguguuuugaggcucccugauguuugauuucuuugcucuuugccaaauuuugcuccuuccuuucagguucuguuuuccucagaguaucugcuagaaauguuucuagaggaugagugugucgugaaguuguuggcugucuuucacggaaagcaaccuuuauuuggccucuuuuuuuuucaugguccuuggucuuaguugcaugugagguccuggguagcagcuccgaguggucccuggagaccgccgacuccacaucugcucuuacagagugccaguguaacugucauuucccucugaggcaucugucuuuggguuucugguauuuggaauucaaguguagcacccuacacagaaggguguuaucaucuguuaagugcaggcccuggggggcagcuggaccagucacccugugcacagcuugccacucaaagguaaucuaauggagaccguagcuggaacggaauuccaaagaaacugaaacacccggucuccaugccucgccgcuacaaggcacaaguggauauuuacagguagaagagccucaagagaaagauuagccuaaacaucaagccagauucauccgacccugugccugcugccucauuugucacagcaugggccguucucucugcccuagcucuugcguaguuuaucugacacauccuucucucucgaguguugccccucagaguguuagccccucagauccgcugccuaguuugccguguucuuuucagcugagagaaccuguuuaguuuccacuguguugcuaauuuuauuuacuauuuuuauaauguguucuuuuuuaaaauacccuuuaaaacuccacccauuucuuuuuacuugcuucuaguauuauucucuaaaauaauuuuaaacauacauuaugauuuuuuuuggaggcagaauuucauguagcucagccugaccuugaacucacuguucaaccaaaaaugaacuugaguuuuugaucuccugccucuaccuccucagugcuaggauuacaggugaucacuuugguucaaugcugggugggaugggauggauacauauacauacacauauacauauacauauacauccauauguauauauauauauucuacuaugcaagcacucugcuaacugagcuacauguccagcccauaaacaugugcuuuguagauugcucuaaaguccaguuuugggggugcugguuaaucucuuuuauaauugcauauuuuaauuucuguuuugauccagaacuccuccucuaagagaaugggugccaucgaugagacugguagucuuuguuaguguagggcgugagcggccagcuccacaccgcucuccucauuuguuagcaccaucggggguugaugaugaauaugguccaaaauuguuuucuuaacuuuuuuuuuccuuaaaguuuuauuuauuuuauuuguaugacuacacuguugcugucuucagacacacuagaagaaggcaucggaucccauuacagaugguugggagccaccauguaguugcugggaauugaacucaggacucuggaagaacucugagccaucucuccagcccccaauuuuuauauaaucucuugcuuagggcucuuauuccaagggaguguccacuuaugccccauagcuacagccauuggagaccggguguuuuaacgucuuuaaaacuauuuucuaaccacagccuccauuucacugccuuagaguuggaggcuuuggguaagguuugguccaguuguccagacccuguuagccacugcacauucucugccccaggaccugaugucugaggcucccgugcaguaccucugguacuugauggugucacugcugugucugaggucaggucccacauagucacaauccuugaguucccucaagaguguucugucuuccacuuaggccccaguagucuucacagcacaagcuucacagggcaguguccucaucccuuccccucuggccuggccucccccguucacccugccuuugugcucuucucgagauuuuuacaucuuucuuuugucucccucuuuguucucccacuguggguacauucugcccuguguucaucgccuagaucugucagaugguuuucugacccuugaaagcccaagucauuucuuguguccuuuuagcuucuucauguuuuguuuuuguuuucuuuuuuuacuuaaaucaaagcaugcaugcgugcaugugugcugugguggagggcugaguggagaaaccaggggucugucuuguggcuccugccugccgugugugcucauguguccuucccuuuaacugucccugcagggcugugguguuugugguggacagugcggcguuccagcgggaggugaaagauguggccgaauuucuguaccagguccucaucgacagcauggcucugaagaacucaccguccuuauuaauagccugcaauaagcaaggugcuuccuggcaaaggcagccaaccguugaggauugcuguugggaauuaguucauuuacccgccguuguuauuucugagcauggggaaagggcuggaauuaagcauuaauuaagggauuaaaucugaaaauuguuucuauuacuuuccuggucuuuuaccagguugucccaaggacuggcagcugggggcucuguugauauuauaucuuuuucaugauacagugcuuuuuaaagauaaauuaucuuacuuuuccaaauguuaauuugugagaccgaguacuaucgguucuggggggauuauugggccucuccuuccagacaggcugcgccacuguucccucuuaccccagcgcucacagucagguuggcugggcaucagcucuguggccaggcggaguaacgucaggaguugguccucgggaacuccuucacggcuacauuuccuaauaccugaugaauggugcagcucuuagcaucuuuuguaaaaguauuuuuguuuuguguguauguggggcggggggggggggggggugugcagggcugaaccucaggcauacccggugccugagaagauuagaagagggcuuuggaucugcugggacaguugugaguuggccaugcagguucugguacuugaacccugguccucuggaagagcagccagugcuguaaccccugggccaucucuagcccuagccaucaucuuuucuuaaggguuaaugugguguuguguugaaaguucuccucagaugucagucaugguucacguaugcuugcuuucuuucaauggacaggacagguuacauauugaagggcuuguaaggugugggaaacuuaagcuugguuaguuuuaaggucauuagcacuaaaacaauauuuuguuguauuuuauguuuuaaaacauuuuuuaaaaaccugcaaauacagcauuuacugugacagaaaggaauaaugauaaaaaguguuucaacaaaggaauguggggugaacuaguugguauaauugggaauuuucuuucugugcuggaaguccagggaggagacagauccugguuuaaacuagaauaaugcucuucuuuuccuucccagauaucgcaauggcaaaaucagcgaaguugauccagcagcagcuugagaaggagcuguaaguggggcugugcuccggguggcguccugaccgucggaguccauucgcagcuuaggaucgagugaucagaguuguagcugggguaguauggaauauguguuaaagggauuauuagaauuauaaaagacguggguguuuauagccauuuaagguuuuucacaaauuagggaaagguguguggcaccaugcccugcuuguaaauuuagucagauguaguauuuaugaaauguccccagcaggaaggcagcaagcaugcugccugugugcucuacagggccagcggcuggcagcacagugacaguuugggaagguuuuccugcuuacagauacaggacagaugagacggaagucuguggaugugugagcuucauagccaaggcucccuaucuacccuuucugaaguuucaaaaccaugaguuuuauaauacaguggggccauucaggagagcuuagaaguagguagaggcuucaaagagcuggugugaccugggucuccuaacccacuggugucugucugaaacagugauccauggacauaaaggacaagccagcagugucaauaccgacuggugcuaucccuuugauuuaggagcucauaggauuuugggcuuuguugcgucugacuuuucucccuuugcccccagcaacaccuuacgagucacccgguccgcggcucccagcacacuggacaguuccagcaccgcaccugcucaguuggggaagaaaggcaaagaauuugaauuuucccaguugccacucaaaguggaguuccuggaguguagugccaaggguggacgaggggacacuggcucugcugacauccaggacuuggagaaguggcuggccaagauugccugaggagcaucgcuggccacaagcguuggucaugugagacugacccugcaguuugagaaagggcgguggugguguggacugauaaagagggggcaugucguugaagcauuucuugaguucuugaaacaauuguaccacccccaccccacccccgucagcuccuuucucagcuaguccuuucuuaauucccauauucuuucucccuuugcuagguguuagguguagcaucauguuagugugagacauaacagagagggcaucgcuuugagaguagggucgcaucugagaaguccuugucuccugccucuguguuggucccuuuuccugggaccagaucugccugcuuguggaauaagugaacuugcaguugccccugguguaggcauaauacagugucaguucuuaguggagucuggggugugaaggucuacagugaagacagcuucaaagccacaggcacagcugacaguguguccuucacgggcucagugaccaucccacaccacccuagcugacaguguguccuucacgggcucggugaccaucccacaccacccuagcugacaguguguccuucacgggcucggugaccaucccacaccacccuagcugacaguguguccuucacaggcucggugaccaucccacaccacccuagcugacaguguguccuucaugggcucggugaccaucccacaccacccuagcugacaguguguccuucacgggcucggugaccauccccacaccacccuagguucaaaagcugccgcaaccccgaagagucacccucacaagguggcucuaggagccaaauccccagacacuccuagguuaguguucuagaggcuccacuggggagagcagggagacagcacacugcugccucgggcgugcgugagcccaggcuguccccugugcuacuugaucagcuccuguugugucaccccagcuagagugcuauggaacaauacaaacugaagauguccacugugcauuuuaaauacauauuuauucaugaugcuuuaaaaaauguuaccuuuuuaaagugaugcugucuucaacauuuguguucucauugcuuuuauaaaugacugguaucuugauaaaugacuauacugaaagcauugagucaaaugaugaguacaagugggaaccugagcuagaauugaaccccagcuccagguuacugagccuacagaucgcugcauauaugagacucuuggucucgucucacacucagagucaggcuucacuaaagccacacuaaagagacaggcagagcauugacucaggugcagugcucagggaauauguguggcgcucugggcuggccuggaccagugagagggacaggauaaacacacagguguucucugugcagaccagcccaagccucugccugcugacacauggccucccugugggucaccugggcugauaauagagucccagaccaugauucccaucaaguacucagcuccccacuccuaaaauaucuacuggccuugcuuaugguguaugagacagauacagcacagcacaggacagauaagccaugagaugacucaguucucacugggaggcaguauugcugcuaggauucuuacugcccuuugcacacugcuguucauguuggucacggacaaaugggaagggcacgaugaaggacguucacaucacaguaggugcucaucaaaaaaaccuuucaguuagaaaauguguucgcuggccucccuuuugucugcauaauaaagugauuuuacuuagugggagaaucaguacaucaaaaaagugacaaggauggagagcaaggauaaauguuauuuauuuauuuauagccuguguccugagcaaaagguaagcugugcagggcugggaaccagguuaguagaaugccuaccuggaacgcaugggucuggcuuugcugugggcugcuguaaaagccagcucuaaacaggcagccgcagcaaagauucuaugucuggacucuuccauggagccacggcagaagcagcuucucacugcuaggugccuuguggucucucgggaggccuuggccccugccacugcuucccagggccuccagcaccuccugacgugagcuguucuaucagaggggaggggaggcaguggcccagccauugagcuauuucaggcacaauaaaauauaaggcuau

SEQ ID NO: 5274 - RNA, 12749 nt, Mus musculus
auuccaccauccauugguuuacuguuuauucaauguuaaauguuacagaguucuuacacugucagaaccaugccugagaacccaaagaaagaaauggugcaauggacagccucauccacccagacaguguauuaaaacuugauucauaugcauuuugauaauuucacaaucuuaaaaaauaacaagacuuggaauuuacaucugcugcaguucuucagcguuccaguacaguaugccauuaaacaaaccucaucauguuucuguucacgucuuaaaccauaaccccaaacagaaucuguguuugugugucacgcuggagugaagcauacuuuaagggaaguuuguggcucaagguguuaacguuucuggugcccaaaugaagucuucaguucaacuaagaaucucaagccucuaaucacucaaccuccuccuggcugguucagaucaugccaacauuauugcucugaaguggcauacagucuggucaggugacacuggccuccaccuccugcuuccuacacugcugcccuaaauccacuaaacaugcucucaagcugggaaaacauccauuuccuguuccacuccugucaguagugagcaagucugaccuguguuuggcaaagggauucguuuacagagagaaacccaggcacuaguauuguaucacauagucauaugccaacauagaguauguguacugaaccaucuguagugacaagguagguaacugacaggcuauuucauuagguagaaagaaauuuagcagaaaccucuucuaagagccaaguacuacuagauaguuaaauugaaauuacaacagaaaugcuacauuacugacuauuccccugcgucuccaagugauuaccaaacauacucccaaggugaaugucaagagcuggcuaaacaaugaauagcccauaaccuucacauuuggggcacacacaaggauuuaucagacaccaugccagauucaugcgcaacuuggguguuuugcuccuguugcuuugaacuguuaaaagccaggucagugaaacccucuccuccugagcagacgucacacucuguccacagcagugagcagacgccacacucuguccacagcaguucaauuagaccugauuaggaggcuugagcagcaccuggagugcagcggauccgcuguccuuuauaugcaucaaaggcuaucugguuccaccuaaggauuggcaaauucauagggcauuuuacaauuccaaugcuucuuucagacauauuucagacaauaugcccuuaaagaacuuacucugagucaaagcaaggccuuaauguggaaccgaacaagcacuaucugaaugaaaaauuauucaaagaaauaagacuacccccccacccacuccccauuugguggaccagaguuugguugaauuaaauccaguuaccgcauaaaacuaaaaacuuaaauuauaaaucauaagccccacacagaugauccaaacacaucauuucugacagcggcuuguuccagggagucuaacacagccacagccuacagaguaugccuuaggauggggcacagaacagguuaauuaaggucacuuaacucuucaucuuuuacagcggcucagaacccagauggcugacuucugaaggcuuucugacaggaauccaguagaguugguuucaagguucacacagacacuaguagcuguaaccuuauguagaagaugugauccacaugaaauccacaacuaagggcagcaaaucugagguagucaaccuugcgaaggcucaguaucugaacauaaagauguuugaaugaccacuggcugcagguuugguuuuauacgcagagcaacuauggaaacacuguugaaucuaauucacaaauauuuaagacaaugaaacaccccuaaauccaacacacaucaagaucagucgugacucuugaacuuccauagugcaacagggacagucacuggacuugaggucuucagucagucacuguagauccagaaaucaaaacgaugaauggcuguucuuggugguuagcuguggucuaguuaccuuggaaggcuuagcaaagaccauuccuuagcuguacuguguguggcuguacuucugauucucaagcacagcauacugguugucuagcugaaguuuaagggccugguuuuuugaaaccuccucccuaucucuauuuuugugucuuacuacuucaaagcucuucuccauuucuuuaucccuaagggaaaagaaauguaaucaguaaauauuucuucuucacuagggaauuuugaaaguacucuuccucgaauuuaaaaagaaaaaaaaaaaaaaaaaaaaaaaaaaaagacccuaaggauaauccuggagagacaggaagagaauacaaaaauccuuaucaaaccauuuuaaggcuucaauugaacagaaaacauguaauacuguacugaagcuccgaggucccaucuucugcauauuuugggaccaacuugaaaacaaccagaaagaagcuguauaaugacauuccuucuaagacucacuucuaaguuuucgcaguuaguagauaauacgucuuuaugcauaagggcaacaauuuccucauucaaguaauguucucaucauucaacaauuucuccucccuuuugcuuugggggaguggucugauuagaucagguacagaaagauguguguggcaagucacugcucucccagagucccccacaugugaggacagaacggagaagcaaguccaaguagaggucuaaauucaagccagcugugcucucaacgaggugaaaaggcugggauuuacuuuaaaaccacccaaaaaaauuuuccaucugaugccauuuacauuucuucccacuuuauuuuugaaaauucaugucccuaauaagauguagaugugccauauguggucauuuaacuucagguaguauucauuuuaaguaccugcugaaugaaauaagauuauuuauaguauuagauuuauaaaugccaacaucuuucaucuucucacauuuacugugaaugcaaugauaaaugcuucuacaauucuaguuuccauauuuaaaaggaacagaagccaguaauaauguacuuaaaggacucuucccccaccuucuccuucccuccuggguaccaaagccucaccaugugcccagcugccugucagaaagccuagcucauagccucacauacuuacuuccggcucucuacaugcuuggcaguggacugcagggaugggaacugcgugucacuguauauuucuggugguccuuguggcguuuuccuuguugugguuagccuugccccaggaggccuguauacaccacugggcauugcuggcuccgggguuucuguaacuaauagauaaaccauucaaauguuugacuuucuuguaacauuuucccacacuccugauccuauaacaacuguaggaaaggccacccugauuuagaauggauuuggacuacacaauaaaaacaaaguucugugagaaaaugucucaaguagaaccuugcccaucucuuaaucucuucugaaauucaacacugcugucgcugguguuucuaucaaaaggugacaucuacuuucucuacuugaaaggugggcuaaacaagguauuuuauauaaauuauuuaauaaaauacacaugcaguauuuuaaauuccuaaaaauaauaaaggucuuuauuucauuaagacuauuggauguuaaguuucucuauuugcuuauaacacaggaaaaagcaccuugacuuuaaauuuacugugacugaauuugggggccacaauguuucagguuuuuccugucuccuaccuucccaacugacccuugauauguauucaagcagugucguuucccacuuuaugaaaaauuucaaaguuucaggcuggggaggcucacugggacagcacuguaaucaucuacuagcugaaauaaaauguucuuauaguuuaaaggauugcuuucuauaggcuuuguuaugccagagggaaagcauacaagcuuuuacugaguaucuaagcugcacuugagauacacacauuaaaaacugccuugaggcuggcgugguggcgcacaccuuuaaucccagcacuugggaggcagaggcaggcggauuucugaguucaagcccagccuggucuacaaagugaguuccaggacagccagggcuacacagagaaacccugucucaaaaaaacaaacaaaaaacaaccugccuugaacaguggaacaugcuugcaacaugggaggcugagacaggaggaucuggaguucaaagccagccugggcaacucagacccaucuucaaaaaaaccagaccaaacacuaaauaacuacugacccuuacauuucagccaccacauguggcuuuuuaaaaaaaauucguuauuuguguuugugggugauaugacuugugaggcuugccugcucucuuaugcacucauucauucauauguuuuuuuaaagauuuauuuauuuauuauauguaaguacacuguagcugucuucaggcacuccagaagagggugucagaucucauuauggaugguugugagccaccaugugguuucugggauuugaacucgagaccuuggaagagcaguuagugcucuuaaccgcugagccaucucaucucagccccgucucuguagcccuggcugccccaacucaaacaccaucugucuguguccugagugcugggaucaaagcaacacauguagcuauuuuagaugaguaaaaugaaaucuagguuucaauuccucagucacauuagccaccauguccuaaguauucaacacagcuacaugugacuagccaucccucucucacuugagcucauccagcaccccccaaaaugcuaccuaaugggcaguauauucuagaagagacaaaaaaaggggagaaggggagaaggggugccaugccaaaaauaacagcaggaguacaaaggagcuacacuucaauguguacacacaucauguagauacacagaugccccugguggccagaagggaaagguggauuccuugaaacuggagucauagauauuugugguccucugauaagaauuacuaagauauaauucuggugcugguagaguguagguuaguacucuuaacugcugagccccaaagagguuacauauuaaaagggggcuugggaaggguuuuauuaacaggguaaaauuaagcagauaugaaaagacccucuuuauacaaaccugguggcaagauccagcuccacaaacucaccacacaaauaauaaaaagaaagccaacacuuaaaaccaaauauuagugaacaagcugaauccggcccaacaacugagcacagcuauccucacugcuguuaauuccacauuacugucuaugccacagcagcacaacagagaccacagucaucuaccaccuggcuuuucaggcaccugauaaaaagaggaaagagaaagaaaauacucccaaagcuaagaacuaagggucugcuggagcugugugucuggugcauuccaggaguagcuugaaagaacaucagguucaggagaaaaaaaaaaaaaaaaaaaaaggcagcauuuccauggugauucacacuagucacuucagcacuugccauaagcauuagaacuuaaacucaugugcaccaaagcccaggcauggcagcagcacaugccuguaaacagcacaggauggguggguggugacagagaaaagaacauccuaggagugcgcuagcuagcuaguacagccauucaaucaucucuagacucggugagaacuugucuuaagcauuuagagugacgaggaagacacagccaaccucuagccucgauacccacacaacaagacauaaacacacacacacacacacacacacacacacacacacacacacacacacacacacacacacaaauucagggcuagccugagcagaguggggaugaauauuaccaaaaauauacugauggcauucucaaaaaauaagaacuuuacauauaaaaaauuuuuuuaacuuagaaaauugccaggaaagcucacaccuguaaucucagguuuugggaagugggguagcauaaggucaucuguauuacagaggacucaaggucagccugagcuauauaaaauaaauaaaacuaacaauuuugagaugaaaaugcagcucugugguacagcacauuuagcaugugcagaguuuuuagaguucaauuucuagcacagcaaaaaccagacaaacacgcugagcuaggaagcuggcucaauggcuacagucugccgagcauguguacaggauggucagauccauguaagccuaggcagccauggcaaggcacacaaacaggauccuaaaagcaaacuggcuagcuaggauagcuagaacugguuugaguucccgguuccuugagaaacccuacucucaaaaaauaaaaauggacaaugagaccggcaccaagcugugguccauccacaagcacuguacaaacaugcaaacacacauccaacaacacacauaaaccccuaaaaguucuuuaguucuaaagaaauuuuacucacucccuucugcugagaauguaagcuucaagaccuaagugcagcaccaagaaugugauuuagugguaggaugauagcaggaggugaacuacuuggcuuuauucccuagcaccaaaaacaaaagcaaaacuuugacagccuacaggacaaaaaaaguaugucccucaauuucuacauuccuuccacuaaagcagcauccauuuggauccacuaugcccaucccucaggagggaaaacagaagaucaccuguuacuggagcaggaggcgcuuguaccggagcgguuuuauuccagggaccugaagauuuuucugcuccacugccaccuccaccuucuucccaauuaucuccuggaucuucucucuucucauuaucaucaucuuccuuuucacuauugaaaaacaagcacauugaacuucccaagaacuggaacuagauguaugcaccaccauaugaaacuucuacaaaaaaauacauuucuuuugaaaauaugguccaauuauacaguccugacuggcauggaaucagauacguaggcaaagcugaucgacaucucagagaccugccugucucugccucccucugcugagacuaaacucuuuaggggcgaacuuuugggaaucaguucucuaccauguggauucuagggaauaaacccaggucaucaacuuuuaacagcaauacccaauaauaagccaucuugcuggcccccauaaaagauauuccuauuaaagcaagauguguccuagcuuuaagccaaauuucuucuggcuuaguguugauuuuuuuuuucccuccauuggugaguggagucuaacuuggauucucauguaugcaacaaaagcaugcuaaacugagccauaccuagaauccaagacaaggccucacucagguagcccaggcuggccuuaaacucacuauauacucaaguaagcugacgauccugacugaucuuccugucucuaucucccaagugcugaaauuaaagguguaaaccaccauacccaucuuuauuaaggcccuuuaaagacacugcccaccagcuggaaguaaccccagcauuuaaagacuuaugaugucaagaaagaggaacaaccuaauuuccaaucuguauuuaagacuaagacugucucucagggcucaauaacagagcacuucaccuguaacucaaaaagacaaacagagaaguaaccaccguuuggaggcugacuggugaccucagcaugcaagcugaggcaagagaaugaugacgucacugauacuuucuccaaaaacuaaaggucacaccuagaugguccuugccaccaagccuaacuaccagagucuaauccccaggauccacaagguggaagagaacuaacuccuguugguuuuauucugauaugcaugccacagcaugcucacacaaaauaaacugcaauuuuuaaaagacaaaggaaaaagagaaagccaaauuucaguuuucccuuuuaacauacaaccuguccagccauauaaaaugaugcuggucacuaacaaauaauauucaugccauuuaaaucaucaucuaauacauuauacuuaucauaaacaucaaacauccagagagaauccuaaagaucuguaauuuuaaugagaacuuugauagcuaaaacaauguuaggaacugauugcucaaguccagguucugccaucucugucauuuaauggucaggcuuucaagaugauacuggcuggcuuuuagauaucaccaauacgaagagcaaauuuauacacucaguacauauaucaccuucguaacaggaaguaaaaaauucuagcuuucauuugaaaaagagaugggaacauguuauucucuaauggaucguaaaaaucugaucagauagcacaacaccauugucuaacaguagcuuauuagcuaguaugaaguuuauaauuacccaggcuaauugugguuuccaaucuucauaauuuuuucaagagguuuuuuuuuuuuugccuuuuuaaauuguaaagccaugucaauacuauaauugcuucagggaugaaauagguaaucaucugggugugguaauaucccaacaaccuaaugcauccaaaaaaggugaaaaagauucccaccuacauggcauuuacaccugcauacacugaagcaguugcuuucaguuauucauucacucuuugaaucuauucacucaccaacacaguaaaucacaacuguucaucuguauauaugguaagaacacuugcuguaaaaguaaaaagagcagaguucaaaccccuggcccccacaugaaagccaggcaugucaacacugcagggcagagacaaguagauccuaacaguuuauuaacaacuuccugacucuaaaaaaguuaaaauaaagaauuuuauauccuguuagaaaaccaguucaauuuaaauguucuccauaauuuaacaaaaucaaauuuuauacugaaaaaacuugaaggccaccccucuaccuucagaaaguguuacuuuuacccacuaaaauucaagucaauauguccagaaauuaccacucaagggcauaauuuaacuucagagcagggaccacauccagauaaaagaaaggaaccuguaaacucccucuccagauuuauagaucagacuuggagauacaaaacaagaacauuuucuacuuuuucuuuuaaguuuugagauagggucucacuaaauugcucagaguaaccuuaaacucacucuaacccaagcgcaccugauuuuucuuauucuccccaccucagcuucucaacagcugacaguuaaggcuuucaccaccaaguauuuucuaaaauuacucauaagcuuauauacugcucuuguagaggauacaaauucagucccuagaacacagcucccaacuaccuguaacuccaguuucaagggaacugaugcgcucucuucuggccucgacaggcaccugcaugcacauacauguacauauacaucccagacauacauauguaauuaaaucuuuaaaaaaggaaaaacaaagcaaaacaaaacacuaaagccacaccaaaaagggagauaacuucuaaguucccuacuauaaaaaacaauguuuaauuugguaaauucacaagugagaacaccuagggauaugaaugccugggugguacagacacuaaccauacauuaaaauauacuaccuggcuuuucaauaaguuaccucagaucauauauaaucuagauuuuaaaagauuaauuuagaguuaagaaaguuauuuccucaacaacugucccauauggucacuggaauucucuacaaauugcaagcuucaaaccaaagacaauuuccaaucauuuugcuuguguaagaugaguaaaggauuuuaaggcaauagagcccuacucacuuuugaacuucaaaaaccuuaccuuaaauacuuacccuuucuacuuaaaaaaaaaaucuuuccaaacauguuacuuuuaaaaccagaucuaaaaugaacuaccacagauugaacgugacaauguagguucucuuaaaucaaccaauccaacugugaaaaugacuguuuuccugaacuuugaaaaccagucaccucagagcccgaaauggcagguagcacaggccugcaauuccagcagcucaaguucaguccggaauacacagcuaagaacugugcaaacgagggcuaggguaagcuacuuuuggggauagguucagaagagccucuauuaacguucaauuuuuugacugggguaguggguauucaagguggcuucauggucaaugcaaauucguguauguuggaaguauccuacacugcaauuaccagagagaacuagaaaacaauuuuacuaaguaaguaaaagaaaaaacuaaguuccugcacagcuuggugguacauuuggguggacacuuuagaauuaagaguucaaggugacaugucgcucagcggucuuccacagaucaggguccagcucacagaacccacacuaacagcuguaauuccaauuccagaagacaguacagacauguauuacacaggcaacucgcuucaaauauuuuuuuuuggaaaaaaaaaaaaaaaacaagccccuucuucuccugagucacacaguaaguucucagggcagcgagugaacuacaggagcccuacuagggguagggaagaccaccuaaauucaaacacgaaguguuaaaaauuuuuaaaugacaaaaauccauuuuagucaagccaaaaauccacauagcugcaaauagggaaaccacaggauuuuagaguuggcaacuaauuuaaugacacagagggcauuuaaaaaaaaaaaaaaguaaacgcgugcacuacuuaacaagguuaccuaaucccacguguaaucacauccuaccuuauuugcauugccugaacucuuaauccgcuguaaucaaccucucuuugcucaaauucuuuccacucauuuucauccuauggaagaaacaacaccugauuaguuuuugguaagcccacuucagacuaaaaggcaucaagggccaacgggauuccccaaacugguaaagguacccgcgaaacaucgaauuaauuaauuagagaucuugguaaacagauuccagacucggaaaaauuccaucaguggucgccaggauucuugagucggucuaagaaucggcggcagucaacaccgagaaccagagagucuaacucuccaggcccacguggugggaagagagaauuuaccccggccucuaaccucuccgcacacguacacaggagugcgcgcacacaaauaagcaaauaaaugugaucuuuaaaaaaaacaaaaaacaacaacaacaacaacaacaaaaaaaaaacaaaauugcagacagugacacagaccuuuaaucccaguacuccagagacagaggccggaggcucuuugugaacuggaggccaaccagagcuacaccgugagaccuugucucaaaaauuggggcuaguggccggacgguaaaguuuagcccguuccugcaagauccggagacgugccuaauucccaaacgcccucucugccgccgcuuuuacuuaaacccaagcccagggcgagcugagcggcggagagaaggcgacagaaauuccacaacucaauucccagcccugcguggccgugguugggagaguaagccacgcuggcccgggcggcacagaggagccucggaacaccuuaagaacaugaaauccggccccagcggggcucaagcgggaccacgaggacucgggcacacgucacccggggaccggcccaacccccguggcccagagggcgcggcgcgcagagggccgcggacgggggcggccagacgagccccgggggccgaggaccgcgagcccgcccgcccgccgggccgacgugcgaagcccgagucacguggccucccgggccggcgggggcgggcacaugcggccggccgccggccucccgacccucaccuucguuauggccuugccggcggggcccgcgcucccgccgucuccggaccucgagcucccgccgucuccggaccuagcaccagagcccgagcucccgccgucgcccgaccuggagccggagcccaagcucccgccgucgcccgaccuggcaccggagcccaggcucccgccaucgcccggccuggagcccgccgccgcgcugcucccgcccgcgccgcucgccgcguuggccgcgcgacugcuccguuccuucuucuucuucuugucccucuuggcgaagaaguuguccaggcuccgcuccucggucucggccauggccgcgguccggauggguggggccggcggagggcgcggcgcucgcggcuccgagcucugggucaaggccggcugugcgcucaggcugcagggugcggcgucgccucagccccgcggggucgccgaggcgcgggcggcagggcggccggcuccccccgugcucuggugguacguuccucgcugggaaccgcgagcguggagcagggucgcgcccgccccgcugccugagggacaaggaaggcgcgcaccggcgagcgcucggcuaacgacggcgcgugcgggaggaagacgcgcgggccugaggagggggagaggggacggggaggggagggaggggaggagggagggcgggccaccagcagagagaggcagcgccgcgccugcgcgcucgguuccgcccgccgcugugggcgcgccgaggggggcgggcggcgggaugagaagggggcgggucuuccgggagagccaaucag

SEQ ID NO: 5275 - RNA, 687 nt, Mus musculus
acacugucagaaccaugccugagaacccaaagaaagaaauggugcaauggacagccucauccacccagacaguguauuaaaacuugauucauaugcauuuugauaauuucacaaucuuaaaaaauaacaagacuuggaauuuacaucugcugcaguucuucagcguuccaguacaguaugccauuaaacaaaccucaucauguuucuguucacgucuuaaaccauaaccccaaacagaaucuguguuugugugucacgcuggagugaagcauacuuuaagggaaguuuguggcucaagguguuaacguuucuggugcccaaaugaagucuucaguucaacuaagaaucucaagccucuaaucacucaaccuccuccuggcugguucagaucaugccaacauuauugcucugaaguggcauacagucuggucaggugacacuggccuccaccuccugcuuccuacacugcugcccuaaauccacuaaacaugcucucaagcugggaaaacauccauuuccuguuccacuccugucaguagugagcaagucugaccuguguuuggcaaagggauucguuuacagagagaaacccaggcacuaguauuguaucacauagucauaugccaacauagaguauguguacugaaccaucuguagugacaagguagguaacugacaggcuauuuc

SEQ ID NO: 5276 - RNA, 3673 nt, Mus musculus
ccaacaaucugcggccucagacgugagccuacuaugauuauuuugcuaaaugaacacaguaccaaaaugccuucuaaguaugcaauuccaggaacuggacggguagcucagggguuaagaacacacacuguucuugcagaggaccuagguucaguucccagcaccuacaucaggcaguuuuacuaacuccaguuccaggagccuccucuggcgccugcaggugcaugcguaugguacacauaaacucaaaacucacaucagcacacacauaaauacauaaaaauuuaaaauuaaauaaaucguaaacauggaucuguguccccacagauuaaugcagcuccuaguccucauuagagggacuguuauguagauagacucacuacuaaucagaccuaagugggacaucucuauuacacucuucccucuuagggucggggacacugaagaacaggaagcagagacugugagagcuggaggugggggagggccagaggaaacagcgucuucuggaaaugacaggaccagugcacuuaggagcgcaccacaaugguagcuggcuggcuggcugccugcguaagaccaagcuagucagcauuccagcacacaucagaggaacccuguccuuggcugaagagcuacugaacguuauggcugcuaggagaggggaaaucagguucuuuagggguguggcccuugguggcugcucaagcuccuaccaagcauauauggggcagcacucauuagacuuagucaguuacacgccuuuaaucccugcacucaggaggcagagagucagaucuugaguuugaggccagcacggucuaaggagugaguuccaggacagccaggaccaaaacuacaauuagggaaugaaguugugaggggauguggcgauuccucugggaguaguuggugguaaaguggggggaugaguaggauccauauauacugugugcaugcaugaaguuguggaggaacagcuaaaaauauaucuuaaauaguuuugaaaccugaaauccguguauauaauuuuugggugauaguaagugcucuagcaugaagcaggccuguggacaggaaagggaacacauaggacguauguguaauacgaaggggacucugcuuuuacaggauagacagggaaggucuaucagaugaugacacugaagaaaagaccugaagaagaugagaaaacaaauuaugaggcuuuccaggggaaaaaagguuuauuuuaggcagaggcuaauauuaaguagagagaucuuggguuaagaacaugugguguuucugggaaguuagugugaguggagucaagggagaagcaugagauaagaucaaagcaaaaccacucuuguuugagggauacacagggaagucauuucaagaacucagauuaauaguacaugaggugacaagccacaggugcacaaaggcguaagcagagaaauuauacacuccacucccaucuguguuuugcugcaauaugggaauugaaccuagggccucacccaugccaggccagcacugcagcacugggcucuguguccaacacucuaccugacuaggaaucagaugaccuugucaccgugugcaaguacaggaguacauggaacagaguacaggggggcaagggugaaggcagugauggucagacaauaagauuugaacacaugcacguaguguaggaaagaaaaucgaagcaggagacaaaaccugacgagcuuucagaaaacgcaacaacaacaacaaaauaaucacgagaugaugaaucaagcaauggauauaaauagaggcccaagaacuaauucccaguggugcuggcuaguuuuauguuaacuuaauacaaacugaagccaucugagaggagggacccuuaagaaaaugccuccauaaauuggggcuguaggcaagucucuagggcaaauuaucaauuagugauuggagggggggggcagcccaucccagguggucccauuacucggcugguggucuuggauucuauaggaaagcagguugagcaagccaugagagcaagccagcaagcagcaccccuccauggucuuugcaucaguuccuuccacgguagacuacaauguagaaguguagccacaucacccuuuccuccccaaugcgcuuuuggucacgguguuucauuguagcaacuggaacccuaagauacuaggucagcuguggccacagagaugagaagacuugagaaaacugaaaagaaucgaaggaaacuuaggagacugcaagcgccuuaaaauaaaguaugcaaaaacauuuccaggaagggaugacauuuaaaugauauacuuuagaagcuggguuaaagaucaaagccagcaggauuaugugucugaccaaugguuacacugguuucaauuauauacaaucaugcaucacuuagcaaugaggauaugcucugagaagcccuuguugcuggguuauucugcuuuuuugcaacaagcccagagcaugcuuaauaccaaacacagauggcucugauguuaugcuccaugaauaagcaaaacaacauguagcacaugacugcaugucacacaucaucauacucauacauacacagguaaaauuaucuaucauguauguucucuguucuucacaucaauuaguuuaacaaagcagcaaccagaaucuaaucauaaucuggaaaucuacauuccaauaaagaacaaaucuaaagucccaggugugggggaacaugccaagaugaucugcacgcacaagccaagguuacucaaacucacacaugauucucaguguauguugaauaacuuauuaaaaggcauuuuuaaauuuuuuggucucaagcaaagacuagaauuucccaauauuuucuguuauauuauguggggaaagauaaugaugugguuacauaugugcuuucccuuuuuuggguuauaugccgugaagacaaagcuguaccucaaacucauggugguuccaggagaugacacuggcgcugcccagcucccuaucaauguuaaauguccgcaucucagacucaagggcaucuuucaguucuucucguguuuuaaaauuccaaaugagguucgaucuagcguggucuugacuaaaccuaaacacacaugaaaugaggaaaucguaugaaacaagcauuucucaaaaccuaccaauagccuguacuauaucuuauaauaagcaagacaagcacaagacuauuaaaccuugccaagaaacaauaaaauauguauuaagcaagcaaaauaaaaugucauugguagaaucucauaauuaacacacauucacuauaaaauucuuuuauuuuggaaguuuucaauauaaauggugaaagccugaacuuuaagauauuagauaaaguuguaugaaauuuaaacauggauaguucaauuucaguuaucuguagcuaacaaaaguucaaacuagaaaacaauacugucauauguccaauuucaggcugugcaggaugagccaccuagguggcacucacagaugacccagaggccucugcagaacugcuggaaaagccacuacagccaacguggacaaaaucuaagcugggguggacggacuuccuaucugcuacuuaucagucagcagccccuuagagggucacuucgggguuccauguuuccaaggguucccgaggaagaaauccaaagcauauacu

SEQ ID NO: 5277 - RNA, 3673 nt, Mus musculus
aguauaugcuuuggauuucuuccucgggaacccuuggaaacauggaaccccgaagugacccucuaaggggcugcugacugauaaguagcagauaggaaguccguccaccccagcuuagauuuuguccacguuggcuguaguggcuuuuccagcaguucugcagaggccucugggucaucugugagugccaccuagguggcucauccugcacagccugaaauuggacauaugacaguauuguuuucuaguuugaacuuuuguuagcuacagauaacugaaauugaacuauccauguuuaaauuucauacaacuuuaucuaauaucuuaaaguucaggcuuucaccauuuauauugaaaacuuccaaaauaaaagaauuuuauagugaauguguguuaauuaugagauucuaccaaugacauuuuauuuugcuugcuuaauacauauuuuauuguuucuuggcaagguuuaauagucuugugcuugucuugcuuauuauaagauauaguacaggcuauugguagguuuugagaaaugcuuguuucauacgauuuccucauuucauguguguuuagguuuagucaagaccacgcuagaucgaaccucauuuggaauuuuaaaacacgagaagaacugaaagaugcccuugagucugagaugcggacauuuaacauugauagggagcugggcagcgccagugucaucuccuggaaccaccaugaguuugagguacagcuuugucuucacggcauauaacccaaaaaagggaaagcacauauguaaccacaucauuaucuuuccccacauaauauaacagaaaauauugggaaauucuagucuuugcuugagaccaaaaaauuuaaaaaugccuuuuaauaaguuauucaacauacacugagaaucaugugugaguuugaguaaccuuggcuugugcgugcagaucaucuuggcauguucccccacaccugggacuuuagauuuguucuuuauuggaauguagauuuccagauuaugauuagauucugguugcugcuuuguuaaacuaauugaugugaagaacagagaacauacaugauagauaauuuuaccuguguauguaugaguaugaugaugugugacaugcagucaugugcuacauguuguuuugcuuauucauggagcauaacaucagagccaucuguguuugguauuaagcaugcucugggcuuguugcaaaaaagcagaauaacccagcaacaagggcuucucagagcauauccucauugcuaagugaugcaugauuguauauaauugaaaccaguguaaccauuggucagacacauaauccugcuggcuuugaucuuuaacccagcuucuaaaguauaucauuuaaaugucaucccuuccuggaaauguuuuugcauacuuuauuuuaaggcgcuugcagucuccuaaguuuccuucgauucuuuucaguuuucucaagucuucucaucucuguggccacagcugaccuaguaucuuaggguuccaguugcuacaaugaaacaccgugaccaaaagcgcauuggggaggaaagggugauguggcuacacuucuacauuguagucuaccguggaaggaacugaugcaaagaccauggaggggugcugcuugcuggcuugcucucauggcuugcucaaccugcuuuccuauagaauccaagaccaccagccgaguaaugggaccaccugggaugggcugcccccccccuccaaucacuaauugauaauuugcccuagagacuugccuacagccccaauuuauggaggcauuuucuuaagggucccuccucucagauggcuucaguuuguauuaaguuaacauaaaacuagccagcaccacugggaauuaguucuugggccucuauuuauauccauugcuugauucaucaucucgugauuauuuuguuguuguuguugcguuuucugaaagcucgucagguuuugucuccugcuucgauuuucuuuccuacacuacgugcauguguucaaaucuuauugucugaccaucacugccuucacccuugccccccuguacucuguuccauguacuccuguacuugcacacggugacaaggucaucugauuccuagucagguagaguguuggacacagagcccagugcugcagugcuggccuggcaugggugaggcccuagguucaauucccauauugcagcaaaacacagaugggaguggaguguauaauuucucugcuuacgccuuugugcaccuguggcuugucaccucauguacuauuaaucugaguucuugaaaugacuucccuguguaucccucaaacaagagugguuuugcuuugaucuuaucucaugcuucucccuugacuccacucacacuaacuucccagaaacaccacauguucuuaacccaagaucucucuacuuaauauuagccucugccuaaaauaaaccuuuuuuccccuggaaagccucauaauuuguuuucucaucuucuucaggucuuuucuucagugucaucaucugauagaccuucccugucuauccuguaaaagcagaguccccuucguauuacacauacguccuauguguucccuuuccuguccacaggccugcuucaugcuagagcacuuacuaucacccaaaaauuauauacacggauuucagguuucaaaacuauuuaagauauauuuuuagcuguuccuccacaacuucaugcaugcacacaguauauauggauccuacucauccccccacuuuaccaccaacuacucccagaggaaucgccacauccccucacaacuucauucccuaauuguaguuuugguccuggcuguccuggaacucacuccuuagaccgugcuggccucaaacucaagaucugacucucugccuccugagugcagggauuaaaggcguguaacugacuaagucuaaugagugcugccccauauaugcuugguaggagcuugagcagccaccaagggccacaccccuaaagaaccugauuuccccucuccuagcagccauaacguucaguagcucuucagccaaggacaggguuccucugaugugugcuggaaugcugacuagcuuggucuuacgcaggcagccagccagccagcuaccauuguggugcgcuccuaagugcacugguccugucauuuccagaagacgcuguuuccucuggcccucccccaccuccagcucucacagucucugcuuccuguucuucaguguccccgacccuaagagggaagaguguaauagagaugucccacuuaggucugauuaguagugagucuaucuacauaacagucccucuaaugaggacuaggagcugcauuaaucuguggggacacagauccauguuuacgauuuauuuaauuuuaaauuuuuauguauuuaugugugugcugaugugaguuuugaguuuauguguaccauacgcaugcaccugcaggcgccagaggaggcuccuggaacuggaguuaguaaaacugccugauguaggugcugggaacugaaccuagguccucugcaagaacaguguguguucuuaaccccugagcuacccguccaguuccuggaauugcauacuuagaaggcauuuugguacuguguucauuuagcaaaauaaucauaguaggcucacgucugaggccgcagauuguugg

SEQ ID NO: 5278 - RNA, 1515 nt, Mus musculus
cacagcccagcacgggcaacagugaacaggccaggcuacuuuacaagaaggaaaagccuuggggggaaaacuugguguuugauaaaggacuugaggaagagaacagcagcugccccuccuuucccaucaaaucgaaacaaaacugagacgaggaaaaaagaaagaaaaaaaaaaaaaaaucgagucuacgcgggaccccagaggaaggaagcaggaccgcuaaccuaagaaaaccggaggcgccggcauccaggagggaaucccgagggcggagcccacaggggaaggagguguggaguugagucggggagaguugccgagagaagugggggacagggauagugaugggagaaaagacggccaggcagagagagggguggggcugccgggcagugccccgggcaaaugucacucagagccgggggaggggaggguccgagcgcagggaucccuggacggaggaucgcggcuucagcagguucgagccacacacagcagcuuaacgccgcccgcucuggggucccugcccggagcccccggguccccgaaggugggaagcggcaucgcagaaacccagagccggaggcggcuuuaccuucgcaggaggcuggaggcgcuccagcccgagcuccgcccgccgccggcuccacgucuugaguaggauggaggcgccgccggccccguccccucucgcuuuccuuuuccccgccggggccugucgccgcggguuccugcgccgcggcccccaccccuccgcuccucccucugccucucagaggcucgcccuggacgccgccaucuuccaccaggcuugcgagcgcugaacccuaacgcgcgugcguggccgccgccccggccgucacgagacccugucagcugaccucggcgcuuccgccucgcgccccgcccucgggagcacugugcucccucccucgguggcccauucgccgucuuccgggaagcgccgcgugcgcgccgcccgccguuccgccucucgggaaguacgcgugcgcuuagcgaaagagagccuuggcccaagcagaaggcgaggcgccacgcccccuggagcgguccgagaggccacgcccccugaaucccuggagacacgccucucagccagacgcuggcauuggcuacuguaacucugcaaaggagcagcucuguuaccuagcccuagucuucaguguccuggcgcauccacgaagccgucgaaagccucagugcgcaucucugguuuagcugcaucgugggcauaacuuuuacucgcuacugacacacccugaacgcggauuuaaguuuugaguguucagggagauaauggagaccgaagccucagaggucaaaggccuuugcgggugaaguguugggacaguuaacacugcugccuuccuggaccucugaucccagagccaggauuuaauuggccaacuacuuaaggucaauuaacuugcagccgucugagauagggauuauccucuauuuucagauaauaaauugauguguaguuccacagua

SEQ ID NO: 5279 - RNA, 1515 nt, Mus musculus
uacuguggaacuacacaucaauuuauuaucugaaaauagaggauaaucccuaucucagacggcugcaaguuaauugaccuuaaguaguuggccaauuaaauccuggcucugggaucagagguccaggaaggcagcaguguuaacugucccaacacuucacccgcaaaggccuuugaccucugaggcuucggucuccauuaucucccugaacacucaaaacuuaaauccgcguucagggugugucaguagcgaguaaaaguuaugcccacgaugcagcuaaaccagagaugcgcacugaggcuuucgacggcuucguggaugcgccaggacacugaagacuagggcuagguaacagagcugcuccuuugcagaguuacaguagccaaugccagcgucuggcugagaggcgugucuccagggauucagggggcguggccucucggaccgcuccagggggcguggcgccucgccuucugcuugggccaaggcucucuuucgcuaagcgcacgcguacuucccgagaggcggaacggcgggcggcgcgcacgcggcgcuucccggaagacggcgaaugggccaccgagggagggagcacagugcucccgagggcggggcgcgaggcggaagcgccgaggucagcugacagggucucgugacggccggggcggcggccacgcacgcgcguuaggguucagcgcucgcaagccugguggaagauggcggcguccagggcgagccucugagaggcagagggaggagcggaggggugggggccgcggcgcaggaacccgcggcgacaggccccggcggggaaaaggaaagcgagaggggacggggccggcggcgccuccauccuacucaagacguggagccggcggcgggcggagcucgggcuggagcgccuccagccuccugcgaagguaaagccgccuccggcucuggguuucugcgaugccgcuucccaccuucggggacccgggggcuccgggcagggaccccagagcgggcggcguuaagcugcuguguguggcucgaaccugcugaagccgcgauccuccguccagggaucccugcgcucggacccuccccucccccggcucugagugacauuugcccggggcacugcccggcagccccaccccucucucugccuggccgucuuuucucccaucacuaucccugucccccacuucucucggcaacucuccccgacucaacuccacaccuccuuccccugugggcuccgcccucgggauucccuccuggaugccggcgccuccgguuuucuuagguuagcgguccugcuuccuuccucuggggucccgcguagacucgauuuuuuuuuuuuuuucuuucuuuuuuccucgucucaguuuuguuucgauuugaugggaaaggaggggcagcugcuguucucuuccucaaguccuuuaucaaacaccaaguuuuccccccaaggcuuuuccuucuuguaaaguagccuggccuguucacuguugcccgugcugggcugug

SEQ ID NO: 5280 - RNA, 12259 nt, Mus musculus
cauggcucugaucccuguccugccacuuagcagcgaugaguuuacaggaggcuuagcugaucuucagugcccuucacucugguguaagccuccuccuuugagagugaauagggcuuugugacuugcugaacaccacagaauauggcgagcaaacgugaugcuuuguugccgauucuguuaugcuacaguguauggcgaaggggauacacuacugccaugaugacucugauccaugguaaggcuccgucuuagccagguguggaggcacagaccuauccuccagccacucaaaggcagacacauuauaaaucaaaagccaacugggguuacauaguaagucuaaacccagccugggcuaccuggcaauaaccugucucacaaaacaaagcaagauuucaucuuaaauugugcaugguacaauccugugccuguaguacuaguccuuggaagguaccugaaggaaaauuacuucagucuccuuuucagcuauguaacgaguuuaaggccagcccaggcuauacaugacccuauuuccaaaaucgacuccuaccccuauaauaauguucauuuugguagacauagagaaagucuuccuagcuuuggaaauacucugcaaucugccugugaagaggccaugugaugggaacagugggcaggcacaggccauaaggacuucuguugcugagagccaggaagaagcagagaaaacgaaaucuccuggugcuuacucuuccugaucgaagaggaaagcagcagacacgugggaagcuggagcccagacucugaggaugacggaugagggagaacucuagcuuagcuuuaccauuugccagcucauugcucugacaccauuuacuuaacccccugaacccgaaaucaggcgagugaacaggguguuccugaagcaugcaccccagaguccgagccuggguggcccucgcugaugauggccaucacagcacuaucauuaguaaugggcuaauaccaaucacuaccguggcuccugcucugugguccaucuaggucugucaugcagcaauuaacaucucuaguacagcacagcucaaaggacaccagguaggaggaggcucucuggugcuuaauucaauggaguuaauuauuugaagcugugcucuagcccagccuaggccaacuuucucugaaaagguccugaaggccaaauggucggaagcagcugagcuugacagauaauccauaagcaaguggcugugcuccagcuaauggucauuugcaaagaggauuggcuggcuggauuugguccaaguggcuugcccaagcccuguccuagcuuuuuuuuuuuuugcuuaugucagcucggcguuccugaacagaggccccaugugaggaguccacggcagagcagccauucuucuccccacugaagcauucugggaauauuaccuaacuuugucguucugagaaucuguaacuuaacuuucucaggccucagguucuuucccugcaaagcuuaggcagcagaacuuccuguucaggccacugugcugauccaagucugugaaaggugauguuuauauaaaagacggaauacauuaaacuaaagauguaacuguacuucaggguuugguggugguguuugguuuguuuuugagacaggaucucucagagccaaggcugguuuggaacuccuuaagagagccuuugccucucgagugcugggauuacagauagugcugugauggccaucaucagcgagggccacccaggcucggacucuggggugccacuggaccugguguguguguguguguguguguguuggcuucuuaucucuccaaauagacagugaguuuguugaaagccaaauaccuguccccacuugccuuuguucccgaaccuccucuaggccuggaaaacgguguccacccagagcagcgcauagggaccgcagggcucuugucauucucaaagcacccguuuuucuuagaagcaaaacgcuugccugggaaacaggagauacacuugaugggggcuggggcaugcggggagccaaggaccgggcagcugcucuucggcuuuggccacagaccccuccacucccugcugcacacccagcagcagcacagggagcaacuacucaugcaugucucugcauuugcuugaaucauggaagcucagccauugcuucugaagugggaguauuuugacaucuuucaaguagagaugguuuucagagcuggcuagagggaccgcaagcauccauuaaugcacggaucaugugcuaacccggggcaccugguuaugaacacuuggauggcaacauaaucuaccaccgccaugacuuccaauugauggcgcgucaggcagaggacaggagaaggcaggcccucugggcuuucucucuggccgcuacagcagacagaugcgugcuuucucugucucuucuccauuugucccagccuaucuccuagcagccagccaggaccuacaacuucucaccugcaaccuacuuuacacauaugcaaggcaggcuggguaauuuauaacccauuagaggugucccuuuacuggagcuuauaaauuccccagacccuuuggcccacagcuaggaucaaaaugaaaucuauguuuuauacuauguuuuaaaacuucacagauuuaagcuucuuuugcacaccaugguagcuuccuuagcacugugugucuuacagacuucccuuccuuacauuaacacacacacacacacacacacacacacacacacacacacacaccccugccagaucaacuccacacacucagucuuugucuuaggcacaucugaggaaggaggcuuacugacccaucucucuguacacuaaugcucagacagcucgggaauauugugacaacgaucaccacgaagcuccgugauucauaagagcaauugcaaacgcuuagccagcaucucucaguuauuaaagaaacauuauuacuccccuuccacccuccccacccccgcccugcuuuacaauagauuauuaagaaugagaaaggcauuccugagaaugggcuagugagcuggggaaagggccaaaccucaaaaagccaagaauccguauucuuuaaugaauagcagaauuauauguuugugugagauuggccccuuugauaaaacccugauucuagagagagcaggagcaggggugggguggagugguugggagaaaggagggaggagaaaggagaacaaagaagaaagcaagcaagcagacaaacauuauuuaggggagucggcagcccaugaaggagaagggccuugaacuugugggagauaagggaaauugcuuugaggcaggagagggagagaaggcuuccugugcucugggaaggggagauacgcgcgcgcgcaggccgaagcaaaugagaaggguuguaaaucaugggcaauccaaguaacauuuauucugcgggcugggcgcugcagaaagcuaucagaagaugaaaaguccggucaacucucucugacugaaaaagcagaaaagcauccagucuugaaacugaagggcuccucuucaucuuuugagcggcaccccggagccgcgguggcugcugcucucuucuuggaaucgggagaccagguuggagguggggguggggacucuuguuggaugugcuugaaucggagaaagguaaccugacuacuucucuuccccucuucuccgccaccugaagaaauugaauugugcugaugaagauuuggcaauugugcugacgcucugaacucuuuaugaaauaacagcccgggugcuaaacucuaaucucguuucucuuuguuggaaaagggaaauaauugcuacuuaggcugucaccugacucugcagaggcagggagauggaucuuaagcacccuaggcccugugaccaaagcucucuccgauaaaaggaaccagcugagcauucuaauuucccggaggaaggacaauucuuggggcugaaggaagauuaggagucgccaagugagggugagggguggaccggguguggaaggaaaagcaaugaccuaauagaugcccuccagcuggcauccacaaaugaucuaggaaucagaaaaggcccgacuaaaccccagugaugccccauuauccugcacagagugagugccaugaauuugggcaacacagacaauccggucaauacucgaaauucugaauaaagcauauuuauuugugaccucauaaaacagcaccauugccaauaacugcaaagauucugaacuccacguaagguccuuggggaguguccacaugguuccaaaaucuacugugcugauuacaagucccuguccccuccugauugauuauauugcaauuuccuuuccaaaugcuguagacagcgcuucucagacaaggccaauuuguuuacagcacagaaagcaggcugcccauguugagucuucaaagggguacuauggucaaugcagcccagaucaccgaauuaaucugugguggggccaugaggaugggugaacuuccccaagaauggucgcuucccuauacaaaaugcuagagcacagcuucucccagcacgugauuccugacaacaucugcacaggccugcaaacacaauaaaaccacacaaguccacuaauaaccauagauacugccgggagacagaugcaaacugaaugcuuuccugggcaauuucccuaugcagucuuucaaaacugagucuugaguguuuugugagcaaucguucacaucaaaaaggcuacccccauccugaacuucaugcagcauuucuaagaagguuaaacuaaucagaaccugccaaaaugguauauauuuguauaauuuuaaagaauguuuuacauaaucacacauuucaaaguuuaaagggaagucaaaauauuccaaaugucaaugucaaaacccuaacaaagcccuggagaucaggcagaggggaaggaccagccaugcaagaggcaggagugucuuugccaggggacuucugugucagucagauugccucugcugcccagguuuuuacuuugcuuucugcagagugcugggagggauguauuuuagggagcucaccaaaacuugcuuccggauauuaauccuucuaaaucccuuuuggcuaagagcuagaggcuaucuguagccaacugaauagaaguaaugaauuugaauaaucaauaugaauuaacauagaaaacaguccaaacuagaaagaggccagcacccccuuuaaauucagucugauacaaacauuuccuuaauauucaggauaaggcaaguugguuaguauuuccagaagcauuagcucauuaacgggauggaaaguuauuuuuauuuuguauauauuuugaauuuugcuauuacauuuugucauauuuauagaugguauauauuuuuaaaagagugcaugggaagauggcuuugucaguaaggugcuugccauacguacgugaagacagguacagugugagucuguaaccauggugcuauguaagcagaaacucauagauccuuagagccugggugaaucacucacugugcuccagauucagugagagaccccgucucaauaaauaaggcggaaaguaauugaagaagacaucagauguugaccucuggucucuacacacaugugcacucacacauguacaccuacauggaacacacacacacacccauguagaccugcgggacagugggugccgggggagagagggagugggagauaacccgcgucccaccagaguucuagugcucuggacgggcagaugugagaggacugccccucgcuuuccagggggccccaggugggugucuggcugugggaagcuacagacucagcccacgguggggggugggugggggguggacaaggggcaguccuagauaagauuucagucucccgcauccuacucuggauucgguggaagagcugagaacaaaugggggcccuggaggcagauaggucagcuccaggucagcuccgggucagcccccaggcagaagggaggagagagcagggagagaggggccacugggugguucccacacaggugagaguccuugguccaagguccgugacuggagcucaggaaagccuuccagagggagguuagaugcagcucauuauaaggagccuuucccauuguucaagcauggugggccuugaugagcagagacagucuaugguuuuagagcuuuauuguaaaaaggcaggggggaagagagaagguagaaagagggaaagaggcuggccaugggggggggaugagagaaggagggcuagaauuuauaguaagaaaagugagagcuuaaagagcgaggaggggccaagcagcuccuuuuauagugggcugggcugucagguaacuguggggguggagccuagccagaaugccagaagcuugggacauugcuugacuuauagucacagaaucauggaguugggggcucuguagugucaggcaccugacucuggaaacgugacucgcuuuucugucccuuguagaguuuucuacugagucaguggagcaagccucauuuaaccaaaauaggcugccuaucacagucccacauacacccacauggaacacacccaugugcacccacauggaauauacaaauacacacauacacccacauggaacauauaaacacacauauacauccacgugaaauauacucacauguacacccacauggaacauacacacacauguacacccacauggaacauacacacacauguacacccucauggaauauacacacacauauacacccacauggaauauacucacaucuacacccacguggaacauacauacacacagagaaaucuuuguaguugaggcuuccccucaagggcuggucaguucuuagagaugaaggacccagcucagucuagcacaagccucugagaugcuuagaagccacuguggacacacacacacacccucaccccaggaaauuauauucuucugauacaaauuaggcaggguacuaagcacuuagaaagcacacccauagucuguagcucccaccaagauucuucagcccugaacgcacaagcccuguccugguuugcuuuuccuaaggacaccccucuaaaagcuguaccccacauuucucccuucuccuaucuucugccucucuaacaauuuggggucuuucccaugcggcccuucaugggguucugaccuccuguguuagggccugugagugccauacacuuugcucuccugagcuucucccacaacucuacuuaccaucacaugaaagaauacuaaaugugcuuuugauagacugugggagcgcauugugaaacucugcggcacucgaagcucucaaacauugaucucguuguuguuguuguuguuguuguuguuguuguuguugcugcuguuguuacugaacaggaccauuuauuaaacuuacagcugugcuuauagguccguagauaaaauaugugaauguuaaguuucacugcuuugugauaaguuaccacgaauuuagcagcuuaaaauagcacaccuuuauucacuugcaguuccugugggcuaggagcucaggcgcagcuaagugagguccucuauucagcauuaagugaagcugggaucccuguguuagcugugcucccaccuggaagcucagcuggaggggaguccauuugaaucaggugugagaaucccucuaucuauggucaaaggacaagggcccagcuucuuggugugucugauucgagacauccccgacauguaacaugcugccugcaguuccuugccauagaggaugucccacauggccauauauguugucacauguggaaggggggucuggagagcaagcuuccaacuuggaaucuuucuuaaagaacauuauauagucacgaggucuuagagaacauaauaugcccauaggcaggguuaucuuuauacaacccauuggcuuagaagaaggggguagcaagauggcucuguggguagcgcacuuucccugcaugccuggugacuugaguucaaucuuuggaacccaggugaaauggaagaagagaacugacccucuagaguaguccucugacauacucgcuccauauacuauagcacuagccaccccacccccaccccauacacauuaccacagaaucugcucucuacaguuaauguacaacuguuaaugaagacauucccagaaaacagauauaccucucaggagugaagcgggcguuccagauggccagguguccaggcagcaauggcuguucucuagggcucccucgugccuuugaggucugaauuuaagcgguuugauuuggaaaggggcccagacuccaagauccacagaugcaguaacagcuuccagucagccguacacuggaagugucucugaagacaugaggucucuucagauaaggacugaagugguuuccuauucccugccuuuggaaagcccacaaguagugcacucuuucuuaaaagccaaacgcugguucuugucaucuauuuuuagagaaaggucucaccauaauucccaaauuggccucaaacuccugggcucaaaugaucuccugccucagccuccgaguaacugggccccugggaauauacggccauuccccaguccugccuuagacuguuuuucucugagcaggaagcaaccccauccuggugaagaauaaguucaucuacugccucgugguuuagauuuaugacaucaauuucacaucgcuuuuaccuuauuuuucuuccaguuuuuuuuuuuuuuuaacucuguggcaauuuuccaccuaaaagcuuuguaacuggauuucuauggaccgggcuccaaccuuacuuugcccuugcaaacaucaaguaccacacaguccaacagucugaucaaaccaugcacaagcccaacccaaagcugagacaggccggaauggccugagacgucaccaucaugucaucguuucuguggcugugccuuagugcuccuaaagagcgccccuaaagagcgccuccuuaaccucagaugcacccaucagugucuagacaggguggaggaagcugaagcuauaaaucaccgaugagaggcgagggcacugucucauuaccucuagaacaagccucauuucaacucugugaugaacaagucccuccucuuagcucugcgguccuuagccugaugcauccagacauuuuauuuuguggcuuacuguagaaaagucucagguggcuuuagaauucuggcuuuguaaagcuguuuucucuguaaagggugaguuuccuauuccuauguaaacagugagcacauuucugguguacacugacuguguagccaagagccggugccgggcagaugcacagcagcacauaacccagaacauaccuguuaaaggaugaauaagaggugaacuguguaguacaugccuguaaugccagcucucagaaagguggggugggaagaucacuggacauuuaagaccagccugggcuauuuagcaagacccuguuucgaaauaugaaacggaaacauucugcucaaugcaguggguuagaaaugggauaauuagacagcguuuaugcacagacauccuguguuauuagaugucuuuugugcugauuaguuuuugacccaaacuagaaucaccugaguuguauccucaccugaagaacuguccugguuguaauugauauaggagagaccaauccacugugggcggcaccacuccuaggaagguggaccugguguaaaaacauuagcuaaaaagccaggaagcagcugcccuccaugggucccgcccugacuucccucaaagaucagcuguguucaggaugugugagccauguaaacccuucucucaaggauuugcuuuggucaguguuucaucauaacaaaaaaaaaaccaaacuagaacacuguucuaaucauuggcacaagugccagucuccuccuucugugaccaaaaaacaaaaagaagucucucuuguucuggagcacaguaaguuuuccuguuucaucgaaggacuuucucugucuuguuugaaaucuaugucuaauccuacauuucugcaggcaggacuuccagugcuucccagcauucauauccuggcuuuauuuucuauacagacuaugccaagcagaccccgugcuuaaccucagugagccucaguuagcccaucuacuaaauggggcuucaguaguaucuucuucccagauaaagucagugguacacagugcucauccuguguucuccucuuuguacuugucauucucagagacuucaucucccuacagcucuuaacaaucacugugucuacuugaugcugagauugaaauacguauccuugaugccucgugaggcugccacuccuggucguccuugucugggggucauuucucccugaugccacuccugguuguccuugucugggggucauuucauuucucccugcuggaucagcuucuucucagcaucauucugccugaaaugauucucaggggguaaaagugcuugccaccaagccugacaaccugaguuugauccccaagacccacaugguggaaggaaagaaccaacucugaccucccuguguguacuguguggcacacacgugccuuucccucauaaaugaaaacguaaauaaacaggaaauaaauggaugugaguucaaaaauguuuuaagaguucccaugugacccagagauuucagucccaggagaaaguaaaaacaccuguccacguaaaagcuuguacauagauauuuguagaagcauuguucauaauaguucccaaaugcaaacaacaucaaacauccaucagugggugaacagacaaaugaaguuuaguguguucauauaacaguacuaugcagucauacacauacuguacaauauuguacagaaugcauugugagugagccuuaaacaugagcugugucaaagaagcuacacagaaaauggaauuguaggguaccaucgaugggaaguuuccagaguacacagguuccuggggucaggaaauaucagaugagugguugccagggcuggaggagucaaaugugagagcugcuggaugcaagacuuaguauuuuuguuuguuuguuuguuuguuuguuuguguuuuuaauuuuuuauuagguauuuuccucauuuacauuuccaaugcuaucccaaaagucccccauauccucccccccacuccccuacccacccacucccccuuuuuggcccuggcguuccccuguacuggggcauauaaaguuugcaaguccaaugggccucucuuuccagugauggccgacuaggccaucuuuugauacauaugcagcuagagucaagagcuccaggguacugguuaguucauauuguuguuccaccuauaggguugcaguucccuuuagcuccuuggguacuuucucuagcuccuccauugggggcccugugauccauccaauagcugaaugugaacauccaaagacuuaguuuucaagguaaggcaaaugcucuggaauuagauaauguugaggucacgcugugaauccacuaaaaauugccaaaauguggacuuaugaauguugagaugaugaaucuuacaucacauagauuuugucuuaauuuuuuaaagauuuauuuauuuauauauauaugaguacacuguugcgucuucagacacaccagaagagggcauugaaucccauuacagaugguugugagccaccuugugguugcuggaaauugaacucaugaccucuggaagaguagugagugcucuuaaccacugagccaucucuccagccccuucuugucuuaauuuuuuaaaagcaaacuuugucauugaaaaguaacacuggccacucuccacuacuggcgguuccuuaggcucugugaggaauggccaguggacgagaccaaguggccgggacuugggcgcuuaccugcggcagcggguagugcaggccuuccgggagggagagaacacccagauuacagaacccgaggccugugaucagauguacgugaccuuagcacgacugcauucaaacuacuacaagcacaaguacccucgccccagagccaccagcuucaguggccuguccguggaagaguaccagcugauccuguccacagguacuuuggaagaguuccaagagaugaauaagaaacugcaggagaaguuugcacccaccaggcccgaggagaaguacaaggccuggacucggguccugucccgcccacggaccugacuguggggucugaugcucaucaauaaaacugcccgguuucuuccaaaagaaaaag

SEQ ID NO: 5281 - RNA, 3150 nt, Mus musculus
uagcuggauaugguaaguguccauucuuuaacagaacaugaguggaaaccaugggacuucugcuuuucuugucuagggaagucucugggcugagcccuuucauccuucucauuggcuaucugggugaugcccguaagacuuucagguaccagcgguugagcacagcagucugcauuacuuagccucaguuccugaaugacugacugggcuaugcuagccacaugcugacuguaauaccuaccuguggugguucgaauauguuugacccaugggaaauggcgcuguuaggaaguguagccuuauuagaggagguguagccuucuuagaggaagugugccacuguugggguggguuuugaggucuccuccuauacucaggcucugccaggguggaaugguagccuccuccuggcugccugcagaugugaguuucuuccuagcugccuucagaucaagauggagaacucucagcuccccuccaguaccacgucagccuggaugcuacuaugauuccugccauggugauaauggacugaacuucugaaccuguaagccagccccaauuaaauguuguccuuuauaacaugaugucucuucauagcaauaaaacccaaaccaagacacuaccuaugugagaaagaaacaaaucuuucuccuuuaagccaauuguuaggucucuauucaagcaguuuaaaccuguaccgguuaucuuuuggucaacucaccaucaucugggaagagggaaccucaucugagaaaaugccuucaucauauuggccuguaggcaagucugucgggcauuuucuugauugcagauugcuacgggagggccuggcccauugugggaggaggcaucucuuaggcaggugguucuggguuguauaagacagcaaauugagcaggcguguagguaguauuccuccauggacacugauucaguucuggcuuccagguuccucaguuccugcccugacuucccuucauggcggagcauaaacucuaagauaaaauuaacccuuuccuccccaaguagcuuuuggucauaguguuuaucacagcagcaaaaaaucgaacuagaacaauguaguccaacucaugcacacauauaugugcacagcaaucuauuucuuuugacuccauaugccccuuaaucugauugccauguguuuucuuuugagagcguucaagaugaaugcugacauucccuaggccaguguuagaaauucaggcacuguuuguccuuguccaauuuauuauucuuuuucuuuaucaucauguagagaucaaguaugcauaggauucuuugcuagaggguauguggguaaauggaugacucagaaaugaaugcuuucaagaaacuuaaaaaguuucgagacuuccuggaaaguaaaaacuuuaaauuaggagcacuugugaugauuuuccccccccuucggaguuuaauuagaauagaaaaaaaguugguuucauuuguguuuuuucccccauuauuauuuuucggagacuguuuccccugguauuuuguguauucaguuucaaggccgguguuuccagagccaaugaccauuuuuggcgaauggcaauaaagcaugcaggagugcccgccccacaucacagcauaaacagccccucuccgccccucucuggagagcauuaaaugcugggaaagcuggugugucacugcuccuccaggcuuccugugugcuaggggauucccaggcucacacgggcucugagggaugaggacaaggagagcuugaagaagccagccuccccagggugccagcuaagaaccagcucuuccuagggguagguguauugauguacauuuuguuuuguuuuauucccccccuccccaaauaccuuuuauuaugaauuacacaaaacaaaacucuaaaucagucguuggugagggucuacagauauccuguguuuaaauaggacugcaacacagcuuuaucuucaaauuuugucacaauaucauguuuuaccugacccgcugaauggaacggccccauuguaauauuaaacaguuacugaaagcagcuguacugaaguuuuaacuggaugcuguucccaaucuaggcuucaccagacagcacaauauggucaaguauugguguggauauaauuguuuucauuuguuuuuacacauguucucuccuccuccucuccucuuuucggcuuucuuuguauuguuuguuuauuuugauuuuuuuuuuauuccuuuugagauagagucucacuguagcccaggauggccucaaacuugcuaaguaacagaggccagucuugaacggcugcugguccuucugcuuuaaccuccaaagucccgggcugacaggccagguaccacaccaccuaugcuuggccuauagaaguauugcuuuuauucguaggcaacgagaaagaggcauguggggacagacaugaguaaccucagauagcaaagaggcagagagugguagaggcugggauagggacacagaagaagaauccgaaauaauacuucuuggagaaagaaaguaacucaggugcaaaauugugguaagaagggaccuacaagucuuugaacuuuuauugaucaagaagauaugaaguaguauggggcuuaccuccuguguggaaaggggucugacgugcguucuguggauuauucaagcuuuuggagauuucaaaacugcagauugguguuagaugagaaaacccagggacaagaaagcacugacaacuuaacuggggcaggcaagauauggaacucaggugaaagaccacuguccuuugcagagcaugcugggggaacugguggcagcccugaguaagauacuggagugauuuucuuaugcuuagcuuaucaggauucauguguguguguguguguguguguguguguguguguguguguguguguaagcguuuguaugugugucuaaguuuuguuauaagacaguuucuuuuuuuuaaauuuauuuuuacuuuaugaguauaaggguuuugccugcacuucuaucugugugucauggcagccuggugguugcugaggacagaagaggacaucagauccacuggaacugaaguuuuagauaauaugcauugccuugugggugcuggguacugaaccuagguucucugggaaagcagcuaaucuucu

SEQ ID NO: 5282 - RNA, 1225 nt, Mus musculus
ugagcaugagccaggguggcccaggggcucacaggaauuccccuucugcucugagcccaccagagcuggcuauacaaugauaacuucaccccccucgccccccaugggcagcaccugcucccugggucuccccugguggcccuauuaucccgcaccugcugcuuccccaccugcucccuauucuuagcccccuccccauagcacacccuguucaucacuaggcccagcugccugcucugacagccagccaggaagggguaauagaaccaggagagguagcauggagggcccaaggacagaggguccagaggccaguccagcucuguuugacuaguaguguguaugcuuacaauggacuccaucucagggccucagucuccccaccugugaaguaggaaccgcaagcccugaccucaacuuucuacaaaaacuuuacugcuuggaagaucuuaggccaucguguuucaagaucugaguuacagaggacaaccagguuggggagaggagggaggugaugugccuucggcuguauucccagggcuaugucuguuagacuacaaggaggccagggcauuucucugauuacugaagaauccuuugugggcuauuuaaguaagguguggacccagccugggugccaggcaacagguagaugaauaaggaaacugugauuauacaacauggaggcuuauccuaccgcaagaaucagugcugugugcaggaaaagaaauggggcugcaaagccuuguguuacaucaaagaagccagaugcagaaagacagaagccacgaucucucccacguaggaucuauaucuauaucuauaucuauaucuauaucuauaucuauaucuauaucuauaucuauaucuauaucuaucuauaaagaguagaaaggggacuuauguggggaggaagguaucuaagggggagggaacaagagaggaugacagggggaguuuaaaagacaucacguguuuuuauguauaaggcuuagauuuuaaaagugcaugucaaaaagguaucucacauggaaucaaaacuacuuacaggaaagaaguggaccaugaggacaaagagcgggacaagggagggugacgcaaccuucacgugcaugaagaugcuaaugguucauauuuuauauccugaagaaagaaaucaaaagaacuaaaacaauccccauaguuaaaacagaacaaagcagaaaaaaagaaucacuucuggggc

SEQ ID NO: 5283 - RNA, 22065 nt, Mus musculus
cugauuuugcuucucccuucaagauggcggacacaaugagccggcggagcgccgguuggcccugaauugacuccggagaagaacggucagcgaggucccgucguccgggcgagagagcgucgccugaggaagaggacgcggcagccccacugucagccguccuucgguucgucuccagcgcggcgcccgcaccgccgggguuggcccugagcagcccgcccgaucgcucgccucucggccccgccccggcccugcgccgccgcugccuucagcagcagcagccgccgccgccaugaagcugaccgacagcgugcuccggagcuuccgcgucgccaagguguuccgcgagaacucagacaagaucaacugcuuugacuuuagucccaauggcgagacggucaucucuagcagcgaugaugacuccaucgugcucuaugacugccaggagggcaagugagugugauaguggccgaguuccaagugccccucuccuucccucugucgcugguccccgacugagcccccacccccaaccccaggcauguggugcaggcgcucuugccagggccaccuccaucccgcagugcugcaggagauccucuuuaagaugaugaugguucuuaguucaugugucuuugcucucuuccgagcgcgcuuuucccgcuugccaaaccccaccuugaccuugaccuuuaaacgccaugucccugcacccugcagccggacggauagcccuuuccacuccccuggcgacugucagaaugugcggguggacucugagcucgaugcagaacggcaggagcuguguucuguccaucaguggcguccagcucucugccuucacagcagugaccuggauucagcccuggcacggugcccgcccccuaccccucagcuucccgcgcggcuuuucugcaaucaagccccgcgggaugcaguuuuuaagcugucaggauuuaucgauugugcccaugugagcuugcuguccuuucccaguaccaauacccaggcuuacaguuaacuuacuaaacagacucuuggaaacuuuucuuugccagacuccugagaacuuggccgccccauucuggucagaaugugagcucucuuuaaaacaaagaaagcauuccggaacaauuuaguguuuccuuuugcauuacaaaaaaaacccaaguuuggccgcuuagccaguaaucucagcauuugggcgauagaggcagucagacccugaguucuggacuucauagcagagagacccugacucaaaacaguuaaaaaacaaaaaacaauaaccgccagauugugguuugcuuauaguuaucaaaguuuuggaauucuggaacugguuauggaaauuauguuaguuggagaacuuguguaucuuugccguuuucauagccugggugugaggaagacauugccugucucaucucuggaaguucaaauccucgauaaguaagcagugaccucuuuuguagcagaaacuaguuuaggcuaaauuugauucccuuugucaacuucagcuuccuuccuaagcaggagguguuuaguuuaauagcuacuguuuucgacauuauguuaaaguuaccuguuuuugaauccuuggcuuuuucucuccuuuuugcagcuguucucuuuguuuauuauuuuuuucaaauaauaguuuucuuuuggaacuugucucugaguuuaucuaaaguaaagcuauuguagaaugagcuguauaugauauuguccuugauggguuuccucgcuggagcuccaacaaaguauuacguaacugucguuggacuugagcuugcuguaugugggagaguuuccuacaguggugauccuggggaagagaaaauuacuaacuggacaaauaguuauuugaauugauguucauauuuguguauugauuauuaucauacacuggucugacuauuugauucuguuuggaacuacaaguaauuugaaauugguuugucugacauguuuggugcaauacauagcuuagaaucucccccccaaaucuguaauggaaaugcauauccuauucaaaggaauaaaacacuaagacugaaaaaaauguuuauucaggcauguaaccuuuuuacaugauuacaaacuuacagaaaguuacaaugcuccaaagaacuuucuugaaaaaagaacguguccagcagugccuauaauuucagcgcuugggagcugggggugcgaauccaaggcagcuugaacagcugucccaaaaaggaaauguaagggcuggagauggcuacaggcacuugcucuuagagaggaacaaguggacuccuacaccuuguaaccaucuguaacuaguuccaggggauuugaccccuaauucugauuucuugagagauggcucagcuguuaagagcaccucuuccacagguccugaguucaauucccagcaaccacaugguggcucacaaccaucuauaaugggauccaaugcccucuucuggugugucugaagucagcuacaaggguacuccuauaaauaacauaaagaagucuucauaaagagagaaguuuguggggggaaaaaaguccaggagcuagagagauggcuaacaugugguuaagagcgcauguuaauuuugcagagaaccuagguuaaucagcagcacccacguggaggcucacaauuacauuuaacuccaguugcaggggaucugauguucucuucuggauuccaugugcaucagaccugcauagggugcccauauauacaagcaagcagacaaaaugcucauauacauaaaaucaguaaauguaaaaauauauauguauagaagaauaauccaauaauuccaacaguagaagaaaauaacuguuucuuuggaaguaacaucuuuauuagauaauaccaguaguagaauuuggguauuugaaaauagcuaaaacacagcugauuuuuguuuguuguuuuuaagauacuacaccccacaguggaacuuugucuguagcuauagugcugguuggcuuccaacagcaauccucuggccucagucuuggcuuaaaaggauuuuuuuuuuuuuauugaaaguaguuuuucaugcacacguucucuguguacguuuuagcugugugugagcuugcugugcauguauagguagaagacagcgugcaggauuggcugcuuuccucccuuccugggagcccagggggugaacugugauuauugagcuuggcggcaagugcccuuagccuccaucuaaccagcucaccugcccaggaagagguugugaagggcuuugguuuuguuuguccauuaaauguuagaauguggcucaucccuuccuucgacuugaaggaauauauaggggguauugcuuuugauugguaaaauauuucaaauuuuuucugucuaugaacacacacacacacacacacacacacacacgugcacaugcgcacauauguuuaguuugccuuaagacaguagucucauguaguccaggcuaacucuuauguguccaagguuggccuugaacuccugaucccaagugcuggauuauacacauguaucccaccaccagcagcuggcuuuacuauuauuuucuuuauucauaucugccuccagaaucauaguuuuaaagaagcuugccaaaauacuuggaaaguucacauaaaaaaauauauccauuguugaugucagacucuuacuuucaaaguaaaacugaauuaguuuucauuaagacacaucuguuaaugcuuuuuuguuuugcuuggauuuuuuuuuuggauguaagacauacagaccauaucuuaauggaacccagguuuuuuuuaauaccacaugcuuuaguguacuguuuacuugaaggguugaagauagaguccagggcuccaugcaugcuagcaagccuucugugacuaagucauaucccagcccugucuucuacuguaaaugggcugaaauacuaggauucgcuuuuaccacugauagaugcaaagucagcaugcucagccucacucagucaguacuuaccuaguacuaaccucagagcuucagacaguagacuggaccuaguacucaguaaguacuuacuaaguacugacugcagagcagagcuucagaaaguagacuggaccugaugguauuugauuucacaaacggcaggcauauagaaaguauaguacaauaaagaacucuuguucagaauagguuucaugaagcagaaggccucacccucucugaccuuaacaauugaaaguacagaaauugacuuguaggcagccuggaucaucugauugcucgaccaaaauaauaugguuccaaaauaauaugacauugagaagauaaacauucuuuugcauaaauucaaacccuuggugacuaguaguacacuagucaaucuuuuacuacaauauuccugggagggacacuuugugacagggucucacagggucucauucuguaguugggacuagccuugaauuuguagugguccuccugccauagccuuuagaguucugacuggaauuacagaugugagccaccaugucuagcuuaaaauucuucuaaaauauaaauguauaaaacacuuuaaaagauuuucuuauuuucuggccugguucaaauggagcacucugucguuccaauuuuguuuucuaaagcugggcauggcugccugccuccgccucccagcacucagggagcagauacaggcagauagcuguaaaccugaagacagccugaucuacauagagaaagcuuaucuuguaaaacaaaaauaaaaaaauauuacuuuaaauuguuuucuagagauauuugaguuaaaaaaaaauugccuacuuuaaauagccugcagcaggaaguuugguuguagauuuuccugagagcccauuuaucugaucaagauuugcauuuaagggacuugcacgaagaaguuuuguuuugaacuuuggguuggaaacacacacauuuacaugaaaguaaaagcaaaaggaaccauccaguaguuuuguuggagagguaggcuugcugcuacuuucuacucuguguaagaaaauuagacaucuucuagagcaaguuauguuagaaacauaagcaggguugcaucugguuucaaucgugauaaaucauugccuuaagaaagugcuugcuaagugaauggcuuaggaaagguuacuggcucugagguacucuccuaucccucuguugugauucuugguuugugauaguuuguguacuuuuuucucaaguagauagucuucccaaaguuuauauuugaagccagguaugguagcucacucucauaauucuagcacuagagaagcccaagcaggagggucaugaguucaaagccauccucaaccacauaaugacuuagcaggcagguaagacccucccucgagauccucucccccuuugaauauuguaguaaaggacugaauuaauauucuauauuuuauuuccaaaccugggcuuugggguucacaaaugaaagacuauucuucaguagcuguuagaguugauuucucuuuucaagagaugggcgcuggagaggugauugagugguuaagagcucacaccacacuugcaggagacucagguugagucuucucggacucugcccuguucauaccgcucaggagcugcuguuuagauggagcgcucgaauguugugagaguggauucuaaugguuccuguuuuccccucuguuuguucaucagaccaaagagaacccuguacaguaagaaguacgguguggaccucaucagauacacccaugcagccaacacagucguuuacagcucuaacaaaauagacgguaagcaagccuuccuaggagaugucaguguugguuucuuugaaaaacuuuaacaaacucuucaugagaacuuguacuuugguuauaguugguuuagauguuucucuguaauguuagcagugcugagaauaucaaugaaaguaaaaaugcuggaaguaagcaauuagcacuuuggaaggauugggaacagaaaauaaaaaaugucugcaguguggaguaggaaaggaaguaccccguuguguuuaugauuugcacuccuugaaacuugaaagaacacuuaaaaagcaaaacaaagaaacacgugacacacagcaguuaguaaaucaccaggcuugccguuuacaaucuguauguggauuaaaccagguguaacacuuuaccucuauauucuuagcccuugggagucugaggcuggaggagugggaguaccaggcuagccaaagcuagccaaggcgcgcacacgcacacgcacacacacacacacacacacacacacacacacacacacacacacacacacacggugagaucuucuaaaaggcaggggguugggguaaaccuuuacauuucuaacugagggagaauaaaacaaaauuugcagauguacuaaaugcagacuggaaaggagaccaaaugcgggagauuaagaauaguagugcccccagcgcucaggaggcgggugugcagcagggccuugguuugagcccuaccugggccauugagcauuuguagcuugaccccgucuuaaaaacaacagaggaacaaaaagacauccaaauaguuagaagagguuagcucuucugugguuugugucacacggugcagugacugugguuguaaauuccaggaauaccuuuuguuuugcuuuagaguaaagguauuuuuuaagaauugaaacauccuuuuuaauaacuaguaucugcuuuugacugauuuccccucgaauaagucccuaagucaacagaacugucucagugcuugaacugucgugugcuuguuauuuuuucucauuuuagccuuguuaauacuaguuuacuaaugcacuuuuugcaguaagauuuuuucauuuuguuuuauugagauaguauuacugugacucaguuugcccugcuucauacuccuggguacugaguguguaggucugugccgcuaucgcaggcacaguagauuuuucuuuagguauguguacaucugagugggugugugccuaugcccuugggccagaauagggcaucagguccucuggagcugguguugcaggcaagugagccacgugcuguggguguuaaccaaacucaggaccucuggaacaacagcaagcacuguuaaccacugagccaucccuuuggcgguacuuuuuuuuuuuuuuuuuuuuuugauuguguauguguguggaggugguaugugcacaugugaacaugggugcccacagagucuggaagcugucagcuucuggaguuggaguuacaggcucguaugagccgucugacguggauccuggaaggggagcucagguccuuugcaagagcagugugugcucauaaccacagugauuuauuuugccucccucccuguuuugaugcaggcucucacuuuguagccccagauggccuugcacucuguauauagaucagguuggucuuaaaauuaaacuuacaggaacccuccuuggugcugggauuaaagacgagugacgccaugcccagccacucagcaaggauagccuagguggcuauuuuaaccuuucucaaagcaaaugggcaggcagaagucuuucuuuaauaagacuucuguacuugaacuugauuuuauugcaugucuaaucaucucuauuuuucauguaugugucagauguaguuuucuaaguaggcaaugccaccgaugcuuuuggauaaggauaaauacuagaauucugaggguauauaaaaauauauauaaaugacugguguauuucuuuuguuggguuguuuuucuaagugauuaaacaauucuccaaauaugguaaagaugaggcaaauguguggcgggugcagcuuugcugccuggccucugcuguggggauguugccuuuccuuccucaagugcguccugcagagcugcuccagcgcuccguucucuuuugccugauuccaggcugagguaguaguuuguacaguuugagggucuaugauaccacccgguacaggagauaacuguacaggccacugccuugccaggaacagugcaccagcuaccaaaugggguggagaagauggugaagcccugcucaucucugggauuccagguaaugggaggggaucucucuuuaggucaggugaguaguuccuggcacuagaauaaccagaaaugcauugugguugucauuugagaggcuuggaguuguucagauaaaccguuugaaacuguuacagaauauauagaaggguucuuuuuuucucucuuauugcaaaugcccucucauuagaaagcaucccugcaagcuaaguguguugcucacaccaguaaucccagcauuugagaggcugaggcugggggauugcugcuuuuuugagacuaaccugggcuguauaauggguuucaaucuagcaugugcuauagagugagacccugucucaaaacaaagcccacucuugaagccgcuugguucuuuggaccucuuuauugggcguuuugccuucccuccugcacuguggugccauguuuuguauuauuuguuucucuuccuauuuuuuguuuuguuuguuuucauugauguuugaguuugguuuuugagauagggcuucaguaaauguaucccaugcuggucaccaauguggugagguuauagagucacuacuuacagcuuuucucuaucuuucuuaggagcauaguacuuucuaauuuuauucuuaccuuuugugguguuagggguuaagccgugggccucacccacugauggaaugcaccaugcgcugagcugccuacccagccucucuucauucugcugucaguguagucuugucuuuucuuucuuucuuuuucuuuuuuuuuuuuuuaauuuuuuacucuauguguaugaaugguuugcuugcauguauaucuauguauccuguaugugucuggugcuuggggagguuagaagaggaugucagauccccuggaacugaaauuacagaugguuaugaaaccauguggcuccugggauggagccugcugcucuaaauugccgaaccaccucucuagacccucuugcuuacuuuuucuagauagacugcuuuuuccuuucuugauuuuucuuucuuugacagaaucugucuauguaguaggcccaacuuuacacaaacuaacuguauagcccucuaauuugcccuucugauguucaguguaagaguuaucacuuugcagacagcuaaaauuaguguccauagcuugugauuuuuucccccuugcuaggaaauacuuauucaggacaaguugaauuauuacuugcaaauaguacaaagauugguaacaaaaaagugauuuuuuuuuuaauguaguuuuuaacucccaaauucgccuccucaaugcugcagauugaacucugagcugcucacaggcuaggugagcacaucaccguugaauuguacaccuaggucccaaaauggugauaguaaugucgguauaaaugccaucaacugaaaauuaggcuuuggaguuauaugaaucuguuuaugcauucaagcugcugagagagguuguucauguucaucuguaauuugcuugugugauagaauauaguacauuguuaguuaggucuugucuuuucaaaaguaaaaaugcaacauaaauuucauuuaaauacuacaaugucauccgcuguuuguuuucuuacagauacuauucguuacuuguccuugcaugacaauaaauacaucagauacuuuccuggacacagcaagagguaagacagagugcaacagucaugcuuccuucauccauuggguaacguagagaauggaagagagggagagguuuuguuaguaaguaaauccagcccuccucacugcuaaggaaugcacucagcacuccucuucaucuuguuaacggaucucagucagugcuugguuaacugagguuauggaagcaggagauggggcuucaaagauaacuauagaaucuguuaaaauuuaaauaaggugccaggcagugguagugcacaccuuuaaucccagcacucggaagugagagagacauuggaucugugaguuugaggaaagccuggucaacacagagaaacccugucuugcaagguaggguaggggauggggcuuaaguaaggagcugggaguauagcucgguggcuaagcaccugcuuagcaugugguuggcucuggauucaauuccccacacuaagaaagucaauauaauuaagaggaguuaagugugguucaaugcaagaccaugcuugccauacaagaaucugugugucugugucuuauguuaaacauguggacuaaaguuauuagaugaaaacuuaugcuauaaaaauuagacuugguauuuagcaacaccaaaucccagauagcucuuaacaaaagaaccauuugcauuuaugaggccuuccacugcauuuguguugggcuguucaugaagaaugucccauauauaaaggguuuuuguuguuaauguauguuuuuauuuauuuguguguguguguuuagucuacauguauaugugcauaccagaagaggucauuaaccacugagccaucucucuagcucccccucccuccaccuuuuugagacaggauccuugucuguccuagaacucacuuuguagaccaggcugacuuacagagauuggccugucucugucuccuaagugcugggacuaaacacauauauaauacagaugaugcagagcugugugguguggugcagugcccuaacagguacugugucacuuuuauuaucuaucugauguucaccuuugggcuucagcaauaggccaaagaaaugauuucacccagaucuucacguugugagccaguaaguguaauugugguugcuuauuggagcacgggcaacugaaauggcaucucccugcucucccaaguaauugucaacucuuaugugucuuugaaggaucagggucuuaugaggguuccucaacagcagcuacaacuguucugacuuaaagagagccauggcaugccuaaaggaugacaggagagauggcucggagcugccuguuagaagugguucuucuguaggguacagugacacacaccuuuaaucccagcacucaggaggcagagucucugugaguuccaagccagccuggugugcacaacaagcuccagggcaaccagggcuaugcagagagauccugucccaaaaaagcaagcaaacgacaacaagugcacucuagcugagcauggugguacauucuuguaaucuagagcucuggaggaugagguuggagaguguuaagaauuagagagcagauuuggauacauaguaaauuaaagguuaucuugggauacauauuaacauccugucucaaacgccuucccacucaaaguaauucagugaaaaaaauugcacuuacaagaaaagaagguaggguguuucuguguuggggaagacaggaaguguugguuacuguguaaugccaaaggauaggccacuggucaugcgcuuugcucugauguuggcgccaugugaccuggcagguaaguguccuuagggccaggguuuggauucuucuuacgugaccugugcuuaucagcuggucccuuuuauaccaacuaagaccuucucugaacuuuuggagcugugacaaaauugcauucugcuugcucuguuuuuauuaaugugacaacgugggcuacauaaaacccuaucucaaaguaagaaacauuuagugaucuaucuaucuauguauauauguaguaagaaaucaucaccacuacugugauuccagaauauuuucaucacccugaagagaaacccuguacccauuagcagccguucaucuaagugcugucucucuagauuucucuguaaauggcaucaaauguggacuuuuguguuuggcuucuuucauguagcaugauguuucugcaauucaucccuguugucauacgaauuagcacuugguuucuccuuagucucaaauaauguuguaucaugguuuuguagucgacaucuugcuggcuuguuaauuagagcauauuugaguuauucccauuuauaaugcuacuguaaaaacgugaacauuuuuguguagacauuuugacuuugcucaaguguauauagcuaggaguagacucuauugagucuguaggaguagacuguauugagucccguaaccaucguuacagaaaagguuuggauuggguuuugccuucucugugguggggucagaagaucaggcuggguauucacuauguagaucaggcugucgcugaacucacauccauccaccugccucuaccuuccaagugccaccacacccauccugaagaaggauuuuauagagcaucgguacagcuuauuccaucagugggauguaaggaguccuaauucuccccaucuuccucuaccucagcacugagccagccuuucauggcagccauuaguggguguggaccaguagcucacugugcuuuugauucucaguaacacacauauuuuguuuuuaacacugcugcugagcuguauagcuccagccugagaauuacacuuuuuuucuuuuauggaggcuuuccuuuucuucauuguauuagcuguucuugguugcuucagauaaguucauguaugcuuccuaaaauguuagucuugggaaaacagguauauguaggcaggcagagugguuuaggguucacauccaauuuuugcucauauuuugcuucaacuccuauuuaucuugauacauugcagggugguggccuuguccaugucaccuguggaugacacuuucauuucugggucucuugauaagaccauucgacucugggaucuccggucuccuaacugccagguaaugguaccucacagugacauuuuugagcauuuucuauggaaagcauuagcagcucucccucucgguuaagagagacgacagugguuucauuuugggaucccagagucuuguuagguggcagcaaacccuuuuccuaguuggcuacugcuugauacgcagauauccuacuccagagcagacugcaguaacguggcguagugcuugaaaaggaagguugccuagagccuuagccucaaggaauuuguuucucuuggaacucuguaauguuguagauacggugauuggaacguaaggugacuuuuuuacauuuuagucagaguuuuguuuguuuacuuuuuaaccuuuuguagguaggcuggguacaguuccuaucccuuucuuaguuuuaacuagaaaaagucagugauuaaggaaugggcuccuucauuuauuaacucgcugucuguccucuucucucauagggccucaugcaucuacagggcaaaccugucuguuccuuugauccagaaggguuaauuuuugcugcgggcgucaacucagaaauggucaaacuuuaugaccuucguucuuuugauaagguaaaucuuugaaucccuugagcuaucuugggguugcagaaaauuuaaggacaacuuggacauuugagaacccuuucugggcugggcaugguggcacacaccuuuauccccacauuccagggcagaugcagguggaucucccugaguuccaggccagccaaugcuccacauugugagagcugucuacaaagacugccuuccuguggugccaaggcaaacggcagcuaacagagcagcagugacucacccucugcuguccacucgggaagaaucaugaugcguaggauagacaauaaggaaaaaauguaaaggcuagaaaaggagcucuaauagaggaaggacugaugugugugaaguguggggacugcuauuuuucuguuuugcagggaccauuugcaacauuuaagaugcaguaugauaggaccugugaguggacaggacuuaaguucagcaaugauggcaaauugauacucaucuccaccaacggcagcuuuauccgacugauugacgcauucaaggguguggugaugcacacauuuggggugagcugacugcuuuugaaugauggcuguuucuuugcucauaaggccugggccaggaaugcuguuugcuggaugguagaaaccaauaguuacacucagugaugagguauggacuuaagaguuucuuggacaugaauuuuacuucauuugaguuggagccuuucgcuucucucuuacgaagugacccaagaugcuuuuuaaauauaauauuaguaaaaauaaacaaguuugguuuuuucacccccaucuccuuccuaaauaugggguuacaauugggaguguuuugugugggagcagcuacacuuggucuuagugacauugcacagagaccuuuggugggaaggaguuuguguguuggguugguuuuuauuaccuauccuagaaugaaaaacacucuuguuuuguuucaggguuaugcuaacagcaaagcugugacacucgaagcuucauuuacuccagacucacaguuuauuaugaucggugagcugccuuuuguuguuguuguuauuuuucugauacccuguuuguuauuaaggaaaguaccuucagauuuuggaguuuccuuuacuugguacacauaagcauacauguaguggcauguguguggggucagagagcgucuucuaggagucacuuuucucauuggagugccauggaucaaacucuccgguccuuaggcaaccuuuaccuuccuuccaagccaucucaaugccucuguucauuuuuugcaguggucucauuauauagccgucugacuuugaacuuucuguguagucaggaaugaccuuggauuucuuuuuuuuuuuuuuuuuuuuuuaaagauuuaucuauuuauuauauguaaguacacuguagcugucuucagacacugcagaagagggcagaucuuguuacagaugguugugagccaccaugugguugcugggauuugaacuccggaccuucagaagagcagucgggugcucuuacccacugagccaucucaccagccccgaccuuggauuucugauucuccagucucccaagugcugggauugcaggcgugggcccuaacacuggcaugaguuccuuauuagcacuggcagugugcugguuuucccuucccgggcuuuagaguuaggcucuagagcacuacucuacugcaguccuugcguucaguaugucagcaggcucaugguauuuagcccccuuucuagauaggaguguuggagucacuugggaacugacauacgaacagugcaacacuccugcacaucuacucaccagcaccuggggcugugauugggagacagaaacaggaaagguggaauuugaggcuggcuugggcuauauagagauuucaaggcuacucuggacuauguaacagaaggaaacaaauaauuaggucaagagcaauugccugugucccuucauuguccucuugguuucugcugaggaauaaaccugaaacuuuuaucagaaugcaguuaucuuuuucuuacuugucucuauuuaccucuuaaaguguuacuauccuaaucauucuuuuuagguucggaagacggcaaaauccaugucuggaacggagagagugguauaaaaguggcuguauuggauggcaaacacacuggucccauuaccuguuugcaauucaaccccaaguuuaugaccuuugccagcgccuguuccaacaugguaugugaacagugagagaugguuuccauauagagauucucuuuauuuggggugguggguaccucagacaguaaguaagcuguguuccacauaguacaaguuccuguuucagaagugguggcuuucuuguuacccugcaucauagauaucugacuaggcuguucuuuuuacuuuaaauccuuuuccaguaauaugggacuuacucagcagugguggagcacaccuuuaaucccagcacuugggaggcagaggcagguggaucucccagccuggucuacagagggaguuccaggauagccagggcuacauggagaaauccugucuccaaagagagaggagaggggcgcggggggaggagagaggggagagaggagaaaggagagggaaaaaagaaaaagcuguaagaugggauccccuaugcucuccuaagagauuuacaaggcauaucuugcucuggccccagauuuuaggcccggccuguuugggcucucuugacauugacauuauucucacuacuuaaacuauucugaccaaccuuuuauaggugaaaccuuucaaggguuuugaauauuuugcuuugguuuggcuuuuggaaauaagguuucucuggcuaagcugacuguguauucacauuaauccaccugcuuuaguccugaaugcugaagugagagguguggaccgccaugccuggugaccuuucuguuuccaaauucuuuccauugaauuccuugaaaauucuucgagugguucauaauuaccacuaaaauuugguugguuuuugugugugugggugugggugugugguuuauuuauuuaucuauuucucauucaagucagggucucucuguagaccuaccuagcugucuugauucuccuggcucugccucccaagcacuaauauuaaaggcaugugucgacacacccagcuuuauuuuguauuuauuuuguguauucuugaacaugugcugugcacacauauagaggucagaggauaacuugugggaauugguucucuccuuccagugucugucguuuuagggaucaaauucagucaggcuaaguaacaggcaucuuaauuuuagcacuugggagguagaggcaggagaaccaggaguuuagucuagccuugguuauaugagacccugugucaagcucuggagguauagaaauguucacugcugugccugauuaccugaauuugaccucuggagcucagaaggagaaaauucaacucucacaaauuguuuucuggccucuacucaugcaccauggugggguguggauggggauguguguacaaauacacaaauguaacucuagaaaacagaacuggagaugggugauaauguuagucucccuagaguuucccuugaagucugucugucucuaaguaggcacauggaugaggcauucauugccuuuauccagaacacagugcccacucuuccccugauauccaggccugagccagggccacaccucaccaaaagaaauguagcaguggcuggaaauuggaaauuagagcacuuacuugcuauguauaaagcccuggcugggcucaaucccuccaguacugggagaacagaaggaaacuaauuuaagcugggcugcguugguacauaccuguuaucgaaacauuuggaaaguagagggauaaagaucaguuuggggucaucuuugaguauauaggaguuugagaucagcauaggacacguaaagccaaaaggccacccagcccucaaaggcaacacaaccuucucaucuggcccuucuuucucuucagaaggaagggguaugauugaggccaucuugagauuagguauggggccagguuacccacacaguacuacuguuuccuuaacacacugugugacuguggugggugcaagggagaggugagugugggaaguaagcagagccagcuuucagagucucugacuuuauagacaagucaggauaagguccaccaaacccuaauuccuucacuauauuggguugggccccuugacugaugcuguagguagcaaaaaagaaccuuccauagugaaagaugccuaaaagcugauuuguguuuuccuuccaggccuucugguugcccaccauugaugacugauccugaugcugcugggcuauuuauacagugagggcggccaacaggaaaagccagaggugacugagaugacagugagauugauugaucauuugacugggcuggagaacaucuuuccacggggccuucccagggaugugcuguccaucgcucuaaugaguuacuuugcugagcaccuucagaaggacuccuggugcugcagacucaguuggcgcucagccuuuccagcucucacugcgccaagcucuucagagugugacuagacuuaugauuagguuacaguggggcucuugaaccccuucaauuuugaauguacucgcugcugaggagccagugaaguccccacuuucugcacauccuucucaccccagaaaugcaugggaagccgcgguucugguuuugagaugcuagggcagcucagcaccccuugcccucacucugcaugucuuguuacugggucucccuguguaauuaauuguggcauuauuccacaaccaucauguuucuuaggugccaaacauuuacaaaaauaagucuucauauaccuuggggucaaagaaagaaacagguacagaaggaccuuguuugucaggaggcuauaugguauucucuuuuuuuuuuuuuuuugguauucuuguauagguggguggggcagaucuugggcuuagauguugacuaacaaaaggcccaagagucugaaagggagggaaggggguagcagguaaauucugagagcugagagauuuagcagcuuggugcaguucccccaucaagaugaucccacagucuccugugggggguccugcugagcuuggcuuguacaaaagcaagcaguaguuuauuuuuguaccugagucacaucacguucuccugugggccaguauuguggagcgagucugaguuguuuacacugaugccuuccuucccugcccaccacaaauuguguacauagucaacagaugaaaccccuccucuucuccagcuccuacccaagagcuggcucuaggccuguguuauauguuauauuuagccuuuuuauauaugacccuugaucuguuuguauuugaacacuguguguguccacuuuaauacauuugugcagacaugcacauuacauacguguauaugccugucucucaucuagauuaucaagggagagggaaccuugcagccaagaaugacucuguggauagugugugccacaaguguuauucuucucuguuaaccuuagggauacaacgggaagcagagcuucuaguguuugcuguuucauggcagcuaagugggggccuugggugacucccuugugcucuuuaagccacacuucggggcccucucuacaguauuagauucuuuuuugccugauuaugcucugucugcaccuguguaugugugacagucacuuuugcauggcuucugugccuggcuuguggcauuuagggacagggugcuggaaccacaguguuuaguuugucagaacuuguuggccaaccauaagucacugucaccugcugugucuacacuguugccccuuuucuugcuuuuuuccugagagacuuuagcuaggcccagacuagaugaguugcaggugaccuucucuucccagcucggcagcuuuagaguagaacaaacggccaucaaacauugaugcaagcacuaucccugcagauccagaaaucaagacucaacagguugugauuugcccaagaguacccagcugcuagcgugcucagaccaucacugcuucuguucagucgcagauagccguccagucaccaaugcuuuugacuuguuccaacugaaaaguuggacugucacugaagucuguuaaguauugcugaacaauccugcuauaaaauucugccuucccagaauggaccgacagaaggagccaggcaaucagcuccauguuugaaagaacuguugaaggcaaaugucuguaaucguagauuaauauggcagcuugccugaacugaacgcaggaaaacugucuugaguguccagggguugaagcaucacacucuuagaagacauaccgccucacggucucugcugggcccugaggccacagaccugaguuauguuccgaauugguaggaaaaggugcagcuggaguuuauauggucacaggguaauaagaaagagggagaaagcagagauggcaguuuggggaugugucccugggauguauucacugcccucugauaugacagcuggcacugcacuguucaaccaccagccacugggguauuuuuuaauaaauuauucccuguuguaacugacaauuagugcuuaugaaggaaaauuggaagaucuuuaagaaccaguuugccacccaagugguaccacuguuuaaaucuugauguuaaauguuccuuuagauaucucugugcauaaacuuugguguuuacauaguuguuauucuacuguacauacaauuuuguccuuuuuguacuuaacauauaaacuuuuuuugccauguuaucagucguaaacaggauuuuaugguuuacagucucuuccauugaguuucuguaacauucccuggcucacuucugacagaauggguuguucccauguccugguuccgguggaaaugcuuggccucugggcaacagaaacacacaccccucccaggcacagucccuuaacuccaaaugccaauuaaauuaccacaggagcaguaaugagugacuagaaaagguaagcuugacucaaccccauucuucagagaccaccucacugccugccuugugucccacacaguuuaccucaaacuuggaucagauuggcaagcucuuguuagaauaaauugcauucucccaggccuuguuugaucagaagugagcaucuggcaguaggaccugcugagccauggcuuggcuaaugcauuggaagucauuggaauucuaggauugcugcuuccuugacugaaucagaauaggugaagaccuugaccuugaccuuuggaagaaaauauucuggcuuggguuuaguugacuauguuggcucuccagcucagacugcucuaagaaugaaagcccucaaagccuggugggaugugcaacaaguuggaucugcggcugaaaguuauaaccauacaaacauggccugaguccaguccccagaucccgugguaaaaggagaaaaccuacuuucugaaaguuguccuuagguuuccacacaugccauggcauuugcaacagagucacaaauuauaaaguggaauacugccuggcagcagcuacugcguuuccaggcuuuccaaugcagaaugcucccacccccaccaguucuaccuacacauuggaucuguagagcuccauuguccccccagauccuccaaaugccuccaacccugcuggugccuuauugucaccaagugccuccaggcucccuaaugccucauuaucuucaaauaccacaaauccucccauuacuugaaggucuacaaaugucuccaggauccccagugaacccaggcuuucagguuugcccccgucccucagcuccacuuguggcuccucagguccuuccaaggccacaaguucucccacaggcuccuauccgaguugagagggugugucagguauagcccggaacaaaagaguaagcuggaaguauuauucaaaaagucccaaguauccuuccuucgagcaacacaaggagccggcagcacgaagcauuugugugauggaauaccaguuccggauaugguuuaagaaccagaggucuagauacuuuugggugcgucccccagaacaucuaaaaacaccugggaaucaaggugggagagcccacgcucacuguaggaggucaugccccauuaaugcuggggccacuggugauccugugaccccaagccuagcagauguuggcucccuucuuccacccagcuccucuggaaucuucccaucccuucuucaaucucgauggggccuggggaacauucuggguguggugcuggcugcccauacagacuacagcaaccacuggccuauuuccaucaaaagccauggacccaguucaaucuguagcaguuaacacaucagacucagcuccagagauaagacccagccagcccuagccaaagcuccaguauucugccaccuucauagagccagcaggacucaagcucccucaaaagaugccacuuugaagauccauguagacuaaaacacuugcaucccaggaccaguucugcauucaaggcuucuaaagauuugacauuccccuagauacuguguuguuuaccaaauccauugucccugacuuugaccagcccuauuucugggaacccuuuggucccucuuguuuauuguauacuuuacuuugguaaguuuuauuaaagacgugcaguuaaaaaaaa

SEQ ID NO: 5284 - RNA, 22065 nt, Mus musculus
uuuuuuuuaacugcacgucuuuaauaaaacuuaccaaaguaaaguauacaauaaacaagagggaccaaaggguucccagaaauagggcuggucaaagucagggacaauggauuugguaaacaacacaguaucuaggggaaugucaaaucuuuagaagccuugaaugcagaacugguccugggaugcaaguguuuuagucuacauggaucuucaaaguggcaucuuuugagggagcuugaguccugcuggcucuaugaagguggcagaauacuggagcuuuggcuagggcuggcugggucuuaucucuggagcugagucugauguguuaacugcuacagauugaacuggguccauggcuuuugauggaaauaggccagugguugcuguagucuguaugggcagccagcaccacacccagaauguuccccaggccccaucgagauugaagaagggaugggaagauuccagaggagcuggguggaagaagggagccaacaucugcuaggcuuggggucacaggaucaccaguggccccagcauuaauggggcaugaccuccuacagugagcgugggcucucccaccuugauucccagguguuuuuagauguucugggggacgcacccaaaaguaucuagaccucugguucuuaaaccauauccggaacugguauuccaucacacaaaugcuucgugcugccggcuccuuguguugcucgaaggaaggauacuugggacuuuuugaauaauacuuccagcuuacucuuuuguuccgggcuauaccugacacacccucucaacucggauaggagccugugggagaacuuguggccuuggaaggaccugaggagccacaaguggagcugagggacgggggcaaaccugaaagccuggguucacuggggauccuggagacauuuguagaccuucaaguaaugggaggauuugugguauuugaagauaaugaggcauuagggagccuggaggcacuuggugacaauaaggcaccagcaggguuggaggcauuuggaggaucuggggggacaauggagcucuacagauccaauguguagguagaacuggugggggugggagcauucugcauuggaaagccuggaaacgcaguagcugcugccaggcaguauuccacuuuauaauuugugacucuguugcaaaugccauggcauguguggaaaccuaaggacaacuuucagaaaguagguuuucuccuuuuaccacgggaucuggggacuggacucaggccauguuuguaugguuauaacuuucagccgcagauccaacuuguugcacaucccaccaggcuuugagggcuuucauucuuagagcagucugagcuggagagccaacauagucaacuaaacccaagccagaauauuuucuuccaaaggucaaggucaaggucuucaccuauucugauucagucaaggaagcagcaauccuagaauuccaaugacuuccaaugcauuagccaagccauggcucagcagguccuacugccagaugcucacuucugaucaaacaaggccugggagaaugcaauuuauucuaacaagagcuugccaaucugauccaaguuugagguaaacugugugggacacaaggcaggcagugagguggucucugaagaaugggguugagucaagcuuaccuuuucuagucacucauuacugcuccugugguaauuuaauuggcauuuggaguuaagggacugugccugggagggguguguguuucuguugcccagaggccaagcauuuccaccggaaccaggacaugggaacaacccauucugucagaagugagccagggaauguuacagaaacucaauggaagagacuguaaaccauaaaauccuguuuacgacugauaacauggcaaaaaaaguuuauauguuaaguacaaaaaggacaaaauuguauguacaguagaauaacaacuauguaaacaccaaaguuuaugcacagagauaucuaaaggaacauuuaacaucaagauuuaaacagugguaccacuuggguggcaaacugguucuuaaagaucuuccaauuuuccuucauaagcacuaauugucaguuacaacagggaauaauuuauuaaaaaauaccccaguggcuggugguugaacagugcagugccagcugucauaucagagggcagugaauacaucccagggacacauccccaaacugccaucucugcuuucucccucuuucuuauuacccugugaccauauaaacuccagcugcaccuuuuccuaccaauucggaacauaacucaggucuguggccucagggcccagcagagaccgugaggcgguaugucuucuaagagugugaugcuucaaccccuggacacucaagacaguuuuccugcguucaguucaggcaagcugccauauuaaucuacgauuacagacauuugccuucaacaguucuuucaaacauggagcugauugccuggcuccuucugucgguccauucugggaaggcagaauuuuauagcaggauuguucagcaauacuuaacagacuucagugacaguccaacuuuucaguuggaacaagucaaaagcauuggugacuggacggcuaucugcgacugaacagaagcagugauggucugagcacgcuagcagcuggguacucuugggcaaaucacaaccuguugagucuugauuucuggaucugcagggauagugcuugcaucaauguuugauggccguuuguucuacucuaaagcugccgagcugggaagagaaggucaccugcaacucaucuagucugggccuagcuaaagucucucaggaaaaaagcaagaaaaggggcaacaguguagacacagcaggugacagugacuuaugguuggccaacaaguucugacaaacuaaacacugugguuccagcacccugucccuaaaugccacaagccaggcacagaagccaugcaaaagugacugucacacauacacaggugcagacagagcauaaucaggcaaaaaagaaucuaauacuguagagagggccccgaaguguggcuuaaagagcacaagggagucacccaaggcccccacuuagcugccaugaaacagcaaacacuagaagcucugcuucccguuguaucccuaagguuaacagagaagaauaacacuuguggcacacacuauccacagagucauucuuggcugcaagguucccucucccuugauaaucuagaugagagacaggcauauacacguauguaaugugcaugucugcacaaauguauuaaaguggacacacacaguguucaaauacaaacagaucaagggucauauauaaaaaggcuaaauauaacauauaacacaggccuagagccagcucuuggguaggagcuggagaagaggagggguuucaucuguugacuauguacacaauuuguggugggcagggaaggaaggcaucaguguaaacaacucagacucgcuccacaauacuggcccacaggagaacgugaugugacucagguacaaaaauaaacuacugcuugcuuuuguacaagccaagcucagcaggaccccccacaggagacugugggaucaucuugaugggggaacugcaccaagcugcuaaaucucucagcucucagaauuuaccugcuacccccuucccucccuuucagacucuugggccuuuuguuagucaacaucuaagcccaagaucugccccacccaccuauacaagaauaccaaaaaaaaaaaaaaaagagaauaccauauagccuccugacaaacaagguccuucuguaccuguuucuuucuuugaccccaagguauaugaagacuuauuuuuguaaauguuuggcaccuaagaaacaugaugguuguggaauaaugccacaauuaauuacacagggagacccaguaacaagacaugcagagugagggcaaggggugcugagcugcccuagcaucucaaaaccagaaccgcggcuucccaugcauuucuggggugagaaggaugugcagaaaguggggacuucacuggcuccucagcagcgaguacauucaaaauugaagggguucaagagccccacuguaaccuaaucauaagucuagucacacucugaagagcuuggcgcagugagagcuggaaaggcugagcgccaacugagucugcagcaccaggaguccuucugaaggugcucagcaaaguaacucauuagagcgauggacagcacaucccugggaaggccccguggaaagauguucuccagcccagucaaaugaucaaucaaucucacugucaucucagucaccucuggcuuuuccuguuggccgcccucacuguauaaauagcccagcagcaucaggaucagucaucaauggugggcaaccagaaggccuggaaggaaaacacaaaucagcuuuuaggcaucuuucacuauggaagguucuuuuuugcuaccuacagcaucagucaaggggcccaacccaauauagugaaggaauuaggguuugguggaccuuauccugacuugucuauaaagucagagacucugaaagcuggcucugcuuacuucccacacucaccucucccuugcacccaccacagucacacaguguguuaaggaaacaguaguacuguguggguaaccuggccccauaccuaaucucaagauggccucaaucauaccccuuccuucugaagagaaagaagggccagaugagaagguuguguugccuuugagggcuggguggccuuuuggcuuuacguguccuaugcugaucucaaacuccuauauacucaaagaugaccccaaacugaucuuuaucccucuacuuuccaaauguuucgauaacagguauguaccaacgcagcccagcuuaaauuaguuuccuucuguucucccaguacuggagggauugagcccagccagggcuuuauacauagcaaguaagugcucuaauuuccaauuuccagccacugcuacauuucuuuuggugagguguggcccuggcucaggccuggauaucaggggaagagugggcacuguguucuggauaaaggcaaugaaugccucauccaugugccuacuuagagacagacagacuucaagggaaacucuagggagacuaacauuaucacccaucuccaguucuguuuucuagaguuacauuuguguauuuguacacacauccccauccacaccccaccauggugcaugaguagaggccagaaaacaauuugugagaguugaauuuucuccuucugagcuccagaggucaaauucagguaaucaggcacagcagugaacauuucuauaccuccagagcuugacacagggucucauauaaccaaggcuagacuaaacuccugguucuccugccucuaccucccaagugcuaaaauuaagaugccuguuacuuagccugacugaauuugaucccuaaaacgacagacacuggaaggagagaaccaauucccacaaguuauccucugaccucuauaugugugcacagcacauguucaagaauacacaaaauaaauacaaaauaaagcugggugugucgacacaugccuuuaauauuagugcuugggaggcagagccaggagaaucaagacagcuagguaggucuacagagagacccugacuugaaugagaaauagauaaauaaauaaaccacacacccacacccacacacacaaaaaccaaccaaauuuuagugguaauuaugaaccacucgaagaauuuucaaggaauucaauggaaagaauuuggaaacagaaaggucaccaggcauggcgguccacaccucucacuucagcauucaggacuaaagcagguggauuaaugugaauacacagucagcuuagccagagaaaccuuauuuccaaaagccaaaccaaagcaaaauauucaaaacccuugaaagguuucaccuauaaaagguuggucagaauaguuuaaguagugagaauaaugucaaugucaagagagcccaaacaggccgggccuaaaaucuggggccagagcaagauaugccuuguaaaucucuuaggagagcauaggggaucccaucuuacagcuuuuucuuuuuucccucuccuuucuccucucuccccucucuccuccccccgcgccccucuccucucucuuuggagacaggauuucuccauguagcccuggcuauccuggaacucccucuguagaccaggcugggagauccaccugccucugccucccaagugcugggauuaaaggugugcuccaccacugcugaguaagucccauauuacuggaaaaggauuuaaaguaaaaagaacagccuagucagauaucuaugaugcaggguaacaagaaagccaccacuucugaaacaggaacuuguacuauguggaacacagcuuacuuacugucugagguacccaccaccccaaauaaagagaaucucuauauggaaaccaucucucacuguucacauaccauguuggaacaggcgcuggcaaaggucauaaacuugggguugaauugcaaacagguaaugggaccaguguguuugccauccaauacagccacuuuuauaccacucucuccguuccagacauggauuuugccgucuuccgaaccuaaaaagaaugauuaggauaguaacacuuuaagagguaaauagagacaaguaagaaaaagauaacugcauucugauaaaaguuucagguuuauuccucagcagaaaccaagaggacaaugaagggacacaggcaauugcucuugaccuaauuauuuguuuccuucuguuacauaguccagaguagccuugaaaucucuauauagcccaagccagccucaaauuccaccuuuccuguuucugucucccaaucacagccccaggugcuggugaguagaugugcaggaguguugcacuguucguaugucaguucccaagugacuccaacacuccuaucuagaaagggggcuaaauaccaugagccugcugacauacugaacgcaaggacugcaguagaguagugcucuagagccuaacucuaaagcccgggaagggaaaaccagcacacugccagugcuaauaaggaacucaugccaguguuagggcccacgccugcaaucccagcacuugggagacuggagaaucagaaauccaaggucggggcuggugagauggcucaguggguaagagcacccgacugcucuucugaagguccggaguucaaaucccagcaaccacaugguggcucacaaccaucuguaacaagaucugcccucuucugcagugucugaagacagcuacaguguacuuacauauaauaaauagauaaaucuuuaaaaaaaaaaaaaaaaaaaaaagaaauccaaggucauuccugacuacacagaaaguucaaagucagacggcuauauaaugagaccacugcaaaaaaugaacagaggcauugagauggcuuggaaggaagguaaagguugccuaaggaccggagaguuugauccauggcacuccaaugagaaaagugacuccuagaagacgcucucugaccccacacacaugccacuacauguaugcuuauguguaccaaguaaaggaaacuccaaaaucugaagguacuuuccuuaauaacaaacaggguaucagaaaaauaacaacaacaacaaaaggcagcucaccgaucauaauaaacugugagucuggaguaaaugaagcuucgagugucacagcuuugcuguuagcauaacccugaaacaaaacaagaguguuuuucauucuaggauagguaauaaaaaccaacccaacacacaaacuccuucccaccaaaggucucugugcaaugucacuaagaccaaguguagcugcucccacacaaaacacucccaauuguaaccccauauuuaggaaggagaugggggugaaaaaaccaaacuuguuuauuuuuacuaauauuauauuuaaaaagcaucuugggucacuucguaagagagaagcgaaaggcuccaacucaaaugaaguaaaauucauguccaagaaacucuuaaguccauaccucaucacugaguguaacuauugguuucuaccauccagcaaacagcauuccuggcccaggccuuaugagcaaagaaacagccaucauucaaaagcagucagcucaccccaaaugugugcaucaccacacccuugaaugcgucaaucagucggauaaagcugccguugguggagaugaguaucaauuugccaucauugcugaacuuaaguccuguccacucacagguccuaucauacugcaucuuaaauguugcaaauggucccugcaaaacagaaaaauagcaguccccacacuucacacacaucaguccuuccucuauuagagcuccuuuucuagccuuuacauuuuuuccuuauugucuauccuacgcaucaugauucuucccgaguggacagcagagggugagucacugcugcucuguuagcugccguuugccuuggcaccacaggaaggcagucuuuguagacagcucucacaauguggagcauuggcuggccuggaacucagggagauccaccugcaucugcccuggaauguggggauaaaggugugugccaccaugcccagcccagaaaggguucucaaauguccaaguuguccuuaaauuuucugcaaccccaagauagcucaagggauucaaagauuuaccuuaucaaaagaacgaaggucauaaaguuugaccauuucugaguugacgcccgcagcaaaaauuaacccuucuggaucaaaggaacagacagguuugcccuguagaugcaugaggcccuaugagagaagaggacagacagcgaguuaauaaaugaaggagcccauuccuuaaucacugacuuuuucuaguuaaaacuaagaaagggauaggaacuguacccagccuaccuacaaaagguuaaaaaguaaacaaacaaaacucugacuaaaauguaaaaaagucaccuuacguuccaaucaccguaucuacaacauuacagaguuccaagagaaacaaauuccuugaggcuaaggcucuaggcaaccuuccuuuucaagcacuacgccacguuacugcagucugcucuggaguaggauaucugcguaucaagcaguagccaacuaggaaaaggguuugcugccaccuaacaagacucugggaucccaaaaugaaaccacugucgucucucuuaaccgagagggagagcugcuaaugcuuuccauagaaaaugcucaaaaaugucacugugagguaccauuaccuggcaguuaggagaccggagaucccagagucgaauggucuuaucaagagacccagaaaugaaagugucauccacaggugacauggacaaggccaccacccugcaauguaucaagauaaauaggaguugaagcaaaauaugagcaaaaauuggaugugaacccuaaaccacucugccugccuacauauaccuguuuucccaagacuaacauuuuaggaagcauacaugaacuuaucugaagcaaccaagaacagcuaauacaaugaagaaaaggaaagccuccauaaaagaaaaaaaguguaauucucaggcuggagcuauacagcucagcagcaguguuaaaaacaaaauauguguguuacugagaaucaaaagcacagugagcuacugguccacacccacuaauggcugccaugaaaggcuggcucagugcugagguagaggaagauggggagaauuaggacuccuuacaucccacugauggaauaagcuguaccgaugcucuauaaaauccuucuucaggaugggugugguggcacuuggaagguagaggcagguggauggaugugaguucagcgacagccugaucuacauagugaauacccagccugaucuucugaccccaccacagagaaggcaaaacccaauccaaaccuuuucuguaacgaugguuacgggacucaauacagucuacuccuacagacucaauagagucuacuccuagcuauauacacuugagcaaagucaaaaugucuacacaaaaauguucacguuuuuacaguagcauuauaaaugggaauaacucaaauaugcucuaauuaacaagccagcaagaugucgacuacaaaaccaugauacaacauuauuugagacuaaggagaaaccaagugcuaauucguaugacaacagggaugaauugcagaaacaucaugcuacaugaaagaagccaaacacaaaaguccacauuugaugccauuuacagagaaaucuagagagacagcacuuagaugaacggcugcuaauggguacaggguuucucuucagggugaugaaaauauucuggaaucacaguaguggugaugauuucuuacuacauauauacauagauagauagaucacuaaauguuucuuacuuugagauaggguuuuauguagcccacguugucacauuaauaaaaacagagcaagcagaaugcaauuuugucacagcuccaaaaguucagagaaggucuuaguugguauaaaagggaccagcugauaagcacaggucacguaagaagaauccaaacccuggcccuaaggacacuuaccugccaggucacauggcgccaacaucagagcaaagcgcaugaccaguggccuauccuuuggcauuacacaguaaccaacacuuccugucuuccccaacacagaaacacccuaccuucuuuucuuguaagugcaauuuuuuucacugaauuacuuugagugggaaggcguuugagacaggauguuaauauguaucccaagauaaccuuuaauuuacuauguauccaaaucugcucucuaauucuuaacacucuccaaccucauccuccagagcucuagauuacaagaauguaccaccaugcucagcuagagugcacuuguugucguuugcuugcuuuuuugggacaggaucucucugcauagcccugguugcccuggagcuuguugugcacaccaggcuggcuuggaacucacagagacucugccuccugagugcugggauuaaaggugugugucacuguacccuacagaagaaccacuucuaacaggcagcuccgagccaucucuccugucauccuuuaggcaugccauggcucucuuuaagucagaacaguuguagcugcuguugaggaacccucauaagacccugauccuucaaagacacauaagaguugacaauuacuugggagagcagggagaugccauuucaguugcccgugcuccaauaagcaaccacaauuacacuuacuggcucacaacgugaagaucugggugaaaucauuucuuuggccuauugcugaagcccaaaggugaacaucagauagauaauaaaagugacacaguaccuguuagggcacugcaccacaccacacagcucugcaucaucuguauuauauauguguuuagucccagcacuuaggagacagagacaggccaaucucuguaagucagccuggucuacaaagugaguucuaggacagacaaggauccugucucaaaaagguggagggagggggagcuagagagauggcucagugguuaaugaccucuucugguaugcacauauacauguagacuaaacacacacacacaaauaaauaaaaacauacauuaacaacaaaaacccuuuauauaugggacauucuucaugaacagcccaacacaaaugcaguggaaggccucauaaaugcaaaugguucuuuuguuaagagcuaucugggauuugguguugcuaaauaccaagucuaauuuuuauagcauaaguuuucaucuaauaacuuuaguccacauguuuaacauaagacacagacacacagauucuuguauggcaagcauggucuugcauugaaccacacuuaacuccucuuaauuauauugacuuucuuaguguggggaauugaauccagagccaaccacaugcuaagcaggugcuuagccaccgagcuauacucccagcuccuuacuuaagccccauccccuacccuaccuugcaagacaggguuucucuguguugaccaggcuuuccucaaacucacagauccaaugucucucucacuuccgagugcugggauuaaaggugugcacuaccacugccuggcaccuuauuuaaauuuuaacagauucuauaguuaucuuugaagccccaucuccugcuuccauaaccucaguuaaccaagcacugacugagauccguuaacaagaugaagaggagugcugagugcauuccuuagcagugaggagggcuggauuuacuuacuaacaaaaccucucccucucuuccauucucuacguuacccaauggaugaaggaagcaugacuguugcacucugucuuaccucuugcuguguccaggaaaguaucugauguauuuauugucaugcaaggacaaguaacgaauaguaucuguaagaaaacaaacagcggaugacauuguaguauuuaaaugaaauuuauguugcauuuuuacuuuugaaaagacaagaccuaacuaacaauguacuauauucuaucacacaagcaaauuacagaugaacaugaacaaccucucucagcagcuugaaugcauaaacagauucauauaacuccaaagccuaauuuucaguugauggcauuuauaccgacauuacuaucaccauuuugggaccuagguguacaauucaacggugaugugcucaccuagccugugagcagcucagaguucaaucugcagcauugaggaggcgaauuugggaguuaaaaacuacauuaaaaaaaaaaucacuuuuuuguuaccaaucuuuguacuauuugcaaguaauaauucaacuuguccugaauaaguauuuccuagcaagggggaaaaaaucacaagcuauggacacuaauuuuagcugucugcaaagugauaacucuuacacugaacaucagaagggcaaauuagagggcuauacaguuaguuuguguaaaguugggccuacuacauagacagauucugucaaagaaagaaaaaucaagaaaggaaaaagcagucuaucuagaaaaaguaagcaagagggucuagagaggugguucggcaauuuagagcagcaggcuccaucccaggagccacaugguuucauaaccaucuguaauuucaguuccaggggaucugacauccucuucuaaccuccccaagcaccagacacauacaggauacauagauauacaugcaagcaaaccauucauacacauagaguaaaaaauuaaaaaaaaaaaaaagaaaaagaaagaaagaaaagacaagacuacacugacagcagaaugaagagaggcuggguaggcagcucagcgcauggugcauuccaucagugggugaggcccacggcuuaaccccuaacaccacaaaagguaagaauaaaauuagaaaguacuaugcuccuaagaaagauagagaaaagcuguaaguagugacucuauaaccucaccacauuggugaccagcaugggauacauuuacugaagcccuaucucaaaaaccaaacucaaacaucaaugaaaacaaacaaaacaaaaaauaggaagagaaacaaauaauacaaaacauggcaccacagugcaggagggaaggcaaaacgcccaauaaagagguccaaagaaccaagcggcuucaagagugggcuuuguuuugagacagggucucacucuauagcacaugcuagauugaaacccauuauacagcccagguuagucucaaaaaagcagcaaucccccagccucagccucucaaaugcugggauuacuggugugagcaacacacuuagcuugcagggaugcuuucuaaugagagggcauuugcaauaagagagaaaaaaagaacccuucuauauauucuguaacaguuucaaacgguuuaucugaacaacuccaagccucucaaaugacaaccacaaugcauuucugguuauucuagugccaggaacuacucaccugaccuaaagagagauccccucccauuaccuggaaucccagagaugagcagggcuucaccaucuucuccaccccauuugguagcuggugcacuguuccuggcaaggcaguggccuguacaguuaucuccuguaccgggugguaucauagacccucaaacuguacaaacuacuaccucagccuggaaucaggcaaaagagaacggagcgcuggagcagcucugcaggacgcacuugaggaaggaaaggcaacauccccacagcagaggccaggcagcaaagcugcacccgccacacauuugccucaucuuuaccauauuuggagaauuguuuaaucacuuagaaaaacaacccaacaaaagaaauacaccagucauuuauauauauuuuuauauacccucagaauucuaguauuuauccuuauccaaaagcaucgguggcauugccuacuuagaaaacuacaucugacacauacaugaaaaauagagaugauuagacaugcaauaaaaucaaguucaaguacagaagucuuauuaaagaaagacuucugccugcccauuugcuuugagaaagguuaaaauagccaccuaggcuauccuugcugaguggcugggcauggcgucacucgucuuuaaucccagcaccaaggaggguuccuguaaguuuaauuuuaagaccaaccugaucuauauacagagugcaaggccaucuggggcuacaaagugagagccugcaucaaaacagggagggaggcaaaauaaaucacugugguuaugagcacacacugcucuugcaaaggaccugagcuccccuuccaggauccacgucagacggcucauacgagccuguaacuccaacuccagaagcugacagcuuccagacucugugggcacccauguucacaugugcacauaccaccuccacacacauacacaaucaaaaaaaaaaaaaaaaaaaaaaguaccgccaaagggauggcucagugguuaacagugcuugcuguuguuccagagguccugaguuugguuaacacccacagcacguggcucacuugccugcaacaccagcuccagaggaccugaugcccuauucuggcccaagggcauaggcacacacccacucagauguacacauaccuaaagaaaaaucuacugugccugcgauagcggcacagaccuacacacucaguacccaggaguaugaagcagggcaaacugagucacaguaauacuaucucaauaaaacaaaaugaaaaaaucuuacugcaaaaagugcauuaguaaacuaguauuaacaaggcuaaaaugagaaaaaauaacaagcacacgacaguucaagcacugagacaguucuguugacuuagggacuuauucgaggggaaaucagucaaaagcagauacuaguuauuaaaaaggauguuucaauucuuaaaaaauaccuuuacucuaaagcaaaacaaaagguauuccuggaauuuacaaccacagucacugcaccgugugacacaaaccacagaagagcuaaccucuucuaacuauuuggaugucuuuuuguuccucuguuguuuuuaagacggggucaagcuacaaaugcucaauggcccagguagggcucaaaccaaggcccugcugcacacccgccuccugagcgcugggggcacuacuauucuuaaucucccgcauuuggucuccuuuccagucugcauuuaguacaucugcaaauuuuguuuuauucucccucaguuagaaauguaaagguuuaccccaacccccugccuuuuagaagaucucaccgugugugugugugugugugugugugugugugugugugugugugugugugugugcgugugcgugugcgcgccuuggcuagcuuuggcuagccugguacucccacuccuccagccucagacucccaagggcuaagaauauagagguaaaguguuacaccugguuuaauccacauacagauuguaaacggcaagccuggugauuuacuaacugcugugugucacguguuucuuuguuuugcuuuuuaaguguucuuucaaguuucaaggagugcaaaucauaaacacaacgggguacuuccuuuccuacuccacacugcagacauuuuuuauuuucuguucccaauccuuccaaagugcuaauugcuuacuuccagcauuuuuacuuucauugauauucucagcacugcuaacauuacagagaaacaucuaaaccaacuauaaccaaaguacaaguucucaugaagaguuuguuaaaguuuuucaaagaaaccaacacugacaucuccuaggaaggcuugcuuaccgucuauuuuguuagagcuguaaacgacuguguuggcugcauggguguaucugaugagguccacaccguacuucuuacuguacaggguucucuuuggucugaugaacaaacagaggggaaaacaggaaccauuagaauccacucucacaacauucgagcgcuccaucuaaacagcagcuccugagcgguaugaacagggcagaguccgagaagacucaaccugagucuccugcaaguguggugugagcucuuaaccacucaaucaccucuccagcgcccaucucuugaaaagagaaaucaacucuaacagcuacugaagaauagucuuucauuugugaaccccaaagcccagguuuggaaauaaaauauagaauauuaauucaguccuuuacuacaauauucaaagggggagaggaucucgagggagggucuuaccugccugcuaagucauuaugugguugaggauggcuuugaacucaugacccuccugcuugggcuucucuagugcuagaauuaugagagugagcuaccauaccuggcuucaaauauaaacuuugggaagacuaucuacuugagaaaaaaguacacaaacuaucacaaaccaagaaucacaacagagggauaggagaguaccucagagccaguaaccuuuccuaagccauucacuuagcaagcacuuucuuaaggcaaugauuuaucacgauugaaaccagaugcaacccugcuuauguuucuaacauaacuugcucuagaagaugucuaauuuucuuacacagaguagaaaguagcagcaagccuaccucuccaacaaaacuacuggaugguuccuuuugcuuuuacuuucauguaaauguguguguuuccaacccaaaguucaaaacaaaacuucuucgugcaagucccuuaaaugcaaaucuugaucagauaaaugggcucucaggaaaaucuacaaccaaacuuccugcugcaggcuauuuaaaguaggcaauuuuuuuuuaacucaaauaucucuagaaaacaauuuaaaguaauauuuuuuuauuuuuguuuuacaagauaagcuuucucuauguagaucaggcugucuucagguuuacagcuaucugccuguaucugcucccugagugcugggaggcggaggcaggcagccaugcccagcuuuagaaaacaaaauuggaacgacagagugcuccauuugaaccaggccagaaaauaagaaaaucuuuuaaaguguuuuauacauuuauauuuuagaagaauuuuaagcuagacaugguggcucacaucuguaauuccagucagaacucuaaaggcuauggcaggaggaccacuacaaauucaaggcuagucccaacuacagaaugagacccugugagacccugucacaaagugucccucccaggaauauuguaguaaaagauugacuaguguacuacuagucaccaaggguuugaauuuaugcaaaagaauguuuaucuucucaaugucauauuauuuuggaaccauauuauuuuggucgagcaaucagaugauccaggcugccuacaagucaauuucuguacuuucaauuguuaaggucagagagggugaggccuucugcuucaugaaaccuauucugaacaagaguucuuuauuguacuauacuuucuauaugccugccguuugugaaaucaaauaccaucagguccagucuacuuucugaagcucugcucugcagucaguacuuaguaaguacuuacugaguacuagguccagucuacugucugaagcucugagguuaguacuagguaaguacugacugagugaggcugagcaugcugacuuugcaucuaucagugguaaaagcgaauccuaguauuucagcccauuuacaguagaagacagggcugggauaugacuuagucacagaaggcuugcuagcaugcauggagcccuggacucuaucuucaacccuucaaguaaacaguacacuaaagcaugugguauuaaaaaaaaccuggguuccauuaagauauggucuguaugucuuacauccaaaaaaaaaauccaagcaaaacaaaaaagcauuaacagaugugucuuaaugaaaacuaauucaguuuuacuuugaaaguaagagucugacaucaacaauggauauauuuuuuuaugugaacuuuccaaguauuuuggcaagcuucuuuaaaacuaugauucuggaggcagauaugaauaaagaaaauaauaguaaagccagcugcugguggugggauacauguguauaauccagcacuugggaucaggaguucaaggccaaccuuggacacauaagaguuagccuggacuacaugagacuacugucuuaaggcaaacuaaacauaugugcgcaugugcacguguguguguguguguguguguguguguguucauagacagaaaaaauuugaaauauuuuaccaaucaaaagcaauacccccuauauauuccuucaagucgaaggaagggaugagccacauucuaacauuuaauggacaaacaaaaccaaagcccuucacaaccucuuccugggcaggugagcugguuagauggaggcuaagggcacuugccgccaagcucaauaaucacaguucacccccugggcucccaggaagggaggaaagcagccaauccugcacgcugucuucuaccuauacaugcacagcaagcucacacacagcuaaaacguacacagagaacgugugcaugaaaaacuacuuucaauaaaaaaaaaaaaauccuuuuaagccaagacugaggccagaggauugcuguuggaagccaaccagcacuauagcuacagacaaaguuccacugugggguguaguaucuuaaaaacaacaaacaaaaaucagcuguguuuuagcuauuuucaaauacccaaauucuacuacugguauuaucuaauaaagauguuacuuccaaagaaacaguuauuuucuucuacuguuggaauuauuggauuauucuucuauacauauauauuuuuacauuuacugauuuuauguauaugagcauuuugucugcuugcuuguauauaugggcacccuaugcaggucugaugcacauggaauccagaagagaacaucagauccccugcaacuggaguuaaauguaauugugagccuccacgugggugcugcugauuaaccuagguucucugcaaaauuaacaugcgcucuuaaccacauguuagccaucucucuagcuccuggacuuuuuuccccccacaaacuucucucuuuaugaagacuucuuuauguuauuuauaggaguacccuuguagcugacuucagacacaccagaagagggcauuggaucccauuauagaugguugugagccaccaugugguugcugggaauugaacucaggaccuguggaagaggugcucuuaacagcugagccaucucucaagaaaucagaauuaggggucaaauccccuggaacuaguuacagaugguuacaagguguaggaguccacuuguuccucucuaagagcaagugccuguagccaucuccagcccuuacauuuccuuuuugggacagcuguucaagcugccuuggauucgcacccccagcucccaagcgcugaaauuauaggcacugcuggacacguucuuuuuucaagaaaguucuuuggagcauuguaacuuucuguaaguuuguaaucauguaaaaagguuacaugccugaauaaacauuuuuuucagucuuaguguuuuauuccuuugaauaggauaugcauuuccauuacagauuugggggggagauucuaagcuauguauugcaccaaacaugucagacaaaccaauuucaaauuacuuguaguuccaaacagaaucaaauagucagaccaguguaugauaauaaucaauacacaaauaugaacaucaauucaaauaacuauuuguccaguuaguaauuuucucuuccccaggaucaccacuguaggaaacucucccacauacagcaagcucaaguccaacgacaguuacguaauacuuuguuggagcuccagcgaggaaacccaucaaggacaauaucauauacagcucauucuacaauagcuuuacuuuagauaaacucagagacaaguuccaaaagaaaacuauuauuugaaaaaaauaauaaacaaagagaacagcugcaaaaaggagagaaaaagccaaggauucaaaaacagguaacuuuaacauaaugucgaaaacaguagcuauuaaacuaaacaccuccugcuuaggaaggaagcugaaguugacaaagggaaucaaauuuagccuaaacuaguuucugcuacaaaagaggucacugcuuacuuaucgaggauuugaacuuccagagaugagacaggcaaugucuuccucacacccaggcuaugaaaacggcaaagauacacaaguucuccaacuaacauaauuuccauaaccaguuccagaauuccaaaacuuugauaacuauaagcaaaccacaaucuggcgguuauuguuuuuuguuuuuuaacuguuuugagucagggucucucugcuaugaaguccagaacucagggucugacugccucuaucgcccaaaugcugagauuacuggcuaagcggccaaacuuggguuuuuuuuguaaugcaaaaggaaacacuaaauuguuccggaaugcuuucuuuguuuuaaagagagcucacauucugaccagaauggggcggccaaguucucaggagucuggcaaagaaaaguuuccaagagucuguuuaguaaguuaacuguaagccuggguauugguacugggaaaggacagcaagcucacaugggcacaaucgauaaauccugacagcuuaaaaacugcaucccgcggggcuugauugcagaaaagccgcgcgggaagcugagggguagggggcgggcaccgugccagggcugaauccaggucacugcugugaaggcagagagcuggacgccacugauggacagaacacagcuccugccguucugcaucgagcucagaguccacccgcacauucugacagucgccaggggaguggaaagggcuauccguccggcugcagggugcagggacauggcguuuaaaggucaaggucaaggugggguuuggcaagcgggaaaagcgcgcucggaagagagcaaagacacaugaacuaagaaccaucaucaucuuaaagaggaucuccugcagcacugcgggauggagguggcccuggcaagagcgccugcaccacaugccugggguugggggugggggcucagucggggaccagcgacagagggaaggagaggggcacuuggaacucggccacuaucacacucacuugcccuccuggcagucauagagcacgauggagucaucaucgcugcuagagaugaccgucucgccauugggacuaaagucaaagcaguugaucuugucugaguucucgcggaacaccuuggcgacgcggaagcuccggagcacgcugucggucagcuucauggcggcggcggcugcugcugcugaaggcagcggcggcgcagggccggggcggggccgagaggcgagcgaucgggcgggcugcucagggccaaccccggcggugcgggcgccgcgcuggagacgaaccgaaggacggcugacaguggggcugccgcguccucuuccucaggcgacgcucucucgcccggacgacgggaccucgcugaccguucuucuccggagucaauucagggccaaccggcgcuccgccggcucauuguguccgccaucuugaagggagaagcaaaaucag

SEQ ID NO: 5285 - RNA, 1220 nt, Mus musculus
acccagagagagaccuuucucuuuaggaaagaugggcucagcugauuucaugauuuccuaacaugcuguuagggagacaucccccccagagggacaagccagagucacauuaacaagagucuccugcuguccucaggcaaggcugggucccauugugugcagacaugcuugcuucugagggucucugaauggaagguggggagaacuggcuagguucugcccagugauggcuccauugaaagaagacaucuuuugggugcacccauaguuccaccccaugcccuagagaaaggcuagagagccugccauuccuuacauuagccaugaugucucacuggcuggcuuucuccccucuggagucccucaaagggacacacaccugcaggaugcuggaaacuggagcgggcccccagugggggagggguguacuugaguaaguauggaaaaagcaucagaguuuggaugagggaggccauauggggagggguugacuauggagacaaagaacagcaaaggcagccugugagagaugcuggcaggaucagggccuccacccacccaggcuggagggaagucccaaaaccuugcuucugaguggauacccagaacccaugagccuuccucaaagggacugugagaaggcccuuggaacagauguuuguuuguuuugcuggaaaccugguaccucauucucuuuagucccuccugcaucucagagaagugccuagcuuaccaaggugucccugagggaaaggaagagcagacaaaggcuucccucacaggucugcaccccugggauaagcagaccccagaaggugguuuguagguggguuuaccuuagcucuuugcaggcagagcacacuuccaggccuuugcaccguugugacaagaauucuugaggagaucucaacaaacacaucugccucgccccagcuaggaagccuaagacagaccaaaguauggauaccaccaaaguucaacuuggugaagcacgaguuuuauuggggucacuuacaggggcagaaaugacucagagaacgcuguaucaccaaagcccacuccagcgagggugacaguucacaaaagcugggaacuuggagcacacugcacacagccuacgggcaacucaacaggucggagagaguccuuuccaagugacucaguggcuccagaccucuuccagguagcucggccaguuucugcugcuuccaggccgcugu

SEQ ID NO: 5286 - RNA, 2179 nt, Mus musculus
cuuucuaggcuucaacucuuuccggccuuggaaccuuuuuucuccgccagcagugagggaagcuuuuccguuggacuuuccggcggugucggcccuauuucccgugcugcacugcgggccuuucucuuucucuuccggucuccggcgcugcgggagccgcggguuaccgugaguguuggccuuacggcauccgaugacauccgugacuacagggcggcggcgggucgcgaggcaggcgacacggguggcaggaaggacagggcgggcagcugcuuggcuauggggcaucgagauugccgggcgggggugguucccggucguccucaaggaacggauggcggggaaagccgccccggggccggcaagcucagucucaggaccgaccuccuugcucgcguuugagagguggggucgcguuuugugaguguugccaggcuggcgggugucguaaaucggaagcgucugcugcagccucugguuucuucauguuaccccagcucagggcggcagaggugugccggucuggggaagcccagaacugaucucguggcuuucuugcaggugcagacauggccaaguccaagaaccacaccacacacaaccaguguaaguuccuugggcuccggcuggcgacuguaccccagcgaggauuggguuaggguugcuagaucagagcuggagggagggcaggucacccuucaggugagccuugaagaugauuguguguuuagcuacuuuggagauuacaaauuugggagccaggaauccgcuuaaaaagcccauagugcuuuccacccauccuuaguguauucucaaaagacugccaaccaugauguuagguggucuuauuggaagauaccucauuuuuuuuugaccuguaaauauuuguuacccuacagcccgcaaauggcacagaaauggcaucaagaaaccccggucgcaaagauacgaaucucuuaagggggugagugaugacagugggucauaaacuaucccuuggcuccaggucuacaggguagggccucuuguaagucaugucuccuccaccaccagcguguguguuucgagcuaggauuucucuguguaguccugguuguucuagaacucacuauguagaccaggcuggcuucgaacucugagcucuagggauuguguugccuagcuucuccuugucucccaugucagacucaacagaaaagccuuccuugaccuucccagccccugguguaaucuccugagaacagaacugcuucucuugcuccguggagccuugagggagggagggagucguucuguauauuggguaccucauggucugcgucuaaacgcaacucuaguucuguacauuugauugcacccagauaauagacuggggauaacugaggcuguacuaggucuguuugcugccugcaaccacgcucucugaugugaaucugauggacuaggcuugguaucugacacucagcugaggugggggggugccccuagacaagucucaggaaacagcuagguuuccagaaguucacacccacacccuccaaccuuuuugugguuaagguuaacuuacuguuguuuuuacaguaacauauuugugaccagggacuuaaggaagugaaccgggccuguuauaugcuaccucauacaccuuuucuguucccagguugaccccaaguuccugaggaacaugcgcuuugccaagaagcacaacaagaaaggccugaagaagaugcaggccaacaaugcaaaggcagugagugcgcgcgcagaggccaucaaggcccuggugaagccucaggccaucaagcccaagaugccaaaaggccccaaacucaagcggcuggcuuucaucgcucaccccaagcuugggaagcggauucgaagcuacauggccaagggucagaggcucugccaaccgaagccuaagguccaaaccaaggcaggggccaaagcuccagcuaaggcccaggcuucagcuccagcucaggcucccaaaggugcucaggcccccaaaggugcccaggccccugugaaggccccauagaaaaggcuccugccagugugaagacagacggacugcugugacacaccuccccacacacuauuugcagaugaccaguguccuaugcuguucuuacaaauaaacucaggcaagaucuguuagcuugugucuguugucaua

SEQ ID NO: 5287 - RNA, 5341 nt, Mus musculus
auuaagaacaucccauccaaugcuggcuuuauuacugggcaggggaaacagauccuuggcagugguaggacugagaguacaagaguuggaagcccuggggcucagcuuucacuaggcagggugggcacacuagcaagugcagagaggaggccuguauauaugucaaccccacggagaaauauauccucaugcagccguucauuauggucauguagcaggacaggugugcgguucaugggcgagaagcccagagcugggauccccaccugcaggggugauaaaacacuguuaggagaaagccaaccuucagaucccugacugcucugcccugcccugcccugcccugcccugcccugcccugcccugcaagugaguagcucaccgcccggauaaagcggcugucaguggcagcaggaaagaucucuggcuccagagugagguuccugaaggggaagggccugguaaauggggaggaaggcagggguggggggaccuagccgggugcaggauggugggaaagcugggagacaacaggaaggagagguucugagaugugggcgaucgggagagggcuggucagugcucacauugccuugcaggcuccgcugaaagcugcccaccagggaucugaaucauccgugggugucauucgaggcucuguaaacuucuggagaaggggagggaugacaaggaccaggacauggggcucugcccaucacacaaugugccaugcuuggcacagggcacacucacccaccuaccaggcuucccgguggccaggacagccccagguccucuuccaguccuuccaaugcccuaggucuggcucucuccucauucucaucuacuucacuguauccuucugauccuagccccaacgccugcugcgggccucagaccggcagaauacauauucucugaauacaagguccuacuuuccuggaccacauacaugcacaaucgcauaaucauaucacagucaauuuucuuucuuucaaaacauggcuucuaucauagcccuagcugucccggaacucaguauguagaccaggcuagcuucaaacucacaagagaucugccucugccucacaagugcugggauuaaaagcaugagccaccacaucuugccuuuguauugcuuucuaagauaaggucucagcaggccuugaggucacucuguggccaaggcuggccuugaucucguaccuccaccucugcacaccggcacaugccacauuccuccuuuaggaggugcuggggaccaaccaaggacuucaugcgugcuaccaacugagccacauuucagauguccuaucaaaggaugcaagcaucccuccugcuccaugcugcagcgagcacggugcaagaccccuguuuucucccuucccauucaaaauggucucuauagcuacugcuuacugguaaauaaaacaucucuuacagcuaaggaaucagacagcuguaugcagagguccuacacaagcccagacuuaguaagcccacacuccuguugcccugacacuucaucaucacaggucccaagucaauaccugagcaaacucaaaggugacccccucuccugcuuccuggcaccaucucugcagcugcuucucgaaggccugaaggaagggguacgagcugaggcucuaggacacaggauggagaaccccgggcucucucccucaaaccugaguggagguggcaccuucaugucuacaucuggugccacucggaagucaaagcuggcacucauaguggcagguaccacauuauaggccacgccaccuucaagcuuggucagauucaccgaagucacggcgccuuccuucaggugaggguucgccugcagccugcaucaguauuggggggggggagggggggaggcagagagcaggcguugcagauaaaaggagguagcacaaucuaucuugcacagcguuccagagccacccccucacuccacccccuuccuccgcugccuuuaccucugccuuuccuucucccggaaugccaagauggagcuuauaaccuuaugcuaagagaguaugaggugagguguaagagcggcccugggacagagccucccgaaugcccaggcuccccaugggccacacaccaacuucucugcagcuguauccucaaugaagcgugaggcauggccuggcuucccagugcugguaaccuguaccccugggagggagagaguuaucggcaugagacaugcucugaacucugagcccauggccuagagcaggaauccuggcaaaagugaagagcuugcccucagaacacaggaaggcaaaaagacuggaugccucuggugucaacuuccaaaagacccugugcugugaggcgaagccacugugcagcaugagaaaggguagcgcacaguggugacugguggcuuuggucagcugaccugggggccccaguauaggaaaggagacagcaaauagcaugcaugccucucccccaaacccauacucacaccaaggacuccgcucacuauaaaagacaguaaaggcauccgugggguuggccaggccugagggagaaaguagggauacaggguggugugacuccacuuccccucgcagccucccuaugucuggcagaggauggccaaccugcucacccucguccagaacgaagccugcccgcagagccuggaacucaggccucuucacaaacaacuccauccccuugugaccuccgaccuccucgucuguaaaagugucaggggugugauaugagauaccucccaacacaccuuucuucccuguucucaaagaugccacuccuaccaggcacaaaggucauguggaugguccuagggaaucgguggcccucgcucuucagccuccucacagcuuccagguaccuaaggaagcagaggcuaagugcucagggugugcacggugucaucuugugcccuagacacuccccugucauguauuucagacuccagaaaacucccugcgccuuuucugagcugguuucuccauucauaaaucgucauggcagccauuucugcuuuagauagaaagucaagaugacccuggcuuggcuuaggguuuuucaacacaucucugugcucuugcugaauccagaagccuagcagggaucugggaaugggggauacucacuggaugcugacacucuucauguccugggagccccuagcauagauguagcccucggaauccuugaaggccucaaaggggucgugaugccaauguuccuggggggcagaggugggaagugaggcccgccauagaauugaaauaaugagagagacagcaggcuagaaaccccagcuaccugacuuccaaccccccaccccccgcaauuuggcuccugcugucaccccucucuagcacagaacccucaauggacaaaggcugcuugaauggagccaugccauaugaauguuaagaguuagugguggagaagcuggacauaauggcauacaccuuuaaucacaacaccagggagggaagagcagcuggaucuuuaaggcuauccuggucuacacagugaguuccagguuagccagagcuacauagugagacccugucuagggaaaacaaaaccaaacaaaccaaaaacaaacaaaacgagagucaguggugagaucggcaccaugggucccuggggaaucccgccggcuacacugugucuauccuccaggccugcgcgcaucccuccauacacaccuugaagacagguaccacaucugugugggaguuuagcaagauggaggggagugacggguuggugccuggccaggucagcacagugaucacaaagccaggcaccaccugcagagucaggacaggaagcagucagcagcaggggacaaaguguccccaacccacggccccacccugcucaaggcuccaggcucaccucuauuuucugacagcucagacccagcuggcgggcucucuccuccaggaaggugauggccccuccuggaaacacagagagccuuccugcugcuuuugcugguacccaccggcccaggcagcccagagauguauagcugucuucccaacacaauuucaaaucucucaaaacaucugcaucugcguucccaaggaacacgauguuuuggcccaacagugacacucugugaaggccagguguuaucuuucuuaaggauagagaagucagagauaaagagacucaccuaaagucucucagcuuguaaaucuuacaaugggacuuggacccaagcacaagauuccuagccacuaagccagauucccuaagggcugugaccuuuguauaacuuugguuauacagaggugggaagagaggccugccauagaauugaaauaguguuagaccaggggugguugccccaguuuccacacaccacucuggccuuugaggagugaggugaauucacaccuuccuuaaacuagcuggcaggcauaaccaucagaagaugcacagcauaggggaaggguaggaccccguugucuuagucaguugacuagaggauggcuacaggaagagaggcagcagagacagcaaagucgggauccucugggugucagguguugaaggcaauguacagcauuagcauacucccagcccuggacccucucagcacaggcccuaagacccugcauuauucucaccauagucuggauuggguugcacagugcagaugcgcagguacuggcggaagagcgucacggaggggugcucagacucgggauccuugguggucauggcgccgcgugcuggcuuggguaaagugcauaguuaauacuacucccaccccuagaaguuggagccccgugcucugcaccugaaaucuggccuuuccaauguuguuccuacagggaggaggauacuucgguuugacuuccccauucugugccaggccaugugcuggcugcuuucuaaacauuuccucauuuaaaccucaaaagagugccuggaaguaaguuugauccuucgagugcacacuugacauaagagaaagcugaggcacagagccaguuuagugggagaacuugguuugaaugagacauugacucccuauacccuccucaaaauauuucucccaaaggccgggcuuuuaugccacagagccacggagccccauacuccucaagcucucccuaagguccuccaaccuugcucucuccacgucucaguccugugcuuuccucucagacuguggccggaacucaggguccaccgaggucgcucccaaucucaaaaccgcccggggccgcccaccacguggccugggcggaguggaggggcggagaccgaagacuauaggggcugucccaguucccuuagcggagccggcgccguu

SEQ ID NO: 5288 - RNA, 5341 nt, Mus musculus
aacggcgccggcuccgcuaagggaacugggacagccccuauagucuucggucuccgccccuccacuccgcccaggccacguggugggcggccccgggcgguuuugagauugggagcgaccucgguggacccugaguuccggccacagucugagaggaaagcacaggacugagacguggagagagcaagguuggaggaccuuagggagagcuugaggaguauggggcuccguggcucuguggcauaaaagcccggccuuugggagaaauauuuugaggaggguauagggagucaaugucucauucaaaccaaguucucccacuaaacuggcucugugccucagcuuucucuuaugucaagugugcacucgaaggaucaaacuuacuuccaggcacucuuuugagguuuaaaugaggaaauguuuagaaagcagccagcacauggccuggcacagaauggggaagucaaaccgaaguauccuccucccuguaggaacaacauuggaaaggccagauuucaggugcagagcacggggcuccaacuucuaggggugggaguaguauuaacuaugcacuuuacccaagccagcacgcggcgccaugaccaccaaggaucccgagucugagcaccccuccgugacgcucuuccgccaguaccugcgcaucugcacugugcaacccaauccagacuauggugagaauaaugcagggucuuagggccugugcugagaggguccagggcugggaguaugcuaaugcuguacauugccuucaacaccugacacccagaggaucccgacuuugcugucucugcugccucucuuccuguagccauccucuagucaacugacuaagacaacgggguccuacccuuccccuaugcugugcaucuucugaugguuaugccugccagcuaguuuaaggaaggugugaauucaccucacuccucaaaggccagagugguguguggaaacuggggcaaccaccccuggucuaacacuauuucaauucuauggcaggccucucuucccaccucuguauaaccaaaguuauacaaaggucacagcccuuagggaaucuggcuuaguggcuaggaaucuugugcuuggguccaagucccauuguaagauuuacaagcugagagacuuuaggugagucucuuuaucucugacuucucuauccuuaagaaagauaacaccuggccuucacagagugucacuguugggccaaaacaucguguuccuugggaacgcagaugcagauguuuugagagauuugaaauuguguugggaagacagcuauacaucucugggcugccugggccgguggguaccagcaaaagcagcaggaaggcucucuguguuuccaggaggggccaucaccuuccuggaggagagagcccgccagcugggucugagcugucagaaaauagaggugagccuggagccuugagcaggguggggccguggguuggggacacuuuguccccugcugcugacugcuuccuguccugacucugcagguggugccuggcuuugugaucacugugcugaccuggccaggcaccaacccgucacuccccuccaucuugcuaaacucccacacagaugugguaccugucuucaagguguguauggagggaugcgcgcaggccuggaggauagacacaguguagccggcgggauuccccagggacccauggugccgaucucaccacugacucucguuuuguuuguuuuugguuuguuugguuuuguuuucccuagacagggucucacuauguagcucuggcuaaccuggaacucacuguguagaccaggauagccuuaaagauccagcugcucuucccucccugguguugugauuaaagguguaugccauuauguccagcuucuccaccacuaacucuuaacauucauauggcauggcuccauucaagcagccuuuguccauugaggguucugugcuagagaggggugacagcaggagccaaauugcggggggugggggguuggaagucagguagcugggguuucuagccugcugucucucucauuauuucaauucuauggcgggccucacuucccaccucugccccccaggaacauuggcaucacgaccccuuugaggccuucaaggauuccgagggcuacaucuaugcuaggggcucccaggacaugaagagugucagcauccagugaguaucccccauucccagaucccugcuaggcuucuggauucagcaagagcacagagauguguugaaaaacccuaagccaagccagggucaucuugacuuucuaucuaaagcagaaauggcugccaugacgauuuaugaauggagaaaccagcucagaaaaggcgcagggaguuuucuggagucugaaauacaugacaggggagugucuagggcacaagaugacaccgugcacacccugagcacuuagccucugcuuccuuagguaccuggaagcugugaggaggcugaagagcgagggccaccgauucccuaggaccauccacaugaccuuugugccugguaggaguggcaucuuugagaacagggaagaaagguguguugggagguaucucauaucacaccccugacacuuuuacagacgaggaggucggaggucacaaggggauggaguuguuugugaagaggccugaguuccaggcucugcgggcaggcuucguucuggacgagggugagcagguuggccauccucugccagacauagggaggcugcgaggggaaguggagucacaccacccuguaucccuacuuucucccucaggccuggccaaccccacggaugccuuuacugucuuuuauagugagcggaguccuuggugugaguauggguuugggggagaggcaugcaugcuauuugcugucuccuuuccuauacuggggcccccaggucagcugaccaaagccaccagucaccacugugcgcuacccuuucucaugcugcacaguggcuucgccucacagcacagggucuuuuggaaguugacaccagaggcauccagucuuuuugccuuccuguguucugagggcaagcucuucacuuuugccaggauuccugcucuaggccaugggcucagaguucagagcaugucucaugccgauaacucucucccucccagggguacagguuaccagcacugggaagccaggccaugccucacgcuucauugaggauacagcugcagagaaguugguguguggcccauggggagccugggcauucgggaggcucugucccagggccgcucuuacaccucaccucauacucucuuagcauaagguuauaagcuccaucuuggcauuccgggagaaggaaaggcagagguaaaggcagcggaggaaggggguggagugaggggguggcucuggaacgcugugcaagauagauugugcuaccuccuuuuaucugcaacgccugcucucugccucccccccuccccccccccaauacugaugcaggcugcaggcgaacccucaccugaaggaaggcgccgugacuucggugaaucugaccaagcuugaagguggcguggccuauaaugugguaccugccacuaugagugccagcuuugacuuccgaguggcaccagauguagacaugaaggugccaccuccacucagguuugagggagagagcccgggguucuccauccuguguccuagagccucagcucguaccccuuccuucaggccuucgagaagcagcugcagagauggugccaggaagcaggagagggggucaccuuugaguuugcucagguauugacuugggaccugugaugaugaagugucagggcaacaggagugugggcuuacuaagucugggcuuguguaggaccucugcauacagcugucugauuccuuagcuguaagagauguuuuauuuaccaguaagcaguagcuauagagaccauuuugaaugggaagggagaaaacaggggucuugcaccgugcucgcugcagcauggagcaggagggaugcuugcauccuuugauaggacaucugaaauguggcucaguugguagcacgcaugaaguccuugguugguccccagcaccuccuaaaggaggaauguggcaugugccggugugcagagguggagguacgagaucaaggccagccuuggccacagagugaccucaaggccugcugagaccuuaucuuagaaagcaauacaaaggcaagaugugguggcucaugcuuuuaaucccagcacuugugaggcagaggcagaucucuugugaguuugaagcuagccuggucuacauacugaguuccgggacagcuagggcuaugauagaagccauguuuugaaagaaagaaaauugacugugauaugauuaugcgauugugcauguaugugguccaggaaaguaggaccuuguauucagagaauauguauucugccggucugaggcccgcagcaggcguuggggcuaggaucagaaggauacagugaaguagaugagaaugaggagagagccagaccuagggcauuggaaggacuggaagaggaccuggggcuguccuggccaccgggaagccugguaggugggugagugugcccugugccaagcauggcacauugugugaugggcagagccccauguccugguccuugucaucccuccccuucuccagaaguuuacagagccucgaaugacacccacggaugauucagaucccuggugggcagcuuucagcggagccugcaaggcaaugugagcacugaccagcccucucccgaucgcccacaucucagaaccucuccuuccuguugucucccagcuuucccaccauccugcacccggcuagguccccccaccccugccuuccuccccauuuaccaggcccuuccccuucaggaaccucacucuggagccagagaucuuuccugcugccacugacagccgcuuuauccgggcggugagcuacucacuugcagggcagggcagggcagggcagggcagggcagggcagggcagagcagucagggaucugaagguuggcuuucuccuaacaguguuuuaucaccccugcagguggggaucccagcucugggcuucucgcccaugaaccgcacaccuguccugcuacaugaccauaaugaacggcugcaugaggauauauuucuccgugggguugacauauauacaggccuccucucugcacuugcuagugugcccacccugccuagugaaagcugagccccagggcuuccaacucuuguacucucaguccuaccacugccaaggaucuguuuccccugcccaguaauaaagccagcauuggaugggauguucuuaau

SEQ ID NO: 5289 - RNA, 6630 nt, Mus musculus
ugaagcuaauacaaccagacucuaaaacuuaaggaauggaauucaggcagcucuggagaggagacagcauccgaacccagagccaaaaucaccgggcaaauaauggauauaugcuguaugugccuagucaaagcugcaugaggggccagucaguccgagcggcuuuggauacgucuacauuacugucauuucaucucugggacuggccaccaaccucagccuacccagccucugacucaccccacuagcggccaaaagcuggaauucuacaccacccccaagcucuuuccccuccucacgugauugcugggaaaucccuaccaaaaacuagcugaaggcucacgaagggucgcuagaugggaucccagacuuggaacuuguuucuuaggaggcacauucagcauuccugauaccgggcuggauaacagccaccucuuccaggguccuguuucauuugggugaguguccuuuggcccugcccuagaguccucugcagggcagggaagggugagguuaaaguggcucuugcucucucuggcacuugaaagccugaaacuuuggcuggcaccccagaacucaggacuguuagcaaaaggcuacaccacuugguccuaagcucuagagagguagauccagcugcagaagggcaacuuauaggguccuuccccuguagcucagaugauucagcccagcaaccuagccagaugacugacaggaggaggaaauguucuagaaggggaagggccccagcguggguggggugagccggcuuucacuuuuucugcugccucggggaacaccucgagccaacugcuuccuaacuccagggugggcagaacugacgggcucuaagcuucugcaucucugagguacaaagugcagguuuggagauggggauauguaaaccaaggaguaggaggccagccuccuaaagggcaaaucugaacgcucccuaccucuugccccaggagaaccauggcuccaaaacgaaaggccucugugcagacugagggcuccaagaagcggcgacaagggacagaggaggaggacagcuuccgguccacugccgaggcucucagagcagcaccugcugauaaucgggucauccguguggaccccucauguccauucagccggaaccccgggauacaggugagcugaagccauguucagaccgcagccuuuuuguuuguuuguuuuuguuugcuuguuuuguuguguuguuguuuuucaagacaggguuucucuguauggcccuggcuguccuggaacucauuuuguagaccaggcuggccucuggccucgaauucagaaauccgccugucucugucucccaagugcugggauuaaaggcgugggccaccaccgccuggcagaccacagccuucuuucuccuccuuggguucucuguucuagccagggauugcguaccugucuucugaagacugccaaggugggcuguuauuccauugggucaagguguaccaugucugaccaucagacacuagggugcaucacacucaaggaaggggccugacucaauuucccccgggacccucuuccguguucccucaaacugagcccucagggcagagccaggucuuuuuucagauucccccacccaggaagcagcugcauccucuccaaauucccaagcccacagcagggcuucaucacauccagucagacugugacccugccccccaagggcagagacacccaagugccaaagacaaggccccccccaugauguucccugguguacacacccagcccacgccccacggacucacccuacacagguccacgaggacuaugacuguacccugaaccagaccaacaucggcaacaacaacaacaaguucuauauuauccaacugcuggaggaggguagucgcuucuucugcuggaaucgcuggggccgcguggugagcgagccaucgcccgggcugcccucccccauccccccucccccccuugggcauccaaagagcuggcuucgucugcagcuguuuggagggcccagcccagagaccagcaaaucuugcugguggacacaccccugaaaguugucccuugcagggagaggugggccagagcaagaugaaccacuucaccugccuggaagaugcaaagaaggacuuuaagaagaaauuuugggagaagacuaaaaacaaaugggaggagcgggaccguuuuguggcccagcccaacaaguacacacuuauagaaguccagggagaagcagagagccaagaggcuguagugaaggugauggggcagcagggggcagcaggggguagaggggagggacugccugccagcccauccuccagucccauccucccucucuggucucagccgaggcccugcucccugugugggcauucugccuaauggcugcugcccgagcaggccuuaucuccccagguguacagcggcccugugaggaccguggucaagcccugcucccuagacccugccacccagaaccuuaucaccaacaucuucagcaaagagauguucaagaaugcaaugacccucaugaaccugggugaggaggagcucucugcaggguggcagcuaccccugacccccacccccacccccacccccaccccugaucucaggggcuacagggcucagcucgucccuucaucccccagaugugaagaagaugcccuugggaaagcugaccaagcagcagauugcccguggcuucgaggccuuggaagcucuagaggaggccaugaaaaaccccacaggggauggccagagccuggaagagcucuccuccugcuucuacacugucaucccacacaacuucggccgcagccgacccccgcccaucaacuccccugaugugcuucaggccaagaaggacaugcugcuggugagggcuggccagcccagagaauaccaggcagccugggcaaagaggagaggggcacauggccacgugguccagagggacaggcugagagccaagagaggagagagcuggacagagagauggggaggagauggaauaggcaguggggugucugucacaugggaggggcuggggcagaaguggaagcccacagggcagacaagguccagugcccguuaucuuaggugcuagcggacaucgaguuggcgcagaccuugcaggcagccccuggggaggaggaggagaaaguggaagaggugccacacccacuggaucgagacuaccagcuccucaggugccagcuucaacugcuggacuccggggaguccgaguacaaggugaacucugaacaccugcccuggagguacccugggagccccuggcuugcagcauucccucccaugugcccugacccaaggagcgcucuggagcaggaagaccacaaggacacuaguccacaagucucccaccuuuggccacuggccuuucuucuccacaggcaauacagaccuaccugaaacagacuggcaacagcuacaggugcccagaccugcggcauguuuggaaagugaaccgagaaggggaggugagggagagucagccccuguaucaccacccugucccuugggggugguggggagcauuuacuuauccgccccuugcuaagcugguuuaacaaccuugaccaguuuccaggucaagcguaugccagggacccauggggcccuaggcaucggucacccaagaagagggaggaacaccugaacccucucgaggcauguugcugccauuuucuaccuucccccacucagggagacagguuccaggcccacuccaaacugggcaaucggaggcugcuguggcacggcaccaauguggccgugguggcugccauccucaccagugggcuccgaaucaugccacacucggguggucguguuggcaaggguauuuauuuugccucugagaacagcaagucagcuggcuauggugaggcaccccugggugaaaaccuggguggggaugggggcuccccaagacagagacugagcgcuuuacugacacagugaggugucccagggcuccgggacucugaagaagcaccuggcaguuggggaugugucguccuagaagaggggaggcagauaggauaaaagcaaacagacucugaggagcuagagagcuccugaagggagggugaaggcugugugggccuggccucacuaggacagcucauucuauguggaaguucccagcagugucaggggacgaggggcagggacauggaaccaucaagggagccuucuccagaaagccucagagagccugagcuggccguacacauccaagaaucuugugacuggagcuguagagagggugacagaggcguggaggcugggcccacugucucucucugcucugcucugucucuuugucugucuagcucugugucucucucucuuccuccuucccuuccucccucccucucugggcacuggcucuggccccagagcugcagaaaugagaggagagaacucaugagcagggugugugaggccgugugugggaaaaggucaaagauaacuccaguuauguccaaguucauagucaggguauccucaguugagugaccucaucagcccaugcuguccccaucacuggaggguacgaucaccuuccaguccaagaaagcaagggucuaagcaaaaacaaauggggcucaaguucuuggcagacagacagauggaagaagaggucuacuaagaugucccaaaaaaagacuggcuguggggccgcaagagagccaaucaaaagucugugguggggccugagggaugggaaaguaaaaguaggccagggagaggugccccucccccagcucagaggcugggaugcccuggcugacuccuuagcugagaaccuaugggagcugagaggcaggggacagggaggaggcugaagugggaggggccaggccaggaugugcuggaagaucgcaagugcgcacuugggcugcaauccuaguggaaacaauguugccacuaccggcuggggaggcgccugagcugccuccuccuaccacugagccucuguguccccuaguuaccaccaugcacugugggggccaccaggugggcuacauguuccugggcgagguggcccucggcaaagagcaccacaucaccaucgaugaccccagcuugaagaguccacccucuggcuuugacagcgucaucgcccgaggccaaacggagccgggugagccccagauauugggcagaucuacagcugaacgugggguuggcaugaggggcuggaggaaucuucaggaggaugucagcauagagaguagacuauagagagauaaaaacaugcggcccuucucuaggaauugauucccugagucacccagcaaacacccacuguaacaacucucuccaggguggcuaagagaacuggaaagaaucaugccauuggcugagcgcuagccuaggauuuucccagagaaaaaaugggggaugagguggcauucccgguaacaaguggcaagucacagggaacaaggcauagguagccgcaggcaccagugaccccuuggcccgccaucccuugcagaucccgcccaggacauugaacucgaacuggaugggcagccggugguggugccccaaggcccgccugugcagugcccgucauucaaaagcuccagcuucagccagagugaauaccucauauacaaggagagccagugucgccugcgcuaccugcuggagauucaccucuaagcugcuugcccuccccagguccugcccugccgagccaugaucuucacccuccucucccuggcucucacagcacuuugucugccucccaggaauauaauacaugccaggcauuggcacacaccaguagccucagcuacucagggggcagaggcaagaaaaacacuuuauccugggaucuggacucucaccuaggcuacauaguaacaugugccucaaaaaaaaaaaauuacaaugagucaaagccaaauaacguuuugaagcaggccaugauucacuccuauaaucccaguacuugggaggcugagacaggagaaucgcugugaguucaaggacaaccuagguaaaauaguuccacguuagccugagcuauagaugaccuugccuuaaaaauauagaagccaauguucugguuagggauggacugcacagcuuagaucaccuaaugacaccguugucaucaguuuacaugaacagaaucuacacacaaugacaaaaucacucagcggcguguucaugagaauguaucaccaucgugaagggaaaacgacuuuuacauugucguuaucuauauauggucagugcugugcaauagacucuuaaaacucauuucuccuguccgacugaauuuuguacacacaucuuccuaagccccguugcucuuuacuucggaguccagcuuuuuuaaggccccacgugugagaucguguggcuuuugucuuucuggaccuggcuaacuugucgugcaaguucucccacguuguuucaaacaacgccauucuuuaaggcugacuaguaggcccguuuguguucacguccucuuugccuguucacccaucaagggacacagcgugauuugugaguugguuguugugaauggugcuuuaaaaaaaaaaaaaaaaaaaagccccagca

SEQ ID NO: 5290 - RNA, 9464 nt, Mus musculus
cguuuuggagccaugguucuccuggggcaagagguagggagcguucagauuugcccuuuaggaggcuggccuccuacuccuugguuuacauauccccaucuccaaaccugcacuuuguaccucagagaugcagaagcuuagagcccgucaguucugcccacccuggaguuaggaagcaguuggcucgagguguuccccgaggcagcagaaaaagugaaagccggcucaccccacccacgcuggggcccuuccccuucuagaacauuuccuccuccugucagucaucuggcuagguugcugggcugaaucaucugagcuacaggggaaggacccuauaaguugcccuucugcagcuggaucuaccucucuagagcuuaggaccaagugguguagccuuuugcuaacaguccugaguucuggggugccagccaaaguuucaggcuuucaagugccagagagagcaagagccacuuuaaccucacccuucccugcccugcagaggacucuagggcagggccaaaggacacucacccaaaugaaacaggacccuggaagagguggcuguuauccagcccgguaucaggaaugcugaaugugccuccuaagaaacaaguuccaagucugggaucccaucuagcgacccuucgugagccuucagcuaguuuuugguagggauuucccagcaaucacgugaggaggggaaagagcuugggggugguguagaauuccagcuuuuggccgcuaguggggugagucagaggcuggguaggcugagguugguggccagucccagagaugaaaugacaguaauguagacguauccaaagccgcucggacugacuggccccucaugcagcuuugacuaggcacauacagcauauauccauuauuugcccggugauuuuggcucuggguucggaugcugucuccucuccagagcugccugaauuccauuccuuaaguuuuagagucugguuguauuagcuucaaucgcuguuccagcggaaaaaucacagaaccccgcaccucuggcuccaccuuguggccauaagacgcaagcaccgcaugcccuccuggccccaccccucccugcuagucaggcguuagcagagcgcaagcgccacaggcccaggccggaaaucgcaagagagacuugcuuccuacuccaggcuggcgccggagccuauaggagcucuugaaggcguguccagcugcgucgguccaauagacguuugggggcguggcaggaucuucucaagggcccaauggagcugcggaagguggggcccgcugcgccgugggaaccuaucagggcuccgggucuugccaugcggcugggguuuagcagccaugugaguucuucgggguagcggcaccuugaacaguaugucgaccgccguggcaacucguaagcgggcaaagccagcucccgggcccggggcggcuccgguggccggcaagcggcggcgaaaggugagcaugguguacucuugggcgcgaccgaucuagcuccugggagagccaucguuccaucccagggcccccaucggggcaaguaucuuugccaagggcuccgucagaaggaagccuacaucucuuuucuucuauccaccaaauccugggaaaccuucuacuuggccagggccaggugcuacuugccucucucaguccugggccucgugaccaagagaggaucguuugauuuccagguagacucugcugcggacaggggcaaguccaaggguggcggcaaaaugaaugaagagauuuccagcgauucugagagcgagaggugaguuuuuaccgggaggaaggauaaacggaggcucguggugacuagaagacucagugcgacuggcaacagagcuggguguuuggcucgagauccugggucuacccuccaguuuccggcagugagauaucgucguuuaucucugaugugucuauggggaagacgcugggcuccugugggagggagagcuugggaccuuuuuucgcuuuaugacauggaggcaggcacaggucuggauugauugagaggcaaggagagaacgguacagaacacauccuccuguucuuaauuccaucuucacacaguaccacaacgacugguguccuugggcaccuuuuugagaugaggucucuguuguuuugcccaagguggccuugaucuccuggguucgaaugauccuaggcuucagcuuuguacugucacauauguagccuuccuaacauuagggucuuguuucacuguugcgaacacgggugagcaggcaaguggagagaggccgugucagugucugcagguguguaucuuggagacauguguugugagaacagaagaagccuuuuaaaaaguugagccuggagagacgaggaguguccuggagcgguagggaagagguucagggaccagagacaaaucugggguauuagugugccaggguggaaggaagaaaggauaaaccggcaggugauagguacaggccaggguagccgugaacuuaagagaucugccugcuucugccucccgagugccaggauuacagaccuggcuaucaguucugcuucuaaaagugaauauguggugccuuaauuugcucagcuuuuuuuuuuuuuuuuuggcaagguuuuuccacguagccauggcuguccuggaacaaccuguauagaucaggcuggccuuaaccucaaagacauugccugcuucugccuccaggaccugugcuaaacacuuuggguauuuauuuauuuauuuauuuauuuauuuauguguguguguguacaugcugaugcccaugggagaccgaggacauuggagccccuggaacugucacaucaggggguugcgagcgagccaccugaggggugcugggacugaacccagggucgcuguaagaacagcaggaguucuuagccgaugagccauuuuuuuccagcccauucuuuaccaccucuuaagucuuuuaacuugugucacgaaauaaaugugauaacuacagaagcaccacucaguuuucuucugcugaucuaacuugggugaaaguaaaaauaaaugcguacacaccuuaaauucaggguugaaacagcuuuucuuucaaaagggauuuuuuuuuuaaacaaaaaguggugcugggcgugguggcgcacaccuuuaauuccucaguaccuaggaggcagaggcagacagaucugugaguuugaggccagccugggcuacguggcgaaaauaugucuugggaaacaaaacaaaacaaaacaaaaaagcagaauugcuaaaugccguuuauaaggucucagcaucaagugucuuuaccugcugagccgccacaccucuaacucuagucugcuuuucugugugugggcccugaaguaagagacugauugguuuggaugcacucagaaaggacauaacucugggccaaggucuggccuugacuuuccugagacaugguuuuuuguucuguucuuuuaggcagggacuuuguaacucuggcugcccuggaacucgcuauguagaccaagcuggccucaaacucagagagaccugccugccucugcccucaagugcugggacaugccccaggacacugcuauuccugauggguuuuaaagucccuucuggaggaaguccugggcagggugcugggcgacagcagguagcugaugggaugucugcaggcuugugauuaggggugcagcugucuuggucugcuggcugagaguucgaaacaccuaccuaagcucccagaaacaggucuaagcuggaccugucugugagugaagggaguguccugagcuggcucacggacacuggggccuagaagggacagcaagaaauuccaucacacgugguuuagucaguacuacuuaggauucacuuggaaccuaguccucgggguacaaggagggugcagggcagcaagccuaggguaccccaauaugucugugucuuggagugguugucauccuggcaucugcguucucuguucugcaugcuggguucccuguuugcagcgcccugugccuugugccuuugucccuuagcuugggaagcucaguagaaggacaggaccaguucucuguuacuauguaccugaccaugucuucuuagcugggacuuguagagauugucuuauucuagcucaggcugaccuugaacuuguggcagucuccuugucuucgccuuccaaauucuaggauuuuaggugugccaccgugccuggcuugacagugcgguuuucuagagcauggugacugaguucaggaccucgcucugucacugagccauacccagggcaaugucuucauuugucaccauaaauccugguaccuccucuucaccuccucuucuuccccuucccuccuccccucuucccuggacuggcuguugagccagggccucaaggauucuuguuuaguccgccgcuaagcuaagucugcaggccugccaccuuugacuucugaucuuuuguguacaaccuggcuucucauagaagcuuguggaaucuucucuuucccuuguugagaugugaucauuuccugguguuggggggagcuggcuguuuugaugaccuuguguuggacacugagugggaccuuccagucgugaggucacaugcaugugucgcuggcccugaggguuggcaugggcaaggcuggccucgaggaagcacaguucuaguggccagaugagggggccaucccuuuagaccccaucccuucuccccacagcuuggcuccaaggaaaacagaggaagaggaggaggaagagcuggaagagaccgcacaggaaaagaagcuacgcuuggccaaacucuaccuugaacaacucaggcagcaaggugagccaggggcuugaugaaggccagggucucccgcagagccugccugcugccccuguugcaaccccaggcaccugaugugucagucacguagguccccauugucacuagugcugcugguguuggguaccuugcagaggguggcuaaggucucuaaugggccaguacgcucugggccagacuagaccuuuacgaagccaagcucaagucuaaacaaaggcaggcauugaccguggaggcaccaggagcuuccuauaagauuagcacuguugaguugggauggaugcuugggauggaggagggaagggcacugcagccugggaucauguggaccguucuguccugcacagaggaggagaaggcugaagcccgugcauucgaggaggaucagguggccgggcgcuugaaggaggauguggugagucuggagggcgagggcuaguguggguguggcggaaggcugggccuucccccaggucuucacuccucuccuuccucucuuugcagcuggagcagagaggcagguugcagaagucgguggccaaggaggugagugugcagggcaccguggugcgugggcagaggcggugugugcacgcgggucggugggcaguuggcuuagugcugcucggguuguuggagucuugguggaaaacuguggacacuugggcagguguggucagguaugcaagagucuuauuucuagggcagugguggcacaggccuuuaaucccagcacuugggaggcagaggcagguggauuacugaguuugaggccagccuggucuacagagugaguuccaggacagccagggcuauucagauaaacccugucucaagacaccaaaaaaaaaaaaaagaaucuuauucguucguguagccccggguucugguuuucucuggcaagugucuucauagcuccuacugcagugaugcagucucuugucuuuccagauccaggccccagcucccaccgacauucgaguuuugcggggccaccagcucuccauuacgugcuuggucaucacuccugaugaccuggccaucuucuccgccgccaaagacugcaccaucaucaagugugagugagaccucgagggugugagccugggguggaguccugaugguggaagcuucuagacaguugcugccuuggaggggcuucgaggcuacagggcuucugagcucuguggggcacagagcuggggccucgaacgggcaaucgggugagaagguguuugaguucugcauggauuuggauggaguccucggcccuucuggguucccagccuuccacaccugagcauaauccucaccuucccaccauccucaggggggugguuaguggucccagggugcugcuuuguuguuguuguuguuguugcuguugcugcugcuccuccuccucuucuucuucuccuccuucuccuccuucuccuccaccuccuucuccuccuccuucuccucauccucuuucuucuucucuuccuccuccuccucucuuucuucuucuuuuuuucuucauuuauuuauuauauguaaauacauuauagcugucuucagacacaucagaagagggcaucagaucucauuacagaugguugugagccaccaugugguugcugggaauugaacucaggaccuguggaagaacagcuagugcucuuaaccucugagccaucucuccagccuauuauuauuauuauuauuauuauuauuauuauuauuaugacuuuaauguuuuuauuugucucgugugugcugugcacauauaccacagcucacauguagagaugucagcagacaaucugugggaaucgaguggguucuggggauugagugcgcacugugagaggccaccaccgagcuccugggcacuuuugcauucuucuccuuuugggcgucauggcugccaucagggacuguuugccaccauuuggcagaugggacaaagugacaaguacagaugcucacagcugcugagcccacguucaggauccuuccuugcccccuugucugcgcugcccuuucaugcugggggaggggagguugcuaagcagccggcccugcccgcacccugugacuucccuccucgcuucguggcagggaguguagagacugggcggaagcugcaugugaucccucgagccaagaagggugcucagggccagcccgcaggccacagcagccacguccucugcauggccaucuccucugauggcaaguaccucguaagacuggguuggcccugugggcaggugggagguuuggguguguggugugugccgguggccauuaccuucguucccacaggccucuggcgaccgcagcaagcucauucucauuugggaggcccagagcugccagcaccuguacaccuucacgggacaccgggacgcugugucggugaggcucuggguauugaccaccugccuagcauggaagccugcugggugugcccuccuggggccaggcgccaggccccaggcucaucuacagaggccuguggguagugagugguguguguguaaaggccgcgagugcguugaagagauggggagcgauggagggagaccagguucagcuggaaccacagagggccugagggguauguagcuguuugaggacaggcaagcauguuccuggcucugggggaacagguuccugggucaugugacucacuuucaggagagccccucugggucuacccuccguaguccauacccuuugaccccucucuguucucuccagggacuagccuuccgaaaagguacccaccagcucuacagcacuucccacgaccgcucugugaagguguggaaugcagccgagaacuccuacguggagacgcugugagugugcccaggcagauagcacaggcccgcgugucagcgagaggucacaugugacccucccucccugcuuugcucuuccccuccagguucgggcaccaggaugcuguggcugcauuggaugcccugagccgagagugcugugugacagcugggggccgggaugggaccgugcguguguggaagauccccgaggagucccagcuugucuucuauggccaccaguaaggcgguuugcugggcugugguggggcucugugggcuggcgagggggcuggacguugcccccucacagccucucuuucuagggguuccauugacuguauccaucucaucaacgaggagcacauggugucgggcgcagaugauggguaagagucccuuucugauauguccgacugcugccgccaccagugcuuccugccugccaggcccuggacuuagcucauuuuggaucaguggccacaucccucagcuggucuaugugauugguccucccugcuguaugccuuugucuggcucuggccccucagacuaucuuuuucacccacagcucuguggccuuguggggccucuccaagaaacggccacucgcccuccagcgcgaagcucaugggcuucacggggagccaggccuggagcaacccuucugggugucauccguagccgcccugcucaauacagaccugguggccacaggugggugggugcucggugagguggggagggggacugugggugagcugguauggggcuugcuuacugacucucugaccuccaaggcucccauaaugcccgugugcgacuuuggcaguguggagagggcuuccggcagcuugacccucucugugacaucccccugguaagugguccuaaaugcauaacccugucuuugcaagacucuggaggcccauggaaugagcaauuucugcuuuucucacccagagacgucuauucagggcaaggccacuuacugucacagagccugucccacuuuucuccucuguuccccaaccccuacucccuccacccuguccuggcucuguguacaagcugagugugaguggguagaggguggaggccugcacugggcuugguucucuguaguggguauugacuugagaaccaggcugggcuguguggaguugacuguccacacuggagugaccugugggguuauguuaugauaugucacacacuccagugccugaggcagcucuuggcacacuugaugggcacugucuccucaguccuuaccaucucccugcuuggcugcggcuccacuccuacaguuucagagaggaggcuggggcucaugggaaaggguuggcacaccuaaccagugcaccaggccccugccugcuguugggagccguggugacgaauguucugaugucuuaccaugucccucucucucagguugguuuuaucaacagccucaaguucuccagugcuggggacuucuugguggcaggcgugggacaggagcacagguaugugauggggguggggccgagggcaagguagcacuggccgguugggaguaggagagggguggcgugcgucugccucaguggucauucauucucugcaggcuuggccggugguggaggaucaaagaggcccggaacucagucugcaucaucccacuccgcaggcucccuguguccccuguugccggcuccugacacucucccuuauuuaagugacuuccaggccccgccccuguccucuuuuguauuaaagccuccuauuuuagaccuuguuc

SEQ ID NO: 5291 - RNA, 27209 nt, Mus musculus
auccaggugaaacaagaaaguaauucacuuuauucuggguucuggaagcuccaauaagagucugcaaaguuggcagcccaggaggcuggugcagauaacagucucuggcuccuucggcccugggagccaaaagggcagugaggaaggagguuuaggcuuggagcaggacaacucaggcuccugguacucccagcccaagcuaggcagguuaaggaagaagagggcuagagaguuugcucaguuccuuagcaaaugcaccacaggaggguugagggcuuaucauuacuccucaccccucucaggggugcugagcucccgagggggccccagaagcuuggcuucaggguucagucgggguucucccaagggucccucgcccuccagguccagcuccucaaaggaugagccacuggcacccgauucacuguagcugugcucgcugcgguugucaccgucgucccagccacgguugccugccccaggagaaagugugguggcugaagucucccggcugccagggcgaacauccaggcucacagaacuugcaucacuuguaucagcuccuguggccaggacaagagagcacagguuagucaacuaccacacacuaacuguccuuuccuucagggccacagcaagggcucucccucuagcacaggaacugagcaugcagagucuacucaugaauaauacagccguaccggcucaggaggcccauuccggcugcccucugcccucugcccugacuagggcugcacugagagagccaagggagugugcagggcaggagacagagaggagcagcuggcugcgcucuucucucuuacccuagauuagcuccagcuccuugcauuuccacaaagccacugaccccgacccccacauccauuaagggccacucagccccggggugaggagcugagguagaacaaaggagacccaaauaccauucauuuucaggcuugagagugguuuguccagggacagcuacagagcauugcccaagaggcaggagggcugaagaaaggaccaagaggacuccucuccaguccaugcuccccaccccccaaagaccuccgcaaggagccaugauguucaggacaucagcuggcuccugccccuuaucacacuguaccuccauauaaagaaguugaagcaagaggaugaagaaauccuaagaaacacucaaccagacaaaaggagaaagcuaggauuaugcauuuuaaggauuuucaccuaacgugccugggucaacccaccaagugcccacuccaacuguuggcacucucuaaucugccuucuacccuagugugucugauaaguaagugcuccuuugcauccccugcccaggacuugucccuuggccaucucuacaaaccagaggcacugauugcagguggaagguggugaggaggaccuacuaugugcaggauucuagaucuggagauagcccauguaucaucugaagcacaaguaaagagggacagcugucaaaucugacaucauggagugagggugggcuggcuuucccagcuccugccuccaguggagcaauuuggggacugcuugguauuugcacuggauagagcugucugucccuugagccuuacuuagcaggggguaggguaguuaacggugaagcaauacgagggucagcucuguucugcuaaccuauucugccaucugagcaaaggugagaugagcccugcaagugcaggacuccuggcccugugcucuccuucugcaguggccucugguggcucccacaguagaaacacaccagaagagcagggaguuauggguaaucccacugacucuggggcgcgacucuagguccucacccauccaccaagggcugcaggucugaaaggcauaaaggacggggguaguuuuucccugaccccauuauugucauguucuaucuacccacccaccuaguggcucacccgagacccuuucccuucccacuccugggcuaagaguaaucagaggauagagcccaggggugccuccuuucagcccaggcucaaaacaucagaugaagauggcuguugggaacagauggacucacuuacaaaggagcucuucaaggcagaggaacggcagccuacagcccuacagaaggagguccuuuugucaagccugugccccuagaaagaggaccccaggaaagggcaaggagcaccuaaauccccagggcugcugggcaggggaugcgaagcuaccaccuuuacccaguuccucucuuuuccucugccaacggccaaugcaaggagaucaaauauucaucgcuucuguggagcuaaauaauacaucaauguaauaacaggcacaaggcagcuaaucaccccuuucaccucccaguccaagucagaggcccagcagggaggcaaggagagacaggcggagccuuggguggccaggcacccaccaugcauuacuguguaaguggcaugcaccuggcgaguggcugcccugagagucaggacagccucugucagaagugggcagaucccacagcacccacaguggggaggaggcaggcaggcuguggggaggacagaccaaggaccugaggggugcgggagcuguggcugcagccagcuguuuggagugagagccaagccguccguuaacacuccuggcaggcaguguuugggaaggaagggaucuaggugggugggccaagaaggcaggaagcagagaaaagguugcccgaaggucaaggcacaccuccuuuugccucugggggcugccugugcuugcugaccuugugccauguccagugcccacaguaggggcaccaagaguaucugccgggcacuacuaagcagaaaggagcaguaucccacggaggugauuaaguggcagaugaaguuaacuauguuggacacuagccccaagggagaagagaccgccucccagugcccugccugcaucagccccggccaacacaugucucucuagagugaccuuggcugcugaagacuggacuggcagaaagacucucagggacguaaaggaggguaguucuuuucccacagcccuguaccaucccuagacuuucugagucacguaaaagaacagucaaaaguuggggccccuaggauuaccuggcauguuacccacaggguuccuugcccaugggucucacacaagaugauggcaagguggugaaaacaagcaagugguuugugggccuaacccugggcauucuagcuaccagcaugggcugacuuguggcaucuugcuuccucucuuaccuucagacauaguucagucucacuuccugacgagcccugcccagaugucuuccacccagaugccuaggaugcuaaguauuccuguuaacaucugaagggaauucagacagggugguguuaccuggagaauaggugugaaucuguaucuauguggaggugcaugucuggcagcaggcaauucuguauguggguccuggugugaggucaccuuccuuccuuccuuugccaaguagcgucuaccuacaaggcuagcuuuggcagaggagccuccuuaacuguguccuuagaugugcagacgagggagggacuccaggcagcuauaggucuacccuacuuccuccaccuuugguaccugugccauccgucugggugucaguggccuccgcaagcucccggcauuuccgcucugucuccuucaccucuggcacguagaaaucuccuugccuugccagugggcacaugaaauggaucuugucuugaugguagaucuccaggcgagggugagcacacagcuuccgcuccuaccaguguugcaaaaugaauauaagcacuauaggguccugaccaacuugccccgggggaaccugggggaagugccugcugccuagucuuucuggaaggucagcucuauuucgcugaccucugaagcagcggggcuagggugugguccucugugcugaagugcauggacacucaggagguucagauucaguaaagacgagucuggcccugcuaacccuguguguguguccaggacuagauagcuagucucacagagcagagggcaagaaccguaugaacuauggccuuagacauuuaagccaaggucugacuuuuuauccuacaacuuuauagcccaauugggucucuccccuagacaaugacacguagauaucaggugagggcaguaguccugaagcugaggccucuggacccugucuauauaugcacuaccacaaaccgcguuuagcccauucccauggcuaggucuaugucaaauuuugaaacuaucaaauauggcuccuguacuucuuuacaccugaccccaggguuucucucagaggaagaagcauaaucugagauggagggacaugaggggggacaugaggugacacucaauauuaccuaauggucccccaguucugacaggcauuccacuccccuuucucuggacacagaccaucacuucuuacccucuagugcaucaaagcagcagacccaggccagagcuacccugggcaggcaggaacagccagaacacggagcaaacaucucucgguguagaaucugcccucucucuccugugauggcacaauuacccaccaagacaacugugaggccccugcccugucacugcucacccgcuaaccuucacagcauggcuauuuauagcaccugccaagcucucaccgugagcucuaaaaugagccuuccacuuaacaguaaugagagacuuaucgccuggcucggagaagccacuccaggacuccacuugucugucugcuuggccaacccaaggguugaggaaagucuuccaauuaaaaagagcccauggaaggaaaaugaagggauaagaagucuggaaggaagacccagcuaggacccucagugccagcuagagagagaguauauccaggaggccagauggagguagauggcccauccuaggucagcaacagcucagauucaaccuccacuaguaauccaggcaaagccuuuccuccugaguauccacgcauucaaacacagaggaccacacccuagcccagggugucuaaggucagugaaauaaagucauuauuuuuacuaguuuugacuccagucuuucacaccagucugguuacucuccaggccuucuccacagccaggcucaugccaucacuagauauaccuucuggguuuucgaaggcugccuguguuucuggacaugcuuacuagagcucuaguucucaggaggagccugaggacaauguacugucaggggacagaucauacugcaaaaaaguaggagcuacuaggcucugggacccuuccaaauccagcaccugagggcagguaucugccaaaccugagcuccauuuaacaaucugggccaggcugccaaagccacgggggcucccagaagaagauucagucccuaccuuagcaguuaaaaagaaugaaggguccccaaauacagucaagagcaugucauucaccaacaucaucagaugcuaaacauuuaaaagguccaaguggcagcaucagaaugaccaauagccaucucaggaccaacaguaaagucuguggccauccagauuccagagacgaugaggcccaagaagccaaagguaggccccagcccugacccuuaccaaacucaugguaccuccaaccuuuccuucuggaagagucugacaguaauaagaaaaaggggguagugcucuuuccacccucucuucuaggcugggcagcagggugggcagcaccaggcagccacccugugccaccuguucugccagcccccucauuggcaggcagcucuguggcugcucugcgcaucugccuccuccggagagcccagcucugaaguugccuggcuguggacagccuguuaccauggaaacugcauccuccauccuugccaucgccuucaucucaaagccaucgggagaacagagggaagggggagacagaggauggagaggagcaaacuguggcccagcuucaguucucugcccaccccuaccucuccacagccuccuacacagggagcagagcacuaacugcccaggccugcuucaaaccuggcccucccuacuggagggaagcaugaagcuaauuaaaaucccauugccugcucaaccccaaaucauuauaacacguucuggauccugucaagauucagacucaggagcggcagagaaggggcaauaagaaggcagaaggauaagacuucuguuagcccuugggcagggaaggggcuuaccgccaucccuguagucuuucccaggagacuacucuccgcucugugcucuguccaucaugcaggaaugagucuagugggaacuaggcauaaagagcacuggggcagagccagcgcaugccccucccugagugaccaggcagagagugagccuuugccuuucuagccaggugcagccucuagggagagagaggauagccaugggcuggcuccuggguccucacugcacagcaggagcugcugccccaaacagcaugucgaugagccaggaaauauuggaaaaccauuggaggaaggugaggccagcugccucucccucagcuagccccagggagcccuuggagaacagacugccaauggccaaggacaccagcucaaugccacaagagccugguauagcuggaaaagggagccuggauaggccugaaacccuaaucagcccugaaauaccacagcccaagaagccaaagguaggcagaagcaauaaccuuuccuggccauggggcuguuguucaucugacgaacucucaccuagagcagcucauucacacacacagagagagaccaucagauucucuccacagccuacuccaccuaacgggagaagucagccagucgcgaaaagguuuuagcaggaacuucgagaaacuggauucaggagaaucagccguuuagacacacccccagcccuucucuccaacccgggccguccagaguuggaaauaagaaagggagacaucacuucucagaguauccccucccauugugccacccuccacuaacagagacuaccuacccacaagugcugggagucaaaagacagagcaacguuccacaucacacaaggcaacagucugagggucaccucagcuaccucaggagcuugcucuucaccucagcuuaaguccucuugggcagaguuaaguaucugcccacacuacccagggcuccacaucugggcugguaugaugggccaauauguucugccaggacccacagguagaucuuucugaauucggguaggagguaagagggaggaccugaacaaucuuuguguuuugcuuucagaacaucagccuauguguuacugguuuuaguuagagguguggaagggcaaggaacagaagcagcuaggccaggguagaaacagaaggagaaucccaccugugggguacucaagggcuggauaugcuuagcuagguggcaaaugccgcaaacgggggagccauggguacaggccgaggacuaugucacacaucucucaccuaugcuccagguccacaaagaguaaguuugccugaugcauccuucuuaucucuugcuucccugggucucuuugcucacccacugcugaccagucuuaccccucugugccaagcuggacaaccaagcagccacacagccagccagcagcuguugcaucccacccgaggugggggcuucuccucacugggggaagugaugcgugcucauuuuuaauuacauagacaccgauaggcaggcucccgccugcacacagcgguccucacaacugggggcucagacccuggaggucccucaggcagccggucugcagugcaugugcagagugcucggggaggcacagcaggaggcugcagcuagaagacagcuagaagacagcacaguugugauuaugcugcccaggaacuuccgucgacuucccucuccaugcuccccucucaucuccaccagaccccggaauaguuucuagccuggaaccuaaaccuuuuugccauguccuggggaaccccaagacaagcaaggagagccuccugaaaaguuagaagaguacuuucuuccuucccucccugacccuccucacucuaccaaagccuggaaaaguacaaacaaacaaaaaauagucaggaaggggagagaagcgacagaguagccaagaaagccccauacagguauugagaccuuagccuagcuacuaacaaaugagugguuccuucugggccucagggucuccaauuauaagauaaagaagaguaaacaguuucaagagaagugggaacuaggaaagacaaaaacccuguuauuuaaaagcauugcaaauguggaaaaccacaaaagacggaugcuggaugagccugccauaaacaucaguaucacagaggucccugaaggauggcccacuucuuugugugccagucaacaaacuagaaaaacacaacaggagcaaacaccaagaccuucuuagaauuagguuugucucagggccagccccguagccuccugaauggcagaggaugacagaggagcugggcgggcagggccaggccugagcaggagccuggggaagacugcagggggggagagugugaaggagugagguggggagguggggugcugugccuggcaccccaggcugcugugccuacugcugcuguugccugaagacuuuucauuuucaccucagagccggcagcuugccacacaauuuacacuucugcucuucucccuggugccacccagacccuagcuuccuagguggcucacggagcgggugcuccauaccaguuagccauuaggaugugcuagugacugaggagcagggaaauuaggauuccuuggaagcagauaucugggucauagguccucauauguccugguaucuggguggacugggaagccuuggacuuguggccauauccagccuuuccuuccaccugggcacacauggccaauaugaaagccuagcucggcucuguacuagacuuucuggacccuguggaaggggagcagaguccagggagccuggaagugaguagcccaugggcauucagccagagcuuugggugggucagccacaggauaccauggaucuaccuuccaaauuggaugcuccuaaugauaacccuaauaccagagcuuacauauaguucaccaugucuccaagaugcaguguuuauguagugaaggaccuugagcccugcuuggcugcucagugcacacggggucaugaagcccagcacccaggagccaggagccaggaaacagaggggaaggaugggcggguaaguggggcagagaaaacaagagaggggaagagaaaggcagcccugauuucccagugccaacuggcacucugaccucucucuagcucucagagacacccuuccuacaugccuuguuagacauagcuucuccuuaucugagggugucaucaaagggcacacucauucuguucuaugaaaaaguucuucccucugaauucugucuccccccaccccccaguccaaaaucccaaguuuucuugagaaggguaacagaauuuuuccuugguaaguccuaucugccuaggaaagguguucucucugaacugguaaugguccauauaagcagugccauccagacagccucagucccuaggucccacaggacuaccaaacuacagugcccagguagguaucuccagagugcuggcucgcaucccaccccagcaaaggcuggcuuuugugcuuucaguccuagggggguggaaaaggguaaacccagagagccugaagagggcgaggucuggugccccacggucccuguauaccucagucuccacaaacaguucccugagggacgucaggaguaaagccuuugcaugugggaaaguuuucuuuuacuuuuuggcuugaucaucuaggaauaaagagucacuacuauccccagauaaguucugcuucucucacuaacuauccaguuaucccuucucaucugcuagcacucaaugucuggcucuaaacccagccuggacacugucacucagaagauauaucccuuggcaugauggcagaaacucagauaacaucuguggcucccugguacuugcaggacccacccaaucuuugggguauaaagucuggugcuccaccugggcacucuagccucaaggggauucuaaugucucuucuggaggggucuucccccuaaacaacauggccuauccuuacuaccaugccaaaauggcugccuguaccucucugugagccuauuccuccucucuccuuccuacucccagacauggcuaagcucccgacgaugggaaugagaaagacucuaggggcucgucaucuaaccuaauguccugggcuaccaagaguacccuccucuucgugcaggcgcaggccaauuagcagguuguggcucugccggcugaccuggcucuagagacccagugagagaagcccaggaacgaagcagccuccgucucaccgagaugaggagaucaagcccaaucgggugccuggagcagcugcuuccugccugagcagcugcaagaccgccauuaaugagugccugcugggaaaaugggaagacagagcagcacccucgggcuccacaguaacaaucagugcuggagaccgagcgucaagcugguacaaguuccuguccugucagacccaccguggcaccauuccaaguauagcccaaacucacaacuuuucugccucuugguuccaccuccacucaugccuggaugcagccacuacuucauccccugaccuuagguaaccuccccuucucugggccucuggcaucucucaagacuuccaugauuaucuucuaaccaauccccauccauaggaagggucagcaaauaauccugaauaagagaccaagcugaaugucaagagggccuccaccuucccuuugauuguuggugcuagggaaggagauggccugugugugcuaagcacaugcuccacgcugggccugacuguagccuagcuccuuauuaaagugaagcuaagaaccucaucacguuagcugggccaaggugguagcaaaggagaaagggagagggacagagggagggagaggggggggggggagagagagggagaaugaccagaucucaaauuucccacagggcucccucaucuggauucccacagccaggaccuaauaucucuccacucauguucuggacccagccccacgcacucacuaccucagacaugacgaggcaggcuaagaggacacaaauacaggguucggauccuggcaggcagaaccaaguuccugagugggcugcuugcuguaagcgccguccaguucaucaggcugacucgcguucacaagcaccucaccgugccgcugcuccugagauccuagcuggucaaacaagcacccaccacuuaaaaguucuguugucucugcuccagacagacauccuaaggcauccacucagcuccagucuccaaucagagugauacuucuccagaaacaaaugcuguccucuguucugccuacacugagcuacgcagcaucuucagaauccagaauaauccuguaucuggcaggggcagagggggaucuucccagggguucaacuaguacagaaauuuacaaaccaguugaggcucagaaauccucuucugaacaaaaggcuaagacaccagcuggauuaaagaaccuuuaggcacugcuauuacaguugaaacaggagaggucuaagcugccagccacagcuggguaccucagcauugucuuuaguucccaccacagagcagugugagaaguaugacuuccuucccacucuaagccccugucagagcuaccagucaauccagcugucccaggucucggccuccacggucccccucauaaggacaccaccuucuuuggcaacuccuccuguagcucucuuucuaauacuauagugaaaugaccacgugguuucuggggccugccuacuuccagccauugugugaacaacacuguuucccuaaacuugggagaagguaccuauguaauuuuuaaaaauaacuuuuggauauaaaagacccuagaggagaggguuuauggaauagauucugaaccuugcugaagggggaauagcaaggggcaggguagucagauggcucggucaggccaguuuaauccucucaaugaucccaaucaacugcuuaagucaggcaggagccauggaccaugcuaggaccuuucauaugcaaucccacacacagcaccccuauuucuaccauucagacugguucuacccugaggucaacuuggggauauugccauugcucuacacucauauuuagauccuagcucuucuguagucuuauaauuugaaggaauucaguuuccuccuguagcugcuugaagcugucuccugccugggacagaaggaguaguuuccuccugucccagagaccacagccuagccaagcugggacauccuuuauauacauagauggccacugguacucaggcagcccuuaccuaggcugucccagagugcucagucuggaggugucuaguaguauuuuugaagacguaaauuccagcuccuauagcucagucuacuagguugucaaucugaggaaggcuggccagagagccagaggcugucacacagaucacaaagauggguuacagccaucccuuccagaaaccaggggaccuucucuuuaggcuccuuguagugacccucaaguccuuugcugucccaugagaucuccaaugucccaccacagcgucugcagcagcagugagacugucaagucaauccuccccgauguuggcaacaugaucagauaagcccucuucauuccucaggagagugcugauggcugcugucacuucaucugaagaacauuuauagcaaucccauauucagagagagggggaaggagggggacguguaggguguguguguacaaagucaacaauagucagcuggggcugggagaauccuaagugcuggagucucauuaguagccuuucucugaccacagggcagugggaagaggcaggggugggaggcagccuuacucucuguuccaucucuugugcugagaggcacagggccaccuccuguagauuauaggcuauggccaaccaggcucuucuucaucuucccuucauuuuaguucuccagaaaccaaagucaggcuaaacacaggacagggaugacccucacacugcccuaaaccucuggcuuuuuaucccugcccccaccccaguaaaacagagcccagagcacagcuaacaggcucccacaggaggggaggggaaagaaagggcuuucaucaaagagaugacgucaaaaccagccaacuugugaagcagucagaggccgggaaauuuggacagaggugucuaaaaauaaacccccgaagccaggaaaaagcuuugguggcugagucgccugccaccauaccccaugccacacagccuguucugaggucuggaacccaggaaguaucucccugaagaugcucuuccagauuagccaucaagacuggagaugacuaagacaagaagcagcucucccucgagugcaaugaacgaugacccccggggucccaugcagagcggggcuagaacaucugugucucacuuccugccaccauaugaaaccuccagucuaacuuggacccuaagcacacccucucuagcagugcuccggggaccaucuuccagcucacaaaggaaaauucauccugucuuccacagccucugaccuacaccaccacagacaccucugcuucucagccauucccacagcacaugcagucagcaagcagcaccacuguuagucacagaaccaguuuugucgaaaaccaggggccucuuuuagauuccucaguucagugggaagcaacgcuaugcuuucaacuaccuuaagaaaggacacagccucuguaacacccccacaccaucucuccuggcuuuagccugacaguuuuaccacaaaauacaguguuaaccucugugcugguucuguguugcuaaaguuacugacuucagugucuuauggccuagacaaaguaauugucaacccaaugugucugagggaaggagugucaaccaccaagaagugucagccuaaccuguggguccccucaggacacucacagccccauagcccaugccugggaacaggguggcccaucuucaagagaaggcuucaacugaauacugacugguuguuagguuggcuuuuagugcuagacuggaucuaggacccucuacaugcaacccuuuccuuagcucucggguugucaaauaucuaaagaagugguauaaacaggacaagguuucagaacucuuguagacacagagaccccccauccaaucucuuccuacgaacaggcuguguugucaacauuacucccuuccaggucagaaaugaaggaggcgaagccugccauggauguucaaguccugaggguagggaggggggcacacugucaaagguagcaucaaggccagguugacacauggccacugagagcucuuuaggccucaaggaggagaggggcagggugaagacaaagacagagucaaucugaccacaccaggguucugaacaagcccuuggagauggucuaaccccaaguucuuaagcaucugaaagagaugccaaaagucucugccauacagccuagccacccuggugacugauccaugagggccuuagagagcugcucucuccaaaccagguguauuccucucaguucccauccaaggggcccgaguguccacccuccacaugcuauaccuaugucucaccuugauguagguauccaaggcaggauggacucggcgggcagccagccagauggauaugggggugguguaagggaagguagcuaugaccacauggcuaggugcugggaaggagaauaucuugaagccaaauuucugauagagguggaugagcucaggugaaggcgacuccucccccucacucaggaugcugccgacugcacagcggcacuucucaggaggcaccuguggagggaggcagggcacgggaucagggucaugcagaggauggaggccuucagacccaaggcccucugcuucugggcuaauccaguccuagaagaaccagagcuccagauaccaggaugaagcugguaauuccguacuaaaaucaacuauggcucguguguaugcauucuguugugggacucucauuuauuccuucagcaaacaagccaagcugcaaauacaacccaagagucauggugggaaaaaaaaaaaaagcaagaaagacaaggcaagacuuggucuccacccucagaagcccuggggaggaaagaacaaagagauaucugagcuaucacccucuacacagccuauuaaucagcagcucugcugaggggccuccuuauguuaccuucugugggucccagccucagagggcauccagcagaacugcuaagagcugagccuaagaucuggacucagcaugguccaauuagcuauuucccuccuaccccccagaggggcaagcuuuacuaacagagagaucauggaaagcaaggcaguggaacugaauagugggaacaaagggaaaagccuguaacagccuucuuucuugguugcccauaaacacaaguauguaugagcauacacaguagaacacacaggacagagcccagagcagggauuuuagcauuugcuguagaagaucaggaugugagauaaaaauuuaagucgaaauccccucuagguucacagauagagacagucaccaucacaagggcucugguccuuuuccccuaaaaccugucuacuuucuaaaucccuuccugauuuuacuccaaacucuuggucccccuccccaugucucccagccccuaacaaauguacuuccuguucuacaucucuccucuccugauccucuguccuacagcucccaucaaccagaggcaguugaguuuugaguuuccaacacuuccuaggacucacuucugccagcagauggugacagccuguccaaccucuguuucccaggucuauuuuccuaccaucuauguacagcucuuggacuaggugccuagggaaagguguuccuaacuccaggacauucaccacagaucuggaccuuaacucugcaccauucaauccuuccccagccaggcccaccgcccucugaugugacagcacacucccuaccugcacucauuuccuuuccugagcacuuccucagcaccacagucagucucacacacgugucccuaccuccccccuccagccccguucacgccugccacuaaucugugggccuuuccuagccccgacccacucccucuacucuggcauucuauccugccuuagaaucauuuuuggggagaccgugggcaccuguucagccucugaccucuacacagacccuagggggaaagcuaacucucaaggcaagcuucugaccgcauugcuuccuuggacaaaugacagcaggcagaacuuagaggaguuuuagagauaggcaauauaauguaguguuuauaaccauaaacagcuacaaggccggccaggagugaaaccugagucaugugaucccgcccaaguccuuccccuggcuucucagagcacaauuccuugauauuuccuuacaggucuuucauguuaaaagagauagcucacaaaggcuugacauuaaugaaaugccccauaaccacguuuggcuauuuguagcaauaacauggucccaacagcagucccucgaccuagaaugcccaccuacucuaacucugaagacagaccuuccccaccaucaucccauccuucagguucagugagacuuuguaccaccuuuccucuucugaaacuuuucccagauucugcugucuuguccucaaguuacugccauccuacucaaacaugucacugcugcaguaccacgucuugucucuagauggugcaccugcaccacuuacacccuaaggauugcauuggccauacaggcaaagaaguucccacccacaggucuggacuggccaagugacugacuguaccugcugaccccuauguauggcaugccaggugggagagaggguagaaaaaaauguuaacaaagguuagagggaaaaauggguguuaggacacuugccacuugauuucuccuuguuaucccuugccugccucaauuuggguuccaaggccucuccugggaucacuucagcaggucccauggaacuaccaacucaaugcucuucugacuccaaaagaugucugaacacacaacuagaacuucucaaugacucacaguucccaucuauggcaaaucuaaaccaaucaggccaggugugacacucaauucaccucaggaccagucagucaucagcagggcuaggacccagaugggccggccggcaaccacugaguacguggcagagggaggggcagaacccggcucuggcccagcccaccuugucagccucuucucccaccacacccccauauacacccacauggagcuauuugcagccaaacaugccacgucgucccaugcugccugccuuugcguaagcuacuuccucugccuuaaauguuccucuucgaccuaugugagucuucuuuaggaaaacucuaguccauccucuaagacuccgcucaauuccucuccucaaagccuuuugauauuuucuugggagcuaccccuccucucugacccuaaauauacacuaaggguacaggucuucuacuucacugcaauggagccuucucauuucucucccaccacgccaggccucacagagaagucuaggauacuacaaagaaaauuccucggguauguggaacaauggugcgggcaugaacacagcugcucacacaaaccccgcccacaaucaaauaaccuggcauaagggaaguguuccucuccaauguaauacagaauaauguggaauggaacacaagaacucucucugacucagucucucccaacuccacaguuaggucauuauuuguccccucccgacucuggccagugcucggacagcaguguaagagcacagcaauccuaccaccugcugaguaguccaagcaacgccagagcuagaaaucuguagaacuaggucaccagcaaggagauaugacagcuaugaagauaauccaggaaguggcaaagcugguccaauagcagugcuucagcccaagacaaaagccuacaccucuuauuugucuacuucuccuccuuacaucagacauuucuuuggagucccugugaccagcaaaagcuggaccagaacugcaccagccuggauccauauuagaaagacaggauaguggugggaccaccagcacucugaagaaagaaaagcccacccaggaaaagcaagcaaaacacccagcaaagccaagacuaacaaggaagaggcaggggcaugccaggcuucagcacaucucucaaggcauccagccuccucagccuaguacuagagggcaguuucuuggaaacuggaucuuucagacaugaguccaucuugaggcuagcccgcugccccuaccagagagguaggucuuugacaaccaucaggucacggugaagaaguucuucuugaugguacugccuggcaaagaccucagaaguguaugaacaggacaagauugauaucuuuaaggauuuagaaaagagaaauuaugucagcuggcccacuggguucaauagagacagccaacugcaagcccacaaccuauacagucaauaggaguagguauaugaucuaguaguccaagcccagaggcugcaucugccaauuacagauguauacugggccuccuuuacccagaccuggugaagcucaacacuuuaugccauguguucaacuccccugguaugugaaggaacacggggaagcaaccaguuggaauaugggcugaugccaacaacuaagccagaggauaaggcucauacucagaaggagggaaggggucauugggacucaacucuaacagagguucuggagcuuucugggagaugccaccuuuagcuccuuaggaaccuuccuccugcucucagaagcacacccuccugagagcgggcaccugacacuugcugcuuuccacacaccaaacccaaauguucuccucgaccuuguuccugaggcccaggauaccaaguuagcaaaugucacacagggaggcaguguuggggucaggguucaaaccuaagcagacaagcucugaaauugcaacauccaccccgcaaucaccugggaauuuaagaagucaguuccagcgaugaagacacaacagccuuucccuguacugugucuccucagacucaggcccccuggagcaggugcuccugaaggcacaaaagcucggugguacaaggcucacagacagggcugcugucaaaugcagguaucuaccaggagacaagcauugggccuuaggcucaucaagcugaugccacaaaauuaaaaccugggauggggcgcgcgcaugcgugcaugcgugcaugcguguguguguguguguguguguguguguguguguagagauguauuaagcaugaacaaggcucuggguucaauauucagccccucaaaaagaaaaagggcccaagaucagaaggauucuuucaucccuguuugauacaugagacacacucaccaagagaccaagugacucacacagaaucacaugcggagaagcagcuggagccuugacucagaccuagaagggugacuccagaguccuccccucacuccaccucccaagggcaucucugcugggcagaggagcucaccuugcgagaucucucccacguuuaacuuaccacagagcaauagucuggcugcaccuggcagaaaacauccucagguuaaucagaguagggacagccugggccucaggaaacagcaacccagcucguauuuccacuucucuguugaggaggucagcccugggaaaccacccuauuguccuucccgguucccccugaccuacaugccguaagagaagcuaccccaaaccccacugaguagugaggaccgggugcagaacucuuaaaacucucaggccuagacuugcucauucuaggccuucauucucaguggacugauggaaagagagaggcagaguauuuuguaagcucugaaugccacccguuccuccaucgcuccaugccugggaaaagcacggugcuugguaguaacugugagcgacagacccccucuugcccaggccagguaaacacaacuagcuaccacacccucaccucccacggugguagcugggcagggugcagacguagcaaacagcagaggaguagcugugggaggugggacaggaguaggagcggcagauagacguacaggaaugcugacagcaccuagcugcaagggccucugugcgcgggccacaguaguugggaagaggugaggugugcaggguccucccaguccuucauuucccuccagcacagaagguucccagaggaauucaucucagcagaggaggcucaagucaguuuucaacucuccaguauccaacuuagaaacaaggcugaggcacaacacugcuugccggccaggaccauucucuagcgggagguagugugaaccauuagcuaugugugaaccauuagcuguggaaagcaggcuuuggccucaagagcucacuccuacccaccagcuuccuugaagaggaaacggccuguacuccaugaccgcuggccaacgaugagagagcaagaccugggaucuacguacaggcugguucacuuccugacacgcugccuccauguuuacccccaacuauguuaaggcuuucggggucaagucagaacagaauccuccugccucacagaaacugacugcucagaacucaucguuuccucccaugcaagauuccaggacucgggucucaagcggcaaaugauaugaaagaacuuacagcaaaugcuacuguccugccuugagggguguugcugcuucugcuacuguccagacccauaucaaacaaaguggaacuucccuaagacucucucaggaaccauccucccccugcauagcuuggacuaggaacggccaugucuagggagcugucaguucacaccucagcagagugaacaacaucuaaaagccaaucucuaaucuuaacuacccacuguucuaccugaaagagcaucacuucccgcccacacucacagcggagaccaucugacuccuguuguacuguguuuacaggaggauuagaggugguauauaccuaagaggucagccuauauccucuuuccccacaucuacauccaagauggccacugguaguagaggcaguuaggaagugacaaacacggauucucaacuuuucuaaggaaggaaacaggaucucaucucuaguaccuccagguuccugaaaccuucaucccaagugguuuugcagccuacguguucagcaacuauaccucguggucuccacggugcccggugucaagcagagccaggacuuaacuauuugacuaaagcaaaacagguuaguaccucacucauucucucuucacccgucuccucccccaccuauuauaccuacuacaguaccagaauacggaccaaguggucagauagaugggugugaaccccuggauccugggaguucacgauucccuagaccuuugccacuggucaagacaauaucuagcucaggagcacaaagagucccaagugucgcugugccaccccaagugcaugccaggauaaaagccugcucuuguggcuaucuucuggagggaucgaauuagggaagugcagagucuaaguggccacuuuaaccucuucacucuucuucuaggcugaccggauauccacugcaggucagucaugagagauucaccacccuuuccuguuaaacaccuguugagagccaugugcuggggugcaugucucaugucuauuacugacgagaauccuugccagccuacguaugaagcaaguaagcauuuucucaggauguugcagaggauaaaacagaagugcagaaaaguugugacgugccuaagaucacacagcaaaaaguaauaagacauaaccagagccuagacucccagcuuuaaggcuauauauacucugaggacucucuucucugaaauuucccugaaggcuuccgaaacccccaacucaaacuucucuggacacugaguccggggucuuguugcggaaucaucuucauggagcugacucauguccagagugcaggugcagggcaggacccggccgagagggagaagcaggacacccuuauuuauuucaccucgugcuagugucccagugaggccugucugcagguagucuauaggguucguccacuugagcuuuccaggcaaagaaaauccaggcugaggaguccaaauaaaaauuccccagggcuuaguuuggcauggcucaaaaauugaggcugaacagcccuuggcagagcugccggcccagccagaugugggcagcaccaccccauagcacggcaggaaacuacauuggcaagcccugacucacuguaggcuuuaguacauccagacgccuacuagaucccagcgaugcuggauuacucugacuccagcauccucgggcuuuccgaguagcucauuuggcuucgcuuggcccucucccaacagguagcuugaagucuacgaaaaagccugccaaugggugggagagcagcaucccagagaggugggauuccaagccucaugcccaaaaacugcccucucaguccuccagggcccauagcccuggcaugagcugagaaaugaaaaguagacaaaaaggacuuaacucuagagaaugggcagauuuugguuggcauggccuaagagcauggccucaaauggagauaggagaagaaagacagcaaaagacagaaccaggguccagacagaagcuagggccuacugcaucagacauccuugaauagacgugagccaaggggcacagaauugggcaagugcaaagccucaggaugccuacacacagugguuaaaucugcaaggggcuuuaagcuuugagagaagguaacugcaaggcuagcucagauuccccuguccuuacucagaaagucaaagcucuccuaccccaacaggcccuggcccagguccgucaaagaggcagaagcccauggaggcuccuuaccguauggggguugucauaguagacagcgauggaacggagcuugggagagaugcugcagcucucugugaaaaggugcccagugucaccauaggaccccacguggaacuuguaggccacaguuauguugcggauugggggugauccagcgcucacugucaccccagucagcaguccugaauaaccagcaaaggccagcagcgucagcagcaacagcagcgucagggccccaaucaggcccaguaguaggagauccggcaugguucuuucugggacucccucucagcaccccaaggcagcugcaaaggagacagaagggagaggaggcugguagccugcucuaacccagccugccugccaguccugccuuagugcucuggcccaggauggggaggggccacagguauuuacacacagugaccuagaagggaacuacaaaagaugacugaagccacaagccucuuuauuucuuaaucacagucacugaagcuccuggcacagcucugccugguacuagcagcccuguuuauaccuggggaaacugagucauacuccaggcccugaccagaaaggaaauaucccccuccuuuuccucuuccuuccuguaguugaaccacacugccagcccaacacccucaagccucaugaacuacuggagagagagagaggaagagaagagaagagaagagaagagaagagaagagaagagaagagaagagaagagaagagaagagaagagaagagaagagaagagaagaaaagagacaccugacagguguggggcucagacacugauuaacacacagugugcuguaaggguaaggaacgaaaccucagggagaaaugagccacaggaagagaauucaugagguuuuuguuuguuuguuuguuuuuuguuuguuuuggguuuuuuuuuuuuuuuuggccccauuuggucucuagggaccucucuuuccaacaguguagcuauccaaaacuacaggagaccagaucaaaacagcccgagagaggcaagaacaaaguucaaccugggcuuccaggacuugaaccaccaaugcuaauaagcuucauuccacauuugccagcccacaaagacuagaaacaagggaagaagaagaaaaggccguuaggaguggaaacacaagagagggaagaguaggaguuacuccuaaugacagagacagagagagagucuauaggaguaagcccaggauuaccagggaagccagugugaaacauucuaggccgacucuuacagagggugucaucugaguagcccagggucagagcacacauaacaguuaaaaagagaaacauaaacaucaccaggaaaacauucuuacucuagauacuuaaaauuccuccuuaaggagcugcagguaagggugccugaguucccacacaguggggcaggagagacccccacaccacucccuuaaguuauucccugacccugcacaccacccacauauuuuuuuaaggggcuggggagaugggucagcaguaaacaacacuggcugcucuuccagaggacucggguucauuuccuagcaccuacaugguagcuaacaauugucuguaacucuaauuccagaggauccaacaccacaggcuucaggcaugcaggugauacacagacacauaugcagguaaaacacccaccugaacacgaacacacaaaauuaaguguaaaaaaaauuccauagccgggcaugguggugcacgccuuugaucccagcacuugggaggcagaggcagguggauuucugagcucaaggacagccuggucuacagagugaguaccaggacagccagggcuacacauagaaacucugucuugaaaaaccaaaaacaacaacaacaacaacaaaccccacaaaacaaacaaacaaaaauuucauuuaaaaaguaaaugguugccgggcgugguggcgcacgccuuuaauuccagcacucgggaggcagaggcaggcggauuucugaguucaaggccagccuggucuacaaagugagcuccaggacagccagagcuauacagagaaacccugucucaaaaaaccaaaaaaaaaaaaaaaaaaaaaguaaaugguuaagccaggcagugguggcacauagcuuuaauccuagcacucuggaggcagaggcaggcggauuucggguuggagaccagccuagucuacagaaugagugccaggacauccagggcuacauagagaaaccaucucgaaaaacaaaaacaaaaaguaaaagguuuuagagcugaaaagacaaugcuuuauuuagcccuacagaaaacuuagcucuauugauauaugaagguucugaguggaagauaugcuaaagucuguuuuuggagucaaugagcacacagaacuggccuuacaaagaagccaacucuggugucaggacacucccaccggucuccucaugcacccuguaggucugccuguaagcuucauuaucuucucuguuugcucucucugcccuacucaucccaccuccgguugguuucauucuucucuucucugauaaugaucauaccaaaucuuccacucauucuugauauaggcuaggcacugucugaacccugaaacucagcuauuucacuaauccucaaggagaaucuaagaagguagguacacaucaggaaauaagugguuggaggucaagaugcuugcccaaggucacauagguauuacacugagccaccuggaccaaaacacaggccaugggaacccaacagucuaaccgccguucacugacaguuuuucccuccucugguuuccaaaaaggcacuucaucuuuuggcccucgcuuaucucaaggcuagaagcucucaauaucuaggccauagccugucuugggagugacaagcacugccacacacuucuguuuaagggaacuuagcucccaaccugucucuuccuuccacuucgcaaacuguucagaaaaagggggcuauguuucugcccauccccagagcuuuggucagccaaggaagaaguaaggcaaauuuccccacacccaauagagaaaggcgaggacaggggaugggaaggcucaccgaaaaagucaggcucacuuuuagcaacucauagcauccaguccagcagggcuccaguacuccggcgcuaggggggcagaaaggaacagucaucccagcccuagacacaggcagugagcaaagcaggcccugaguaacccuguuccagggaaagcccacagaacggggacccgucuacaaacgcgccaaccccacccucagaucgcgcggggggggggggggagucaggccaaguccagcuucacaacgucaugccuaugaucuucacugggcccgacuaccacacuuggcgccaacgcaaccccugcugcugaccuugggcagcgugugcccucucuugggccucaguuuccacuaaugucagaggugcaggguagagaugacuuccuuggcccgcaagcgucggaguagggacuaggcgcaggcuuccggaggccgcucacgugcgcucugcggagggccgggcccuuaaagggaccugcgccggcgaacuugggugcuagcagccggggggccuuggggucgccgcuucgugcugucggcuuccugccgccccggcucgcuucacggccuccugcaccucugcaacuucagacacgcuaaaguuuggagcggcgacgcgacgcgcggccacaggcagcgcugcugaaaggugagggccccgcccguuccccucuagucccacggaccccggacguucccgcacccagcaccgaggcaggauccgcgccgagaggucaggaccgccuccccgucgcuuucaggcccgggaagcaggcugggccagcagugagucagacgcggggcagagggcggcucaggccgcggggagcaggcgggaggggaugagggggagccccggcagacaccccgucgggaacgccucgccucuggccccgcccucaccucagcggcggccccacggacgcggacgggcgccggaggaagauaggggcucagucguggagccugugugcgcuugccccucgcgcucgcuccgccccuuucgcggcgggacgugaccg

SEQ ID NO: 5292 - RNA, 1461 nt, Mus musculus
gguucuauuacagccagcgaggcccggcagcaccuacagaagaugccggaggguacauuccuaguucgagacagcacccaccccagcuaccuguucacacugucagucaaaaccacccguggccccaccaacgugcggaucgaguacgccgauucuagcuuccggcuggacucuaacugcuugucaagaccucgaauccuggccuucccagauguggucagccuugugcagcacuauguggccuccugugcagcugacacccggagcgacagcccggauccugcucccaccccagcccugccuaugucuaagcaagaugcaccuagugacucggugcugccuauccccguggcuacugcagugcaccugaaacuggugcagcccuuugugcgcaggagcagcgcccgcagcuuacaacaucugugucggcuagucaucaaccgucugguggccgacguggacugccuaccccugccccggcguauggccgacuaccuccgacaguaccccuuccaacucugacugagccaggcacccugcucugccucacacagucacauccuggagggaacacaguccccagcuggacuugggguucugcuguccuuucuucagucauccuggugccugcaugcaugugacagcuggaccagagaaugccagcaagaacaaggcagguggaggagggauugucacacaacucugaggucaacgccucuagguacaauauggcucuuuguggugagccauguaucagagcgagacaggcaggaccucgucucuccacagaggcuggaccuaggucuccacucacuugccugcccuugccaccugaacugugucuauucucccagcccugguuucucagucugcugaguagggcaggcccccuacccauguauagaauagcgagccuguuucugggagaauaucagccagagguugaucaugccaaggccccuuacggggacgcagacugggcuaggggacuacacaguuauacaguauuuauuuauuuauucuccuugcagggguuggggguggaaugauggcgugagccaucccacuucucugcccugugcucugggugguccagagacccccaggucugguucuucccuguggagacccccaucccaaaacauuguugggcccaaaguaguccugaauguccugggcccauccaccuguguauggaugugcccacuuuuuucucccaagccucuuuugggaggcuggguggccagacagacaggagccagaaacacaagggcucccacucuucuccucacagggcagcaccauggcuucauagagcuggcuucucuauguugugccccaccucaccccccugccgaggggcgugugcugggucgggaaguggaugcuuauccaagggccgcagauguagcucccuuguguccguuuccugccuaggaaguugccugcacgugagagagg

SEQ ID NO: 5293 - RNA, 1461 nt, Mus musculus
ccucucucacgugcaggcaacuuccuaggcaggaaacggacacaagggagcuacaucugcggcccuuggauaagcauccacuucccgacccagcacacgccccucggcaggggggugagguggggcacaacauagagaagccagcucuaugaagccauggugcugcccugugaggagaagagugggagcccuuguguuucuggcuccugucugucuggccacccagccucccaaaagaggcuugggagaaaaaagugggcacauccauacacagguggaugggcccaggacauucaggacuacuuugggcccaacaauguuuugggaugggggucuccacagggaagaaccagaccugggggucucuggaccacccagagcacagggcagagaagugggauggcucacgccaucauuccacccccaaccccugcaaggagaauaaauaaauaaauacuguauaacuguguaguccccuagcccagucugcguccccguaaggggccuuggcaugaucaaccucuggcugauauucucccagaaacaggcucgcuauucuauacauggguagggggccugcccuacucagcagacugagaaaccagggcugggagaauagacacaguucagguggcaagggcaggcaagugaguggagaccuagguccagccucuguggagagacgagguccugccugucucgcucugauacauggcucaccacaaagagccauauuguaccuagaggcguugaccucagaguugugugacaaucccuccuccaccugccuuguucuugcuggcauucucugguccagcugucacaugcaugcaggcaccaggaugacugaagaaaggacagcagaaccccaaguccagcuggggacuguguucccuccaggaugugacugugugaggcagagcagggugccuggcucagucagaguuggaagggguacugucggagguagucggccauacgccggggcagggguaggcaguccacgucggccaccagacgguugaugacuagccgacacagauguuguaagcugcgggcgcugcuccugcgcacaaagggcugcaccaguuucaggugcacugcaguagccacggggauaggcagcaccgagucacuaggugcaucuugcuuagacauaggcagggcuggggugggagcaggauccgggcugucgcuccgggugucagcugcacaggaggccacauagugcugcacaaggcugaccacaucugggaaggccaggauucgaggucuugacaagcaguuagaguccagccggaagcuagaaucggcguacucgauccgcacguugguggggccacgggugguuuugacugacagugugaacagguagcuggggugggugcugucucgaacuaggaauguacccuccggcaucuucuguaggugcugccgggccucgcuggcuguaauagaacc

SEQ ID NO: 5294 - RNA, 11269 nt, Mus musculus
ugggggggcgcuaacccugggucaauuuucugguacuugugugugggccgggcgagcgugcaugcccucugguagguaugcaccagagcaggagauccggaugggaaaugcauggccgcaacguugauuuugagacagggauggcccucucccucgcuuucagggguggagagagggcgcgcuuauaucguugauaauguguuugcggaucugggauggacgcugugucgaggcuuggagauuugguuccuuccguagcuggguacugguggacccaguugcgucaggaaucuagcagaaccggauuuguguucugcccgggguauuuuauaccugaguuaccgugggcaaguugcuuuccucuucuggagcccugucugagaggauguggcaguuagcagguucucgcaaaucuuaguuuggaccuuacuuaguuuggaaguagaggggaccacagauuuuauguuuucagauaacuuguuuaugcuaacuuaagcguaacauuguucauuauggguuaaaauagaggcaacguuucagcuucuaaacaauaaggaaugucacaagccaagcucccaagcacggcagucuccugccaucuguuagugagucccaagggucuuccaggccccugauagucguuggucaaggcaccacucuccagaaagcuaguguuauuuauuucucccacauuaggagcaaacuggaagucagaaacaacggcucaacugcacucacucacacuggggucugacauaggucuaaccuacucccaaaccuacaccuugacucuuaacaggacagagcccugccaguucaaccuaccuaugcuaaaaauaacaaaacguuacuggccaagacaagaaggagucagauagcuggcuggggauaugaauauaguccaggaggcgacagacuaaaaagcacacccuuuccuggcacauuuugagucuuuuuccacauccuucuuuaggguagcagaaacaucugagaaacaaaacagagaacuggaacccaugacugauucuucacccagcccagcccagggaucacccugagccccuaccucagugcagauagcacaagagagacucaggcacuuggaagccuuucuccaagaaugaagcucuggggacaaauacuuuggacccuucuaucuguuccccgaggaaggaggggaguccuccagggcugggccuucaacucauggaagacuuauucaucccugacugggccguugagugccacagggaugguuaaucacuggacacgggucuuugaggaaagagguaucccagaggcccgggaauccagugaguacaucguggcucauguccucggagccaaaacaguuaaguguaauguuagggaggacagggagagggaggagggaacucucuggggaauagauagugaaagggggguuguuuuauuuguuuuuauuuuguuugguuuuaauuuuugccucaaucgggcugcuuaauugagucgggugggauuuugcugaacaaauguuucaggcagacauguauucauucauccaacaaacuacugcaguguguuccagguacuguguguuccgggaugauuaaguggcuaguguugaguugacagacauuguccacacaaaccugggugugugucccuagaccaagggagccagccacucacauucuccaugggaacaguuucagagccugaaaccagcacuuuggaccaagccacugaccccucaacaauuggaaugcauccaggagcuauguggccguagauuacagagguaagcacccauggaccgauccgaggacucuacagagauccaucuuucaccgguuccaccaaauuauggccagggaggaguaaagugucugaggucgagagggaucuguugggguaaggagguaggaggagagggacugguguuguaaauugaaagaagggaaaggcuagucuguuuguccuaggguacugcagucaggacccugcugaauagccuuagcuacauuaguccucaguugagcucuggccuuauucauccugguccugguccugaugacucccuggauacuccuccugcaggaugccggugcaguauauccuuggggagugggacuuucaggggcucagucugaagaugguacccccaguguucaucccucggccagagacagaagugaguaucucacuaagacaggaugaagaugagaaaaagguucaaggcacccgucuugcuccagacuuccuccagggggcgcucgggccccauggcugccauucacagcaccuuucacacauaagucuugcuggcuagguugacugagccaugauugaggauccuucuugcccccucccuuugacucucuuuaaauuccaaaccucugccccagccucagugaccagaagugacagagaaugguucaaguagugcucaacuuacuguguucauuagaagcuauccuaugggcccauggcagacucaacccaugggaaauaaguggccuucagcaacuuagagggcauggaggaaauaggaggggcucugcuggaggccuggcaugagcaguguggacuuacaggugauugcugucuacucuggacucagaugauggacugucaggccuugcugucugugacuugguggucuggucaggugauugcuugugucagucccucagaugacuagaacuggugguuguguggcccaugcgugcugccccuuggggacacacccugaucuuugagagauguuuuucuguuuuucuuggauuuccccugacuuuguugauggcagagcugaaagcuggaaaguagacucugggguaaagugggguugcaugaggggaugcugagaaaaaucagagggcacuagacucugaaaaagauugauuucuggaaagauauccuggcucauaaacauucgugggaaaagucuguccccuuccaccuuuacuggguguggccuuugagcugccugcguuucauccuuuuaaucuccaucccuugaucgugaacccucugaucugucugaagagauggcuuagugcuuaagagcacugacuucucuaccaaaggacccagguucaauucucagaacccacacagugguuuacgaccauuucuaacuacagucccauaggauccaaugcccucuuuggccuuucuagguacugcaugcacauacauacaggaaagauacuauauacacauuaaaaaaacaaaaccaaaaagccaaaucuguugauccccugguuuacccccuuaccguguggcaggacugggagaagucacaggguugucaaggaaggggacccacaggcagcuccugaacuuucugacucuauccuauuuagaacuggcaugaccuaggccagggacagauacucuaagcaugauguggccugucaucuucaggcuuuuaggagauugcccgguagcuucuuccaaauaugugaccauggucaggagaucacuugccauccucggauacuguuaagguucagaacauagagggacagcuaucaugggacagcuaucaugggacagcuaucaugguggccuuugcaucccuuggagcugaccugguaucugaguguggggugugggcuuucagcuccugugugacccacccacuugaagugggccugggccaggaaggcagcuuugcugccggaguaggggggagugaggaugcugugguuggcugggaggccaggucugccucacuguacagacauuucugagaacucaucagguuugcccccaggggaagccacaucagacgggagugcuuuacuaagaaaucaagaggacguggccugugguagggaguggagagaagggacucaggggaguggggucacagagucuggagucucuguccaucaaagggcgguuuuugaugaugggugugaaagucugaagugcagaauugcaaguggcuugcggccugaugaguuugguuuucccuaggaggugagaggguggugaggccuccgguguggugauauauacagugggaagcccgagguccgggugggagccauuccaucuccaucuggugcugugugacuguguggccugggagaggcucagugcuguaacuguuuuagggagucagcccagcagggauaggauccuaacacagggugugcaugcccuuguauccugcugagaccgcagggccaccucuguaggaacugugcagucccauuuggagcaguggccccagggaaagccaccaacugcccauucccugucucuguccuauauuucucuucugucauaccauguuuugaauucuugcuggauucagcuggaacagaugaccugggucuguggcuagcuuggcucagagccaacagcuuuagguagaggaaaggucuucacugcauaagaaagaacuuucuagacuuccuggauguggucucaacauagcuaguucccacacagucaccagaugggccuccaaugaagugagcuuuccauggucugugguaaaaggaaagaaagaagccaccgucugucagccucacacccugccccagcuggccauuuacauagauggugugugugugugugucugaggucagggaugccucugugagguggcuagccagcgugggcuggcugaggggucauccuccagccagagugggccauuuguggccaggaaacccguagaaacuuacaccccuaacacaggcugucauuuuucugccuuucagccugcugccugucccacagccucucagucacagcccuagauuacaaguucuucgcugaucauaagcccagcuugcugcacacacccaaguguucuccacucccggcacaggacugaaccaaguuuucucucccauggcaguagcucuuuaguaccaaagggaccugacacagggagggcugguccagcucuucagcuucucucugccugggacuuguuuccuuuggugugaaugaacaucgccaccgagauucgggcccuagaaggccgaaugcuuuuuuggggacucagcuuucaaaggaaagcaggcuugggugaccuggugcuauuugcuccccuagaccuggcugaugggccaaccccaagaucuucucaugauuuaaugugacaagagaggcaaacccaguccuaaaucuucaugcagguuagagauccuuggguuauagagaugcaacuggucugacagaaaugaagauguucugaagagacagaugugucccucauuccaucagacuauugaaacgggaccccaaagaaguaggaauguccagagaaaucucaugcacuagucagagggagagcuugccucccaccaagagagacaccacagcucucaccugagagcaugagaaggcugaaacccagauaacagggucagugugggcaggcccacaccguagccuggaccgcucggcugcgcacauccuugccugccacuuaaaucuugaucucacuucaggacuaaagacagccuugaaggguuuguggaucucucuguccuucuucucaguguagccauguugaauaaaucuccuuucuuccaucuccccccuccccacccccaccuucugcuuucuacuuuuaaccuggcucuuuuuguugacuuauugaggaugggugucuaagucugauuuggggcacaguuuguaaccuccaggugugauaacagacaccucacaggggcuuacuucuucaaaguggaucucaccugcugcuuuccucccaguuuccugagccuugaaggggccucugcucauauccaggggauugucuuugagaagagaccacgcugcccucucccugcuacaugcuuggauucccuacuguucucuggguaaaaacauuucagccguggggcagcagccaccuucagccuucacucccagcucccccagugacgaugaccacguacagccugugugggcagcggaccucaagcucucugcauucaugcugauggugucuaaaguguucccucuggauguccuggguaccauccagacaggcucuuaccacauggugcuucauuaccauguucaguuugugccacagccaccugcaagacuugggcagggcugugucccugcccuacuaagagaauugcuuguccuuugggccuaggaaucuccugggaacuuuucacccucagcucugugagaaagcugaggacacaccagccaccucuguuuuauuucuauuuucccccaugguacugggguggaacccagggccucacacaucuaggcagugcucuacaucugaauauagucucaacuccaagccugguucuugaccacugugaaccacaguucagacgccagguagggccaugacccuugaguguuagugucuauaugagccagugcugaggaaccaacagguuaauauaggcucuagaagcagggccagaccuagggagacugggugucaaauagggcucccagcauuucugugaguauaaaaugggaagaugucuggaaggcaccggugggguguauugugcguguaguugccgaugauagaucaggucugugcuucugauuacuauuuacuauguuucuaagaggaguacucaguugugcaaauggguaaacugaggcacggagggacagaaugacccacccagggucccugcugaugugaagaucauuuggcuuuggcucucccccaccugucuucaguaggagccaacugcuuggacuuccuuguagaggcuccucaggagcuaagaugaucagcaccuagucugaucgacccucuuccuuccaggaacugguugaauggguuuuagaggaaguggcccagaggccccaugcagugagagcccaggaugguccccucauucuggaggugggcuguggaucaggagccauuacucucagccugcugagccagcuccccaagguaggcugucucugcaucccucuaccaugccuugagccauugagauggucccuucugguauucugucccccacaucccucuguaagaagcauugagggaaaguggccauauaaggaagaugugcccagcccagcaugaucacagccucuaacuuccauccuucuccaucuggcuagagucugaccacaggaaaacuuuguuauguauuccuuuccaagagggagcuaggggaagauuguagacagacaucucccagaaauucaccucucuuccuuuguucuuggggcagagucgaguuguugcuguggauaaggaggaagcugcuguuagucugacccaugagaaugcucagagguacacgggcuggaccuuccagaaggccagcacuggggagguggacucugggaccugggccugaccuuuauucuaguacaaacccacuaguguuugacuugauucucgagggagagacacaaugaggaagccuggcaauggucccauggguuugcgagugguggacugugagccgugguuaugcugagccaagaagggcucccuuucccuccugguccuuguagccaagguuugcacccuaugcucagcacuaucuccccaucuccaggcuucagcugcaggacaggauccggaucauccaccuugauauaacuucagguagauccccuguacaucuuggggugggcgcugcugcugguggugaggcacugcagaaaugggguaagguaaggguuucccaauaaucaaaccuguggcucaucucacaccagcccugcugagcuugcugcgggcucacaaggugcuggugucuccuuggcugacccgacccaugaagggacuagccaugagguccggccuuuuucuccucuucucuccucuccucuccuccccucuccucuccucuccuccccuccccuccccucccuuccccucuccuccccucccuuccccucuccucuccucucuuuucuugucugucuuucuuuuuauuucauuuuuuguuuguuuguuuguuuguuugucuuucaagacaggguuucucuguguagcccuggcuguccuggaacucacucuguagaccaggcuggccuugaacucagaaaucugccugccucugccucccaaguacugggauuaaaagccugugcaaccacugcucaaccacaagcaauaagggaucuucuggguccccuaugccugauaaauuugacuaggacuuauuuccugggaagagguaaacauguucaaagcaaagcaguugagagccaaguaugguggcagugaggauuccugugaacucagggucugucuggggaacauggugacuucuagaccagcguaggauauaagcagaacauccccaaaaaucaaaauaaacagcaacaauaaaggaacuuuaggaccaaaaugcacguguggccuccugcccacauggccuggaugaggugguccagcagcgccuggucugugcagguuuugcagugucuucagguuuccagcuccaauucugauucuuuuguuauccauggagcccccaagcguuguaugaguguuagacaccugccuuagcaucugguacaagugggauccaaaagcagccauaagggguugucugagggcagcaagucugcccucccuguacauccagacuauauugguuguaaagcagagaaugguaaggccaaggggcugcagagcugaggaacccugccuuugccuuugcaaucaaggagggcuuacuggagguggcacuugaauuuggcuuaaugaggaggccuugucagggaggagagagagaacauggauauucuaggugaacagcuacaugucuaaacauguccacuccggccagccugcuaacuccggcuacuaauccucgagucuggcuuauuaggucuaaagagagauuugaagagagggacuaccuaagggacaagguggcaagcggaucugucaccuuucacacacuaugcauguaucuuccucuuugcucacagaggggugcugcacacaccuuuugcccuggagccccuuggacuugguggucagcaacccucccuacaucuuccgcaaggacauggaacagcuggcuccagagaucugcagguacagggugggugggacagcagagaagcucuagcaggauugguugggguggaggcccuucuaucaggagaagauggugcaguauggaacagcaggguugagggguacacuucagagccugcagccuuccuggggaagguguuaccuuugcgcccugaccucuggaggccccuagccucucggaaccuccguuucccacuuugaaagaggagugagugguagcgcuugcgggaccguggugaggacuuaguguugggcacagcgaggccgauagaaggugcucacagggaugugucacuuuacacaagaccaaggccuagagagggaagacgcccuguuaaaggucccaccagggcucggugggaaagccaguacugacgccuccucgggcuguggaaaagccauccuguguucacauggacagaaaacccaauguaacuacccugucucuaccuaagcguaggugauccgggguggagccggcuccucguuccugggcucagucagaaucagcuuuaaauacccucagauggagaacaggagcugccuugugagagagccccaaggacuuugucaguggagucucagugggacuccauccagcccugcucuguggggugcugucugcgugagagaugaggggucacauaggaaccacuugcugagggauccucagcuuaccucucagccccgagucugagucccagagggcccguuguaaaggccugccuggcuucucagcaccugacacacccucccccagccgcucaccuuccacuguuugcccauucaguuacgaagaucugguggcccuggaugguggugacgaaggcauggacaucaucacccacaucuugaccuuggcaccccagcucuugaaugccucuggguauggagaccagccuccucccccuccauuguguaaucgacaagccuuggcagucauugugcccaugccucuugcaggccagacaaccuggaaguacagguccuggcccugccucguugagcugacccauuucuccuucauguagaagcaucuucuuagaaguagacccaagacacccagagcuugucagcaguuggcuucagagccauccugaccugcaccuuagucuugugggaguccgugaagacuucugugggagguaagaccguucucguagcuguaucacuucugugugcucucccagcccucaccaggucacgugagcauuccucagagcuuagauacucauucugucuccucaggccccgguuccugcauguccagaagucugcaccauagcguggcuacucugugaacacccggccaggauucuagccugcuggguggcuggcuuacccuguguggaaugccgcccaggggaaggugaacagcgcuguccugggccccuggcacggccaugguccugugauuccccaugauggauguuucuaggagacuuggaaagaaggauggaguguucuuccuggggcagcaaagaacagagacccaagagcuggguuuccagccuggcccugcccccucuguguagcaggcuacuugguguuccucuuggugaaauugcuauaaagauguugggaaggauggcuaguaaaguguugagagagcaauaaauggugagccaguauuuuguuauuaacauucaugggcccucguuccccaugcaggacuaggccugagagccucucccuucugcagcaagucaagccgacugugugguguaaggauaccaggugauagggacaggggauggggaggcucaguccuggccuuggacacuguagggccugcacagaauagcccacucugguuagcgucauccggaugcuccagccugggaaugccuacauucucuaccuugacugggccuguguaggacugugaaaggcagccugguuccugguugagcuaaaguuggaaaccccagugauccugaggaacggcaggcauuuugccugguucucagacucuaggcuucagacaggaggccacagcccuccauagauuuguggccagcagucacguaagggcaacgcccccaaaccccuccacagaaggcucaagacagaucuccauuuuaauaagauacuuaaaggccugagggcuuagccaauaaacuccccuucccagacacuccucccuacaaaagguauuuaaccucaggccagcccugagaagugggguaugguuuuauucauccacuuucugccaugacaauaaacgccuuaaaacca

SEQ ID NO: 5295 - RNA, 4766 nt, Mus musculus
ugcaucugauaaagaugagagggcugcacaagguggucugacggagcccaggagccagaccucaaagaaccgcuuuauugauacugugaagcagguuuggcugcccgcucagaugguccuguagaaaauaccugggagcuguggcagccccggcuaggcacaguugucacugccacagcagaagggcacaagaaacccugaugagaaugcagucugggggugggcggggauguucagacccacacuggcuggguccccagaacauuuuuggcaaacacaaauccuugccuuggcucggggcuguuggcaaccaguuucagacauaagggcuggcccaggagccguggcaccagugucccugcagccacuuccuuggugaggaauuguaccgcugagguacaaucuuacugcaaauggggaucugcacuggcugcugcucagagaccccguaccuggcauugugguugucuggagucagaaccagguagcaacaaggguccuguguuaguguuguccagacacagcggaaggccacaggaacccccagcagacccucuucccucuccucagagcagucagugcucugcaguagccgagacggaucgggaaggcaugggaguagaagaacugcacucaaaguggucuagaguaggggagcugucuccaaggugaugagacuggauuccgggacggucaccuucccugggggcguggaagcuucuucuaagggcagaggacuguccguuuuugccccagcuuccucuucgucaucauccaugcugggccaggcugacugauccuccacucucuucagccgcucauugagagccuuuagggcuaguugccuggagccagaagagaaaaggcagguuacacuggguuugggagaccaacauacucugcaaccuucuucaauaaggccaaauccuccuaccaaagagguuugccuccaaaucccacguuucccauccccgugccgcgucuaagagccugggccaggaucugcuuuggcaauugaaugaggacccaaggcaccuccagacugagaaggcuaccuagauguuggcagccuaccuagcaggccagccaccacggauacuucugaguuugcuagcuaaagacggguggguguagugcuucugucaggaguggcguguuucagucccuagaaaugcgucccacgugcgcuggugucauuuccaagggcaggguuauuuggcuuugugguacuagggauuaaagcgaaggccagcacuccaccacagagcuguccccagcccuuaaacacuuuuuuuuuuaggcagguccauacugcuucaaacuagcucuguagcacaggcagcccuuggaucuccugucucagccucccgaguaacaggauuagagccuguaucaccaggcucccucagcgaagggcucuuaaugaagcagccucaacuugcauggcccuuccuaugacaauuuuucuagaagcuuuucucaaagccacccagaccuuagcagagccuuuguagcagaaacagccaugugggaaggccagagagcagggucuguuguuuccacaggguagacuucugcaggcauuauuuugagaaaaggugggaaaauacccuuggaaauuuucuuuaggacacccgagaagucucaagcuguagggccugcagcaugccuugagugcuuucccaccccuuggacaccagcuguaaacucuuuuaaggaagacacacccuacacaccaagcuacccagccucagugaaggacaaguuuccaaguguucagcacucuugcccacagaaggugaaguguccguggaucccgauggcuuaccucuuugcugcuacaggcagacacgccacccuauggcguucuaagaucuaaaauuucuaccacgccaagaaaauagacaggaaaagcagcagggauacaggcacugaaaacacuaaugugcuccagccuagcccaguagcaggucuucccugucacuccacagacuacucuuggagauguccuugccagcagucacuuuguggaauccucuuuccuccuuguagcccuuuggguccgagaguggcaugcaguugcaugacaguugucugggaguugucacccaccccaugugacugggccaguccccacucuuccuuuucuauccacuuuuuuuuuuucucgagacaggguuucucuguauagcccuggcuguccuggagcucacucuguagaccaggcuggccuugaacucagaaauccaccugccucugcugagugcugggauuaaaggcaugcaccaccaugcccggcuuucuauccacuuucuugauccuggagagaggcuuucugaaugaccagucaacugucacaauucaagacuucucacuggggcaagggcaagcucuggcccagucccaucugaacagcucuaaggacagcuuuguccuuaaaaacucagcccccagcccauuuccucuacuaaguaaggucaagauggaguggucuuuaggacacuccccaaaaacucaagcuguagugcccaaacuuaggccugcagcauggccuggcuguguucccacaccugccagcugcuaacuccuucaaggaaggaggcuacacucagcuauagagccucaguggggaaugagcugagagaauucuuccccugaggucaggaaccccuuucacaggggagcaaaagcaggagcccgugauaaaugcuaaggaauaagguuggcgagaaacuuccucaacagucucaggaagaacacuggacacugggucuccugggagcugggaacacuguagagaguccauaggucucagaaaguaagaccugaauucaaagagcauucuccugccuuggcuaacguguucagugaauaaugcagugagauuacugaugcugcacuugagcaggugaugcagaggucucugaccugccugguguggucaggaggcucucgcagugaggcacacaaccugucuccguuggugauugggguaaauuuaguaauaccccaaucauccuacauuaagaagggaaagacuuaaggacaaagaccuccuuccccauuucccaucacaggagaaaagagccacaguuucugucuaucacuggaccagugcuuagaauuuggaaauucugaggcaagaccaaagguaacugggcauucuguagccagguuuagugguccgaguugugagguacacagaguccagaaaccuacacauucaguucccucgaggccaagaccugaaucccuuuucugaagccgcucccaacaccugccuguagcucuccagccuauauagagcaaacaucucaauggcugguuauguggccacaccaacagucuagcuaccaagauuuuagagaaguucccaguaccuucugcgcuccgcaucuugagggucugugccugggaggcugauagugauggacgacggcgcucccacaucguagcgcuucacugucuucuggcauaucuuuacuuucaccaggaggccgugcaccaaguucgcuagcagccccaccaccgguugcaggaucuccgggaagaagguggcaaaagcaaaauggucagccauguccccucggccccggcuauggcgcugauagaagcgaagauacacccaacuggauagcagcccaaagccguaggaagccagggcugggcucuggagcagcguggccaaccggaggaguagcagcaacgccagcaacagcaugggaacgacgcugacgcggaccuggggcacucgcagaaccacacagucucccauaguuugcuugagggcuaccagaacaccaccuaggaaacccagggcgccguggauacgaauagugaacagguaaaccaaguugaaggaagccauguaggugaggagguaggcgagggcccccagaagccccacugacacauucaccaccgagaagaagaugagcagcuccaaggcuccccagaggggcuccaguaaucgcccggccacaaccacuguggccaggcuaauggccacgucccacacgugcuguuccaugagcccguggguggccaggguccagauccagaaguugggugggaaaagguagccuggggugacggccaggcagcccguguccacagcgaaggaaagcagguagagaaacaguaccacggcgcacagugccuucaccaccacgcuggcgcuggccaggauggcccccagauguuggcgggcaccagguagggcgcguugcaucuuccuggcggacguuggcuuaagggaauguguggaagguggccuaggggccuccccggggccucgucccaguucggccccgacgggaggcccgggcccggcuacuucacuggcuucuguuccgugggaaggcucugguuccgguuugauccgguuguaguuccaaagcgaggagaaagucuucuugccggggaccugucguuaggcccuggguagcuugggcucgccugccugcggguuccgucggcccagcggccaggcuagcguuaaucucaaggcuaggcuuccuccauccacucugagacucugcgaucugcggggaacuggugccucguuccggcccaagucaagcccguuuagcuccggcugggcuaggguuuuggcuugacgguaccuccuccccucuccggggccgacaaacaggggcgccgcgccugcgcgcccccgccggcggccgcggcaguacgcccucugagcgcuugccuuccggcuucucggcaugcugggauacggaguccuugggaccuagccgacc

SEQ ID NO: 5296 - RNA, 3189 nt, Mus musculus
uggaugacagaacacuugcuuagcauuucagagcucuggguuugggucccagcacuacauaaguggggcaugguauggacauacaugguacauacaucuauaauccuagcacugcggugaaacaggagaaucugaagucugucauccuaggccauguugugaguucaaagcccaccugggagacuugaaaccuugucucagaaacagaaggcaaauuucucuuguucaugauucuacuuucuuuuucccuuuugagacaggaucuuacuauguagccuugguuggcuuagagcucacagagaucugcccgccaccacaaaugaccaugguucaacuucuaaguccaucuccugucacuggccauagucuccagacucuagcacaauuagcuggaaauagcugugccguccacacuuagccccccaaugcacugggaucagaggaaguuucacagcaggcucugaggacucccauucaaggaggggccccuccuuacccagcugaccauuuucuuaccaugaugcauuagcaagaaccauccucaacucugcgcugcuccucccgacagguuuucaggauucuguuuguuuauuuuacuuuucuuuccuccaugauuucuggacauaccaguacaaauauaagcuguauggcugcuggggagacuguugcaacuccaacuucacccagacacaugaccaugcuccccuggguugacagcaagaaaagggagacacucuagugugaggagaucuaccccugagugcccuagucccugaaauguccccagacccugucaguugugagaguccaacagguuccgagcuccugguccgaagcugaggugcaaauccagccuucguaauaacuggugagugcucauggcuggauccucuugcgguacagguaggcauugcucacuugguucaugauuaccaaacuggugaggauggggcacaacacagccagguaccaggcaccaccagugacaguggcagugaaccagagugagaacaugcccaacaggaggcuggcacugcccagcagguagcccaccaacccagaaguggcgugguagaguuucagcuuugccaggggccaucggggcagcaacuugggguagagcagccccaugcccccugaacacugcagaccugcccacagcacagcuaacagcccugccugcccaugccgaguggucaggugugcuuugccaagcugcucuuuguggaggaugacaagaccuagacccagcagagcacagaguagggccagcagcuggagcacccaguggcagcgugcgcggaccuuccgagagagggaccgcagcagggaacucucaggagagaacaucaggagugccucggucaucaggaaggagaacugaggagacaaaaacucaagugagcucugagcacuuaacccuccacaaaggugcacccccuuccguccccuucccccaaggacaaaaugcugcacuugauaagaugaaggcccuguguggcacaaaauggcugcccugaguaguuagagcugccucuccagacuucuuccuggguguuuuucugaaaugucaccucggcuaugugacccagcaaacaagguuugagacauggcaguuauaaaugauucacaagcuuugucucccuuccauggggcaggauacaauuucuuggcaagagcuagccacacgggugcacuguuucagggacaauuagaugcaucaccagaaauuaagguuuuuagggacagagcagccuccaaaugccauuucucagcuuccuagcuggaggugagagaagccgcccuuuugugcuugggugagcuucaucuguucguccugggucaugaauaccguuuucaagccuuggauauucgucagaagcaggagugaggacauacagcucgucuacacuggcacuaaaugccuacaaggauucugagagccaccaacaacgcccacauucuaccccuaaaagcuacccaaacccacuacuuacagccagagacauaagaacggggugccaggagaacagaccuggaaugagaagagggcgccucauggaacuagggaaaaagaaaccagcauaccaggcucuauagccgggauggacagcccauccaucacccaaggaggggucaaaaugcgagccuccuccaguaacaagcucaucuuacccacccccuguucucuucccuggacagaaagcacgcucugccacuccucuggcggcuccuuccuccagcauccccacaagucaggaaugaaaugccaaaucaaaggaagagaagccauguacuuaaagcuugcccuggcgggcagagcccccacacuggucugcucuucccacgacguuaaauacguucaacagagaauauccuucagccagucaauccuguucucaggaguuacgcccaucguuuccuacugcccccuguuccccaagagaaguagcuuuucccuucccauaaguggacuaugaauucuacuuacuggagccaggucuggcaagcacagcaacaaagaugguaaagccuaacgccacgaggugggcugcagccccagaggcagugcgcagagcucgguagauaugcgacuccgucuccacagaaagggccauggucagcccagccgauagcugcacagccugaaagcaucguaggcguuggcaagagugcccacuguccacgccccucacuggggacaguaacucaggacagaaauggcaccuuuucccggagaaguuaugacaggagcagaguagugccggcacuaacagucccaacuuagcagucuaccugucaaacaccuguauuugaagugguaacgaucgcaccuuccaagugggaggaggaagacuacaaaucccagaaugcagcacgucaucguuagccggaacggaaggcguggagcacuacgggaauuguauuucccagcugcuucccuaccuaagcgugaauuucuuugcacacugccuccccaugugcaccugacacgcuguaccuccaccguagaauuuugcccuccucaccugcuucucagguucuacgcagugacuuccuccaaaauaaacuggacccucggccccgccagccgcgccaccgcuccguuacggaguagcuucacuuccgggugcgaugucuacccacccgagacuuccugggacaagcccccucccaucccauccagcg

SEQ ID NO: 5297 - RNA, 2870 nt, Mus musculus
ucgugugcagggucuacaaauaacuuuuauugaaauugaacaaauaacacaacagccuuccugugcuggggaucacucgucccaagccauuucccacacucuagaagcacagagcuuccacaaggaaguauuuuuuuaaagccaucucuguauagaaaucagacucugccccaacauuaucauagucuagacuauuuacaaaccuucacauuuuaauuaugccucuuaaguauuuuccccuccuuucuauccuuaccaaggagcuccaguacuuucucuuaacagacccugaagggguaaagauacuguaaggagaaggggggggaugggcuccucauagcuacuggcaccagccccagucguuucuuaccacuaggugguggacugccucuccccuacaacuggggauuugugggacuggugcaaagacaagggagacgacgaauaugugguuuggggcaaguccccacagguacaggcgucaguagccuguccugaccccggccuguacccucucaacuugagggcaacugguugaaaucaagagagaucaguccagcccugggugaaaggagaagccucccacacugguccucauucuuauugaacagccagcaaaguguccagcuuaagagcgggagcaugugguagguaggcaggaagggugaggcugguauguaucuccagucuguccgauacaggaggaaucgagguagcaaacggcugaaaugcucugacuaggggggaaggggagugaggaaaaggaaguucccacuuggguagagccccuacagcccaggggcuggaagaaggcagacucugcuuguaaagugcuguagcuucuaggagggcugggcccuaggcaagcuuggaagaaagcaggucaggcagguaaccaggaaccaggcauuccugaccggcacgugucuccugucaugcuucucccacaagcggcugggggagacgggcugguaauucuguccuuagcccucaccagccaccaaccucuuauuguucagacauccgccaauaccaguuaacacugagggacaaccccucuuacaacugaagguucugggccaacggaguuuaguuuauucaagguuguggcaccagccuggacuccugaauggaagcuacaccuugauccugggaguuucuugcuggggcagugggugcucgugucugccaugccacacacagguucauacuucauagaggaucacggggaaauccacguggauucggggaggauccagcuucacgaugcccugccauggaaacagaggcuagugaagaucagcucugggccucuaugcuaagagccucucuguucuucccagcucuucccccagaaagccccaucuguaucuccguugacauacugauguaggcuuuaugaucacugcucggacccucaccugaggaaucagauucuuauguacccgccucagcuuggcucgcuucugcccauucuuggugacgauugucuccucauagaauucgugagccagaucuccaucuucaucguagaacauggagcuguggagagaaggggaacaggcuggauuggagccucaucccuggccuuggcaagggccacagaccacagggaaguacgcugaaccccaagagaagacgcacaacgugcguucuccguggaagaacucuuugcuuggugcccggagggaagcaggcagugugacaaggccacuguugcccugucauaccaacaggaugucacaucagagcacccucucuaggcaacuaaaguuaguccucaccacuggucuguuucacaaaggucaugauucuaguagcaggcccuucaccuagggcuuauuuauggagugggugggguaguggccugggcauacuggucucacuucuaaagacacugcugguccagggccaaagaccaagaugguggaugucugagcccagaaggcugcacuccaagucauuccccaguggcuggcacugucuaaucgacacuguugggucuuucugguauuuacggucaaauuuccaucacagggaaugccagucccuaggagcucacuagguccaggccauuuugugugagcaccugggaaaaaagaagguuagguuaguguuccagaucuagagaacccaacuggcugagggcacuuuuuuuguuguggccccaccuucaacacugacgccuuucucugcuuuuccagacacuauucucggagguccaacuucacagugaggaaggcaagacaccuaaacagaaggucaucuucccuuagauuucuucuaaggcuuagaagaacagaagggacauaaaugccuuuaauuugcaggcugaguuggaugaaagggagguuuuaagacucuuagaggccgucuuagcugaauuauggagcugcucccuaagagacgaaccucaggcaauucucuaaaaagaccaucugggcggucaagagcugaacgccgcuugguuuucccuucuccuugcuuugacugggacccaaaauaugacagucgucugauucaaauguaggggggcguuucucauucccggauguccucccaaaggcagauacccaugcccuuacccgcggcgcgugaauacgaagggaggcacugcucgggcucgagaccgcaccagagacugcucggagccugccgccucugggccgccgccccccggaguggaggcaaagggccagaggccccgagcuuuggagccgcuggcgcccaugucagcgccgcgggcgcauggcggacccagcggccgcuccgcucucacagcgcggcgggcgcgaccaugcccugccccagcuuccacucgcaggugccgccgccgccgccuuccgcaggcucugcugucuccacggaaa

SEQ ID NO: 5298 - RNA, 4012 nt, Mus musculus
ucccucccucccucccuccuugucucccaccccaggcuugucugcagcuaagaucucuaccucaccuuuguccuccauggcaggacacuuaguuccccaggucagcgcugagagcugagacuggaccccccacugggaggccuggcagaguggguggcugagccagggcagcuauuucuagacuucugaaccuccuaucuggggguggccagagggugcugacaggaggugccaggaaaagacuggugccccauccucugaccuuuggcuauccaaagcagggcccuggcaccagaaggcuuggucaggccuggccugaagaggucaagagagacaggaagcuguggaguucuaucaggcuuguacagaaaucucaccaaggaguaguguaaaugaagccaucagugagagaacagagaccugcuaaaagccucuuucccccuccccacagucucacauacagauggcaucucagcugggugcccgagccucacuggaguugagccuucuuagcuggcugaggcuagccagacgcaauuugagcagagucuccucuugugugcgcagugugugagccaacacccucagggauucgcucugcagcacugggaaugagaagacauuugugggaccuugucaugauugcaugccuccccagauccccaaacagcccuucgucaggguuugcccacuggcccgugccccacccuuuauugcuucauuuccaguugcccuggguuccugguccugccuguuccuaccacuuagauagacagccacgguggccagcgccaggcaggugaacaccagcaguaccagcagcagaaggaagcccccacggccacacacagggcugcaaccagcuugggugcacagcgauggugguaagacacccagaagcuccucccaugccugugccuccuccaccagacagggucguagugagccugcaaggagaaccgguccaucgggaaggugguacccacagcauccaucucacucccugucugagcucccuuaccuccgcuguguaggucacugauggacuccacucggugcagacgcaccuccugcacgugguuaggagccagugcuccccuguuccucugguucugcauuggcaacacggugucuacaggggcggugggacaauuggagcaaucaguuccuuuguagguugcggagacuugggacauaugggaacugcaccugugacauuugguuccaaauucccuacaauuucaggggugacccuaaguuuggguccagggcuccaaaggguccagggacuccaugcucccaugucacauuugagcauuucccaggucugccugcuuauuccuccuggccucuggucugccuucacagugauucggccucucuuaugggagggaguccugcuguuugcacucaacggcgccgcaggaguccacuuuuauucuuaacaguuucaaucuaacuuugagggcuccucccucuggccucccucugaggcuaucugggcauuuagguaguuuccaauucucaguggaaauuaacccccaggacauccaucauuaaacaugaagguuuuccccacuuuccugaaaguuacugaggacaauucucagaaguggaaaucauggggcccaaagaacugagaguucucuuugaagcuaucaucaaaacuaucuucuaaaaggccuguccagagcccagcaguacaacauggccaccauuagccaucccacuguggggaaaauguguguguguguguguguguggugcagaagccaaaggucuugcugaccuggcacuggaacccaauaaauaaccuagacucacuaacuacggagccccaggaacucucucuaccucaccagaccugccugggaucagaaguguguaccccgagaucuguagucccccucccagacauaaagacuggcagacaguaucugcuuuuggacuugcuucugagcaugucgugggacagucuucacacacauccuggccccggagaaauaaaacucaggucuuucaagcaugcuagacaaguucuucacagaacuauccccagacucuguaugcccacaccuuuacauauauuugcuaacuugagagaugagaaacagcuugucuugauugcugccuagggagccugaccaacguguguguaauuaccguuuacagguucugccuauuuagccgcugacugugguucccuuaugguuauauuuauuucagguuuuguuuuguuuugucuuguuuuguuuuguuuugagauagugacucacugugcuggccuggaacucauugcguagccuaagcuaggaugggcuuaaacucgaaauucuuuugccucggccuaccuauuacuggcauuaagugugugcaucucgcugggcagugguggcucacgccuuugaucccagcacuugggaggcagaggcagaccgauuucugaguucgaggccagccuggucuacaaagugaguuccaggacagccagggcuaugcagagaaacccugucucgaaaaaaaaaaaaaaaggugugugcaucucuacccagcuuugcuauuugguuuguuuguuuguuuggguguuuuuguuuuuuaacaaggguagcaaccaguaagcuccauuguccuuccuauccucaugucccagugcacacagcacugggguuauaaggcacacaagaccacaccuggcuuguuccguggucacuggggucugaauucagaucuucugguuauacagcaagugcuuucaaucacugagccaucuugucccuccucccaccuccccuguuuaagacagucucagaaaguucccagacugguuuugaguaccugguuaauucaagugauccuucugccucagcauuucaacuauuaucaaaauauuugugauuucuaaauaacuauaauuacacuuucugcugauguugacuggguauuuaguuuugaaacagggauucccuauguggaccuggcugccuagaauucagaauauagaccagacuggccuugaacucacagagauccuccugucucugccucuugagugugcacugucaaggucuuuuauuggauguuguuguuugguuugguuuugccccaacuccagaugccugccaggaacgcagguuacaguguagcccagcacuggggauggauggcuuuggguccucccaucuccggacaguaacucagccuuuaugacgugcuugaagcugccccaugccaugcucacaagcaauucaaacaaaaccagaagcugucaguccuugagccugggcggcggaccgcaagucacauuacauccccucugcuccucacugugcgucucccauacuuuauaugugaacauguuucauuugcuauagaaaaagacacaugguagauguuauaguuaggucucccccucucaccccaaaaagguuaacaucccuuagcagagggcaggcccuuucucggcaguguaaaauauuuaggagggacaggauggcucagcagguaaaggcacuugaccggcuaagugccagucuugagcaggcuaagacacucggggcaggccugccuacuucaucgccuccugggccagauauccaaaugcuccccagaaccggucuucaccccaauccuggcuccuucgcugaaggaagaucugaacugcuugggagcucccccagaugcccacacccacuugggcacagccuauagcugacccacuccuaaguggagagcuuugaaucccucccugaggcaggaccuuagguggggaggaguucuaaguauaacggauacauucuuucuccaugcauagggguaggucccuaggagugcgguacaaaaagaccgagaggucuccccaugaagccaggucucucugugagcagaacuagagccuuguccuccccaguggccacccucuccuaccuucuagggucuccucaggcauggcaguugguagguagucagggcccaaugagagugcccaguagcaaaacuugacaaagagagcaau

SEQ ID NO: 5299 - RNA, 784 nt, Mus musculus
acuucaacucaagcaguacuuuugcauuuauucucuggacuuagguagaaggggucuuauuuauguagccgaaaagccagcagcccuuugccguaacggaauaagaccggaaagaucuccucccauuuucugcacccgaacugacaaucucucucuuucccaaggggcaaggcaggaccgucccccagcaccuggcagggugugucacuaggcugucuaagccacccggaccccuugcacacuugcgaggaaaacaccagagaagcagugacagcacugaagccaaaccauaacucccggcaggcccugcggagaagcgugccuucuaauugggcaguggcuaacagcgugccuuuccauugggcagcagcuccaccagccgucaaagccgcugcgcgcagggcacggcgggagaggaggccgcgggauuugcggccguacuucaucucccggcgggcccagcgcugaaggcgguggcgcgacgccuuuguggaagccggagcccaccgggaggaaguuccggucuccgggacgcuggguccguggcggccucugaggaggaggagaagcgggccgcggcggcuacgcugcuuugguaagggcccaggcuaggagagagggcgugcccgagcuucugggacggggucagcgggccuggcggcucuggaaaucgcgggcccgcgcggccuagcagccguggcuucgaagacacggggcggccgcggccucgcucgcuugcgaaaacagucgugugucgcgggaggcgccgcucgcggcaggaacg

SEQ ID NO: 5300 - RNA, 13509 nt, Mus musculus
uuugauccaaguagcuguagcagcggcagcuagaagcagcagcuggggccccuggugaggugaucgugccauugccguguccguggguccacagccaggugcucagaccacaagccagagagaaagguuggguuugccagggaccagggcaggggggcagcugcccaggagcuuucaguaccgcugcguaaagcuggucucagcucggacccugagucugguucgaucaaguccuggaccuucugggauucccaaggggccccagcucaauggggcugccucugccgcugcuucaauccucucuucugcuaaugcuucuuuugcggcugucggcggcguccaccaaccugaacuggcagugcccacgaauacccuacgcagccucccgagacuucagugucaaguacgugguccccagcuucuccgcggggggccggguacaggccaccgcagccuacgaggacaguacaaauagugcgguguuuguggccacacgcaaucaccugcacgugcuugggccugaccugcaguucauagagaaccugaccacuggcccuaucgggaacccuggcugccagacuugugcgagcugugguccaggcccucauggaccaccaaaggacacagacacacuggugcuagugauggagccagguuugccagcccuggucagcuguggcucaacccuacagggccgcugcuuccugcaugagcuggagccucgggggaaagcccugcacuuagcagcuccagccugccuauucucagcaaacaauaacaagccugaggccugcacggacuguguggcuagcccccugggcacucgugugacugugguggagcaggggcaugcuuccuacuucuauguggcaucuucgcuagacccagaguuggccgcuagcuuuagcccccgcucgguguccauccgucgucuaaagucugauacuucuggauuccaaccagguuuuccgucgcugucggugcugcccaaauauuuggccuccuaccucaucaaauauguguacagcuuccacucgggggauuuugucuacuuucugacuguccagcccaucagugucacaagcccucccagugccuugcauacacgucugguccggcucaaugcuguagagccagagauuggugacuaccgggagcuggucuuggacugucauuuugcaccuaaacgccggcgccguggagccccggagggcacacagcccuacccagugcuucaggcagcccacucugcuccaguggaugccaaacuggcuguggaacugagcauuucagagggccaggaagugcuuuuuggggucuuugugaccgucaaggaugguggcucuggcaugggucccaacucuguuguaugugccuuccccauuuaccaccugaacauccugauugaagagggugucgaauauugcugucacucuucaaauucuucuucccuguugucgagaggccuugacuucuuccagacgcccaguuuuuguccuaauccggugagcagaaagagcgggccccugaccugugaguacccuguggagcugaauacgggcuauuuccuugcuaucucugaaagggccugggugggaaaaggcagugggcuaagacacacaaaucaucagccaugucccggaaggucacccagcacgaggcugucauccuuccugccaucugauucuuuaagauagcuuccaggguugugugaggaggggcuuacgucauaguuaacccugccagcacaacuuccaaauuccccuccaaccuguccaguuccuagacccucagggacaccgagaaaaauacagacagaggcaaacacucagagggcagagccucacaacgguccgcagcggcuugccgaccaguucuacuuuccuuugaaggcacuguuuugcucugcuuuucaaagaggggugguuggcagggcugccagagaacuccuccccgccccaccccccacuccgugagguuccagggaacccuggaagucugggaguuuuuuuggagagccuguaugaucugugauuuaccaacccauucuccacacugucguuaugggaaaaaucugggacauaguggaaaggcaguuuuagcuccgcucuagaaaguucugggaagccucaccccagucuugugcaagcaacgauaagcaauugaggaaggaugaauaaaggcgugggaggggacgguuucgauugguccacccuggacguuuugucccuguagccaaggcccugccccagguaggaggucucacagcugguauuauagcacaucagggaagaaaagaaggaacaggaaaaagaaugucuuuaaaacgcuacugaggggcuaggacuuuugagagguuagugggagacauugaauggagcauuggaugagccaucaauccggcucacagucacauucuuggaggcucuggccacccagugcccuugcucugcuaugacaauuuuuuguuugccuccuacucccaacaccccuauggccauacuaggaacuggggguugaaucuggggccucccaccugcuagucaaaugcucuaccaccaccgaggcauauccccagccccucuccucucccuugauaauuuuaauuuugaaacagucucacuaaaguugcccagucuggccuuggacucauucucuaagcccaauccauucuuaaacuuguaaucgucgugcuucacccucagggggugggggguguucuugggccguggucuugacucgcuuguuucuagcuucuguuaguggaggugugaaauuuacagccuguguugcagucaaaagucauuuuucuuuagaaccugaugaccaaacccaggagcucacacacacuaagccucuaccacagguuauauugucagccuuuuguuguuguuguuguuuguugguuuuugagacaggauuugcuauauagccaaagcuagccuugagaacauuguguaguucagguuggccuugaauucaauauuucccugcuuccaucucucaaaugcugguauuacaggcaugcaccaccaggccuggugcuuauuuuuuuuuuuuuuuuuugguuuucauuuugagagauuaaacucauggccuugaacauauaaauguucuccugcuggggaacacccccagccuuggugugugugugugugggggggucaucuuuagccugggucccucagcugaguauauugaguauauuuagguugagaaguccuaugagcaagaauguuuggucugaaccuagacaggaagucagaaccucucccgucuuaacuagugccgaguagaucaggacugcaucgugccaggcaccgggagaacuaaucuuaggcccugccuauccgcucuaggcaugggggugugccaggucuccgaagauauguaaaucaguguuuauccaaugaguucaaguaugacaccguguuaguaccagccucuguguguacucaaugguugauccuaaagacuagugccuggauacguggauucagauugcguguggagcauguauuaggaaggggacacugaaggcgaguguuuucagggauaggcaccuuugucaauccuaggacccagauugaagacuccagggugucggggcaagcaagcagcagcgugugcuuaccugagccacuaccuccuuaacgacacagccccaccugugccugagucacggagaaaacaguuggcaagcuuccggcuagggccaggcuccuuuccuucucaaguuaggacaagguuccaguccacacccaagcaggauauagacccagauuggguggggugucuagacccaacacugcuuccucuugacccuccccaucccagcuucugcuuaucacugaggcccaggaauggguuaaaucugugcaaccugaaggagguucugaaaaccuaggccucuccugacccuucuugcuccucuaacccagcuccacauuggcuuccugcuguccuaggaccauucaugguucuguccuaagaacuuacagcccccaacacuccugccuaaaagccagggagagguuuguguccugcaaacaucugaggcuuagcccgccggcccgcucaagguuagagggccuuguauuuuuuuuuuuuuuuaauuuuuguaccugagggagguguagguaauuguaggacuuauggagucccagggaaaggaaccauguugccaacuuugggaagccaccuaaccucaggauucaguccucuacacaaguagggaaacugaaauucaagagggacauuggcuaagauguacgcacagaggcagcaggagcugggagaguacccuggauccugaaggguucgugaggccuuggauaaaugaauggauguguggguggguugggucuaggagauuaaauaacgggucaccagacuggacagagcaaggcaaggcaugaaguagggaucuggcuuucuagacugggccuccuuucuucccugcccuugcugucuccaggagccuccuggcauggugguagcauacgagggguaggcucuaggccuccucuagucaagcacggugggggucacaguuugggauugcugauagacuaacaaaagcccccaagagucaaugcccaggccugaccccgacucuccuccuugccuuugccuuugccccagccugguggagaggccuccggccccagcucccguugccacuacuucccuuugaugguccacgcuagcuucacccguguggaccucuucaauggacuguuaggaucagugaaggucaccgcacugcaugugacacgucuuggcaauguuacaguggcccacaugggcacuguggaugggcguguccuacagguauauccuuuaccccacagccaucuggucccgcauuccuguccccugccccugcuacuuuuuucucauagcugaccugucacagguggagauagccaggucacucaacuaccugcuguauguguccaacuucucccugggcagcaguggacagccuguucaucgggaugucagccgccucgggaaugaccuacucuuugccucuggggaccaggugaggugugcggggucagaacuuaggguucaggguaaugggagcccagagaggcauugguaggaagaccuuaccucuccaaucuacaaaggaaccaggaggaccaacaguucucaccuuuagccaucccugaccuacccguuugucacccuaaggucuucaaggugcccauccagggcccuggcugucgucauuuucucaccuguuggcguugccugagagcacagcgcuucaugggauguggcugguguggggaccggugugaccggcagaaggaguguccuggcuccuggcaacaggaccacuguccgccugagaucagugagguacagcuuaccccagcaggguacaguaaccauggggcaagcggggauggggguuggggagggacaagcagguugugguggggcugggggggugugagugucaaaaaguccugaccacaaucuuccucggggaauccuugucagaggggaugacacaugggaaacuugggugguaggaaaagucugauaaggacuagcaggugacucagaauggccagacugugagauguacaaggcauaugacacgggacucuuggggaggcagguggggcugagagagugcaaucucacauaaaaccccagggcucuucucucccuuucaguucuauccucacagcgggccucuaaggggcacuacgaggcucacccuuuguggcuccaacuucuaccugcgaccugaugaugucguaccugagggaacacaccagaucaccgugggccaaagucccugccgacugcugccuaaggacucuucaagcccuagguauaacauggucccugccuucccuauccccgaugagauugaccaagcggccccucauuugugagacccacuucugugaaggauaugggacaagcuguauuggcucuggcuucuugugucccugucccuuuuugagccugugugugcucuacuuacuugucuguuuagcuguggacuagacaagguuagcccacuugauccugucccacucgauccugccugccuucaggagagggcauggguggagaugcuccucugagguucagagaagccucgugacuuacggcagaggcguagccagcccuacaugauucccaacguggugcccuuccugaucuuccaggccagggucccucaaggaauucauacaggaacuugaaugugagcuggagccccuggucacccaggcaguggggacuacaaacaucagccuugucaucaccaacaugccagcaggcaagcacuuccgaguggaaggcaucucuguacaggaaggcuucucuuucguggugaggccacagugcccggucuuugcccuuggaucaugggugguacgagaagggugggcuuggaaugaaugguuuguuucagcugagccucuuccacauccucucaggagccagugcugacaucaauaaaaccugacuuuggcccgcgggcuggggguacuuaucucacccuugaaggccagagccugucugucggcaccagccgggcugugcuggucaauggaacccagugccggcuggaacaguaaguguuaucagguaaacuuaugggaagccacaggacccuaccuuugggagacuccaagugguaucugcguccugagguggcccuccuggcugcugccugaggucaccucaagucucagguacaacacagucccaaucuucuucccugucccccaacggagacaaccaagcagccccuuccucgugagacucuuucccacccagagagccucaccagguggguaccuaguuacugccaguguggagagaagagagucaguuguuuggucaaaguagggaucagugccaggagagaucugcuguccucuccagcccagagacaagagagcccaccacagaggccacugucuccagccaaggauaugggagcuuguuaccucccuguaacaagcuucuuuuuuguuuuuuaaagauuuauuuauuuauuauauguaaguacacuguagcugucuucagacacuccagaagagggcgucagaucuuguuacagaugguugugagccaccaugugguugcugggauuugaacucgggugcucuuacccacugagccaucucaccagccccaagcuucuugaaggucuuacugggagccuccucucuccaguccguggaguguagauggauggaaaagacagccacagaggaaguggaaaggauuaguaagcccuggaggagguaaaccugcucauccuaagaaggugucccugugcccaaucccuccuuccugcagggucaaugaggagcagaucuuaugugucacgccuccuggagcuggcacggccagggucccccuucaucugcagauagggggugcugaggugccuggcuccuggaccuuucacuacaaggaagacccuauuguguuggacaucagucccaaguguggcuacagguaaguuccaccucucugacuacuuuggccuacaggacaugagagcaccagcucccugaguccccuaaacccaccacccuaccccuucucacaguggcucccacaucaugauccauggccagcaucugacuucagcauggcacuucacgcuaucauuccaugauggacaaaguacaguggagagcagggugagcagagcgggugacgaccaggagggaggaaagcuggaccaguccccugauguccaacuucaccucacccugggcugaggagacugaagcagccagggguuggccauuugccuaacuacuuucccaugggucucagcagugugcggggcaguuuguggaacaacagcagcgucgaugucgccugccugaauaugugguccgaaacccucaggggugggcaacagggaaucugagcgucuggggugauggagcagcuggcuucacgcugccugguuuucgcuuccugcccccacccaguccacucagagcuggccugguugaguugaaaccugaagaacauucaguuaaaguugagguggguuuaacgguuaggggagggacagcggauaaggaggcagagcccagacucuggcugauccuucugucugucucggcaguaugucgggcugggcgcuguggcagacugugugacugugaacaugaccguggguggugaggucugccaacaugagcuccggggggauguggugaucugcccccugcccccuucccugcaacuuggcaaggauggugucccauugcagguaggugacacagcuggcccucucaggaaaccaugagcugagggucugcagucuggguuuaaacugccaucugcuuucaggucuguguagacggugggugucacauccugagccaagugguucgcucaagcccaggcagggccucacagaggauacuccuuauugcucuucuggucuugauccugcuuguggcugugcuggccguugcccugaucuuuaacucccgaagacggaaaaagcagcuaggugagaucccuacauucaucuagacuaagccuaacaguagacuccccccagaacagcagcaucuucaaucuccagacugggggugggggugucucccacuugguccccgagagcuuggcaagacgaagcaccaugggcugucuuuccacaguccuugcucccaaucuggaaugacccugcaucccuggauccgucccccagagccaugccccugucuauauuccgcuguggcucugacuacagaaguguccuuggugagaugggggaggcagcaggagccagagcucgccuuuccccacaggugcucacucccucuccccaacaacacucucugacaucaacgauacagcuuccggggcuccgaaccaugaagaaucgucagagaguagggaugggacaagugucccacugcugcggacagagucuauccggcuccaggaucuggacaggaugcuccuagcugaggucaaggauguacugauuccccaugaacaaguggucauccauacugaccaagucauuggcaaaggugugggggauggauugggagguggggcaggggcauagaagggguauugcugugugcucgaucgagacagcuggagcaguccccacuucgacccgcacacuaacuugugugaccuugaggcugccaaacuucugagauguggucaucuuuggaacgagguuuuggagaauuugcucuucgguggcuucugguguggcuguguggacgcgggaggacuguaaacgacccuaccauugggcugccgcuugcuuuuaaggucacauuggccaauuuggggguucugagguugcuaguuauaaagggcacacugugagucugggcacagaguccuucuuuacccucuugcucuuucuaggccacuuugguguugucuaccacggagaauauacagacggagcacagaaucagacccacugugccaucaagucucugagucguaagcgaggcauaggcaggguggguagaagggugaccucaggcugcagguccuuuguaccugcuaugcugccacuuaauaaagugagccuugcguggaaccuuccccuuccugcacuguuuccaccugacccuuguaaaggaccuucuugcccuuggccugccugaccuaugcuacucugcaggcauuacagaggugcaggagguggaggcuuuccugcgggaggggcugcucaugcguggccuacaucacccaaacauccuggcucucaucgguaucaugcugcccccggaggggcuuccccgggugcuguugcccuauaugcgccacggagaccugcuucauuucauucgcuccccucagagggugagugaucauuguccagguugggaggugucagccagcacccaccccugccuacgcucaccagucaccuugugcccccagaaccccacugugaaggaucuugucagcuuuggccugcagguagccugugguauggaguaccuggcagagcagaaguucgugcacagagaccuggcugcuaggaacugcaugugaguggcucaaguaacugaggugaagcaagagggcagguugcucgaggaucugcagcuccuaaaggcuaccucaagggaggacccagccuuugcucugcggccuuaggcacuuucagucuuucugguauaggguuagacacugugguucuuaaggccuucgaaggacuuggaucagaucggggcaagaccuggugggaagucaguucuuacccggccagugagcuacagccccagcuggguuccaguucaaccugugauucccucuccucaggcuggacgagucauucacagucaagguggcugacuuuggucuggcacggggcguccuagacaaggaauacuacaguguucgccagcaucgccaugcucgccugccagucaaauggauggcacuggagagccugcagaccuacagguucaccaccaaguccgaugugguaaggugcccucugcuccagaacugcuugacccccauuauaccuuacaggauuuugccuugcuuuucugcaugauccgagcauagagacuccccaaguuaggcaacccccauaccucaucugucuuggacaaacgugaaauagaaucugaugccggccaggacaaacgaaguuugugaauuuauugguuccguaugaguaacccagggcuuucagcucugaaguugugagagucaggggaagaaacucgugugccauugaggauugagcucugggcagaaaggugggagugucgccuauuuccagugaagggcucugagaaguggaagaccuggggacccaccugcccccaaacuuggggugaucauuugaaucaguccccucacuuuucuccaacaguggucauucggggugcugcucugggagcuacuaacacggggugcuccacccuacccccauaucgaucccuucgaccucucucacuuccuggcucagggccgucgccugccucagccugaguacuguccugauucacugugaguauguaaaagggagcgggguggggcagggcuggacuccagacaggaggugggggcaacggaccaaguuccugccuuucugucugacccuuugguugauugggacagggagcaucucuggggcucaguuuacucaucuguguacugguucccccccacccaugcaaggaaggacucugagaggaccucacgguugccaugguaacagcauuccaacucagagucuggguugaggccagugguuugguuucccagaucucuuuucccacucgacuccugcaaagggagaggggcuguuuucuaucucugccacucgcuuaaccucaaagaaacguucugccagcucccacaccagccccucugcgucuccccaucaaggucuuuuuuuuuuuuuuuuucacugcacguaguucagacuccucauucccaagggauggcagcagccgugucauccgugcccgugggguagguuugacucccuaaucagccggcauaccccagcugugcucaagucugcaugcuuagaacagggagaaccaggucacagguagagcggcugaugacuccugucccaggcugugcuccagaaagggaaugaguagcucuuucuuacaguucuccccaucuuggccuugaccuuucuaucaucuguuuuacuaauauauauaguuugaauuauggaaauuaacuucacugccugccugcaucuaagacaggcucucugaacagauuaggguggggauuucuacaugguagggcuucagugguagguuugggaguugggggguugggguuggggagaaacagggcuugucagaggaagagggcaguugugaugcaugggagggguggaacucauucuauauaggacuguuagaguugggcuggcccugcagagaccaaggggccaggucucuaucccaggcacuaaucagucacuggucacaggcuauacucagugagcagaugugagauugggcaagauauguucccgccugccuaaaggaggcugaagcuaagagccuccaacauguaacagucucagccacugagaaaacgaaggagauccggguggcacacugcagagugcacuccugggcuccguuuugcccaacuguaaaguggguuuuauaacacuccccucagagagugggagacauguauaagauacugcgcacagacacuuagacucuuaguccaggcagcaugccaucccuaugacaacaaggcaugcucucagaugcagcaggccagccuacugcuucagagccuuagcuccagaaccacuguagggacugcccacaggcuucucuuucaguccccauuuaaacucucccaggacuguuuugcugcugagauuguuugauguuuuuguuucguuuuuuuaaagacugggucucuguaguagcccaggcuagccuugaaugcaggcuaauucuccugcuucagccuucuaagcccugggauuaaaggcauguuucacugagcucauuauguguuaguugguuugcuuuugagacuggguaccacuauguagcucuggcuauccuagaacucacuguguagaccaggcuagucucaaacucuuuauguaacuaaagcugaucuugaacuccugaucuuccucccuccacuucccaagugcuugaauugaaggugcaugccacuguaacugacucucuaugcaggguuuaaucuucauuuuauauccuaucuggaagaggugugaugauccuauuagcuccuaagccucuuagccaugugcugaggguuucacaaguuuaccccgugaaccuagagcugugaagaggccaucuaggcauagaaaagucaaggaacauacccgaaaucacauagcuaaggccccgggcagacucaacccucuaccugaccuccaucuucuuacagguaucacgugaugcuucgaugcugggaggcugacccagcggcacgacccaccuucagagcccuagugcuggaaguaaagcagguaguggccucacugcuuggggaccacuaugugcagcugacagcagcuuaugugaacguaggccccagagcgguggaugaugggagugugccuccggagcagguacagcccucgccucagcauugcaggagcacgucaaagccccggccucucucagagccaccccugcccacuugaccaaagcccugaguaggccacaggcacuagaucugcuaaguggccuugagcaaauuacaagcugccucugggccuaggacaagccucagcauggaaaaccuccacucuuuagcuuucuggggccacugaaggugggaaaccgggcccauuugagccccucguuccagcaugagccagugacauuuuuguagcauguauuuauguaaugucuguuuuguaccuguuucggaauacagaggauccagcagugaucacagagauacuacaguguaaaauaauauaaauaaauaaaugaaugaauauucgagcacaag

SEQ ID NO: 5301 - RNA, 1127 nt, Mus musculus
cauggagcaggacuauggaagacaccaagaagguggggggcccugauccaucgggcccccagggccauccacugccuagcagccagcagcuaacggguggcuucaaagugucccagggaccauggaugaacccuaaaucccucuacucgaagcaagggcugucacucuccaccggggccaucaacucaaccucucaggcuccugccucucaacccaugcuucaacuacuccauaauucugcucaggucaacucccagugugacuaugcacgggccucccaggacaccucgagauucucuucuaacccauacccaaaccccguugugggaacccaggagcaucuccucauggaugaugggacucagacucugccaaugcccccagacaacaacggcacagaugacaaagcccaguacagauucaaccucucccagaaucaguuacagauugggagggagagcaaggcuccagcuaaaguccugguaggcuggggcaaaggaaccuguaacauuggccagauggccucugagggcuccagaaagagucgauggcuacccuacuuccucucgggagagagugguguaguugaaggucaagcaccucuucugacucaggcuccaguccaagaucagaggcaagacaaguguccaugucuggcucagucucccacccuaaacaaggcgacuucuucaccgucacugccucuuccaaccucagugccagcuucugucgcagcugucaacggauuaccagcaccugccgcaguuaaaccuuacaccuauagucccaacuaccugacuaauaccacugcagccgcuaaagaccugccucuugaucuaaggaacgggggcaaccaauugucuguucucucagauccuuccaaaaaggacaaaguauauuuuuuccuuaaggagacuccucccacuccaacaucuaguccagcagaauuuucacccaaaauccaggaccaagaaguugccaaggugcaggugccaauccagcaaucugaguacccugcaaagaagugucuagucuccaggcuagacaccuuaacaucaaccucagagccucuagacucuuucaagauacaggagaauagccacaagguuugcagcucucauccagac

SEQ ID NO: 5302 - RNA, 36424 nt, Mus musculus
ggaggccccgcccccagcccgcccccggcccggggugcgaauccgcugccagagagcgacuggcgaugcuggagguucuggagucgaagcggcugcagcuggcgccgcgucugccccgcgugcccggagcggauucugcccgccgcccccggagcccugcugagcggguuaucgcuuccugccugugaccgaccagcuuugcaggugcggagcagggagggcugggccgguggggagggcgccuccuggaugcacguuggggggccuugggagauuguuucccugguuagagaauccccgcgcaggaugcgcgcgaucaccgcgaggacucugggggucccaagcaggggcacagcgcaccguuucugcagaugcgaggugggguggcgugcgggguugggcuaaaguuccccauuaccucugacggcuugggagggucccagagaaagccucugcagcuccgaauuguaaaaaacauaaacccucgaagauucguggugccccuuauagggguaaagggccaagggccgagcgguccauccucgcuccuagagcggucuucagccccuccccaacugccccugggggcccccucccucugguuuggcagucacuaauuuccaugacaacggagaguucuuuaugggcgacaauccggagggggcugggcggggcugcugcggggcugggggaggagguucuaagcccgaguggacuauuggcccccaagcuaaguucaggcuuccaagccuucugagggucuuuugucaagggaggugggggcgcagcgcacugacacacgugcgaggugggggugcggggcgcacauguuucugcugggaggugcggggcuugcugcucacacgugugccucccgcauguguguugcugugccagcgggggcgagccagcagcacuggggaagggggucagagugguaccauggugaagagcagggacucugccuggagucgcaggggacaauuaaagcguuagccucucugucuuuuucagcuugcuauugcuugacaggagacccugggcuuuugagccccagccccaugaagggcugccaacugcuccccgaccccaaaccuguucuagcagguuccuuccuagagaacagggcccccuuuuccucaccaaaagcuccuagcuggucuauacgacucuagugggucuuuugcacaccagccuccaaacacaggcucaggcuuuggggcccccaggaccaccuuugcagaaguaggcuggcuuccccucccccucugaguugauuacuggcagauucagugacuucugagccucccuuuccuaacuuggaaauuaguaucuccauucccuucauagccaggaugggacagaggucucccuuuuuuuccccucauuuaguguggauccccaggcgcccuacccuggcucuguauauaucugcugcaggcccuucucugugucuucauucccugguggcuaccaauuagccggcugguggcaguccucugcucuguucagggaaacugagaccugggggguguuggugugccuuugucuuccuguuucuggcuugcucauggugcuguuuuggcugcugcuuuuggccauccugagaucugcccaagacugaggcugggaugaagaagggcccuggaaacccaaggccuggagaguucagcugacugagguggagauugcuggggacccuggguaaggcugggccagccgagacggcuucuuaaggaauuaggcaggcuucuuucugggugucuauccugcaaugccagucuuuucaacuuuuggaccucuucgccuaagcgggagagagacuggggacugacuggcuggggaccgcaacagcuggccucuuccacaccaagaagcuccuagaagcugaccucuuuuuacuggaccuccugugccaagugcacucacucuaugucuggggggauacucaggaaucuugaaagccaaaugccagggguugcuccuggcccaggggaucccaaaacgcggccuuggaggguuuaggcugcugcugagcauucugagucuucuucagaaucuucugccugcuucucucuuguggcugugucccuuguacucugcugccuccuuuucuacuuccaacagauucugcccuugucucucuuggucucugcaccuuucuuuacuaaagucucugcuuuccccucccccacccuuuacggggagcagggucucagaaccugcagggaaggagccaggccuaaaugucaguuugggaagagggaccuuugcuaauaccuaccccuuacuccuccccuuguuuuaaaacuuccaucaccauagcaaccuuauacuccauugccuucugcagaucccuuuccuccaaccaaagggaugcagggccuccaguggcuucaaagauugggaccccggguucuaaggccagugacaauuggcucuuggcuuugccuacauguggagagcugacuauucuggaaauagcaguagacugcaugcucacuucuaagacugcaagguuggggguuagcaggggcuccuccauacuccuaacauagguagaaaagagucaacaccaggaacuauucaugguggcucagcuuguugcccacccaggacuguaugauauccagugucuuaaggcaacuggacaguaggcuugaagcuugacucugucuuguguuaccacauacacuggaaggaggucacuaccuccccuaggcuuguggcugugagcuagaugggauuuggguuggggcauguccguuugcaguagcaaacucaguccuaaucacuaagagaggggaagaggggagggaagggaagagggugccugcaggcugguguucacagcugccacuaaauugggagguguugcccacaguagggagucaucgggaggccuccugggcccuuucuggccucucuagaauuacugcaagcucuagagccccacauggcagguaccaggggagcaggaaacuucauuucuggauaugaaaggugagaccugaaaugggcugacccuggugggaaaaacccugaaauggggucuuuuggccuccaucuugauuggguuuccucuggcucagacuugccugaaaauccaauagaacuccuagggacccuuucugacaagggcaccaaaauagacaaaagcugccugaguccugggucacugagcccaagagacaaaaguccaggagcacacaguaauggagugcugagcccggaagcuuccagggucugcuggaguggagggcagugguaguguucugcccugcucuucuguucccuuuggguagcccaggaguaagguuuauuuccuuugcagagaagggaaggaauucuaucucgagaaaagcagcugccauggggcuccugugccauaccugggccgguguggagcugaccagauucugugguguuggaaagaaaacuuuuguugggugcuaaauuuggggccaugaggaugagaaaugccaaucuccuucugcugugcccucccacccuuccucaagcuuuggggcuagucccucuuuuugcugagagguaccaaggugcucggugucuacaaccuacagccucacgggguagcaguagguagcagauggcaaguguaaaggggaugagagaacugauuggaaacaugccuucuuuucucgugacccugaaagaucuagguguauaagugaauucaaguagacugcuggggaaggauagugauugggugacaucugggcagccaagauagaggggagugguggcaaaguagauucgucccuguuucauuauugagaccuguaggauagggcuguaggcugucagcacuguggacuuuccauaguagagacagacccuaacaccagcucagacccucuuggcagaaauguacauguauagccaaaagcuggcaccaggaucagagacaagcauauacaaaaccucccaccuacaccacguuggcagaggcgagagcgguugagcuggggagggagggagagccuggaaaaggugucucagaacagggccauuugcaucuggccuuggagcaucaggauuguuuaagacaacuuguuacagagacaaccuuaugaugccagaauugguacugaaagaacacgcagcccugguccugauuccuugcccguguggaggcuguuucacagggcagcccaggcggguggagcucuuaccaaugcccacacuuccugccacggaguagacauauuugagcugucgaaucaccuguugucggacauuuagguagucgccgacuccuuuuuaauguuauaaauaacucugugaugacaaauagaauucccaugggaggcuuugggggaaggguauuugcaucggagggaacaguguaacagagcaacagaacagggaaugaauggucucugcccaguccugagaaaccugggagcuggguaccaucuuucugcucagugaauggccuucagauucuagccugggaggguaaucuucuuucaccccaccccuggggaaaauguccuuagggaacaagaggacugaugcuggccucucccuccagauguuacagugaggagcuggggagcuggcaggggugguuggcugugcuucugcucccagcugcaacaaugagaugcaggagcagggauuuuggacauaguggcaaagacacacagccgacaucuucaaagccucucucguuugccucugucguauuuugcuagauggcuuaagcucugacuccaucucacugaugaaaugcguguauuccccaagcucaagcaauccagaggaaggaguuauggaauuugaucucuaaugcugaggacacauuuaagggagggccuccugggagguugugggaucccugggaaauaguguagcuggcuucugccugggaggaagugauuggcguccaggacuauccaaagggcuugucugggacccccagcucgccgaguccucuuuguuaccaagaacugauacuguaagugccuucagauagggggauauguagaugcucaaggccauggcccagcucuuuccacuucaagcacuuuuggagguagagggggcaugggugacagaggcagaacaguuucgguaugaccucaguguacagcuugcuacaaccacaggcuggcacaaagcaaacuuuugggaggcagacucugggguuagaucaauaaagguagaugcagccaucuaucucggaacgaggacauuggguaccuuucccuuuggaugcugggaccagucauucagcaccacacuuuaggcuugaucuguaaagggacagaguggaggcagggcccagugccccaggugcagaguucccugaaccugcugagccagcaguagccagacugagccucaccuggcccugcacuccugcagcacuugagcgcuaggcaggcuugucuuacccuggauugucaccccugcaugccucccggcaaagccuucugcucccagccccgauccuaacgcugcucuucccuacaaggaacgugucccucugugcauaccacauacaacaugucugaauucaauauuuaauaaauccaucaaacuaauaggaauaaaaauucuaagacagcauuagagcacaguacacgccuauaaucccagcacucaggaauaggggcagggaaacucggagaccaaggccagccucaguuauauacugaguuugaggccagcucgagcuacaugagacucuaucucaaugaacaaauaaacaaaagauaugaauuuauacuuucaguuuuuugcccuaaagagaaauuguauuuccuuuaauguccuagaaaaguacacacacacacacauacacacacacaccacaaauaaauaauguuugaaguuugaaaauuauuuauucauuuucuugugugcauguacaugcacaugcauguguguguaugagcacucaugccaguggauacucagaaaucagaagaaaagcaucaguguucuuugacacacuuuccacugauuccuuugagacaggucucucucugaacuuguggcuugcauuuucuugguuaaacuagaaguaacaagcgcuagcaguccucucccugcccauccuugcagcuggggcuucaggcaugugcaggauguguggcuucuuaaggaugcugggauucgaacucugguccucauaauugugcagcaagcucugucucugucucucugucucucuugguuuuucaagacaggguuucucuguauagcccuggcuguccuggaacucacucuguagaccaggcuggccucaaacucagaaauccaccugccucugccucccaagugcuggaauuaaaggcaugugccaccacugccuggcgcagcacgcucucuuaagagcugaaucaucuuuccauaucccugcaaguccuuuuuguuugucuguuuguuugguuaguuuugagacaggguuucuuuguguagcucuggcuguccuggaacacagucuguucaaggcuggccuugaacucagauccaccugcuucugucucccaaaugcugggauuaaagcugugccaccguggcccagccugcacauacaucuuuagugauauauaaagggagugggggaguugggacuggagcgauggcucuaaagaggagcaucccagcaccccagcucacaacuaucugaaacucuaagaucugacacacucacacagacaugcaugcaggcaaaacaccaauauacauaaaauaaaaauaauaaaaauuuaaaaagauauaaaguacguucauuuauaacuaccauucaggcuuagaaaugggucuuccagaaguccccuuguguccuaacucagucaccuuauccugucccuuaggagccauuaugugagucuuugaacuuauuuucagcuuuuuugaacaguguuacuucugugcuugagcccccagcauuguguggaguucagcuuguuuucagcucuguaucaaaagacucacacuacaugcaucuuuccuguuucuaucaacacugcuuuuugcaagauacacuguuuggcugaguagagccauagcucccucauuuccuuugcagcauaacauucuauuauacggcuaugccacaguacauccugcuggggguagauauuugggcucguuccagcuuuuagcaauuauggauauggcaauuaugagaguucuuagccaaguguccugaggcauaaauguaugccugccucucucucucccgcccucucuuugacgggaacucucuauguugcccaaguuggccuggaacuccugagggacacuuggcucaaaugcaugcauuucuauggagcaaauauuuaaaguacauagggugggcuugagaaaucaugcagugguuaaaagcacugguugcuccuccaaagggcuuggguucaguccccagcaccaaaacaacggcucauaacuauaacuccaguuccaggggauccaacccccucuucuggccuccauagauacuaggcacacauagacacagguauacaugcaggccaaacaacuauacacauaaaaauaaauaacuuugcgcugggcgugguggcgcaugccuuuaaucccagcacucgggaggcagaggcaggcggauuucugaguucgaggccagccuggucuacagagugaguuccaggacagccagggcuauacagagaaacgcuguuucgaaaaaccaaaauaaauaaauaaauaaauaaauaaauaaauaaauuuagcugggcgauggugacacaugccuuuaaucucagcacucagaaggcagagguagguugaucucucugaguuugaggccagucugguuaauagagcuaguuccaggacagccaaggcuguuacacagugaaacccugucucaaaaaaacaaaccaaccaaccaaccaaauaaauaaucuuaaaaaaaaauaaaagaaguacacagaauauguuuguuugucaaaacuggcccuauccugucuuguccuuuaagacaaagucuucuguagccugggguagccuugaacucaucaaguagccggggcuuccuugaaccuugauccuccugcugccaccuccuaaauucuaggauuucaagugugcgccacaccuggcucccagcuuuuuaaaagggaaauuggccucuuccaacagauuucauuuuguccauagcuucacccacauuugguaucucuagacgaucagagauaaauaacuaguaugggcaagagcucguaagaacucaacucuagacaaaaaaccacagacagguaaggaaggcugagaauaggagaaauaaauagucuuccucaagaaagagcagaccaggugacuauccaguaccaagugguggaauaggugcaagugugugugcacauauaacaauaaccaaagaauaaguggucauaaauuugauuagagcaagauggaagguaggcaggggaaaaugauauaauuucaaagaaauuccuggaauaaacuuaaauuuauguucauggacuagcuacaauguaaagauuuuuuuauuuauuuacuuacuuacuuauuuauggcuuuuuuuuuuuuuuugagacaggguuucucuguauagcccuggcuguccuggaacucacucuguagaccaggcuggccucaaacucagaaauccacuugccucugccucccaagugcugggauuaaaugcaugcgccaccacuaccuggcucuuauuuuuuuugaaauagggcuucccauuguaguccaggcuggccuccgacuccuggcaauccucuugcaucagcuuccuugagugccagaaugauaaugugagucaccacauuaaagacuuuaaaaaagcugugugguuuuuaaaaucacauuuaucuauuuauugaauggggggcacagaauaguaugugcauggagguccgaggacaguuucugggaguuggaucucacuuuccaucauguggguuccagggaucagacucaaguuuggaggucagugcccuuaccuggugagccaccuggcugacccuagagagacuaaugguuuaaccccaucauuggagaggugaaggcaggaggauuucagcaaguucuaggccaguuugauguacauacugggucuaggauaucuagggcuaacuagugagacccugugucaaaaaucaaaacuaaauaaauaaacagauuguccuguaagucuuuucaaaugcauauaaugaaagaacuacuucuuaauaugucagcuuagggaauuuuugcauaguggggacuguuguaguucaggcagccugguugaauggcuacauguguggcccaauaaagcagugucgaucaguauuuaccuacuuugcccuucacuugaccugagcugaguuucccaaaagcaauuucagugauggguguugggguaagaaaaugguauagcugagccagaucccauccuguuugcaccuuagagccuagcaaugccguuugggugugugacucugggugacaagaagaacuauaaccagccaucggaagugacugacagauaugaccugggacaagucaucaagacgugaguguugggcugcuggacagugauggggugaaauagaucagggcugggaaagagggccuggaguguacccuguccuaaggcugggugugccugcuggcuucagugaggaguucugugaaaucuuccgggccaaggacaagacaacgggcaagcugcacaccuguaagaaguuccagaagcgugauggccgcaaggugcggaaggcagccaagaacgagauuggaauccucaagaugugagugugagggcugagggaagagucggguaggagauagcaggggagggcuugaagagcaggguaccucagaaaggacauguuagucuguuacaaccacucaguguagaaaccagagcuucucuugggugcacucaacccugacuacugacccucccacugucacuagggugaagcaccccaacauccugcagcugguagauguguuugugacccgcaaggaauacuucaucuuucuggagcugugaguaccauacugggguuccaggauuccccagucccuagggucuuuucuuuuuccucccuuuauagcuaaagaaacccacuuuugaaacccuuugggucccaaggcccugggcccugcccagccaagugccugguacaaaucaggccucccaaaugcuccuguccuacccccgacccugcccacgccgggcucaggggcuggugucccucagggccacggggagggagguguuugacuggauccuggaccagggcuacuacucggagcgagacacgagcaacguggugcggcaggucuuggaggcuguggccuacuugcacucgcucaagauugugcacaggaaccucaagguaaggccagagccggagggaugggcuggggcuggcaugagugccacacugggcucugguccggcuucugaggcccucaugaugacuucugcccacccuuccuaccauucucucccgaacagcuggaaaaccuaguguacuacaacaggcugaagaacucaaagauugucaucagcgacuuucaccuggcuaagcuagagaauggccuuaucaaggagcccuguggaaccccggaguaucugggcaaggagggaugggacaggggauggucugagggacagccuucagggggagauuuugggguagggaagaagccucuauuccaagaaauggguauagaugcugcuguauauggccacacuugagucuaaccagcagauaaccacuuuuuuuuuuuuagcaccagaagugguaggacggcaacgguacggucgcccuguagacuguugggccauuggcgucaucauguauauccugugaguggcagggcacacaauugggcuugcagccaggugggcuggacaauuacgucuguggcccuccuaggugacccuacuccauguaggcuuucaggcaacccgcccuucuacgaggagguggaagaagaugacuaugagaaccacgauaagaaucucuuccgcaagauccuggcuggugacuaugaguuugacucuccguacugggacgauauuucucaagcaggugaggggauacccggccugugggcagaguauagggcugcauggugggaggcacugcucucagcgucugcuggauuacuacuccugcuccccagcccauccuucacagcuagacaaugagauggggcacccuugccuagcccaucccuggcuuuguccccagccaaagaccuggucaccaggcugauggagguggagcaagaccagcggaucaccgcagaagaggccaucucccacgaauggugagcagggcccccugggaggagugggcgagccucuguugcgcuuugaaugucuuacaccagaaguccgcauccuugaggucuuggcaagggaaggcguucuagagcucuggccaaaccagacacucugccugguggcccuccaucacaccgggaagggcugugcagacuccacgaggcacagaccauucccaucagaugcacuugccuccuuucuaggauuuccggcaacgcggcuucugauaagaacaucaaggauggcgucugugcccagauugagaagaacuuugccagagccaaguggaagguaggcuuuggcucgcauuccccuuggcccaguuccaagugccucuucuugcaccccacaguuccuugcugcuacugcaccucuucggcugaacaccaaguuuucucaggcuuccacaggcggcugcagcugccgcggugaucaggagcugaagaaaugaguagcuggauagccagcggcagcuggggcacgacagaaggggcugggcuuagccguuuggaaggaguggaucuagugaagcucaccacgaaccuuucuucacuguccuccuugcagaaggcuguccgagugaccacucucaugaagcggcuccgggcaccagagcagucuggaacagcggcgacccagucugcuucagacgcugccacuccuggggcugcugguggggccaucgcugcugcagcugcagcugcagcugcagguggagcugccucagccucuggggccagugcuacugcagccacagaggguggugcugggugugcugccaagagcgaugacauagccucugcagaucguagugcuacaccagccacagauggcagcgccacuccagccacagauggcagcgucaccccagccacggauggcagcaucaccccagccacugacgggagugucacuccagcuacugacagaagcgcuacaccagcuacugauggcagagccacaccagccacagaagagagcacagugcccgccacucaaagcagugcccugccagcugcaaaggcagcagccaccccugagccggcuguggcccagccggacagcacagcccuagagggugccacaggccaggcuccacccucuaguaaaggagaagaggcuacuggaugugcccaggagucucagaggguggagacgagcugaaugggcagccuguugggggguuuugagggaugggaaggagggugggaguuuggaugaggggcuucucacuguauauagagucacuggcaugaugcccuagcuccccccaagcucccucaucccaguggggcaugccugggggccaugggagagcagucuugucuccuguguggauguaugugaguggcgggcaggccagaggcagggccagccccagccccugcauggauuccuuguggcuuucugucuuucgcuagcuucaccaguuucuguuccuugugggaugcugcucuagggauacucaggggguccuugcucuccuucccucccugccucaucacucccccaggcaggcccugcaaaccucauccuuucccaggcccuaaauggguggccuugcccugagagcugguccuccagcgaggcccugucagcaguguuaggcuccugcacgggaagguguguaccugugguguuugggcugcucuaggagugugcaagagaggaugcagaaaaccuagggcagugugcuuuaagucaagucuggucacgugguagggagcaggcauugcauguuagcuguggggauccucagaagugggagagagaauggguagaagcuuccaucuuuuuucccuggguggggguggcgaucuucccucuugaagauccuuguguuauuucauagccuccugaguccuguagcggguugcucuguaucccgauucuuaggagacucuaaaggaagagagaaacaugucggacacagcagcgacgccuaggagaacagaguacagugccccagccuaucuggcuccuuccugugagcuggauagggagggcugguguccccccauccccccaucgucuuccuagaugccauuaccaagaaagagaccuuugccauagccaccucaugcaggcucaggcaguaaauccuauuccucccagggaggcguggcagcaccucauaggcugcguugggagcaugcuuuucacagcagcagauuuucugcucuuagugcagcgauauggggaggcuuuuccucuuugucuaccaucagaggcugagguauugcucagccaugugaaguagcucuggcugggaugaggaaguagacuacaguuccccagcucccugagggaugcucucagcaggugcccuuggucagacccuaccacagccugaacaggcagccacgcugguccuugcccuugcucggcacuccauggugguccugcccuucucccugcaugccugugggucugcucugguaugugaagguuggugggcuaacugugugccuacugaaccuggcaaauaaacgucacccugcaaagccucuggccacccucuugccuuugcuuccucuguccucuuggggaggagccuauggaaggcagugcgggagggacgaggcugugggacgaucaguuuuuggguagcgguugaugcuuaguguguugcuuggagugagaguggaggucaccuucuccagugucuaccuggaugauguugaugggacuccucuggacgcuaaaaaucccacgagagugguguguuucagcuaaaaacuaucccgagcugagcgccgaagggcugacgcuuuuccgauucuuguugacaaagagccuuugucuuaacuuggacuuagagguggaaucuacucagggccaaccacuauaggaagugaccuugcgcgugggcacaguggggagagggugggauugcacaacaguucugugcuucuugaugccuacuuccugugaauaccugugcuuuccacuuagaccaaaaagauuucauucugucuuccccggcuggagcagaccuacuuuauaaaguuauguaugcuucuucugagggaguaauacugcuaacgauaccguaaaaaucgcuaaggagccucgcuucaacucaagauggccuuucucagggaggaccuuaaauuaucugaugugggaauaauaaagaggguuuguuauuuccuggucuuugaagcaucuguaccuccaaaaucaccauccuacagucucagguaugaggcauucugggaggaaagggcuaaauuacuagcuccagugucuaccuaaucucaaagguuauuaggucauauuugaauaaagccaggacuaguguagugguucgaagggcuaggacuuaauguguccaccuuuccaagaugauccauaguagaagguuuagaaaguggggagcccucuuucuguuugggaacugugggcugccagcguauggccuauuacuuuccauagccaugguaccaucauccccuuuucuuggcauuccagucuauuugacugcccugaagugcagcaagaaggggucugguucacuucgcaccggcucuagcuugagacaauacccggcuuagcagggauaggggucagacuguaguuucacuguuuuacgccacaggggaucgcaggguuuugcgguagaaacagggacccacucccaggagacccgaaggagcuaaaucccaggauuccgcacggcuggcgggcugcuuaucacagcccuccagcgccccgccccgaaguuuguccaaucagagggaagcacucaggcguggguuuguuauuccuuccgguucacuaccggaagucgugcgguggagcgaaauuugaaggaaccggagcgguggccgguucggccaccaaacugugucugucgcuggcagcugguucccugggcugcuugagucgagccaucaugccuauccgcgcucugugcacuaucugcuccgacuucuucgaucacucccgugacguggcugccauccacuguggccacacuuuucaucugcaauggugagugacggcgguguagggccccgugcguguccuagaaccacuuagacgcuaugggggugucgggccuagagacaaucccuccuccgaacuaagacaagugacgacgacauuagaggagccucacggaagcuuuccaaccugggccgaagugggccagguggaagugauaccgguagcccacggugaaagagugcuucuuuauugcgcuaagaaaugacuucaaaacuauuaguuugagcgaagaugagcuuuuacugcacuaacgagcuauuguauuuuauuugagagucaagagacagaccaacagccgggcggugguggcgcaagccuuuaaucccagcacuugggaggcagaggcaggcggauuucugaguucgaggccagccuggucuacagagugaauuccaggacagccagggcuauacagagaaacccugucucgcaaaacaaaacaaaaaaagaaacagaccaauuuaugcugauagguuucuggcaaucuuuaagggucugucguuugcuggaaugcuuuggauuguuucuauccagaaacaccucguugaucagacacuccaguacaccuggcuuaacuuggaauggcaaggaaguguguuccugucgucgagggguccugauguucaguugucuugugggugacgaaagagucccuuugcaacugagcaggcugauccaaagcucccaaccaaagagaaaauaagguagaagagaggucuccuuugggagacugggagguuuuugaggggcaauagggcccacaaagcaggaaguggugugaacacuucugggugucucccauuugcaaagcuuuguuuaaaaccgaccuuagagucuguuguguugcauaucccaguacaggcuggggaggagggacaguguggagacugaaugauugggaguuuuaagguuagucucagcuacauaaguaaggcaaaagucagccugaauuuucccagaccuugugucaaaaagacaaacaaacaaaaccacauaauacaguguuguguggccugagcuccauuccuaaggagccauuguguaguuagguuagaaguaaccccgccacuaaagcuacuuuguaucaccugcucucucccuaagcuuucaccuuggacuuuccuguguaauuauguuuuaggucuguuucuugaaaucauauuuggcuuuaaaaauuugguacuaaacugaaccuuuuuaagccuuaagugugagcuuacugaugaaauuugucauauucaguauuuucuaucuuguuccaccuguuggauuuuguggggguuuucuugucuuuuuguuugcuguuuucaagaaaguguuucucuguguagcccuggcugugcuggaacucacucuguagaccaggcuggccucgaacucaagcuagaucugcucaccacugucucccaaauuuugggauuaaaggugugcgccaccacacccacaccuagcugauuuuuuuaaucuuauuuuuauuuuaaauuauguguucuauguguaugucuuuguguggcuaugugcauaugaguauggguaaccucagaggccagggucaucugauccccguggggcuggagcuagacagucgugagucaccugauaagagugcugggaacugaacucaggacagccgcaggagcaguaccaacaccuacucucaaccaguaagcugucaucucuccagccuuuuaaaacagacaaacaaacaggccuugcuguguagagcucaggcugacugaauuucugguucuguuucuucugccuccuagagcucagauugcagguauaugccccaccuccccugucucucagauccauguccugugccuggaaggcaaguguucuacuacugguuauaccccaggccuuauagcuauuuuuuguuuguuuuguuuuugaaacaaggucuugcuauguaguauuggcuaguuugggauucauggcaguccucuugccucagccuucugagugcugugauugcaggugagagccaccacuucuggcuuccaccugugcacuuugucucacguacccuuggcuggccuugaacuugcugcguagccagggauggcccugaauuuguaaucauucugccuccaucucucaagugugaaaguauguaccauucuuuuugguuuauauaaugcuagggauugaauuuugggcuuuguguaugcucagcaauugaguuacauuccaagaccuuccugccccaaguaucuuuuuuuuuuuuaagauuuauuuauuauuauacauaaguauacuguagcugacuucagacucucauuacgggugguugugagccaucaugagguugcugggauuugaacucaggaccuucagaacagcagucagugcucuuacccgcugagccaucucuccagcccaaccccaaguauucuugaguaaauuuuuuuguuguugggagacagagucucaauauguagcugaccaugaacaaggagauccaccugagcucagaaauuaaaauugugugccagcccagccagcacuacuguaaccaucuuuagacgcugauucuguagcauugagcacauuugcaaugugauauacccuucaguguucucaucugaacuugccaucagccgcagacgaucauagcccacuguuacaugcuaacucuccauguuaguccucccagacccugagacccucugcuacaccgccugucccugaguucccuaucccagggauccuauagguugagucuuguauucuguguccuuucgagucugauguauuucacguagcauuauaauuuuaucauucacccaucuucuagcauguaucagaauuucauuuuuguuguggccaauauuuaauuguaugcaugaaaauaccauauuuuguuuauucauuugcugauagacagguauuuccagauuuuugacugcugugaauaaugcugcucugagcugcuguacagauaccuuucugagccccuguuuccguucuuuaggauguauaccugggagcugaaagacuggggcagauggagauucuauauuuaggguuuuuucggaacuggcauacuauuuuccacaacagcugccgacuucucucucugucucugucuuccucucucuuucucugucucucuauaucugugugucucucucugucugugugucucucuaggucucucucacaucucugggcugcacaagcugacuuuuaaacaccuuuuuauuauuuuuaguguuagacauuguaaucgccuugucuuggucuuguaaaugcugagguuacaggccugagacacugucuugcuuacucuauucuguugaaguaauguagaagaaacuacagagaaguacacauguuaaaagugcauagcuugggcuggagagauggcucagcgguuaagagcaccgacugcucuuccaaaggaccggaguucuaaucccagcaaccacaugauggcucacaacuaucuggacagcuacaguaugcgcauauacauaaaauaaauaaauaaauaaauaaaucuuuuuuuuuuuaagugcauaacuuguaggguugucacaugcccagcacaucugugcagccagaauccagaucuagaaguaugguauaggacugggagggaagcucacggguacagcacuugucccgaguaaauaaggaccuggguuugcucuccagcucugcagaaaaaaagaggauaaugccugcauuagaaaucucacgugcccucccaccagcacccucacacacauaaagguaccauuuugagguuuucuguuauacagaugagaucauacagaauauuauguuuuugugcaugugccuucuuuucaauauguuuuaaugauucauugauaauaugcuucuuuguuuuuuguuuuuguuuuuguuuuuucugagacagugauucucuguguagcccuggcuguccuggaacucacucuguagaccaggcuggccuggaacucagaaauccgucugccucugccucccgagugcagggauuaaaggugugcgccaccgcugcccggcuaugaugcuucuuaguuaacucacucuccugugucugauuagcuuuaauuuuguaguaugugaucuuugaauguauuuguaguuuuuuaauguguuuauagaaaagacuuggacaugcgagaugguuuuugaaggggaguuugucucuuauucuggggugaagaaggcugccccacucccaucccuggucucucucucaagccgaggcuuguuuggagcucgugauucucuugccuagaccgaggauuacaguuagacaccgccacaccuacagggaacuguuucaauuaacauuuaauacuuguccauaccaauaacugauguaaaucuguccauguuuugcuuuuaccacuacuuaagaccccuaaauuccuaaccugaaguaggguauuaucaaagacuaugucucugagagacucugagcuuugucaccuacacuguacagcccagcugcaaagaacagcccugggccaagacuuccaaccugaaacaacagcguugcucaggcccgcaggacuguccugccuguagugauagccucucauuguaggcaaggcaggcaggccggucuuaaaguggagcuaauagcaguggucaugugaccuguauccccagccaugccaggauuacuagucuuucauucuguuuucacuguagccuaauccagugguuugagacagcaccaagucggaccugcccacaguguagaauccagguaaggaugauggaguggggacaucucugcugaagaccuaccucuucuuuccagaaggcagggauggggaaaacaucucugaaauagaaacauuuugaccuuuugacccuguuggugugaggccagcugauccucccaaacaucugugagucacucaggaggccugcuuacccccucggguggcuggaagauagacuuucccaaccaggcuucacuuguguauacuuggcugccucuaauguuuagcaaaugucccugugcauagacaugacuucauccaccagcaagaggaugcauguggaaaguuaggucugagagcagaccuagaacaugagguaggcagucgaaccccacacucaggccuuccucuuccucaacuucgacacacuucaccauucuaaucugucucauuuucucauccagguuggcaaaaagacuauuauaaacaaacuuuucuuugaccucgcccaggaagaggagaaugucuuggaugcagaauucuuaaagguacauagaauuuaucuccuccuacuaaauuccaaacccucuggaaguucaccuuucuacuuagaaaacguaccuagagcugggcagugguagcacacgccuuuaaucccagcacuugggaggaagaggcagguggauuucgaggccagccuggucuacagagugaguuccaggauagccaggacuauacagagaaacccugucucaacccccccccccaaaaaaaaagaaaagaagaagaaagaaagaaagaaaaggugccuagaguguguggagcgaggcuuguggagcagguagagcugucaggugcaggcaagcaaccucgagacagucaucagaggcauacacugucaguggagaggggauaagcgacuaguggaucuccccuugggcucucagggccucuaagacccugagcuguaugaaggacuuacggucuuccuuccauucucacuagucagggaagaugugugaauccaccauucccuaaccugccugggccucgaaauugucuggagagcaugguguaguggcagaugcugggccuuuccaagcccagccggagaggacaaagcuccuggauuugguauuucuaaccagguggaaggaagaucagaccacagggaggguaaccagguuaucuucuauauuucucccauuuuccccccauaucuaaaauuuccuuccuuuuuguuuggggaagcuggauuggcagaauaucuugaugaaguugaguuggaguuugccagugauugcuggacuguaaggguuaauuugcugagaauuugucagauuacgacucgacucguuugaccucaacccacugggugcugugauguccuugaaaccucugugcuucaagaugguugagcuuuuguguuuggagccauccugugcaucgucaugguaacugcucccagcuuuaagagguguccucccugugauggagauaacaaaggcagcuuccagucuuuucuuuagcuuucaaagccaaggcugugagacacagaggccacaucuugaauaguuuggagcaaggacuuggaaagcauccugcugaggcguggaaagagccaggagacuauggggcgucugaucucugcauguccuuaccuaucuaccaguuccauucccagcuguuagguccacaguccccagcccagcugccaggagcuccugccccagagcccugggcagagaugcugguagcagagcccuuacuacuggucacacaagaaguucugagucuucuguuaauguuuaaagugugaucuggagggaagucugcccagauucuuccacaguggacccuugccugagccuggaagugugcuguaaaaaccuuuguuugccucuugcucacacggacauugggcuuucuagacucccaagugggagcccuccuggagcuuggagggagguggacuaaagcaucaaagcccaagaugaagagagcuaguaauggucucgagugccgggcuaucccugugcuaugucccugaugggucccugugucccaaguucgugccggagagugaggauauggcagggccagcagccccggagccucugcuauuggcugaacagcaggccaagcucuacuuccuguagcauucauucccuacaucuuaccuuaccuuuuuaaaaggcucagaaggaggcuggagagaugguucaguguuuagggcguuggcugcucuagcaaaugacaggguuugauucccagcaccuaaguggcagcugacaacuguccauaguuccaguuucagggaaucuaacaccuucuucugaacucaggaggcaaugugaauacacggugcauugacauaaaugcaggcacaacaccgacacauagaaaauaaaucauauuaaaagauuuauauaucuuaugcauaugaggcuguuuacguauguaugccugcaugccagaagaggguauuggaucucauuauagacgauugugagcagccuugugauuucagggaauugaauuugggaccucuggaaaagcagcucauaauugcugagccaucucuucugccuagaaauaaauaaaucuuaaagaaaaaaaaagucccauaccaggcauggugacacaugccuuuaaucccagcucuauagagcgcagaagcagaggcagauggauuuuugagaguucaaggccagccugguccacauagugaguuccaggacagccugagccaccuagugacaccuuguuugaaaaaaagaaaaauaaaaugugccugucucuguuggcuuggcuuuaaaguguauuggguccauucauguucacugccccugggcucugcacagccuuaugggaggcugaauggaggcgagccguaauguguuccugaugcuuaguaugugcauugucuugcagaaugaacuggacagcgucaaagcucagcuuucccagaaagguaaguuagcaagagacaagaggcccugggaagucucuggcuugguuguuggagggagggagugugagaggggggccuuugaccucuggcauagccaggggcucguucugcuuuguauuucccagaaucuugcuagcucuuaaaaccaguuaaaaaggagagagaugacugaagcugccugccucggccaggcuggccucuucccugcuuggaacccugugcucaggaguaguuuugggaggggccccaccugaugccuuguaucuucugggcuugcuacugcuggauuugacaggcauuugcuuggguucuggaaugauggauuaccuagacccacuggagugggagaacagugccaucuacccagacaguuccagcaggaagaaggagagccagucuaaggagagcagugaaagcuagcuuagacuucccggugcacggcagagagaagcggggcacccagcuugcuccccugugccuuguccuuaccugacucaaggaggagcugcugggugucagagguuaagguucucaggcaugauugggccuuucuucgccuugcuccccucugcuucugcuccagacagggagaaacgggacagccaggccauuaucgacacucuacgggacacccuggaagaacgcaaugcuaccguggagucccuacagaacgccuuaaacaaggcagagaugcuguguuccacccugaaaguaaguccucagagucagugggagguauggccacagccacggcugguuuggaacacgcagcgaucuaccugccccugccucccaaguguagagauuaaaggcaugcacugccaugcccagccuaggcucacauuucugaucauaucuucuauuucugccucaaccaaugccuuuguuuauguuauacaguaguaaauaaagugaaggcacaucucugcuucccagaccauucuccuccagaccauaaggaaaggggcgcaauggcugugcuugugggcuuuguguccaguaacaaggccuccccaacauuucacauggggccugcucaauggagaccugaguaggcugggccauguuuccaaaagugucucauacuccacugaugaggccagucugaagaaucuuccauuaggacuccaguccuuggcggggcugcucucuggagccagaucaaacagcauccuagggaggagcaaaggccuuugaaguccgcugugcugagcugaccgagcagaucaaagccuguagagcaagcaggccuagacccagaugaauuuuguaucagccuggguucgugagccucuugcucucugagggccacgaggcgauugaucugaacucaugauugauauucuagccuuguaggcaggagcagcccuugcugggugccaucugaaagggaugggagccauccuugugaacagauggggcccuaggauuuucauuuucuguuccugcuuggaggccgagcugcaucacauggccuagccagugggagggaaggggccagcaccagguuacagagcagucucugaugcaucccuggucagaccugggaaggucucgugcugaggacagcuccugccuugucucuccuauucuggcacuucuugucuauguguauagaugagauauagguuugagcucuuggcuucuuccauaugcgagcauguacagugagacccuuggcagaucacaguaguucugagucgguaagccagggaggcccaucuccagggugaggaaacugcugcccuaaaagucuagcaaaaaagcaugggccaagagaaggcugcgguucaaagccuggcuuggauucucaacguuucagacacagagagacacagacacaugcacacagaggccacacagagacuagaucagcaugagggggcucuuggcaguuuaucuccugcucuaucagcaucuucaaaagauaggcaaguaugaagguccacuccuaaaaucccagcacauagggguuauccuuggcugcauggugaguucaaagccaaccuaggguauguaaaacccugucaaaaaccaaaaccaaacaaaagauacaguacaaacagcucucaguggccaugguucugagacacugagaaggugucuugugcuuauucuucagaaacagaugaaguuccuggagcagcggcaggaugagaccaaacaagcucgggaggaggcccaccgacucaagugcaagaugaaaaccauggagcagugaguccccagcuggcuucuauacuguccuuucauaccuagggcaccagggggcggauucucagggcugcagcugaaaaugggucuuguucaucuuugauucagauucccaggugccuuuggccacagauuuccuuuuuuaaccucugugggccccuucccuuuuugugaguccucucauuacacuucuuguucuguugccuauggauagguggcuugccaugccuuucccuccaggagccucucugugugaagucccugaccuugaaguccucugucagcaccucuuuuuccucagaagcaucccuggagcugagcucaucucugcuguagaaccuuuccuugggcacacccaccugcuaaagcauccuagcagcccaggcuguugccauagcaacagcagcaaagggaggcagacuaaccaucagccuccagauuucaaaugccgugggccgggaauguuuuucagaauugagcuccuacuccagagccagcggucugagguggaggagaugauucgagacaugggugugggacagucagcgguggagcagcuggcuguguacugcgugucccucaagaagugcguaagcucgggcgugccucugccaucaucuuuuguaaugcagauacugugaaggagcagguuguagaaccauauugucguaaggugaacucuagcucuuaggcuacuuccgaggccccucugaccuccacuuuucugcauggagagagggguuugcccuugcugagagaagaguauggaugcaaguuuugucucugaggagcucaugcagcucucagcagugagcucccucaggagaucuggagucuucugcauuagcccuguuucugacccugccugacuuccauagcaaacuccccauauccuucauuaugguggugacaggaagcuggagaaaggagcugcuugccuccauuugggguuguagggagcccccuagugaggcuugcaugcucaaggcgcaguuccugagugugaccaggauuuguuccuccaccucauuacacaugcagggccugccaggggcccuggcaggcgggugaggaggagcucauuugugaggccucuguuaagcuggcgcuauggcuuagucacagcaccgaccaugccagucaggguguucuguucugugucucuucucauggcugcuuugcagagaguaugagaaucugaaggaagcucggaaggccacaggggaacuggcugacagguugaagaaggauuugguguccucuaggagcaaggugacugacugguggugacaaagggaaagggaggugggucuccugagcuaggccauccaugcccacaccacugggccagagaagguggccuacagacacuggguaugccuuuuacugugcacugucucagacucuggcuugucacuuggguccccagcacacacucaugccaccuuuugcucuucuugauuccuagaugcaucuuagcuggcuuggagagcacaaaccuccaguaugguagcgccagcagcccacuuuauaccccaucccaaaccgaggguucuugggccugcugcuuuccuucuguaggccgcacuguguacagagacacgcuugcccccaggcagcccauauucaugcuuaguugaugucuggggucuccccuguaccuccgguuuuuuuuuuuuuuuuuagacuacccaaacauacacuggauagcagcagguaggggcaggucauguggcaccacuggcuucuccuuucuuacaguugaagacucucaacacugagcuggaucaggccaaguuagaacugaggucagcccagaaggacuuacaaagugcugaccaggagaucacggugagacacccuggccugugggaagugaggggaccugagggguuaugugccucuaaggguagggcuggacuguuucugccuggaaaccuguguuacagucauugguguuuccgggcccucuguauccuccuggguuggaggugggucagcauaugcacccuagucuggccuugagccugucccuccucagcagagggcuaagggcaccgugaaucuuccucugucgucugcucaguucuuaccuccaaggcggucccuaaucuccagagcgaguaugccaccaagcggaguucucaggccuggcugguguugguggucagcccucacucuguucccugugcccuuuacacaggcguuucuccuuagugccacaaccuuucucucagguucucgcucuccuuucuccagagccuaagaaagaagcugaugauccuccagggaaccuugagccugccuccggcgaccaaugagacggucagccgccugguuuuugagagguuuguuacccuucuggggugauucuggaucacaagcuaagagagccugcgcuccuggcuuuggugggauagauguguuuauggaccuucugaccagagagccagccaggcucuaacugaaaagcggcuuugagagaauuuggggucugaccaggaaaggcagagaaagccuuugaguagccugaggacagggcaggggcagugguugucuuggaguauccuggaguuucucaccacaugcgucugucugccccaucucugaaacauacuugagagugcucacucuaaaauaagcccccucagccuggugguguuggugcacgucuuuaauccuagcauucgggaggcagaggcagacagauguaucuaugaauucaagaccagccuggucuacagagaguuccaggccagccaguccaaaauaaauaaauaauccucgcggguccaggagugugcuuucaggcugccagcagagggagccaaacgacccagggauuggugucccugcuaggagcaagcuucagucuuccugaguguuuuucacagaaaugggcuggcuaagaauauccucaaggcugucuucugccugcuacaggaccccagcaagggagccaaauuaaaacugucaacagcccagaguuuuacuuaagucacuuuuuaacauauuauggcaaaucaguaugcccuuucuuucugccagugcaguuuacccauucagugccuuccaacacuccacuuuccuccuggguacuguggccccugacuccccaucucucaguuccucaauacugugucucaggacagucauggagcgggcuuagguuuaaaugguuuccuaggauccugccgugucacagccaaccauaagaaaacacuucuuccugcuuccacaauugcuucuuuucuuuccuaucugaaggcucuguuugugcuggccagcuuccucagccagauagcacauugugugugugcuugugugugugugugccucauguguguauucaugaaugaguauauuuguguaagaguguguguauguauuauauauacauauguaugugugcaugaaugaguauguguaugaaagaguauaugcgcaugcaugagugagugugugguuguucgugucacaguauagaggucagagcauaacuuuguggaucauuucucuccuuuuacuucaacauagguugaagggaucuaacagaaguugccagacugaugcagaaacgcccucacccucugagccaucucaccagcucuuauuuuuuuccuuagcaucucucuguagagcccaaacuacccuccuguuguaguuuaugacgaccugagaacugugggacuguggugggcacauggucugccaugcgguccggcacauggucugccaugcgguccagcacaggggugaccuugacaacucaguaggcucugucccugauucuuccuccuaccacacccagccaucggccaugccuucucugaaguccauuguaacacgagggcuuugucaagagcuuacauacauguaguaugugcccuaggaaaacgacaaucucagaaacuguacuguagagaaaaccuuagccuaagcugccucaggcuggggauagagaagcauucucaggaauacccgcgguucccugauggugaucccucuagcuucuguucugcgagccucgggcuccuuucacacaguuguccucugugccuggcuguuauagcaaggaaaacacaagcacaugggcuaccuaggugcccagggacugugcauacccacuuuugcuaauuucccuuacuccccaggcuuuucugggcuauguuccuguacuagguauuggcugccagugcagccuuguuuuuguggguaggaugauuaggcccggaguccacuaggcagccccauauuauagaagaauccggucuggaacgcccaggugggaaugagcccucugucuggucaauaagccucaugccagggccacaccuuacuuuggcacuaagaggauaguucuggucucucaaaucaggagggcacugcauuagccaaaccucaguccuaagccugcugggcugcccuucaaguuguggacagguucccugucuucaccaguaucuuucuaggcgcgaaaccccagggauaggacugcugcguuuagcauuagccuuuuaaacuuggcauacucgauucugaauuccagguucucccuccuagggccccuagaucuccaaaacaggcugcugguuccgggguugggggcauuuccaguuuucucugaucuacaagugccucugucuuucucucugacuuguugcuguguaguuuggugagauucuuaaacuuuccuaauacagaugagauguguagucacguucaucacauucauaaaaccaccauuaaaucugaaggaagagaaaucuaggcagagaggaugacgaguucacaguccuuggggcauugcuaaggugggcuuagaggagagggguggguggcaggugggucagaucucugccagccuucauaugucagccuugcaggugcagauuucauccuaagaacaguagaaacuauuggaaauguuucuggaagauaguucugggaccugcugcauaucccucauuucaucccgucuccuaccaauugauuccuugagcuguucucaaagcugcuuugugcccccaagccugccccuguagauuccggcuucugugugaggcucacauuccccuggccgugcucaguaucucguggaagggucuggaugucgcuggugaugcccaugccucguuuguuguggugggguuacccuuugcuucugucaucauggugcuuuacacgugugucugcacaccagaagagggcaucagaucagcugccaugugguugcugggaauugaacucaggaccucuggaagaacagcuagugcuccagccaucauuuuauuuuauuauuuuaucuucuugaugcauuaugauauauuauauaacccaggcugguuucaaacucgauauguaucugaguaugaucuugaacuuccuaucuuucuggcucuacauccugagugcuaggauuacagucauauucuaccacaucugauguaugcagaggugggauugaacccagagccucauacaugcuaggcuagcacuguacuaccugagccacauccccagccaugcuucgguuauuuuagggcagcuccaagggacccuugccuuuccuucccucaguuuuucaaagcuacaccauagcucuugcccacuggggcgcaguucagaggaaagggagcuauaggggaagugauaggaagacaucucucgugggcccuaagggcuccuaaauucugaugagauagggcaggacuaagaggcacugaguucgugcaggaugugcugacaacggccgcacaaguaacaucugccuagggcuuuggcuuagaaaggaagaaggcuuugaguuugagugccuugccucauuuccugaggccgguaaugugaagcuguguaaauuggucauaggugagugucgcagaggugauggaacacucagugccucgaggcagaccugugcuguagugaaggaagcaccaagaauccuaggcauauggaggagagggcaccacgucauacaaucggacaugcauguauaguuuugucuucugagacaggaucucucugacuguccuggaacucacuguauagaucagcuggccucaaguucacaaagauccauccaccucagcuaggauucagaggugugugccaugaugccugguuugugcauguauauauuuuuuuauauucucuuuuaggcagucuugauauauaguguaggcugcccucaaacuagcuuugaacucaugaucuucuugccugagaucauaggugugugacauuaaauugaccauaugaguauuuuucuauguuacuaaaguuccucuuuuuuaauuauuuauuuuuuauaaaugaguacacuguagaugucuuaagaggagggcauuagauccuauuauagaugguugugagccaccauaugguugcugggaauugaacucaggacuucuggaagagaagucaguguucuuaaccgcugagccaucccuccagucccacuaaaguuacucuugagaacacuauguagugucuucauccgucagcuccugcaguaccagccacgagcacaccaugugccgugagaagcaacagcaucuucccggcucuaucacugcaguaauguggcugaauggcuggcacugaguucacaggaaguaugugcucaaagggaagcauccugcucauuccuuuggcuuacauuuuucccauugauuuuauuuuaagcgugugugcauguauuacacaugucugcuugugcaugaauuacacaugucugcuugugcaagucagaagguaacuugugggagucagugcucauccaccaugugggugcuggggagucaaacacaggucauuggccuuuacccagugacccuaccaaaccagcccccuuuugaauuugguuuugcuuuuguuuacuuucuuuuuccugauuuucaauggucacauagcuaugcaaaggcugaagccgcuuagcuuauucuuagagauuaagccugcuuauauauaggcaacacugugagucccagcccuuuuaccucucaaccuuaaaaucuaggaaaacuucacuccugucaccccaaguacugucuccacaaugcaggcucuuuggcccucugguauaguucaacauggggcccgugcccucgugugcucuaauauggucugugucugugugcccauagcuagcuaucgaggcauauaaaaagggaacucgaugauuucaggcucuggggugacccugagucagggauaggcauuaggagccccuggaacucagcugucucuuccucuucuucuguuuuguuuuuuguuuuuuuguuuuucaacguguguguguaccacaggaugcaucaggacaacuggaaguauucaguuuucucuuuuuuuccauaugggcuccaaggauugaacucagggcuucaggauuggggacaauuguauuaccaccugagccaacuucacugggccaagcugaguuacuucugauaccuaaggaucugugaucucucugggucaucaccgcaguccugaauaaugagauauuuugucugccuucagcccagccccuguggagaugaugaacccgaggcuucaccagccacccuucggugaugagauugaucucaauaccaccuuugauguaaauaccccuccaacccagaccucuggcucccagcauugccuccccaagaagcugugccuggagagggcacgguaaguauugguccccggagguuccuauaaucaggaaggccauagcuaagucacugguggguccugccccgauggcucugagugguuggugcagcugcuuaggcuaggauacagcuuugguuccagccccagccucguuggcuugagugcucauucugggaguccugcuuaguucuuuaacccuaacaagccucaggacgauguguugggaugugagucucaguaggggaagucuggauugguacugaggcagguauccuaauacucugagugccugcccaucagaguccuggugugggacucugaauuuuucucaugugucucugagguuccugcuuaacgcaggaccaugucaaaccaugaucccauaacccuaccaccuagggaaagaucccauuuaggcagauaggagggcuucugugcagcugugaggugggaccugcucuagacaugccauggaacaaggagagggaggccaucuccuuggccagacacaugacugugccccuucauguacaugggucugugcuacuccagaaaaggaggucuuuuuacauuuuuaaacauuucauucaucugguuuuuucuggggguaggguggggguucacguggcgauaagaggacuauguauauguguagaaguuggcucucuucuugcaccgugugggggccaaggauccaaguuggguugacaggcuugguggcagaguuuuaucugcugagccaucucucugguccuaagaaaaucuucaugugagacuuuggauguaagagaaaagaacuguuaugucaggccaugacagugagagggaacccaagggcaaagcagcugaacauggcucccaugcugcacaccgcuggucuggucgcagcgagaagcccaagucgcacagcuacagcagagagcugugggguccguccgcuccauccuccggcuuccucuuauucccucuucagcugccaguugaggcugugaaugcucauccucugugcauaggacauuggcugggcucccuagaacuuggugaggagccuaagaacuuggggagcacugaaaugagagcccagacugaggcaugguccugucucccugacccuggagcuaaucuuuucugacuauacuuggggagggucugcugagguuccuggccaagcagagccaugauggcagccugccacguagagacuccucugaagggcuugugcccgccaucuugcuuacuugccuucacgucuccugucucgucucacagcucucccaugcagaauguccucaagaaggugcacaaagucuccaagccgguaagggccggguuccucaaaggcaugcagacagucccacccaggccuugccagaacaggaaaaccuaucccucuaaccugugugugugugggggggggggggggaugguuauaccacuguaauccaguguuugggaagguaaggcaggaggagaacccugcauagugaguucugggcaucccggacuuuagugagaccaucucaaaacaaaauaaaacaaagaaaaagaaacgcucuacuucugagagcacagacuauguucagguucccucccugggcccaggacugagacucuucagagccauccuugggcccuggcucacuuuccccugccuccaguccuuucuccaucacugccccauguccuaugcugcugucuggcuuguugugucugacucuggcauuauuccaacaggagucccagcucucacuggguggccagcgauguguaggagagcuagaugaggaacuggcuggugccuucccucucuucauccggaaugcuguccugggucagaaacagcccaacaggaccacagcagaaucccguugcagcacagauguggugcgugugguggccagccuugaggguggggcagggucgucagcucccuauccauuacucuaacccacucaucucuucccucucccuagguaagaauaggcuuugaugggcuuggaggacgaacaaaauucauccagccuguauccuuuuucuauggccauggucugagaugaccuuaggggcauaugccaugcccugaucuguauccccaaguucauuacuuccagugccuacagccuaagaugggcccagcugcgccuugcucaguguaucugcacuuccugacccagggucugcgcuuuccugcccuggguuccaguccccucucaagcuucuuccuugacauugcuuccagagggacacaaccauuauccgaccagugccuguuaaguccaaggccaagaguaaacagaaagugagaauaaagacugugaguucugccucccagcccaagcuggauaccuucuuaugucagugaacggugaccagagucauguuugcaauuagugggccaagaccuggcuaaccggaaguguuuuuggaagauggcuccucuuggaccaguccaagagagaugcccagaaaacacacuuccuguguucacugcgcccugcaccacacugggaagccacaugaccaguuuacuguuccgaucagcagggccuacuuccaguugcaggguuuugcuuauagcuacaaccagguguggcuggacuccuuuuguuuuuauagaacagggucacauugacucuaaguggaugggagugcuggaggauccuaugcaggcuggaggacccugcgcuugaacuccugccugccuccagcuuauugcuugaaauuauggggugagguggugauagggaaagguuggggaaguuuucuguguaaaauaaaaaggcaucuuuucuucuaggcucuggcuguauaaauuuguaccaaaaccuuagaaaauuucuaggcuuagaccuaguauuuuaagucuaggcauggcauuggcucucucccagggcacaggaagacuagcaagaauggcagcccugcaguccaaacuguaaacaaagcaggugggugagcccagugaguuccagcaagcacaacagauaacuacugaccaacuguuagccucuagggcuuggguucaggacuuucaccaagagaauuucccuauuggccacuugccugagucagauggccuaagccacuccuguuauugaacaggagcucacuggcuucccucucacaccgcgugccucgugcugaagacaauccaaccacuugccaggaaaugggaggagccugaggcugucuggauggagaugauagccuucuuuaagugaugcuuagcuuugauuggcaacucagcaugaucuagagucacguggaaagggccucuccuugagaucuagauuagcuuggccugugggcaugucuguggaggguuaucuugauugugccuacuauaaguuggcaccauuccuccccuaggcggaggauccugggcuguuuaaagagcaaacaaagagcugagcacaagaacacaugcacuaugucugcuccugagcgcuacucacugcuccacccucugccuagacuucccugcaaugaaccuguaaccugaaucuugaagcuaaaauaaaaacuuucuccccuaag

SEQ ID NO: 5303 - RNA, 1696 nt, Mus musculus
cagauguuggggcggcagcggcgggagcuaccgagagcaaggagccuuagaguaaggcaagggugaggacgccaccacccgcgggccgacccggcccacucugcgccgcucccgcgggugaucggcgggugagccggccgaccuggagaguguacagcaccagcaccagcaugcacagcgcucggcuugacagcuuccugagccagcuccgcugggaacuggugagucuuuggagugggugugguugugaagauguguguggggugcguggcugccgccuggauggaacaacaaacggcaaccggguggacuccggguacccaucugagucaggaugggggcaggguagcgcgcuacagauggcccagauggcccgcuucggguuucugacgguugggaauuguucugggcaucagguaacaggcgcccagcuggccgugcuagcggcagggguuggcggggaaggagaguuggggaagagaaguuucuuuuggggaccgacagggagcacccagggccuaaagaagugcugugcugcuguggacauccccuaccacgggcuggccuguaccuccuuccucuacucugccugcccgcccugguggcgcgugcugacuugcccggcccugcgugcugcagccugccggacugccaccagcucugcggaugggagccacaugagccucgagugccagugcccccaugugggcccuaugcuuacaguuccgccuugcugcccagagguuuuucaaguccuucugaaaccuccguucucagggcuggcuugguuagacacuaaggagucaggggcuaagagauuccugaccaacauuugcccuaucuuucucuccaguugugugcucgggacacaggcucaccuccaaugucuggcccacugcaaccaaaacccagaacugaucaaaauguacagccaaagcgccaguucagggccucggauguuuuggaagaggacucugucugcuguguagaagaggaagaggaggaaggcuugguagcagaagacaaggguuuacccuugggauguccuagggagcaugcucuagacugggacucuggcuucuccgaggugucaggcaguacauggcgagaggaagagccgucuguaccccagcgccaagcaccucgagaacguccaccucauagccagcguuucucagucagugacauuccuaugcgcaguagggcagcuguaaccaacauaccuccugcccaccguccgaggcccaaguccaccccagaugcuugccuggaacauuggcagggauuggaagcagaggacuggacggcagcccugcugaacaggggccgcagucggcagccccuggugcuaggggauaacuguuuugcugauuuaguucacaauuggauggaguugccugaagcaaccagugaggggagugauggagauguaccccgagcacgggcucgacccccucaguuccugcuuggucucucugagcagcuacggcguaggcuggccagggcucgacggacagcuauggcaagcaagagguuguccugcccaccucgcucagaaccugaccugccugcagacaucucacgauuugcagcccucaugaacugucgaagucgccaaccuauuaucuacaaugaugucagcuaccucugacccugccccuccagcuagggacaauaaaggcuuuuuuuccuaaac

SEQ ID NO: 5304 - RNA, 3626 nt, Mus musculus
cguagauuggcucucccuguuacgucacuggcugcgccgccuccggccggaacuccggaccagccggucuccaaccaguuccucgucuucuguucuggcugauccuggaccccacaucaggguagagcaggggggcgaggugacaccagaguuggucagucuaguuggugaaacgugcaggucagggcacggcguugggagugcgcggcaggggucggucaggcggccuguaaguacuuuggaccgauagauccacuucuaacaucugcagacgccaugaaggcacugaucuuggugggaggguaugggacacgguugcggccgcugacguugagcacuccgaagccauugguggacuucugcaauaagcccaucuugcugcaucaaguggaggcgcuugcugcgguaaggccgugggucuguuauggcgggaagagggauggauagugacugggaggccagggguggucauaccuugugacugagccagucaacuagcacaccuuauugugucugacaggcagguguggaccacgugauccuggcagugagcuacaugucacagauguuggagaaggaaaugaaggcacaagagcaaagggugaggcauggacuuagcccuuucuuuaggucccuggggcucuuaccauuggaggaggaacauaaccagauggcuucuucuuuccagcuuggaauccgaaucucuaugucucaugaagaggagccuuuggggacaggucaguauaaggaaggcccuugggcaaacuuuagggccagcaaagagguauccaaucugggcggauggguggggccucuggagucuggaccuaggccccuagcaaggugguaacuuaugacuuguccccuucucuagcugggccucuggcguuggcccgagaccuacuaucugagacugccgacccuuucuucguucucaacagugaugugauaugugauuuccccuuccaagccauggugcaguuucaucggcaccauggccaagagggcuccaucuugguaagagaagauuuccucugacauucccacccucacauggagucuuuccugaccccuggucuuaaacucuguuuugcuacaaagcuaugcagaaugucuuugggggagagccuuugagaugugggauaggcauauuuaucaagaguaaagaaaacuggacuaggccuaagguacccuccaccucuauauucagguuaccaagguggaagagccuuccaaguaugguguggugguaugugaggcugacacaggccgcauccaccguuuuguugagaagccacagguguuuguguccaauaagaucaacgcaggcauguacauccugagcccugcugugcugcagcgcauccagguguguaggagagaacugcugggcgggcugggguggagcaggccucugcuguguggccugcucacaaauugcccacuuccacagcugaagccuacauccauugagaaggagaucuucccaguuauggccaaggaggggcagcuauaugccauggagcugcagggugagguagaggccauagggugugggguagucaguguguggcuaggcagagcccucugacccaucucucuguacaggcuucuggauggacauuggacagcccaaggauuuccucacuggcaugugccucuuccuacaaucgcugagacagaagcauccagagagacuguacucaggcccuggcauuguggggaauguacuuguggugaggcccuuguccagccugucgcuaaucuuuucagauuugggagacaaaugacccacucuugcuuuccucaacacucucaggacccaagugcccguaucggucagaacugcagcauuggccccaauguaagccuggguccugguguggugguggaggauggugugugcauccggcgaugcacagugcuucgugaugcucacauccgcucccauuccuggcuugagucaugcaucgugggcuggcgcugccgugugggccaauggguaagucuaugagcugggcugggcaggcacaggagcaggggaauaugugugccccauuaacaaggcuuaucccccaccuccaggugcgcauggagaauguaacagugcugggugaagaugucauaguuaaugaugaacuguaccucaauggagccagcgugcugccccacaagucuaucggggagucaguaccagaaccucguauuaucaugugaaggauauggagggcuggccaagcauccacuuugccaucagcaggguaggacucaaugcuucacgaggcccuggacuuggugccauuugucuagggaggaguggaugacucugaagcugucggacuucugccuucugguggggacagacauggacaggacccugcuggguguaacccacaagcccccacucccucaagaagagcgggcccagggcuguuuggaauaauaauuuaaugcucacuguagccuggacuggaagucaagcucaggcucccaccagcgaggcuacacacaggcagauggguggguggaagugguaagagugagggugauggguaaacagggcccggucugcggcugauggcggagcuuccaggauggccuaggcagcugaggacauggcgcuuguguuggcugccuugucccaguccucuacagauacaaugguggcuuugcagaagaagcaguccuuguuguucaucaggugcugguugaugcaggcucuacaagaggggagggaaggagugcuaccucgugcguccuaauuugccuccccaaguccauggggcccacuuacuugcaggauuugugaccacaaggcuggaacacagcagagauggggugggcguagcagauugggcagagguccucuucauuggugggcuacagggcagaguggaggaguugggcugggauccuuaccccuguccugguguuuacagauuaguaaaacggccucuguuaugccacacucaccagggaggcggcggccgccugggcagaugcagcggucaggugagccagcaucuguuccaccugggccagcuccucagcgcugauauaaucuguaucugcaucaguaguagguagcaucagggccccugucgucugagaacucagugccucuugaauacucccaggcagggaauuugcuauugaggauccugaaacucuucccugaccugacccacccgcugguucacuuacaacucuguagagagaagcguuuccggucaggggcaggcaagguagugccaggugcuaggggcucuggcugccccaggagauagcauauggaacgaagcuggaagcagggaucagccaggagcacagagguggcuugcucuguccuagguaggggagggugcauaggucguaggaaggcuuugagccugugugaacauuuucuccacgugggacagaugaauauccagaggccucgcucauuauuaugccuccacucuccccccuauuacuuaccaacccucccagguguuuggucccacaugaccugaauaccaguuuaaagagaagggugcuauugauaaaaaggugcuugcuaccagcuaugguaacuugggucugauccccagaaccucacaagucgucguccgacgucugcacgaaug

SEQ ID NO: 5305 - RNA, 3626 nt, Mus musculus
cauucgugcagacgucggacgacgacuugugagguucuggggaucagacccaaguuaccauagcugguagcaagcaccuuuuuaucaauagcacccuucucuuuaaacugguauucaggucaugugggaccaaacaccugggaggguugguaaguaauaggggggagaguggaggcauaauaaugagcgaggccucuggauauucaucugucccacguggagaaaauguucacacaggcucaaagccuuccuacgaccuaugcacccuccccuaccuaggacagagcaagccaccucugugcuccuggcugaucccugcuuccagcuucguuccauaugcuaucuccuggggcagccagagccccuagcaccuggcacuaccuugccugccccugaccggaaacgcuucucucuacagaguuguaagugaaccagcgggugggucaggucagggaagaguuucaggauccucaauagcaaauucccugccugggaguauucaagaggcacugaguucucagacgacaggggcccugaugcuaccuacuacugaugcagauacagauuauaucagcgcugaggagcuggcccagguggaacagaugcuggcucaccugaccgcugcaucugcccaggcggccgccgccucccuggugaguguggcauaacagaggccguuuuacuaaucuguaaacaccaggacagggguaaggaucccagcccaacuccuccacucugcccuguagcccaccaaugaagaggaccucugcccaaucugcuacgcccaccccaucucugcuguguuccagccuuguggucacaaauccugcaaguaagugggccccauggacuuggggaggcaaauuaggacgcacgagguagcacuccuucccuccccucuuguagagccugcaucaaccagcaccugaugaacaacaaggacugcuucuucugcaaagccaccauuguaucuguagaggacugggacaaggcagccaacacaagcgccauguccucagcugccuaggccauccuggaagcuccgccaucagccgcagaccgggcccuguuuacccaucacccucacucuuaccacuuccacccacccaucugccuguguguagccucgcuggugggagccugagcuugacuuccaguccaggcuacagugagcauuaaauuauuauuccaaacagcccugggcccgcucuucuugagggagugggggcuuguggguuacacccagcaggguccuguccaugucuguccccaccagaaggcagaaguccgacagcuucagagucauccacuccucccuagacaaauggcaccaaguccagggccucgugaagcauugaguccuacccugcugauggcaaaguggaugcuuggccagcccuccauauccuucacaugauaauacgagguucugguacugacuccccgauagacuuguggggcagcacgcuggcuccauugagguacaguucaucauuaacuaugacaucuucacccagcacuguuacauucuccaugcgcaccuggaggugggggauaagccuuguuaauggggcacacauauuccccugcuccugugccugcccagcccagcucauagacuuacccauuggcccacacggcagcgccagcccacgaugcaugacucaagccaggaaugggagcggaugugagcaucacgaagcacugugcaucgccggaugcacacaccauccuccaccaccacaccaggacccaggcuuacauuggggccaaugcugcaguucugaccgauacgggcacuuggguccugagaguguugaggaaagcaagagugggucauuugucucccaaaucugaaaagauuagcgacaggcuggacaagggccucaccacaaguacauuccccacaaugccagggccugaguacagucucucuggaugcuucugucucagcgauuguaggaagaggcacaugccagugaggaaauccuugggcuguccaauguccauccagaagccuguacagagagaugggucagagggcucugccuagccacacacugacuaccccacacccuauggccucuaccucacccugcagcuccauggcauauagcugccccuccuuggccauaacugggaagaucuccuucucaauggauguaggcuucagcuguggaagugggcaauuugugagcaggccacacagcagaggccugcuccaccccagcccgcccagcaguucucuccuacacaccuggaugcgcugcagcacagcagggcucaggauguacaugccugcguugaucuuauuggacacaaacaccuguggcuucucaacaaaacgguggaugcggccugugucagccucacauaccaccacaccauacuuggaaggcucuuccaccuugguaaccugaauauagagguggaggguaccuuaggccuaguccaguuuucuuuacucuugauaaauaugccuaucccacaucucaaaggcucucccccaaagacauucugcauagcuuuguagcaaaacagaguuuaagaccaggggucaggaaagacuccaugugagggugggaaugucagaggaaaucuucucuuaccaagauggagcccucuuggccauggugccgaugaaacugcaccauggcuuggaaggggaaaucacauaucacaucacuguugagaacgaagaaagggucggcagucucagauaguaggucucgggccaacgccagaggcccagcuagagaaggggacaagucauaaguuaccaccuugcuaggggccuagguccagacuccagaggccccacccauccgcccagauuggauaccucuuugcuggcccuaaaguuugcccaagggccuuccuuauacugaccuguccccaaaggcuccucuucaugagacauagagauucggauuccaagcuggaaagaagaagccaucugguuauguuccuccuccaaugguaagagccccagggaccuaaagaaagggcuaaguccaugccucacccuuugcucuugugccuucauuuccuucuccaacaucugugacauguagcucacugccaggaucacgugguccacaccugccugucagacacaauaaggugugcuaguugacuggcucagucacaagguaugaccaccccuggccucccagucacuauccaucccucuucccgccauaacagacccacggccuuaccgcagcaagcgccuccacuugaugcagcaagaugggcuuauugcagaaguccaccaauggcuucggagugcucaacgucagcggccgcaaccgugucccauacccucccaccaagaucagugccuucauggcgucugcagauguuagaaguggaucuaucgguccaaaguacuuacaggccgccugaccgaccccugccgcgcacucccaacgccgugcccugaccugcacguuucaccaacuagacugaccaacucuggugucaccucgccccccugcucuacccugaugugggguccaggaucagccagaacagaagacgaggaacugguuggagaccggcugguccggaguuccggccggaggcggcgcagccagugacguaacagggagagccaaucuacg

SEQ ID NO: 5306 - RNA, 9234 nt, Mus musculus
cuucuuacuauccaggccccgcccccugccgacuggccggagcuuauacagggcccugcgggucccaggucgccacugaguguagcggaaacuggggaccgccuuaggccccgcccccggagcuucacuuccgggacuuagcugcuaccgaaagaccgacuauggagcgucaggugagggcucggcccguggcccccguggccuccguagcccgggcugagccugacccugguguguccccugcgcaggugcugcugagugagccccaggaggcggcagcgcuguaccggggccuuagccgccagccuucgcugagcgccgccugccugggcccggaggucaccacgcaguaugggggccucuaucggacugugcacacugguguguagaccgagggaacuggguggcgacgggccgugcauccagguggagagauggggacuguggagggcacgcugcuugacacggguuuggggaggaaacccaacuguaguuccugcgcacagguguuuugggggcugcacuagccuuacugauaaauaauuccguaaaugaguugaaggugugggaguaaaauucagaccugagugcaaggugugggccucgcaggacucuccggcccuuacauucuacaacccaacaacagcuauguugcccuuaaaauucugugguugguaguggguucucucugaccgucagcucaggcucugggagccuaggcuuagguuauauuaagugaaguguuguccaggcuauacucaggcuguccggagacagacugggaaagauaggccuugauuggugggcagugguccaaacuggcccagacaaguugagcagcccccugccucccuugcagaguggacucagagggacuuggaucgaauggagaacauccgauucugccgccaguaccuaguguuccaugauggagacucggugguguuugccgggccugcgggcaacaguguggaaacccggggggaguaagugugacaggagcagucuguagacaagaccgcagccaccugccuugcuagccuuucauaaaugucgccauguguccuuaggguguugugcucugugccuauccccuucagggacaacuuuggguggcuucaggggagcaaagagcaaggugccugaccccugagagcuugucuggucucuggagacauggccugauaaauacuaggagcuucuucuaaacuagggccuaggucccuaggacucuggagacagucgagucaguaaccuaaggaagagaaaaaaggccagccagcuugaggcugggagugcuucaugggcugguaugauuucagagucccaguuagcugggagauagccuccugugcggccaauucugauuuuauaacgccagaccuaaaagggcuuauaaagaaaggagagagagacagacagacagacagagacagagacucagcuaagagguugugaccaguaagggggccagcacaaggcuguugggggggacgacuuggcaccuuccugaccugcaaccccuguucucaggcugcugagcagagagucuccuucaggcaccaugaaagcagugcugcgcaaggcuggaggugcagucucgggagaggaaaaacaguucuuggaggugaguuugcaaggaugagguggcagccagccggucacuuagugccacaagugaagcccuguggaggggcaagcagccugaugcccagguaucuucaggucugggagaagaaccgcaagcucaagaguuucaaccugucugcacuggagaagcaugggccuguguaugaagauggugaggcgccuggcugguaagcaggaggggugggcagaaggggcagcuauagcauugggcucccccuaaccgucccucccugcaugcagacugcuuuggcugccucuccuggucacacucagagacgcacuuguuguauguggcggagaagaagcgucccaaagcugaguccuucuuucaaaccaaagccuuggacgucagugccagugaugaggagauggccaggccgaagaagccagaccaggccaucaaggugcuugugguguggccgggccacacaggcccugccgggcagcccugcccuacauccgguggaccugggaggcccuagugucuaggaggcaggucaggguucuguaggcacccugggcauugaguguccucuguucucagggggaccaguuuguauuuuaugaagacuggggagaaacuaugguuuccaaaagcaucccugugcucugcgugcuggauaucgagagugguaacaucuccgugcuugagggcgucccugaaaauguguccccuggucaggucagcagcaacauggccuuugccccuucuggagucgggguccccugcuugagcgauuacgucuugcucauaccuacuuugugguuuuguuugcaggcuuucugggccccuggagacacgggugugguguuugugggcugguggcacgaacccuuccggcuagguauccgcuacugcaccaaucgcaggugagaaagcaggcagaccagagggcccuuacggcccagcugaccauagagcugagugucucucugaccuuuccaggucagcccuguacuauguggaccugagcggggggaagugugguaagugucuggcguccgcacgugcuuuccugacuguuagucuucccuggucuaugugauacucauauuucuguggccuagaacuacucucggaugagucccuggcugucugcucuccucggcugagcccagaccagugucgcgucgucuaccugcaguacccaucucuagccccucaucaccagugcagccagcucuuccuggugagcugaaguggguggggugggaggacgguuagcucuugauggggaaugagggcuaaagggauggugucaucuccccccucggggcccucuccuguccuccguggaccaguggccugacccuucaagguaaguccuggaagcuuggguacucucagggcucaccaccucaagggguccuccagccacagagaugcucgcgcgucuuaguucacgucuccaaguagccgggcucuacaaggagcaggggcagaguuggggguuauauagaguccauccccugcacaaggagagcucugggugaaaagccaagggacaugccuaucugagacaaguccaggcucccauaaaagagguaaauuagcccccaucucuccuaaguagucacccaaagggauagauaacagaguucugugcccugagguccauggccugguggguuugaccauuuuguucucuugcaguaugacugguacaccaaggucaccucauuggugguggacauuguaccucggcagcugggagguaagaggugccuggcucaucaguggagucuguaauagugcuaucugucccuccuuccugaguuccuuuggaggacucucuccuuguuacugcagcccugugcccaggcccaacagagacagaagaugcuacuauggguaauagucugagaguuuuuggcuagaccaaaacuaaggucagaguagcucaaauuggcuugggaugagucucaggaaauauguuaguuuggaauauuaugccugagaagccuuggggcugcaggcucuguguuacucuguguucaaccccacgccaccccagcaaccuuuguccagucuaagucagcugguccuccggaaagguagcucugaggcuccuuucucaacaucagguacuugcagcucugccugcagucuaggggcauccuaaggacacagggaugaaaguuuucuuuucucaagccacccagaaagguccaaggguccagugagcagguccagugcacaaaguugcagggauacagcuggaaugcagcucaguggucaagcacaaggcuagcaugugcgaagcccugcacuugauccuuaguuacacuuuugguuuacaaggacucgauaguagggacguagucuaaccucggcucugcccguuagucauguguccagggucagugcccuggccuccaugagcuuguuucuucacuuguggacggggugguuauguccccccuccaagcucccgugugagcugcugugcucugcacugcgguggacaaacacguucuauauaagguuaaggcacuuaauguugccaagacccaaagggagcaaccaauaggaaagcgucacguuugccgccugagcuuuccagcucugccucuauggguccucagaagccucuccucccgcccccuucaccuucuacucgguaaacuccccacugccaaggguacccucaugucuaggacugugauucuacuacagauuucaggggcccugugugaauuccccaaccucaucuucucgaucccucaggccuccacucuuagaugcagcuucaguguuucugucuuugcagagagcuucucugggaucuacugcagccuccuuccuuugggaugcuggucagcugacagccagagaguggucuucgacucgguccagcgcagucggcagguaaaagccccugauugugucaggagguagcaucaacaacgucugcccucugacggucugccgaggaguuuaggaccuggggcagagggcgugcacggcccuagaggagccgagccagaaagaauuagcugagcccuugaagucuuuucugcuggacuugcuguuccucaagggggccaaaugcucugcugccccacagaagaggcccaagccuugggcagucccugaacacuuuauagugacaguugauggagccuggauggguccuuagggaugaugugcuggcaugucccaugguccuuuggguauggcauuauuuguucuccuauccuuccguuccuugccuggguguauccggcacguugugaaggaacugaaucuagauccaggguucuucuuguuucacagaguagccaucaccauaggccaaaguggcccuaagccaguagaaaggaaauaggggcaggccccagagggcuguuggauguggugcuacaaguagucuccccucuguuuaaggaccuguuugcuguggacacccagacaggaagugucaccucccugacagcuggugagcaggaccucugccauagggugacagcagggugauggcagggguuggggaugggcagccaggggcggguggauggguagccgcuuaggaaaggagcuagagcuugacccagggcagcagugguacguuccgucauucucacccccgaugcgccacaggcuuugccagcagugcccugaggagccagccaggacacuaccucuuuucuucgcugcacuauuaccuccauaugcccuagccccauagcuccaccccuguccuaagcucuacagaccuuucuugccaggcuaguauagucauccaccuccugcccagacccuggagaaaccacugcuggacucucuagcuuccccacacucaccccaauggucucccucugaaccagccuuugaguucuccaccugccuuggcucugcacacaucugcauccccgaggugggucagaaagaggcugucuuaggguuucuacugcuaugauugugguaacucuucauuaggaaacaguuaauuggggcuggcuuacaguuuccguuucagagguuuaguccauuaucgugauggcagaaagcacucaggcagacauggugcuggagagggaacccagaguucuacaucugaauugacuggaagcaggaagagagugacaguggaccuggcaugagcuucugaaaccucaaagccuacccucaauggcacacuuuaacggccacagcuacuccaaugaggccacaccucuuaauagugccacuccuuaugaggcuuuuggggaccauuuuuauucaaaccacuacagaugccaaaguucuaguucuacaucucuggcuuaggacauagcuccuuccuaggguguuucccuagcauaagccuagugcauaguaaauaguaauaacaacaauaacaauaacgaguggacaaacguuagaccaguccucuuuccuacacccaguaggaaaaggcuaucauccuugucacaccgaagucauuggaguagguagaguacuuugguagcuuucugugucccuaggucgggcaauucuugagcauagccugugucugucagaugaacaggaggcuuacuuaggacauaugcaguuaggugugcaucucaggguuaaagguagaaaaguugucccugccaggcacuuauaucaucugcuuccucuaggggggucagcgggaagcuggaagcugcuuacaauugaccgagaccuuaugguggcccaguucuccacacccaaccugcccccgagccuggugaguauugugggucccaggcuagaagacaggaauuacaagcuuccaugccuuagaacugggcccaaagacugaccaugguuggucagcauguagaagggcagagacgacugggcuccagccuaguccaaugguucuuugagcucaacacucaugaguaggaaccaggggcuaacauuugcaccauccugaacagugugccuacaaaagugcccagucauuuauuauuagaguccagggagaaagggaaaccucgaagccaagaaguugguagggccaggggugguucagauguggaugucucccgcauacaccacucaacaagaaucuaugcugugcucuucagagauggguuccugagagcuggccuaccugugacacucuccuucccccuggcagaaagucggguuccugccuccugcugggaaggagcagucugugucaugggugucacuggaggaggcugaaccuauuccugacauccacuggggcauccgagugcugcacccaccuccagaccaagagaauguacaauauggugagcugggccaauggcagacgagcuccuucuccagcacacggcacagugguggcccuuccuagcucccauugcaggcuuucuaggauuuccucuaaaaguuuuucugaucuuacagucaugagaaguagcgucgagagaucugagaaccugcugugguuaucaacacccgcuccugccagggcauaccaucccuggugggagaauuaagguuuaaaggaaacaggccacgcacgaggcuuaugugacuacaccagaguguuauccuuuccaacaaggcagaaaagugcaugagcuuuagggggcuccaugugucaugugugagcugccugugagcuaccuuggcuaggccucuguucuacuugaucagacccaugccauacuggagauggggccuugguugaggaagccuuugugaaguagcacuggucaugcugacgacugccuucucccugcagcugaccuugacuuugaagcaauccuccugcagcccagcaacucuccagauaagagccagguccccaugguagucaugccccaugguagguauucaccuaagagcccuagccucccucccaccccuccuagcuggccuucauccucugcuuccugucugcagggggaccccacucuuccuuugucacugccuggaugcuguucccagccaugcuuugcaagaugggcuuugcaguacuacuggguaaguaagaaaggaccugcaaucccccugggguuccaugaagugacgggguggccuugguuguaugugcuuuucuauggugugcuuacucuuuagaaacugcuacuggggccgggcaauggcggcacacuccuuuaaucccagcacuugggaggcagaggcagguggaguuuugaguccaagaucagccuggucuauagaggaguuccagaacagccagggcugcacagagaaacccuaucuugggaaaaagaaaagagaggaaguaaauaaacuacuacuagaaauugcccugauguagccucuggcuucauaaccuggugaucauguggauuaacuugaagcuucccuggaaaggaugcuguggucucuggguagccgcuuccuaucucuuggcuacuucgccuugacagccugugaugcagcugguccuagggccuacuucacagauacauggauggguugaguugagggcucaggacguugccugacuaucuugucucacuuuuagugaacuaucgugguuccacgggcuuuggccaagacagcauccuuucccucccaggcaaugugggccaccaggaugugaaggauguccagguagccggguacugggcuccuagauagggaggguggagccauggccuucagcuggcagugagcaagcugugguguccucugcccacaauuuaguucgcagugcagcaggugcuccaggaggaacacuuugaugcaagacguguggcccuuaugggugguucccaugguggguuccucuccugccaccugauuggucaauacccagaaaccuacagugccuguauagcccggaacccagugaucaacauugucuccaugaugggcaccacugacaucccugauuggugagugugcauuaaaggucccugccuuccucccaccccguguucccagggagauccugcggucugcaucuguuggucuuuuauagguguaugguggagacuggcuucccuuauaguaaugacuaccugccagaccugaauguguuggaagagaugcuggauaaaucacccaucaaguacaucccucagguacccagguauccuugugccacccauuccuccagaguccagagcucagcucgccacagcuccuugccucccauacaccuagguaaagacaccaguguuacugaugcugggccaggaggaccggcguguacccuucaagcagggucuggaguauuaccaugcccucaaggcccggaaugugccuguccggugagugucacaggauaguugggcagcugguggcagguaaacaggacaggacccuccaaugucauguguugcugcucauacaggcuccugcuguaucccaagagcacccaugcgcugucagagguggagguggaaucagacagcuucaugaacacugugcuuuggcuacacacacacuugggcagcugaagcccuguugcucuuugugagcugggcaguccgucucgaacuuugcucuugguaagccccaggaucuggcagaacugccuagagguuuccugggcucuggacuccgaaugagugggcagaggacuauggacucuaaucauaauaaaggaggacacagagccuggucugugcugguacuuuguaccaagccauccccag

SEQ ID NO: 5307 - RNA, 4852 nt, Mus musculus
gggaugcagacauuaaagggagaggcuuagaccauuacauuggcucccuuccuucuuugcacaacccaccuucgguaagcauccaagcccagggcuugucaugagguuaaggaugggggcaguaaguuagaccugccugccugccucugccucugccucugccucugccucucugccucugccucucugccucugccucucugccucugccucugccucugccucugccucugccucugccucugccucugccucugccucucugccucucugccucucugccucucugccucucugccucucugccucucugccucucugccucucugccucucugccucucugccucucugccucucugccucucugccucucugccucucugccucucugccucucugccucucugccucucugccucucugccucucugccucucugccucucugccucucugccucucugccucucucucugccucucugccucucucucugccucuccugccucucugccucucugccucucugccucucucucugccucucugccucucugccucucucucugccucucugccucucucucugccucucugccucucucucugccucucugccucucucucugccucucugccucucucucugccucucugccucucucucugccucucugccucucucucugccucucugccucucucucugccucucugccucucucucugccucucugccucucugccucucucccucucugccucucucccucucugccucucucccucucugccucucucccucucugccucccucucugccucucugccucucugccucucugccucucugccucucugccucucugccucucugccucucugccucucugccucucugccucucugccucucugccucucugccucucugccucucugccucucugccucucucucugccucucugccucucucucugccucucucucugccucucucucugccucucucucugccucucucucugccucucucucugccucucugccucucugccucucugccucucugccucucugccucucugccucucugccucucugccucucugccucucugccucucugccucucugccucucugccucugccucugccucugccucagcaacggcuaagccuggaguagauaagguccugaccauacucuuuccucuaguguuuuauuuacauuuucaaacaguuuucuuuguuuacucugugugugugugugucuguguguaugugugucugucuaugugucuguguguguguguguguguguguguguguguaugcaugugucuguguguauguguauaugugugugucugucuaugugugucuguaugugucugugugugucuuuaugugugucugugugucugucugugucuguguguuugucugucucucuguguguauguguguguguauguaugugugucuguauguguaucugucugugugucugucugugugucugucuguaugucugugucuguauuugugucugucuguguguguuugugugugucuguguguguuuauguguguuuaugugugucuaugugugugucugucucuguggugucuuuguguguguguugucauggcuuguguuuggagaucaaagaacaauuucugcccuuccuccaugcagcuccugggggcugaacucaaguugucaggcuuggcaucaaguggcuuuaccugcugagccaucucaucagccugguaauuuucucaaguggaguuugaagugaaucuaucucugggccagccaggguaaaacagagaaacccugucuggguuugggcuagcagcccucacaccccugguaggagaagaacagaggaggaggaagaggaggagaaggaggagaagaaggaggaggaggagaagaaggaaaaggagaaggagaaggagaaggagaaggagaaggagaaggagaaggagaagaaggagaagaagaagaagaagaagaagaagaagaagaagaagaagaagagaaagaaagagagaagagaagacaaggagaagcacuuccccauuucccauccccggcucugaauguuagcgucucuggccucugguugccaaugugauaucagagcaaggguuucuuaugugugguaaaaacagaacugaugccaaaaugaaacccucuacauggucuuuuggcagaguuccuaacaggugaaaucuuuguaauuuaaaaaaaauuuuuuucaagacaggguuucucuguguagcccuggcuguccuggaacucacuauguagaccaggcuggucucgaacucagaaaucugccugccucugccucccgagugcugggauuaaaggcuucgccaccacgccccgcugaagguuuuuuuuuuuuuuaauuuuuuuuuuauuuuuuuucauuuauuuauuuacuauauguaaguacacuguagcugucuucagauaccccagaagagggcaucagaucucauuauggaugguugugagccaccaugugguugcugggauuugaacucaggaccuuuggaagagcagucaguacucuuacucacuaagccaucucaccagcccugaagguuuauuuuuauuucacauuuuuuccuuguaagcacuucagugcaccauguauacgcaauacccaugaaggccagaagagggcaucagauuuccuaggaacuggaauuauagaugguugugagcugccuuguggguacuuggaacaacccaggcccucugcucuugugucaagcagaaguacucuuaacuguuaagccaucucuccaacccucaggugaaauucuuuaccugcccugaacugaaaaaaaaaaaauccaaaaagacuugaccuuuuuccagaggagugacuagccuagacugaguuagagguaugcaaacgagugguuuuccaggaaagaugaaacagaugggcgagcaaagccugcagaguugucuccucuucacaucaagguaugacccaggagguggcucugcuuucagcaugugacagaggacaaugacaccaaugugaccauugugcuuugccgcuccucaggaaacugugccaagguuaagcuuuccuugacaggaauaccccugaaauccagcuccaagaaagcaaagaucucaucuggaggccccagcagaauagaccgucgcugggcaugggccuguggaacagaguaagacagcauuuuuccaguggggaguugcggacuggcagcuccacccaugcucuguagaagcaagccugggagaggcugccaacuuucaucacugucuuagagcccuggaugccccaaggaugccaaaagcuugugcuaaaggaccacuugacucauccagcccagcauugguuugaaguauuuggccaagagguuuguucuccaccaaauacugacaauuugcaguaaguuugaggcccucuuuccuucuggcccugagccccagcuuccgcccagcacaacgaggcagauggacugagagucuccagguccuccuacucugcuguuuuucuaggcacaguuaaaggcuggcucccuucccaucucucuaaagguucugggcuuggaggaaguggcuaaggcuguggcauaaggggugcugggauacgcaccacgugcgguucuuucuucucacccaccccaccuagggcugcagcacaagagagcaucucauggaguugggaacccaggggguucacgaugaggggccaucccacagaaacaugggccauccaccaagucuuccugcucccgggaggccaggagcuuguggcuucucaggcgguaggaucaaacaggugagcuuccccucuuuugaucacacuuuucccaauauggaacagcuaacacuuacuuaacugaucggcgcggggcugggucuguuucuaaucacagaugcaguaaucacgagcgugcacgccuccucaggaagcccccacauuccaggagcagcuccaaacgcacugagucaucgccuccugccucggcaucucgcacguaccucucgcaaaccacacgucccacacccacagcaccucaugcuggcauauauagacccugaccugcuaacagucauucucacuuaucccccucccacacgguccaaacaacuccagcugccgagaaucccagugcugccugcagaggcuacccgguguccuguccaauucagagucuuuguggggagaagaugagacuucuaugggucacccuguaggaauacaaggaugccagaaaacccauucauuguauuucaaaaguauggcuuucccuuagcuaacacaugggagcccccaaaagcucuguuaggcaaccccuccaacacagagaaauccugaacaaagcuacgauggcgaugugaauccauaguucuuugggggcaaaaggaggcuaaacucaugaauaucguccuguagcauagcuugcugggagaauaggacguggauaccuugugaaugccuggucucuaccacaaaauuggaggacagacuaguccaccaccuuagacgcccagacaacuggaacugaacccagagaggagcuguccagaccccugcuagaaggcguucccagguccuccuagaaaucugguccucuuaugagagucucucugcaggacugucaaggagagaggcaggcccauagcuagggaagcuugccuucuccucccauccucccaccccucagccccaagcccagaggaguguauggucaucucuacuggaggagccacuggaagaucguguccuuuucuuuugcccucuccaaggcguaauuaaaccaguuucuuuugaauuucu

SEQ ID NO: 5308 - RNA, 2869 nt, Mus musculus
aucuuaauuuuuuuaaaaagaggaugaauguuuuauuuguuucucaguguugcaaagcuggugcuucacggugggaaaacaacagccaacacagcacauggugaaacaaagacaguacucuccugccucugacacuguacaacacuucccugcauucccaaugagaaaacacuaagucucugacccaaauccagugguggauaugggcaaauaacaaaauuaucuaagaaacaccacuauuaucuugaauuaugaaagucuuauacccaguagguagggucucaccauguagcuguggcuggucuagaacuuguuguguagacugaccuugaacuaacaucugccuguugcgugcugggauuagaaggugguccgucaccaaaaccagccucauaaccacguuucacugcagaugauccuaagaauucuaaacaccagggcuuaaccccuagucuaaauacuuaguauggcgauuaucaaaaaccuguacauuguguuuaucugcauccuuuaggaaguugggggugggucuuaaguagcacugucaagaacaguuucuuuccaucaguauugcuaaaaguuauuucaaguccucuauucuccacuaguuuaagacaagcaugcuggagcaggucacauccaguuugaucuggaguggagggaugggugccauggucacuccucaauggacuucacauauuuuuuucauaugcuucuucacucaucaauucauccagcucugaagggucacucggugucaucgugaucagccaaccaucuucauaacaggauuuguugacaagcccuggguuuucagcaagugcuucauugacuucgguuaccucuccugacagaggagaggagaguucacuggcagccuucacacucuccaaagccccaaacuccucuuguuuuuucaauuuugucccaacuucaggcagacuacaguaaacaacaucucccaaagcuuccugugcaaaauugcugguucccacuguuccaauaccuuccucugucguuauccauucauguuucucugugaauuuacgcaccaacagcaaaacagauccggugcgggugcgcagugagcagaaggcggcggcucuuggcggcgcucagcucccagggccgcagcgaguagaaggccagggcggugcgcaggcuguaggccacaauccgcaagcuccuccuugcagcgacacgaucagagguccggagguuaacugagcuucgccucugcgggcagcaaucuuaauuuuaaaaaauggcagauugaaggagcuggagagaugucacuguaguuaagagcaugcacaguucuccccgaggcccagagcuggagccuuagcaccugcgucagguggguagcucugacccucagggaucucacuccucuggucuccaccagcaccugcacaucacccacacagcugacguacacacaaaagucacaggaggccauuguuucaggcaggauuugguggcacacaucuuuaaccucaaaaccucagcauuuaggagguagaagcaggcuauguagaaagacccuaucucuuuaaagauaaauaagguuacaaaugugcaacugacugguauacaccucucucucuccuccguguagcucuggcuguccuagaacucacucuguagaccaggcuggcucugaacacagagaucugccugccucugccucugccucugccucccaagugcuggaauuaaaggugugugccaccacugcccagcuacauuucuuuuaaaaauauguacaucuugucauaaaauuuucaaacuguuuuucuauguauuugcaguaaauauauauugcacauauauacagcauaugauacauuguguaucugucuccauugccuucuguucuccccuuccuucccgcugagccauucuucccagcuagucuccucacucccccacccccaccccguggcuucaucauugaagaaaguggcacucccucucucagcagucacuaacaaccacuagcuccgcagaaagggaugggaccucguagggaauccuucgacucaugauagaaugaugacgggucuagucuugugcagggaugcauggcugcugugugcucaugacugcaucagguuucggaacugcaguuucauggcccucacaguuacacccccccacacacacacacaucccuuuccucgcugcucccugcaccuuggagagagcacauucuugucugccugcauugccugagcaauccacucucccugcauccuggucagcgcugauacuguccucguuuuguuguugugugugcguguucaaaacagggucucacuauguagcucuggcuguccugaaacuucaguuuuuaaauuuuuauuuuauuauggguauggguguuuugcucgcaaauauguuugugcaccgugugugagccuggugcccagagaggccagacgagagcauuggauucccuggaacuggaguuacagacaauugugagccaccaugugagugcugggaguugaaccuggguccuuuggaagagcaacuccagagccaacuuuccagcccuucuaugacuuacauuuuuuucauugucucacauuuuuauuauaauauauauaugcagaucugcuaaauacucaguaauagauccuaucaguuagccagcauaaggcgcucugcuggcaaucuaccucaggucagguacaacuccucgucacucuccagagcuuaagacuuaagcgcugaguucagucccaggccacaaacuaaaucaagacacuaacugcacuaaggacacacgugagcugaaaggaacgcggaaucaggcggaaucaacggcacauuuuaaaaaaacaauauuuucugagacaug

SEQ ID NO: 5309 - RNA, 996 nt, Mus musculus
gacggucuggccccaacaucucaaucacuuuacaccucugaacagacucccauucaucugcauccugcaagucucucacagagccuguucuaugcuuuaccuaccaggacagccuccugcuauaucucacaauagcuugccccagaacaugcuauauagauaagccugaagucucacagagaucugccugccucugcucccacgcgcucggaagaaagguguguaccacgauguaugguccuuauggauagaaagugccagauuucaggccguggacagcgcuaugccaccuuguggcauuuuccccugccuuuucuuuuugucuauuucucuuuuuccuuucccucucucccucuuucuucucucucccuuuuuaaaaaucaugucauuuguuuguuuguuuguuuguuuguuuaaggcagcauuucucaguguaguuugguucuccuggaacuuucucucagagcgggauggccucgaacucagagauccuccugcuucugccucucaaauccugggauuaaaggcgugugccauuaaguccggcugcaauaaaaguucuuaacugcuaauucaucucucuagacuauacuuuaacggaagacauuuuuauuuguguauguguauagcugacggaaugggaggauguggagagcagaagacaacguggaagucgguucuuuccuuucaccaugugggcuccuaacucacagcaucaaacuuggagcaagcaucuuuaccuauuggucccuuuugcuggcccgguuuuuuuucuuuuaaaaugguuugguguaggcuggccucgaacucacuacguaacuaaggaugaccuugauuuuccugccucaaucuccuauugacuggcauuacagacguaggccaccacucaaggcucuuagucgcuucuaaggucuagugaaccuccaaagugguccagcagauugcagccagccacccgaggccgccggccuucauucaacacccgccggccgcguu

SEQ ID NO: 5310 - RNA, 59327 nt, Mus musculus
ugugcgcgggugcggcgcgcugcggggcuagcgacgcaggcagaagcgggccgcgcgcugaaggcuagucggcgccgcuccgagucggccgugggauuggcugcggcacucgcgugucaggcgguugcuaggcuccggccgcgcgccccgcccucgcgcucggcgcccucucaccgcucgguacgugaucgcgcggaggcugcggcgcggcgcucgcgcuccuggggcucgggggcggcagcggcgguagcuucgcgcggaguccccggggaguggcggcggugucccugggcccggaggagcgaacaccugccgcggccugcccguggugcugggugagugcgccucccgccucugccucccggugccugccugcuggggccgggauccccgcugcagccgaccgagccuuccgcggaacaccugcugcugcucccuuucggcccggggcggggacacggccacggacguccuugcgggugaggaggcggcgccgccgccguccgugcggagccgccccucggcucuccguccgguagcugaaggcugaggccggagcugcgcgccgcggcgacgggccaggccucggccccggcccgcgcucccgggaacgcggggccugugcaucggccgcgggcgugugcggccugcgggcugccuccggguugccagugggggucgcggcccaguuaggaggcaucucuacuguggggcuccugccagaggcugggaagggcgccgcccccgccucuugcuuugagcugcuccgagucuugggguucuuuccucccccucgguugcgcuucugugggagacuccuuuacuaccuuugcaguggguauuugggaaaucagguucacuugcgaguauauuuggaaaauguucccagagggaacaccauguugacucagaguccuuugcuauaacucccaaguucauuuauugacaaacucaacgggcaauuaaaaacacaccucuuaaucucuacaauuugagaagcuuuuguuaaguugaauuacaucaagauuaguuuucguggugaugacgaaguuuugacugguccgccuagucugggacaguaccuuuauagccuagaggucuaacuugagaguccagccugcuguuucccuaaauaagcgaguagaaguaguucuuggcguggaagccagacucgugaagugagggugguguuuauagaacauaacuccagcuagaguugggugugcuuccagauguuuuggaaucugauggagaugggguguugcaaucauauuaguauauauugugcuuaaugagcaagagacauacuuucagaauguucuaguuuagaaaaagaauuccacgguaacggguuguacagaucgaugguuuaaauauggagaauugaaguucuuuuugccuugaagucaaggacauggucagcgugcuuaaaggacauaggggcuauuggagaaaucagaucucacuagggaguuaguugcaaggcgugugggauccugugugaagguaggaguaaguagcacuaugcaggcagcaccgggugggaaugugcaagcauuguugauauguaccucuguugaaauugucaccggacaaguccucaucauucuaaaaaaccugauuugacaagaugcauucauuuaguaaauguuugacuuuacucccuggggacuucuggguaggacuugggggcccauguaauacaucuugcuuuguccuuaacugauuuuggguucagugaaugagaaucagaacccaugacgagaauaugcuugcuugcaugguagccugaagagagccuuccugagccgugcguggccuucagggccagcaggaauuagcugggggacauaaaggcuuguacacccggaaccacauguacaugguuuaaaauagagccugggagucuuccagcuggacaggugggagcucugggccuucuuugcacauaggagcuccaaccucuuaggguacaggagcuugagaaugcuuuuaaucguuugaguggcauaaucuagaucgaguuuagaaagagauauguugguggcaugucgggagugucagagauguccagaccucugguaguaaagucagccagcugagaggaaggaggacgagccauuugagaggggagacugaaaagguagugcaaagugaauggccagccugaugggaggggaagccugaagucaggaauguucaggcccaaagucuaagaaugaccaaggauuuaaagccauugggguggggguggggauuuaaagcuaugugguagagauucugcauaucgugggugaaguucuaaguuucaacccccaaaaccaaccuccaaacuuuuuguuguugagacggucucuugaagcccaugcugguuuaaacccauuuaguggugaggcuagcauagcauuacacuacugacccuucugccuuuuccuccuaacuucagggauuaggccugagccacuauacuuaacuuuuaaaacucuugacugcugaauggguggcugacagguuugcuuaucuguuagguauuaagaaugauggggcuuggaggaauugggggaaguuuacuuugauugguguuguugcuuauaaaagagaucuagcauuugauuguuaaaaaaagucuucuagcuugguguaguaugguagcuauaaauccuaggauucaagcaaucugagacaagacccuaagauugggggucacagggcagucugaacuaugcugugaggccauguuuccaacuaacauaccuacacuguauuugaacaugggguguuguauuuccuuuuuucuuccuugagacagggucucauugcuuuagcucuggcugaccuagaagucacugaguagaccaggcugguuuuaaacucagagagccuucugccucugcuucuuucuugcugggauuaaaggaucagccaucaugguuggcauguugucuucuaccuuacagauagagguaguuucucccacuuccugggucaguaauggcauggacugauauaacuaccauuugcacuuaaaguccuuguauuucugcuucguguguguuguucugauacccaguagaaaacuucuguguguguggcuuagcacacacucaugagggcgcacuuacaaguggaagccagaggagaaugucuuucucuguuacucaccagacucucgcuaaacuuggagcuuaucauuuucaccuagacuagcuggcugacuggguccugggaucugccugucugucccccgccacccccaggacuguuguuucuggaguuacagguacaugcaguccugccugcccagcuugggauccaaauccuugccuucagcacacacuccaguguacagagucaucccuucaguucccuggaaucuuuguacugcauaaagaaauggagccacagaaaaaggaacauguccacacuuuaugauaaaguuauaugauauaacacagucaggauuuguuguuguuguguuuucuuuuucuuuuuauguguuuauuuuuaauuacuuauuuuuacuuuuguguaugcaucugugucuaugucaguguacgccuaguggguauagauuccugaagaagagagcguugagccucuggagccggaguuaacagagauaguuccuaguuucccaguguggguauuggggucugaacuuaguucagguccuuuggaagaacagcaaaugcucuaaacugcugagcuaucucuccaguuccuuguuuuuguuuguuuguuuguauguauguauauauguagguuuucuugagacaggguuucuuuguguaccccuggcuguccuggaacucacuguguagaccagguuggccucaaacucauggagaucuacccaccucugccucccaagugcugguauuaaaagcaugugccaccgccacccggcucugacuaauacuucuuaaaaaagcaaaauugaucacugcagcuaugcuccaagaccuucggggugcccaguuccucuaaggcccucuauguaagcacuuuggcuccaaccuaccagaauacccaaggagugagugucaagcuguaacucccuagagcuagcguuacauacgugugugugcacaugcaugcaggugccuuuaacaguuaggaagcuguaacuccuagagcuagaguugcaggcaauugggagcuacucuacauggauucugggaacugaacucaggucugcuacaaaaaugacaaggacucuuuuaaaucauuccuauuuuauguguauguuuugccugaauguucugugugugugccuaaugaccagagaugucagaagagggcauuggauccugucuauacuccaguucuaggguugugucucgaaaaucaaaaaacaaacaaacaaacaacgacaaaguaguauuagucacaaucagagagauggcuuagcaguuaccugaguucaauuuucaguccccacauggugacuaacugggauccaguucccucgacuggugugcagauauacaugcagacaaaacaucuauguacauaaauauaaaagggaagcagcauuaguguuaauguuaguauuagucauugcucaggucuugugggaagcuaguggacuugacccacugggccaguaguaaggggugagguggagagaaacuuaaggucaaaaccaggaguuuugaagguguuugggaccuguugaguagaaaggucaagugaccaagcagagagacuuggaauuccagagcuaucacuuuggcuacgaagaacacuuugugucuuuguaacugguaggauugaugagccacuuguucauccuaggcagggacuuuaccuugagcuaccccaacuacauugcuaccucuuaucccccaguuuuguuuuuuugaggcaaacucuuacuagcucaagcuagcugcagacuugcaguccucccaugucaguaucuggagcaguagaauuaggagucuguaccaucgugacuggcuuccauaacuccccccccgcccccccaagucucacaguagcucagguuagcauggcauucagucugucgcuuaggcaugccuuugcugagugcuaggauuuauagccuugaugaagaaggcauuaauguacuggaauggcaggugacaauaggcucauuuuauggaagguucaagaaauaaaagaggccuggcagugguggcacaugccuuuaaucccagcacuugggaggcagaggcaggcaaauuucugaguucgaggccagccuggucuacagagugaguuccaggacagccagggcuacacagagaaacccugucuggaaaaaaccaaaaaaaaaaaaaaaaaaaaaaucuuagcuguaaguagugcuacaugccugcagucucagcacuuucuguacugggaggcugaggaauuccagaccagguugggcuacguacauggcauauacauccugaacaggagaaagaaagggcauuuuauugaaaauaaaaaugaggccaaaccuagaucugagaacuguuuccuuaucugcuguuuagacuugaguaguugcagguugugauugcauguggauuaggagaggacacaaggccucauaugaucaucaaagagcaagagugcuugagagaacuugugcagugcagguaggguguuguugagugcgugcugugugcugugugcuggucaagguuuucccuccucucugccucuucccauguaaagaacauuuauuuguaucguugcuaccauuuuuuuuuuguuuuuccaagacaggguuucucucuguagcccugacuguccuggaauucacucuauagacaaggcuggccucgaacucagaaaucugccugcaucugcuucccaaguacugggauuaaaggugugccucaccaaugcccagcucuuggcuaccauuuuugagccucuuuucuauuuucuuuucccucccucccucccucccucccucccucccucccuccuucccucccuuccucccuuuuucucuuucucccuucucuuccucuuccucuuccuuuuccucuuucucuuucuccuucuccuagcccuggcuguccuggagcuuacucuagaccaggcuggucucaaacucagagauccaccugccucugccuaccgaaugcuagaacuaaagucauacaccaagucacacacuacucuguugagcuccaaaccauuucuuacuaggcccucuuacucugucuccuccacuuaacuguguugacccuguaggcugagaguacaguuaguuagucugauaacuucauaguagaucuuuugugguuuuguuguuauuguuguuuuugguuuguuuuuugaaacagaguuucuuuguguauggcuauccuggacucccuugguagaccaggcugccuugaagucacagagaucuguuuacuuuugccucucaagugcugggauuaaaggcaugcaucacccaccacccauacucuuacuaaagucuuuuuaagcccacacuuugguuauucaaauagucuuccuauguuucgaguaaugguacuguaauuucagcucuuagucugaggcugcaaauuggaggccagccugugcuacacagugaggcacugucucaauguagauagccucccaccagaaucaaagccgaccaaccaaaaccccaagcaaccaauggaagaaaagaggcggucuuucucagucauccucagucuucauccuggccguccaucucccuuuacucugaucacuaguaauacugcucaaacagcaguuucuauaaauagagauuuagaguaguuuacaaaauugcaccagcuacagggccuaauuuagcuuuaaugaauaggguuuccuauuuaucuugcuuggguuugguaaguaagcaguuuuugucuuugggucuggguggagagagagaugggcugcuguagcucagguucauaaacugucgauagcaaaggugauaaagucauucugugacguaaaucuguacacaacucaagcaauauauggaccucauuugacucguguuuuauuugauuuuuuuugcuugagacagugccucauucuagaccuggcucaucuggaacucacuguguaggccuggaugggcuugaacuggaagugauccuucugccuuugcucuucuaguacuguuagcacaugccugguauuuuaauuuaaauuuuuauguguauguaaaauauauguauguaugcuuuuaaaauuuguguguauaauguguguuucugagagcaugcaugugcaugacacauguggagggcagacaguaacuuuguagaaucaguucuuaugcgugcccuacuacggauuuacauuccucugugugugugugugugugugugugucugucugucugucugucugucagucugucuaucuugucaguuugucugucuaugaaugaaugagucaggcucuuuggcuggccucaaacucacuguuggaugaccagacuugcuauauaauggagagugaccuucaacuucuaaucuucuugcuuguagcucccaaguacuaagaucacagauguguaccaccacacucaguugauaagaucaaauccuggaguuuauacauguucaacaagcagucagcaagcagcuacauuuccagcuuggacagaaucaauacuguaagaaaaaauuagcguaacaauauucuaaauaauaagaauguauaacugaaaaaaacccaugagauggcucagcaaguaaggcacuugucaucaaccugacaaccugaggucauccccacaacucacuugggagaaggaaagaauuggcucccauaaguuguccuuuggcugccacauacacugugguguucucuucccaaauaaauauaaaaacaaggaaacaagaaaaaaacauaaagagcucaguuggagccaugaguaggcacaugcuuuuuuuuuuuuuuuuuuuuuuaaagauuuauuuauuuuuauuauauguaaguacacuguagcugucuucagacacuccagaagagggagucagauuucauuccggaugguugugagccaccaugugguugcugggauuugaacuucggaccuucggaagagcagucgggugcucuuacccacugagccaucucaccagcccggcacaugcuuuuaauccuagcacaggcaaagaauucuaggccagccugguuuacagagcaaguuucaggccagucagaacuauacagugugauccuauccgaacaaaacaaaacaacaacaacaaacccccuccccccaaacuuuacugacaguuauggggagguggcuaaaugguuuagagcacuugggaacccaggucaguucucagaacccacaugcagccaacaaguauuuuuuuuuuaaagauuuauuuauuuuauguauaugaguacacuguagcugucuucaaacacaccagaagagggugucgcaucucauuaccggugguugugagccaccauguaguugcugggauuugaacuugagaccuugggaagagcagucacugcuuuuacccacugaaccaucucuccagcuccaccaacaaauauuuuuaacuccaguuccagaggacccauugcccucgucuagccuuugugggcaauacacacacauugugaacagacauauauaugcaggcaaaacacccauacauauaaauaaaaauaaaugcaaaaaaaaaaguaaaucucuaaaaaccaaaauucagcuggagacagguauauuugcucaagccuauaaucucaguacuaaaggcaggaaaguuauccuaaaguuuaaaacaaaccugagcuacuuagugcauucuaagcucccuggguuaccaacugagacuuuguucaaaacaaccccccaaaaaggaagaaggaaaaagaaagugaaaaauauucagcagaucauucccucuaguauccuguuuuuguuuuuuguuuuaaauaugaauagggaggcggaugguguaguucuuugagagaauucuuaauugccaggcaugcauaaaacacugguucaaucccuggaccugaauuuaugagucagggaugauaaugcaagccugagucuuagacagacagacagacagacagacagacacacacacacacacacacacacacacacacacacacacacucaccaucaaaacaguggagcugagauggcuguaugugcuugcuguuuuugcagucgacccuaguuuagcuucagaaacugcauguggcccaccuucauccauaaccgauccuuuguucugaccuucgcugaccccaggcacacacauuguguguauacauacauuuuuacauauauacauacaggcgagcacucauacauaaauaaauuuagaaauaagaaaaacccagccgggcggugguggugcacaccuuuagucccagcaguugggaggcagaggcaggcggauuucggaguuccaggccagccuggucuacaaagugaguuccaggacagucaggacuauacagagaaacccugucucgaaaaaacuaaaaaaaaaaaaagaaaaacccuaaauggaaaaacaucgcuguacaaaauuuauauaugguggcauaucccuguagucccagcacuugggaaguagaggcaggaggaggauuagaaguuuaaggccaggggcuggagagauggcccagcaguuaagagcacugacuguucuuccaaagguccugaguucaauucccagcaaccacccauaaugagaucugacgcccucuuaaaucagcuacaguguacuauaauaauauauauauaauauaauaauaauaauaaauaaaucuuaaaaaaaguuuaaggccauucucagcuacauagcugaauuagagggcugccuggguuauaugagaaccuguuuuaaaaaaacucagagcugagcauggugguguacaccuuuaaucuugggagacagagacaggcagaucugguguagccaagacuagccuggucuacauagagaguuccaaaccagccaggaauacauaccuugucucaagaaacuaaaguaugggggcuggugagauggcucagcgguuaagagcacugacuucucuuucagagguccugaguucaauucccagcaaccacaugguggcucaugaccaucuauaaugagaucugaugccuucagaucuggugugucugaagagagcaauugugguaaacucauaggcauaaaauaaauaaauaaauaagucuuagggaaaacaaaacaaaacaaaacuaaagugaaugggugcacugaggaaacagcaaaaccaggaauggcagcauacacuguaaccucagcacuguucaaagcuggucugggaaacaugagaaagaagaaaagaaaugaaaguagcacaaaaaauagaugcuggaauuaauuuucuuugcuaugugaagcuucguaacuuuugguuuugaguggacuguacaucaaacauuucuuuacaguggucuuuucacaagcagggugacuaaugggugaaaugggcagaaucgugaaguggcauugccuguuuccccugguguugguuauuucaguuuggggacucaagacuauucuuuuuuuuuuuuuuuuuuuuauaagauuuauuuauugguuauauguaaguacacuguagcugucuucagacacuccagaagagggaguuagaucucgauacggaugguugugagccaccaugugguugcugggauuugaacuccggaccuuuggaagagcagucgggugcucuuacccacugagccaucucaccagcccccccccccuuuuuuuuuuuuuuuuaaagauuuauaagacuauucuuuucuucuguuccuacagggccugugcucucuaggaagauaagguuuucaacacugccuggcacuggagggugagguaagacacuugaaaagaaaaaacucugcaaaggagaggggucgugagcuacuaggcaauucuaaagcaguaacagaggagaaagcugccagguaauacccuuauuuacuuagugguuuuggggacggggccccggcucuaaagcauguuaggcaagcacuccuuaucacugagcuacauucuucuuugaccaugugggccuugggguucaaacucaggucagcagguauggguggcaagcaucuuuaucccgggcugguccacagaccaagucuaaaugcuccccaucuuuaagaguauguauugcuggccgggcgugguggcgcaugccuuuaaucccagcacucgggaggcagaggcaggcgaauuucugaguuuaagggccagccuggucuacagagugaguuccaggacagccaggacuacacagagaaacccugucucaaaaaaacaacaaaacaaaacaaacaaaaaaagaguauguauugccacagauccauucuuuuuuuuuuuuuuuuuuuuuuuuaaagauuuauuuauugacuauauguaaguacacuguagcuguccucagacacuccagaagagggagucagaucucguuacggaugguugugagccaccaugugguugcugggauuugaacuccugaccuucggaagagcagucgggugcuccuacccacugagccaucucaccagccccccauucuuuuuuuuuuaagauuuauuuauuuuauguauaugaguacacuguagcugugcagaugauugugagccuucaugugguugcugggaauugaauuuaggaccucugcuugcuccagcccugacaauuuagcugucuucagacacaccagaagagggcgucagaucuaauuacggaugguugugagccaccaugugguugcugggauuugaacucaggaccuucugcagagcagucagugcuguuaaccacugagccaccucuacagcccgaucuguucuuuuuugagacagucauagcccuuagugacugugccaauuggcggggagcucaagggcaaguggaacacuuggacagggugugucauaucagggagacaguggccagugcccagcuuaguugccucuuuugguauuugcucuucauuucuauggaaguugcuuuguauuuaaaggugggugucuacgaacaaacuccccuuacggaauuuuuucuaauugguauuuauaacuuggaauaaaacaauggaguuuguuuguuuguuuguuuguuuugagccugggucuuacuaugcugcccugggaggguuagaacuuuguauagaccaugcuggccugaagcucacagaccugccugcuucuaccuuucaagugcuaggauuaaaguaauguaccaaucacauugguccugaaaaaauuauuuuuuuuaauuuucuuuuuuuuaaauuuauuuauuauuaucucuaaguaaaucguauuugucuucagauacacgggaagagggugucagaucucauuacagaugagccaacaugugguugcugggauuuaaacucaggaccuuuggaagagcagccagugcucuuaaccugcugagccaucucaccagaccuuuuuuuugauuuucuauauaauguuucucuggguagcccuggguguccuagaacuagcucuguagaucaggcaggacucagacucagaguuugccucacaagugcugggauuaaagguaugugugcucccuccccaagcuggcucucugacuucaaggguagccuggucuacagagugaguucuaggacugcugggucuacauaggagcccuguuuccaacaacaaagauaugauuagguuagcauacauaguguggguuccaagauaaugauuugggcuggagagauggcuucuggagugucugaagacagccccggugcacuuacauauaauaaaucagucaauccguaagaaaacugagacuugaagacguuccuugcugauuuugcaguguucuggucaucuucucuuuuacccuguggccgugcugugaccgcaugcuagagagacggcucagcagucacaaguaugugcugcuuuaucaccgcauccaagguaguuguucacagcuauccacaaguccgguuccagaggauuggacuccuuuuagccucuguaggcacuaggcaugcaugugguacacaggcauacaugcaggcaaaacauccauacauguaaaguaaaauaacaaucaagaugauucucagauucucuaccgugcaaaugaagcuccucauugauugucauaaaugccuccuuaauuaucucuguagucauucuguaaagcuggguuaagcuagcuugcauguguauuacuggggauccaacuuggggcuugagcaugcuaggcaagugcguuccacugggcuggacccccagcccuuuuaaauuuugagacaggaucuugguuaacuucuccaaccuuguguccaaaucucuuucuauccuagacuggccuguaacauacuuugaccuuccaaauucagggauugcaggggcuggagauaugacuugguagcugagagcuuaagcugauuucuagaagauaggaguuugguucccagcauccacauccgaccacucugaaccacuuguaauuccaguuucagcauauccaauaccuuuagccuugaggcaucugcacuuauguacacagagcccuccccauacaaguuauuaaaauaaacaaaaucuuuaaauuauugaauuuaaggugugccucuucauaccuggccuccaacagauuuuugccaagaaaaguaauauaaaaaacaaucaaauucuaaauggcauuaaaaguuagauauuaauuagaaccuuggacaucaucuuuuuuuuuuuuuuuuuucuggacauuaauuuuuuggauggagggguguuucaggacaggguuucucaguguguagcccuggauguccuggaacuugcucuguagaccaggcuggucucgaacucagaaaucuuccugccuuugacuccugagugcuaagauuuauauucucuugcuugagccugcagaucaucuuuguaucaaaucugucaagagcucagguagccuugcuaaaggagaguccagucugaagaccucuugaguaggguuaaauuuuggguuuagggaaaaauaaaguugauuguuaagugucacauuuuuagaucucugaacaguguuggaaagauugaauugccagaaugggaaaauuuggugggagaguagaagggaggcucuuuauuaaagaucuaaaaauagaguccauuaaagucacaaauagauaacaguaggguuccugucuuacccuuuccuguucuggguuugugcuuccagcuguugcuucugcuuaccuggagaagaucacaauauuucccaguagaguaaguguagaccugcaacccugagcaguguaccaaucuguauaacucuugagaauggcagucugagaugggauugggaagcugggguacagcagggguucucaagggggcagggccgagagaaugacugaacuccuugggacaggaggaaaucuuuagcagaggcugauugugcugcucucagugcauccuugagcugacagggcuugcggguaaccuguauucucaaagcccuuaguguuauuuccuucuaguuggcauugcugacuacaggaaggccaauucuguggccaucuaguucaccugagcuaauugcuagcauuucaggccccccccccuuuuuuuuucuuuuuaaagaggagagguccucucugauuuuaacaguugaagaaaaugacuuccuguuuaggcuucugaaaagugcccuuuccgucuggugugaggggguggaggaauguccuggccucccaucuuccauccugucauggggcuccagggauaauagagucuauugugggcugugcccaaggcacagccguccucuucagugucagcuuuucuguggccucugugucugggcugcuguaguaacuggauguugggcgaggccugucucacuaugcuuuauugcugcggagggcucuagaacaugacugauacgaccuuacuuuguaguauaggcuggccuugaacuugaaauccuccugccuucugagugcuggaguauaaagucacacguaguuuaugccauguauuauuuugaggugcugaggguucagauccagggucuaagcaggcacucuaccagaguuaccuauccagccccucauaucuuuuguuuguuuuuuucuuuuuucucucccuuuuuuuuuuuuuuuuuuguuuucgcgacaggguuucucuguguagccuuggcuguccuggaacucacucuguagaccaggcuggccucgaacucagaaauccaccugccucugccucucaagugcugggauuaaaggcgugcgccaccacugcccagcuguuuuuuucaagacaggguuucucuguguagcccugacuguccaagaacuagcucuguagaccaggcuggcuucaagcucauguggaucugccuaugucugccuccugaguacugggauuaaaggcaugugccacuaugcccagccagcuucuugauaaacauuguugugaacuucuugugggccugagccuuguagaucugaggccauauuuagagaagcaggccugcuauuuccaaggguggcugagugcucacugaccauaggagguugggccucccccugggccuuucacagcuuccaaaccaucuguaacacauagaauugauucguuugugagugaaauugcacacuuuaaucuauuuauuuacuuauuuugaauuuuuuuaaaaaauauuuauuuauauucuauguaugugaguacacuguggcuguuucagacauaccagaagagggcaucagaucccauugcagaugguugugagccaccaugugguugcugggaauuaaacucaggaacucuggaagagcugucagugcucucaacugcuaagucaucucuccagccccuacuuacuuugauuuuuauugcugcucagacuuacugaugauguuaaaugccaaucuugcugguagguaugaggauuugaacuuuuuuuuucuauguuaaaugccaaucuugcugguagguaugaggauuugaacuuuuuuuuucuauuuugaugcuggagauuuaacccagaacuguguacauguuaauuuaagcauguacccuaccacugagguauaccuuuagccccagguuucuuuaaaaauagguuuguucugguuacaguuguuuuuuccugagaucaacuugucuuugucacuucuauuccugacucuaggccucuggugucucuggggaaguguaugaguuugagucucucccucuuccugccccccacccccugugugugugugugugugugugugugugugugugugugugugugugugcgcgagcgucuccaggauugauaaguacauauagagaccuagaugugugaccgcuugugcuguauaggguucaugaggggagcugagcgugaggguagagggcacaggaggcggaaggcucugcuuucucugugauggcagauaccugcugaguuuguagacuuuggaaugguccuggacuuuguucuuagucuucugaguaaaagauuccauucuuuucucuuuucuguauaucuccucugcuuuugucaucucuccauuucuguccccucuucccuucucuuuguaaaauacuaggcaaguguuuuuuuguuuuuuuuguuuuguuuuguuuuguuuuuuugagacaggguuucucuguguagcccuggcuguccuggaacucacuuuguagaccaggcugaccucgagcucagaaauccgccugccucugccucccgagugcugggacuaaaggugugugccaccacaccuggcuuaggcaaguguuuuaagcaaugagaugcucccuccagcugcucuaguccaacucaaccuguucucuccucuguuugagcacuguguuguuucuuucucuguuuagaaagcaccauaucauuuuugucaaaugaaggaauaaaacauauguaccacucuagcuacguuugcucacucuuguuauaagaaggguuuuuaagagaucuuggucaugacuuuucagagauuagcuugcugcuguugagcaagacaggcaagauuuuuggcauaagcaugaugauguuggacagugguaacuguccucagcaguagagaccggagcuugaggaagggaucuucaaaaauagacccugagauccuccguguugugaccucaggugaggccuuugccuucucuuccuuagugagacugagacaguguaaucucaggcugcagaggacacagauguccagcuagcagugugaauggcgccuggcaugugucugaucauuggcacuugauaucugccccuuuuuauuuugguauaaacuaugaguuugauaucucauaaaaccugcagaguggaaacaugcucagaagcacuuagcuuuuacagagggucugguuucacucccagcacccacugcugguuuacuccaucuguaacucaauuccaggggauccagagcccuuuucugaccuuucuugguaccaggcauaugugcagguaaaacauucauacagguaaagucuuuuuuuuuuuuaauguaauauuuuauuuaaaaaacauuuuuuaaauugacuuuacauccugauuacagccuuccucccauucuuuuuuucuuuuuuaaaggauaggguuucuugggcuggagagaugcuuagugauuaagagaacugacuguucuuccagaaguccugagugcaauuuccagcuaccacacgguggcucacaaccaucuguaaugggaucugaugcuccccucuucuggugugucugaagacagcuacaguguacucauauacauuaaaaaaaaaaaaaaaagaaagaaagaaaagaaagaaagaaaggaagaaagagagaaagaagaaaaaggguuucucuguguugcccuggaauccacucuguagaucagucucgccuagagcucacaaggcucaguguaccucuguuugcugagugcugguauugaaggcgugugcagcacaccaucccuaagcccacagugcuuucuuuuccugucuuggcuccucuucuccauggagucuauaaagcacaguaggggggauaggucucacugaaggcagugcuccugaggggcgggaguugaugccucucucuacuuagacaucauaguaugcaccauauacuugucucccugagagauacaguggcugagggccaggaacagaaaagauggagggacaaggcagcuuggucccgagaacaaccugauuuuaaaaagaaaccugagcuaggggugaugagagaaugugcuuaauuagcauggacauugucccuaguugaaucccuaucaccaacccaagugaagaaacccugagggaaggaagucugugucuaccgcagccgaugcagcccagacuccuugcuuuguagagugauaauuaaucuugguggcuuuauaucagacuuagaucuaggguggaggaggcaggacaucuauguaccuuagcuaggcugcaggagucuggaugcugauguguucugugacuggguuaagauguauaguuuguguauacguguauacucuucuguuuugaaacagaaucucacuauguagcccaggcuggucuugagcccacaguguuccugcuucagcuuccuuaaguucccugugcuauuuuuuuggagacaguguuucuauuguagaccuuaagcucacagucuuccuacuuuccccacauguugggguuauuaguguuuuauauaugugagccauguuagugucugauucgagggaagagcguaagagggcuucagauccucaggagguugugaguagccaccuacuggugggaauugaaccuggguucucugcaagagcagcaaaugcuauuuaccucuuugucaguucucagcucaugaguaugguuuuauuuacagcauuuuuucuaugcaguguguccggucagcaaggauggaucugguggugaugacacaaauaugguucuuugcuugucuuuagacagaagagaaggaaagacaguuucccuugguugauauuuuucagaagacuggauuagugaugagaugccucugaaagugaccugagccaggcuguguguauuucucucauucuagaagguucugugagaguuuagggagagggcuguggaaaauggagaagcaguaguuuagauuauuuucaaagccaaauucacauuuugggacauaaugacgugacugucccugaucuugauacggggcccuaaggcaguaguggcagugcuccaacgccuggucagaguggauugcagaagccucuugguuugcucaugauuuggauaaaggaaggcauggguguggaggauaauuugagaugccuuggaaagagaugagagccagauuagaaaaugcaaacauugcuaaaaggaggggagagaagacaacucauagugaauggaagaacuuugcaucuuugcccuuaauuccuacacacuuggaggacauagauuguuggaaaggucucugugggcacagugagguauggugacuagagacuacuguggguaggugggcuagcagugggacucagauaggugcagagacauugccagcuuugaguuaguagaguucaggacacaguagguagagcuauuucuugaaugggaaaugaagcagugaaguuagacuggcccauggaugagacauauaaauaaaauaaauaaaucuacauauaaguacacuguagcugucuucagacacaccacagcagaagaaggcaucagaucucauuacagaugguugugagccaccaguaguugcugggauuugaacucaggaccucuggaagaacagucagugcucuuaaccgcugagcuaucucuccagcccaaaaugaauaaaucuuaaaaaaaaaaaaaagacaugaauaaaguauccaggcaguuggucauagucacaguaucaucuugauagccgaugaguguugggagagugggaccugagcaggugaccucuggggugucucuaaugguuucucuacacagcugguugucucuacucacccuuccaggcuuggcugucuuggcaaacuaaaaaacuucuucugggcugugcuucaaguuuacuucuucauuuuuguuuucauuuacuuauuguauauggauguguuugucacauaucccguggcaguuagaagacaacuugugggacauccuucccucaggcaugucccaggaaccaauuuaagucauagucagucauggcagcaagcaccguacugacugagcuaucuuacaggcccuguuguuuuugcuuuuaaguuuuuuagauuauuuuacuucuauacauuauacauguagcuauugcuuggugcccacagaggucagacgagaaugucagaucucuuggaacuggaguuaugggcacuuauaagccaucauguggguguugggaauugagccugggugaucugcgagaguaacaaaugcucuuuaccacuaagccaucucucuagccuuagguuucgucuuuugacgcaaggucuucggaacaaaggcuaaucuuaaauuucugauccucuguucugcaccucugggugggaucauaggccccaucuguagugcugugugguagacacacugucccggagccuacagagagccaccugucucugcuucuugugugcucaaauuaaaggugugcaucgcugggcagugguggcgcacaucuuuaauuccagcacuugggaggcagaggcagguggauuucugaguuugaugacagccagggcuacacagugaaacugucucgaaaaaccaaaaaaaaaaaaaaaaaaaaagaaaagaaaagaaaaggaaagaaaagaaaagaaaaugugugcuucgccacaccuggcuacagggugcguuauuaggcacugugguuuuaaccuuucugccuuuuacuuguguuucuaaggucucucuaaucuguaguuuucuccucugcucuuccccucuauaguuuuucuucucuuuaauuugcugaagaacuugagaaugaaggguuacaggcugaauuuaggagauuggaccucagaguaauucuucuuuguuacuucugugaacuggcugcuggauacugaaucuuccguuucagguuugguuccuuucaggcacaguggggaggggagcacagcuaugucuuuuccugggucgcuggccucuuuuuuuuuuucuuucuuuguuccugacagauguccaagacacuacuucugugcaaggauaugaggccagaguggaggcuggcuuugucaacaguuuagucauaccuagcauagugugacaggcauugaaagaggacaguucuggaugccuuuugagguugauucucaggauuggguucauauaccacgccauucuuuucuuaaccccucccccuuucuugcagcuucucugguuguccuuuucuacucccagucuuaucucuucuccauuucuuucuuuuuccuuuuguuuaaguaguguucugacugguuuaaguuugaggauuaguauauagcuucuuaguacugaguagcucacuacaugggacuacggaagccuacacuuaucuaucaguaaaaugagagacuauuauguuugaaacgguuaucuuaaagccucuuacuauuauuacaagacuuuuccgaguuucagggcuuuuuagaggguuuuccuguuuccucauguaggggauaguuuuaccuauaaggaaguggaaaagugagaacagccagaauucaaucucuauuuauagcuaccuccucaacuagguggucucugggaugguggucagucucuguggggugguggucagucucugugggaugguggucagucucugugggaugguagucagucucuguggggugguggucagucucugugggaugguagucagucucuguggggugguggucagucucugugggaugguagucagucucugugggaugguagucagucucugugggguggucagucucuguggggugguggucagucucugugggaugguggucagucucugugggaugguggucagucucugugggaugguggucagucucugugggaugguggucagucucuauggaaugguggucagucucugugggauggugguaagucucugugggaugguggucagucucugugggaugguagucagucucugugggguggucagucucuaugggaugguggucagucucuaugggaugguggucagucucuaugggaugguggucagucucuaugggaugguggucagucucugugggaugguagucagucucugugggaugguggucagucucuauggggugguggucagucucuaugggaugguggucagucucugugggaugguggucagucucuaugggaugguggucagucucuaugggaugguggacagucucuaugggaugguagucagucucugugggaugguggucagucucugugggaugguggucagucugugggaugguggucagucucugugggaugguggucagucugugggaugguggucagucucugcgggaugcugggcagucucugugggauggugguaagucucuaugggaugguagucagucucugugggaugguagucagucucugugggaugguggucagucucuaugggaugguggucagucucuaugggaugguggucagucucugugggaugguagucagucucugugggauggucagucucugugggaugguggucagucucuaugggaugguggucagucucuaugggaugguggucagucucugugggguggucagucucuaugggaugguggucagucucugugggaugguagucagucucugugggguggucagucucugugggaugguggucagucucuaugggaugguggucagucucuaugggaugguggucagucucugugggaugguagucagucucugugggguggucagucucuaugggaugguggucagucucuaugggaugguggucagucucugugggaugguagucagucucugugggaugguagucagucucugugggguggucagucucuaugggaugguggucagucucugugggaugguagucagucucugugggauggugguuagucucuauaggaugauagucaaucucugcgggaugcugggcagucucugggauggugggcauggcuuuauuugcuggucugaacuucuguauauagaaacuuaacuuacaggcuaguuaccuagcauguaucuaugcuaucuuuacaguuauuugcacauuuaaauauucauuuauuuuauacuuaaauuauuaaaaauuauuacuuuuauucauuauauguuugucuauguauacugacucaucuuguuagcucccuauauaauuuugauaucaaguaauuaagauuuccuguauaucauaguacaagccuaaguugguguuuguuguuguuuugagguagguucuuacucuguagcccuuguuggcuaagaacuugcucuguagaauaggcuaggcuugaauucugagaucaacugggcacugccucucaagugcuaggauuuguuaaugugucaccauagcuggcuucuuucuuuuuauuggugauaugguggauugaucccauagauuuauguauauaugcuaagcacguguuccaccucugagcuacagacuugacuaggucucccuaauuuaguggagcuagacgaccuacccauuccaggccuugauggaguucuuuaccgccuagcuaaauucccagcacuuaguuuuuguuuucuugauuuuaacccaaguuuucugaggguugccuuucagggagaagaauguaaagaauuucagucagggaggugugggcugugcuggaaaaagggcugaagggcuagcagcaggcaggguagugagucaagugguaaaucuucuguauugaaacaguugcuugauuagcucagaaccacaccaaaguucguuauuagagguggcaaagcagcuguugggugcugguauucucuggcuuauugauugguaacaaaaucguaagaggggagaacuugccuuaucucaggugggaagcuuuaggcaacaguuccccaacuucuacuucuacuaggcuggaaguuguuacuucauucuauaggcugugagaaccuacucauaaaugaagcuucaccaaaucuguguaacccaguaguacccaguaguaguugauuuguuuuuguuuuuguuuuucgagacaggguuucucuguguagcccuggcuguccuggaacucacuuuguagaccaggccggccucgaacucagaaauucgucugccucugccucucgagugcugggauuaaaggcgugcgccaccaugcccagcuaguaguugauuuuuauugaugccacuaauuuuauuuauuuuauucaucaucaucaucaucauuauuaugugcuuuggugucuugucugcauguaugucugugugagggugucagaucuuugaguuacagugguaagcugccacauuggugcugggacuugaaccuguguccucugaaagagcgagagugucagaaacaguuguuauuggcaaaaauuaugcugaucagaaagaaagcccaggaguggaaguagacuaguauagacucgcagguacuucucugugugcacugguccgaggcagaagguuucuucccagucucccaggauccugguucucugggaaagcuggcuucucacauucuuccagagcaugccuguuauucagaggauaacacacaacaaaccuagagguuuggaaauaggcuuugguaaaggugacugcuuguggagcagugagcguacaguguggagaguagaugugugagcucggaagcagugucuggcuuuccucuccuguaccuguuccugcugcucugagcuuggaguuguucuaggauuugucucagcuccuagggugcuggagggucagcuacagaggcagagagcgccacagccaugcuauuauuugcaguaauuacucagcccauauguuuucuguuggaauuccucugagguagucaaguuuggcuagaaaaacaguggcauguuuugauucauuaguuguuuggaaacucauccucccauaucuucaugaucaaucaagcaauggagaagguuaacuucugucuugugcuggucaacccugcuccauuuucucuucuuuuccuguucaaauuauuaaugaaguguuugacaguaacucaauaccaguaaaaguaagaggaaaaaauuuaaauccuuagguuggguaugaauugaaagccauuuuguuaaagucugucaguuccacaucuaggauuuuucucuucagaugugucuauagagugcaggaauguguacgagaggccacuugagaacagugcacacacacaugcagaggaauaguuaugaaauaugugacugagcuuugagagugauagaagaaaccaagcaaggugcuggaugccuuuaauacuagcacucagaggcaggcagaucccugugaguuuacggccagccugaucugcauagugagacucuuuccaaccaacaaacaaacaaacaaacaaaaaaccaaacuaaccagccaaccaaacaaucgaaggaaagaagagcuggguuugguuuuuaaucccaguacaugggaaguucaggcaaaaggauuucugggcauccgaggccagccugagaccuucuuacaaaaaauaauggugcagaaaaagagauguacuuguuacguggggagacgagcugaagaaaccuagcccuuacccgagggccuagaaaggggaccuguguuaucuuuauaagcuuccuagaauuguuuuuguguguguacacaugugcauguaugaucagaggauaaccaguggaguugguucccuccuauucugugggcuucagggguccaacucagauuaucuguuuugggggcaagcaccuuuaccugcacagucauuccuaggccaggcccaucuccuccccuccccuccccuccccuccccuccccuccccuccccuccccuccccuccccuccccucccuuuuuuuuuucccucaacuuuugcuuacaguuguuagaauuuguuuuguguguguaaauuucuuuuauuuuauuuuccguuaagucaaagaggacacagguauggugguggaaaccuguagucccaguguguggggaauugaagcaggaggauuuacaaauugaaggccagccuuaccuauuguaguucaccuagagccaguguaggcuaugagauucugucucaaaaaacaaacaaaagaggcaaaacagacaaagccuagcgcagcagccuguuaaucgcuaucccugaguaaagcuagagugugguggcccauuccugugacagcuggagcuaggguggugauaggcagcucaagucacuuucuacuuuguagcagguuuaaggcuaaccugagcugcaugagagcuugucucaaaaauauuuuucaaguaaaaaguaguggcacaugccuguauuuccaacaggagacguagaagcuggggggauuacuaugaauuugacaccagccuggucuauauaaaagugaguuccaggcuagcuaugaaaaagucagagggggacgagcagccagccggccuuggaguucuugugaggcugauggggaucaauagcagggaucugacacuggcgaaggcugcuugcugguggacuugaucuucccuggaauucugggccuuucagcuuggugauguaauggcuccggcuggguguuuucuucuaggugggcaaagcuccuuccuggaaagggaagaugcaacuauuuuuaaucuaaagcaaauauagcucagaguagucauuucaggccccagcaugacauuuucuuucauuguaacccaagacacuuuugaaacaaacaaaauucuuuauguaaguuguguuuguuuuaaaauauaacauggugaggggugccuggugggcccaugccaagguguucccccaagaaauuaugccaugcaacagcucugguauaaggagguuuauuugggagaagggaggggagugaggaccuggaggaguagaggcagacguagacauguagacaggcagacagaugagagcagagccaugagggcagggaagaggggacagaggaggacauggagggagggaaagagagggagugaacaagugagcugaccaggaacaugaggcaaaagagagggggccugggugguggguaauccuuuuaugcacaccuaguggaccaccuaguguggcuugaggugauggcaugagcaauugcuaggucccugggaggagccuagugggauuuccugaaagcuaacaguguugguaguguuuccagaggagaauguugguaaaauaccccaacuuuguuucauaaacuuggaggguuuaggguccugcuggguauguguuuuuaauagggcugucuggugguugguuccuaggguccagaacuguaguagacaagugcugacaauuuaauuagugcacaggcugccccagugcugggauuaaaaggcaugugcuaccacaccaggcaguugucagguuuggcaaguaccuuugccuguugguccagguaguauuuucuuacuuauuuugaguucuggggauugaacccaaggcaucaugcacacuaaccacucuugccuuggcuacaugucuuccaagcccaagaugcaauuuagaagcaaauaaaagcaggucuuauccgcuuuaaaauaauuuaucuuugcuuuagugaugggaaauuaucagaaucagugagcugauuucuaaagauugaucugcauguugaagggagggcucuugcucugggcuguggaguaucugaagccccgcucugugaagcugugcuguuguugggaacuagagaaggugguauaaugucucuugaaauggcggagcagauggucuuuacaguucuucuggguagguucaguaucaugugucaccuguaccuucacugugucacccaccauuagacuuucagaacagauguaaucuggccacugagaugacuacugugauaauuucauagaaaaagaaaggaguuagaucaugggggaugucuugggcagguuuugugaggaagcaguauuugggggacugggaucuacacggauaagagaacagguuagaaaacauaaccugcucaacagaugcugaugccuuugguguguguaggcagcauguggacagggcugucugaguuaggacucuuggaggggugaugaguaggaagggccuaagguggauucggcuguaggcuuuaggcagaggagggaaaagggccaugugaggaaaagcagccucucugugugcaggugucaguggaagccuggagcugcucugggagcagucaguacacagagaauugaacagauggcugguucugccucuguuuaguuauguggggucuuacacugagcaaguguuuggacuuauaguuuccuuucuguuuccuuaagcaccuuaagggaggaagagcuuauuugguguacaguuaauucauauccccucauugcaaggaagucaaggcaggaaaucaggacagcuggccacaucacagccacaaucuagggcagggaaagaaaggcacaugcuugugcucagccuaacuccuccacuuucacucaugccaaaacccuuugucuagaagacgcugccuuucagggagggcugguucuuccuacaguuaacauaauucagacaauccccuacaucaaguucaaagaccagccgcaguguagacaauccuagaagacucuagguuguguacagacuugauccacaauagcaguugugagcugcugggcccaugcggugcuaucagugguuggcucuagcaaguguacuuggggagcugggcuucaagucagcucugccucuugguguggaucucaguucuuaauauuauguacaauacguuagcuguucagcagggaugcuagggggaucuugagucucaugcuagccauauguuacauucagaacaugauauuccucacuguggcuguugagugcagaagagccagucuuuggaagaagcaguggagcacuuagucugcacaggcaccaggcuuaucugucacucagccugugcugacaguggcccugugaugcuuagaaugacuaaugagaaagcugggucacccagcaacuucagauauuuugaguucaggcuacaaaaucuuaguggaacaagggacugugacuacuaccguaaggaaggacuggggucagagagguagaaggagcacuucugucuaaaucuuuacuuaugaaugucuuccuuguuuuuguuuuuguuuugagagacggucucacucuuaguuacuuuccuauuguuaugaagagacaccaugaagcaauuuauaaaagaaagcauuuaauuagggauugcuuacaguuucagagagugaaucugugaccaucauguuggggagcaaagcauugagcaggcgggcauggcacuggagcaguagcugagaaccuacaucugauccacaaguaggaggcagagagcaagauugggaguugugugagcauuugaaaucucaaagcaccccacuuccagcaaggccacaccuccuaauccuuccucaaacaguucuacaacuggggaccagucauucaaauauaugagccuguggaagcccuucucacgcaagccaccgcacacucuauccaggugggccugggccuuugcuuuuaaagugaugggauuaugguguaugucaccacuucugcagucugagggacagggaugcuugucucacaguguaguccaguuuauguuuguuucuauguucuuugaggcagggucuuaacuuuccaguaacuuuggcuguccuguaucaggcugaccucuaacucaaagagauccaccugcuuuggucuucugaguguugggauuaauggcguguaucacugcccccagcuuguuuuuguuuuugugaagcuguucuuugggacuagauccuaauguugugauccuuuaauccagucccucauguucuggugaccccacucauaacaugguuuuguugcuacuuuaucacugcaguuuugcuaugguuaugaauuguaauguagauaucugaugugugaccccuuugaaaggguccuuugaccuucaaaggggucauuaacccacaaguugagaaccucugaguuagagagauggcucggggguuaaaagcauuugcuguucuuccagcagaucugaguucaguuaccagcacccauguuaggcagcuuauaaauacacucuaggaggauccagugacuucuuuugccuucugcugacacacaaacauguauggugugcacacaaacacauaaauaaaaaaaacuuaaaaaaaaacaacaacaaaaaacaaacaaacaagaaaaccagcuggucuuuguaagauugggguuguucucagacuuggguucuuguguuucagccuucugaauguugucauacaguguaugccacguuuggcuucuuccuguuucuuuagcuaguucauuuuggauuucucagugcucacucacucuguguccuggguaucucaguguacugucuacuuuuuauuucaagguuccuaugucuuuaaaguguagggauuuauaauaauagcugguugagaacugugaccuggacaucagaaucuuuggggugugauuuguauagucucugccuagguggcuccacuguguggcaggggguuuagaguccuugcucuugcuuucguauaacuuuuguacuuuguugaaguaagaacuuagccaugcuuacacagcgguagaacauuuauuugucuagcccaagauaccucugcacccccacccccacaaagaaucaaccaguuuuauaaaaacagaacaggacauacuguccauuaguugaguguuuccagaaagaugaaugcaaucucuuuucugauucauguaccuccugaggccaccagaaacacucauuuccuuggugacugucuuccuuagaugagcacugauauccaacccuggaaaugucuuauccuuuccaagcuggagaaacaaggaagguaaauuuugguauggagccacagaugaagaagaauuucaguguauauucauccaucaaccaaauauuucucucuuuuuuuaaagauuuauuuauuuauuuauuuauuuauuuaauguaugugaauacacuguugaagagggcacuggguacuauuacaagugguugugagccaccaugugguugcuggaaauugaacucaggaccucuggaggagcagucagugcucuuaaccgcugagccaucucuccagcccaaccaaauauuucuugagcaacuacuuuauacuguuguguuguaggagugagugcuccaggugaaguggagcauaauuauguuguaggaauaccccugagaguacucauuaugcagugaacuaggauuuggggacaggagauguaccaauagagggcgaaggaagaagaaucuuucaagagaaagaggauggauagucuugaauguauguagagaacccaugguuucaguacacucugaguugggcagaaaugugcacagguaaaaugcagggcugagggaugaagagccagccacacaucuggguauugucugggaaugguagcacacuucuguaaucccagcaauggaggcugaggcaggaagagcuugaguucagggccaguuugggcuauguaguaagacucugacuuaaaaaaaaacaaauacaggaccuagagacauggauggcucaguggucaagagcaccgucugcucuuccagagguccugaguucaauucccagcaaccacaugguggcucacaaccaucuguaaugggguguccgaugcccucuucuggugugucuaaagacagcuacaguguauucauauauauaaaauaaaucuuuaacaagaaaaaauagauccagaacacaugccuuuaaucguagcacuugggaggagaaacaagcauaucucucugaguuuugaggccauugugaucuacauaguugauaaguuauucuccauugaugaaaugagccaguucaagcaaaauuagaguuuauaaaggcagguuuauugggaagccacucuaucagggaaguugccauaggggagggagauuuaggggagggguagagaaagaacacacagggagaggggagaggauggggagaccagagugucuggauuauauaaggaagagcaucuggaguaggggggucccucccccccucccccccccccccccgcuuuagcuggaaaguucagggcagaggguggggcaugccagcuucuagugaacugcagacacauaggggcugaaggaugcugggagaaccuggaggccuggaggccugauuugauauuguaaagcaugccccucagcccuuugucuugugucugaaucccaacaguagugaguuccaggacacccaggucuauguaaagagacccuaccucaaaacaaaaccagccaaccagacaaaaccccaaacaacaaaacaacaaaaaccagguggggggaaaagaagcuuggacuugcugacaaggcugguggugaagagauggaagacaauaguagggcuucaggagaugaaguggagguaaaaggcaguccucagucucagaccuuuggccucauuuugaacuggacugaaucuuugggucuacauuuuaauccucuaaggaagagcaaacguguguguguguguguguuguguguguuuguguguguguuuguuuuuuugagacagggucucucuguguggccuugacuguccuggaacucacccuguauguagaccaggcuguccuugaacucacaaaagagucacaugcaugucucuaccuucucagugcugggauuaaaggcaugugccacuaugcccagcuuauaacucuuacuguguguguuguguguguguguccuuccuuccuuccuuccuuccuuccuuccuuccuuccuuccuuccgauacuauggaaaaaugaaaugaguaauauuguugaagcaagcaguagguguucugugauacuuacuuuauucaaugauaauuuguuauuugcccaaguaaucuccauucaugcugcuaauuauuguuguagcugcuguuauuuuguauuuacuuagaaauaagguuuugagaacagacuggauauauaaaaacaaaucuuggccagagaaauugguguugcuuauuauacuugugcucccugccacucagcugaagggaguguggaaucccugguggucacuuagccuugucugcucuugccugcaguucuguuggguagggacuucuguuugucuuaugaagggcagaggggauuuaaaauguucgucuaccuuauauuuuuuuuuuagaaaugauuucauauuggcugucucauaucaaauaaaguaccucuugcuaaccauucugaggguuuauguuuguauacauaucacacaggcagggcaugagagaaaguaauaaguacaggugcauaugauaggaacccuauuugaagugcugucuuagaugcuuguggaguuuggagcuuguuauuucuggugccaugaccagcaucaacuuucauaaguaggggagaccaggaacaagauccauccaugcgauguacauccucuaaacaagccucaccccccuaucuguacuuucucccucccugucauaccaucaaauuaugaauucuucuguagguuaauucuggccagaucacuucaccaugaccaucagcuggcaaccagaccucugacacaugagccuuugggcgauguuuuagauucaagccauagcagcgaacuugcuugguguagaggagccuauacuaaacacuaaacaucgaacucuagucuauauuuggcuccuaauaagcugcacagcaucuucuacugggaaagcuagcaauuugagaucuucaggaccugaccugggaaccucugccucugcaguuccuagaagcugugcguuugggugcuucuuuaggcuagccugauccugaagccagauauggcagguaucccuguucucccuauuugacauuggccugccauaccagccauagugacauagcuuugcaaacagggcucccaaagaguccacaagauuccagguccucuggaagagcagccauugcuuuuaaccacucagccaucucuucaggcccuugaagaacauuuuugaagguuuauuaguaguaucagcgugugugagacagauguauggguacacuuauggagggcagagagcagcuuuguaaaucuguucucucagccuaucuguguguggguucugggaagcacacucagguuacagucgugcacaacagcacuuugccagaugucagacccugaaagaaaaaaguuuuuuuuggagacagaaucugacuguauguauagcucuagcuggucuggaacucagagcucugccuaccuuugccuccuaaguauuacuaggauuaaagacaugggccacuaaguccagccucuugaagaaauuuaaaaaauaaauaaguaaauauaaguguaacuuuuuguuuguuuguuuuuuguuuuccgagacaggguuucucuguguagcccuggcuguccuggcacucacuuuguagaccaggcuggccucgaacccagaaauccuccugccucugccucccgagugcugggauuaaaggcgugcaccacuaugcuaggcuaauauaaguguaacuugaauggaugguauaugucuauaaucccaacacuaggaagauuaauacaagaggaucaggaguucaaggccaguuuggaaugcucucugaaacccugucucaaaugcuaaaaccauaaacaaauuuaauauagccuacacuguguuugugaagccaacaauaaugcauaguaaggacucugggcuuuguguacgcucaccacucacccucuuacccaggcucagccaggcuuuccagucugggaaacagcucugcuaacgcugagagcccauauggcuggacuaauuuuuuuuuggggggggcaaucuuuuaucuuuuaugcuguauuucucuuaugacuuuucuauguuuagauauauuugaauacagaaauguuaguauauacaauggucaauauuauucauuacacucaguuucuguaaguuuguggucaagagaaauaagccauacuauaaaaccucaauguaaauguaucaccuagguuugcauuauaugacauucauauaacugucugacacaugcucagaguauacccucaucaugaaacaacggauagucaugcuuuuccagguaggugcuucccagaacuaaagcugccuucuaccuuuccaaacuccaucuguacuuaugcuaacucccaccaacucaauacaaagggacagaguagcacuaccauuugaaggcagggucaggagucaaggagaccugcccugagaagaaaggagagugaagaggccagugcaaggucaugaccauauuuaaucugcugcucccuccccccaggaggcagggaacucaugggauaucugcaagggugaagggcuucauuacauuccucaaugacugacugaccaugcaggaaggcagugaccacuugguuauguuuucaaguuaaaagcuaagcuuccugguuuguuuuuuuuucccauuguaauaggaaagacuaaaaaccucuaaauguaaucuggcuuuaaagaauugaauuuagaaaacucucauggcugcuggucuuucugaccuaauuggccaaugauguagaacacucccaaaucacugcccugcuccuuuuccuccacauacaaaaacauacucucacagaccauuuacugcagccagugacccugccaacagccugugauacagggcugagaccucagaaggucagggccucaggaucaaagaggaugucacagcucugugacugagagccauguacacguacuugcucuaagcugccaugguaacaaguguuuuaaagggauacuucaaccuucuguguuuaaaguccugacaacuugcuuaagcuaccuucuuuccugaacacauucguaaagcuugaccaucaggaacauauuuuucaugccagaaguacacaccuuguuuauaaaucaacaagacaaaacuggugccuacugucuuugcccagggaauuuccugcuagaagaauuccuccccucccacagauaguuuuguuuaacuugcucuuuuacuugaucuuaaaucuuaaccauggcugcagcuucugagaaaucacuaacuuuccuauguuagguucauacuucuaaaagaacaaaaugcccaaaagagagaagagauccacuuaggguuucugacacccuuauacagauauacauacaggcaaaauaccagugagcauaaaauaaaaauaaauuagauuuaauuuuuuuccuucaauaaucuuaccuuacugaaacuuuauaaauuuuucagguuuuuuuuuuuugacacagauuagaacacaaaucaauugcacauugaauggcucaacauaauuucuuuaagaauugacucuaggggcuggagagaaagcucagugguuaagagguccugaguugaguucccagcaaccacaugguggcucacaaccaaccauaaaggaaucugaugcccucuucuggugugucuaaagacaucaacauuguacucaaauacauaaaauaaauaaauuuuuauuuuuuuugguuuuucgagacaggguuucucuguguagcccuggcugucuuggaacucacucuguagaccaggcugaccucgaacucagaaauccgccugccucugccucccgagugcugggauuaaaggcgugcgcuaccacugcccggcaauaaaucuuaaaaaaaaaaaaaauagaaucuaaggccucacaugcuaagcaggugaacauccaccccaguuccaaguuuuauuuauuuauuuauuuauuuauuuauuuauuuauuuauuuauuuauuuucgagacaggguuucucuguguagcccuggcuauccuggaacucacucuguagaccaggcuggccucgaacucagaaauccgccugccucugccucccaagugcugggauuaaaggcgugcgccaccacugccuggcuuccaaguauuauuuuuaauacagagucuuacacaguugcccaggcuagauaggacagauuucuguagucuaggcugagcuugaacacacuuguaaccagacuccuccccuccccccuucuucuucuuccuucuucuucuucuucuucuucuuuuuuucuuggcuuuuauuuugaacaugguauaccauauagcucuggguggcugggaacucucgauguagacuaggcuaacccaaacuuacagagaucucuucuagaacucuucuguuucugcuuucugagugcuggaauucaaggaaugcaaaaaaaaagaaaaaaaggaagaaaagaaaagcuuuuuuguuguaaaaccagacaggagugaugauuuaugcuuguauucccagugcuugggagauagauacaggaggaucaagaguucaaagccauucuuugcuucauagcaaguuugaggcuccauaaguuacaagaaaugcugcccuaaaaccaaauagacaaaauauagaaaucccccuuucaaacccacuucccuagaaacaaacaacauagacaccugcuacccucuagccugggccuacccccaguuuuacccaagaggucuucagagucagcuuugaguucccccugaaggcucuuccagcugcucucucuccccuuccaaguagggaaguagaccuuuaacuugugcaugcugagcaaaugcuguaccucaaagcuacaucccauuccaccccaauucacacuuucuuauucauaaguaggaguaaguucuuaauacugaaaaguauaguaacuauauaagccagcaagcugcuccuuuuuaaauguacuguacuauauauaauucuauaugcccuacuguuauuugacuagcagccuaguagguuuuacccaguggccacagugugagugcuaccuuguauugugguuaggcaucaggaacuuuuuagcuuuauuguaauuuuauauggccacuaucauaaaugugcucuagaacauugguaugagccuugugacuaucuaguuaaguggauuacuguuuguguuuugugauuugguaaugcauauaaagucuuaauugaauagaauaugaaauuuagaaagacugcucaguaauugaagccucacaccuauccuucaggguaagcagugugcagaugugugcugaaguguuaauuguguggucuuaagauaauuguaguuugcuuucauuggauuccuggaugccgugugaguugaagguacauucccacuugcauccuaccgagucugaccauccaccccuggccccagcccccacuuccacuacaccuccuguacuaccugcuuuaaccaaauggaugauuagauuuagcccuugucucugggcucuuuugaacccuuuuccauccuuagugaccaguuuaggcauugauaguuaaagacuggaccuuguuauggaaaugagcuccuaaggcauccuuguggaauuuuuuuuuuuaaugucuaaauugcaugauucugaggaaugcuuugauuuuucuggagacaaggccuugcuauguauccuuagcugaccuugaacuugcugugauccugucgccuguaucucugccuuccuccugcuggaugcucgguuugaauaauguuuccugguuaguuuugcagugcuguggacuaagcccagggccuugcacauacuaagcaagcacucuuccagugagcugugccucuagcucagcucuugcauaaacgucccuguguggugugugugugugugcgcaggaguauguguaugcaggggcaggcagagcagaggccaaguccuccacgguguugaacuuacaggguuuauacugccugggagccagaacuagguucucuaugagaacagcacacucugaaccucugagccaucccuucauucccaacuucaaaguccauaacuuacuuaaaaaaaaagauuaauuuauuuguguauaugagugaucuauuugcauguaugccuguaugacagaagaggguauuuuacagaagugggcaucagauuccacuauagaugguagugagucaccaucuauaaugugcugggaauugaacucaggaccuauguaagaauggccagugugcucuuaaccucugagcccucucuccagcuccaucauguuauuuaaaaauguggcauguguaagugcuucauguucaacccaggcccuugucccaugguaagcauguccgcuagcccagaguugguuugguuuuguuuuugagacaggguuucucuguguagcccuggcugucuuguaacuugcuguguaggccaagauggcuugaacucacagagaacugagcaccucugccuucacacugcuggcaucaaaggugugcuaugccugucgcccugagcuuguuuaugcuaucauuuuccuuucucuuuuuguugaggagguggggcguacuggagauugaacccagaaccucuaaccauuaguuauagucccaguccuuugcauuuuauuuauuuauuaauacuccugaauuugggucuuauuaaguugccugggcaggccuugaccuuguauuccaccuaccucagccucuugaguagcuaggauuauaggccuggcucuaaaauaaacaacccaaaacuacuuuuggagaugggaucucacuauaaaguugagacuucaauucuuuucaauuuccuggccuuagccuccuaaauauugggauugcagggaggaguuaaaaugaaucuuguuuaaaaaaaaacugcauaaguugggcauaauuguacaugccauggaggcaggagaaccaggaguucaaggccaguacccacuagaggguuugaggucaauuugggcacaauauccugucuccgaaauaacaaaauaggagagaaauucaugccauaaaauccaugccauaaaauucaucaugugaacaguuuuuaagugugacuuaauagugaauaauauuuaaccacugcauguggaguguaauggaguguggaauugcucagugagccucccacacaggguauucaaagucagcuuggauuacagaccagggucuaguagagaaaagcuguuuaguucuggacuuucaacuguauucuucccccuucucuagcacauguuuucaccuguguguguguguguguguguguguguguguguguguguguguguguguguguaaagguugaggucuuugcuucauuucugugaugauuggaaaaaaaaucaagccaccaucagcagaaaucacugcccacuguagcuuuccuugguaccugugauaagugaggauuuacaagaaguuuucuaaaugagagaagcuuuuaaaguagcuuuccuuguugauagacaggauaggugcgcuuacuucucagagguggcaacuuucucucccacagauuuuuacccuuaagucuguuuauguggcccuggcugcuuuugacugacugggccugguuguuccuccccauggcuugaaaucaucucuuaccaauaucaugccaggucuccauggcagagaaacccuggugcuuccagagugaagaacaguucuuaggugagacuugaaauucucaccagcagcuuucuuuaucuguguuacagaguacaaaagaccuuuuaaagacuggaagcagaaaguccgcuugucuuuuucauauuuggaguccaaauaaauuucacagcauuggguuucguuguguuuagauacccuguuugcccuuuagauugaacugcuuuaaacugguuaacuuuacagagguuuuguguuaauauugaacucacaguauugaauuauaacuuuuguguauguggacuaaaaaagccuuuuuguuagguguacccuaaagugauuguuuuaauuaaaauuucuuuuuaauuuucccaagaccauuuaaaacagagacauaggacuucauuauuuuaauuguguuuuaagaggaaaaucucauuuuccuuaaauguuuuaauuacaagagugaacaguagaugucugacagugucaguaaggcuuuaagguagcagagcuggugaguguuccccuccauucuagcagugugugaaguaaguagagugugguuaacaaggaguugaaucucacaacuuuuccuuuauucuuagagagugaaaacuuauagcugcucuuuaaagaguuuuuagguuaagauagguaaaaguuuuauuccuggaguuuugguuauuguggacugaauauaucauaugugcauuuaauuuuugaacucacugagugaagcacuaacugagucccccaggagcacaggcacacauuacauguggggaggcaccagagugguccagagcugccuuugucccagggcccaggucugugggaauaagacucucuccuucucaggaacucaagcuuucugaacauaauagggucauaagggcuuggugccacacuggcaccuacuugucccucccagcaggugacaugcuucaguuaugucuaaguagggcucuguauaggugauaggaaagguuagaaggccccuuuccugcugcauucauucugccucagcugacuggaguccuugccagacacagcauagugauuuugaguccccauguaucaaauggcugauguauaauuucuacuuccaaggcaacuuuugauauuuuggguuaccuuuuagguacuuaugaaaugucacuuugcuucugcccauuugagacuuccauuuuuagauuaaaggcaucuaucugauagauuacugcagacuucccaagagcuugguggaagucuugucuucaaauacucuucuaccuucaggcgaagauguggcuguuagaugcuuacuguaugcuuggcucagcagugaggugggggagucucccagcucucagggaaguccugagcagccugagaggcugcuccuacacugcugucagagaaagaaggcucagucuuuuccagguucuguaggcaccaacacuuuuuuguaguccaaucuggccaugugaguaguggaauuuagguguguaccacccauccaaaccucuaacacauuuaauuaguuaaacauuuuggggugcaaagucucccuguuguaacccuccuggccuugaauuugcuagguugcccaagcuggguggcuacaaucuguuaggagaaagggcacagugcuccugacgaggcacacacaguuaacacuucauauacauguacaccuucugugacaccaggacucauggccgauccucugaauggaccgcacuugcccucacucacugcugucagagcucuccugagagaugaaguuugaaauccucaugucuuagcuucucugcugcuaagauuuuaggccugugucacccauauuuauuuggcuucuucagcucuucuaauaccuuccaaguuucucuggucuauggggauagagagugucuaaggcugcugucagacaaacuuaucuuuuacccuguguaccagggccacuagacauguuguucagagagccaagguguuuguuaagcuccaagagggccuguuuugaugcaauuguauuuugcuggcauagggcaucccugggagcgcagauuugugugcacugcccugcaucccugucggcaccacacugcucaucucucaggagagcucugacagcagugagugagggcaggugcgauccauucagaggauccgccaugaguccuggugucacagaagguguacauguauaugaaguguuaacugugugugccucgucaggagcacugugcccuuucuccuaacagauuguagccacccagcuuuauacagcagugauugaauuuguacuguucuuuggguuuugaucccugccagaaggucacucuggugaccaagagugagcauuugagacuuguacaaaaauuuuccagagcuagucagauggcuuaauggguaaaggcacuuggugccaauccugaugaauuaugaauccuaagauccaugugauaaaaggagaccccaaaaguuauccuuugacuucaguaugccugcugugacaugcacccucuccccaguaaagaaaucauaaaaauuaaaauuugucccagagggacagcuuaauauaggcauguagauauaauuuacaaggcuucuagcauaagcaggcaugauucuugcuuauagaaagccagcaucagaaagauauucgggcugcuuuuagccaaguagcagaaacugucuuuucuccccagagcauggaaaaccagcacauaguaguuggaguugugcccuggacauugccugacugcuaaaugcagagcuguuagucaugccugugaaacagacaccccaugugacaugugaccacagauaguaggacuaagcucaugcuuuuagugggguaggguuugucuuauaacuagugcuguuuccaaauaagcuaagauuuaaaauugagagucaggcuggggaaguaaaagaucuacuggaccuaguagauuagauggaaaaguaaaugaacuauauuagaaaaaaaaaguaguaaaaaugaaaaggcccacacccuccugugcauccauuaggugaacgccuaguacugaaauguaccccuuccgugcuuccaggaguugagcacaggcuuuccacaugcucgacaggaacuucacugcugaaccacacucagcccagcagcugggcaggcuagggagggagaguggggaacagacaaguaguggaauaaauagggcagagucuccagauaccgaugggaguuuggguuuuaguuaccauuucaaaauuuccccaacacucaugggaacagaauucaaauccaaaaguuauaaaacuggucuccaacucccuauagaguccaggauacuuguauuucugguccuccuggcuucacuucccagggcuaggauuccaggccugugucaccauguuuugcaauuaaguaauuaaugcccauacuacccccccuugugugugugcgugugcgugcgcgugugcguguguacaguaggacaacugugggaaccaguucuuucuucucucuccugccauauggguucuagcgauugaacucagguuauuaggcuugguggugugaaucuuuacucagcggcaucucgcuggcccuugcuuuguucuuugagacagagucuugcuguagagcccuggcuaaucugcuggucguucuccuuccuuuuccuucugccuccugagugcuaggauuuacaggcccaagugugugccaccacacccugcuuaagauuuauuucauaucacaugauucaguagaaaacacgcuaaugucauacauaccugaguaugcagauuugucaacguuaucauucuuccauauuuuuaugauugaucuaagaaaauuuggagagucuagagagauggcuuagugauuuaaagcauuuauuuguagcucuugcaaaugaccuggguucaauuccugucacucauauggcagcuuaaaauuauccauaaguacggcuccaggggaucugaaacguuuucugaccuuugaggacacaggcauacacguggugcacauacaugcaggcaaaccauucauacauagaaaauaacucagcugggugugcuggcguacuccuuagaucucagcacucuggaggcagaaacaggugagugcuaggcuggccugguuuacagaauggguucuagggcaaccagggcuacauagggagacccugucucaaaaaccuaaaauaaaauaaaauuaauaaagauaaaaggaaaaaagaaagaaagaaaaggagaaguugagugugguguuuuaggcguguguuuguagcuuuacugggcugggaauguggcucagaaaggucucuagcauuccucuaggggcgggcugcuuagaggcagaaugucagcuaaugucauucauuuagaguucccucucacaacaaaacaaacaguuggacuuaauuccaccuauuuguauuuuacagaauuuuuuuguucauuuaguaaugugagugauuuaauacgcuauaguuucaauauguauuaucccuuuaaguuacuuuucgaugauauauucacuuauuuuauaugcacugguuuugcuuauaugcaugucugugugagggggucagauucccuggaacuggaguuacagacaguugugagccaccaugugggugcugagaauugaaccuggguccucuggaagagcagcaagugcucuuaaccacuaagccaucucuucagccuucccuuuaaauuacuaaugagguauuuuacguuuuguuuuuauauaaaauuucaaacuucaguguuauuuuacacuuacuagaccaaucaguuuccaucaguuuccaucgcuaaguagcugcugaaggacacaggaguaagaggcucuaguuagggcagaaugucuuggcagaacacuggggaaguguacagucucaaagccgccaacaugguuugaauguuugaaucuguucuucucuuguaggcucugggugcucuaggauggaacagcugugcagagggugaggauccaacccugggaccacaucauuugcuuucuuccuuagcaacugguggcuugaacaaacacuagccugggugaggaugucuguggacaacuggcuacugcacccccucuggggacagaccuuucuccuccuccugucuguggcuguggcucaggcccacuggcccagugaacccucagaggcugugagggacuggaagaaccagcuugaggcguccaugcacucaguucucuccgacuuccaggaggcuguucccaccgugguuggcauuccagacgguacggcuguugucgggcgcucauuucgagugagcauuccaacggauuuaauugccuccaguggggagaucaucaaggugagacugcaugcaagcacagcugaggaaggaagaggcccccucuuccacuuaguucugauacucgaugccuuuuccucuuuuguuguaucuuacugauuuaucuauugagacugggcuggcucgagcacucacauguauguaugaauaccacaugugugccugccaccugcagagaucagaagcugucagacucacugagccgugacucccaccugagccauuccuccuuuaaggcccaggcugggaaagcucccagcaacagcuuuuucuuucuuuuuuaaauugugugugccacugaagucagaagaggaugugcauuccuuggaacugggguuacacaugguugugagcucucauuugggugcugagaaccaagcccucuagaagagcacccagugcucuucaccacugagccgucuccagccacagcccagcagcacuuccacuuucggcucucaguugaaacuuucacaaagucugguguggccuuucugacauacaaacccagccuucuagguugaacagccgcagauuccaugccagucuuaccuggaagaggugaaucuguugcuccuuuccuuuuagugugggugagcuuuucccucuggacuccauucucuguaaaucauagucuguuugcaggguggccuuacuucggaagacccuagcucauagagcaggugaauucuauagaucaauaucaguuucgaucucucugucucuguuguuguuuguuuuugagacagggucucaccauguagcucuggcuguccuggaaguugcuuuguagaccaggcuggccuugaacucgagagauucccuugcuucugccuccugauggcugggauuaaagacgugcaccgccagcaccagcccauagaacucuucuacuccagcaggcagaugcuaaucuauuaguuaaagacugguagcucgaaggauauguugcuugccugauuuuauaugacccuuugaguguccugacucugcauugguugccuuuguuccggugguuauuggaauguuuuacauggguuaauuuugaccagaaguaucuugaauugauacagugacuuagauauuuguaguaucuggcagagacauauaaugaaugggcuuaccaggagcauaaagagcuuuuacugggaaaacaggauuuaucugaacauauuuaucuguggagaacaaacaguuuaguagcugaugagccuuugggagagcagaugaaguacugggguguaguucagcagcagagggcuugcccagcacacuggacuaagauuccauucuguagccacccugcuccucagaaccagggcuguguggacugaggguuuggaaagguaaugcaugaccugauucugggagcuucgcuuugcuuuucucgccugugaaaauaagcuuaaagaggauuuacuuacuuaucuugagacagagucuucgcuggcuucugaacuaugaucuuccuaccucuucugcuguguggugggauuacaggugugugccgccgaccugaaugaaaagucagugguaaagcagcaaccgaagggcuggagagagagaaggcucaggaguuaaacacuuguucagaggaccuggguuaaauucuuagcacauaccugguggcucacaaccacucauaacuucagguuucaaauacuuccucugcccuuugagggcacaaaggaugcaugugggacacagacauauaugccagcaaaacaaucauacacaugaaauaaaguaaauacaucuaaaaccaaaauuuuaaaaaaguuacauacacuugcaaaguaugugagagacaaaggaaaaguuuuuguggcuuccaccauuuucuaugcuuauuaagagguggauguacuacauauacagauauuuuagacugacccaagauuuguagguguuugugugugugugugagugagugccagcuguguaugauucugcaggaugcaaaagagggcacuggaucuguaacagcuggagacacaaguggcccugaaccacucagcaugggugcugggcacugaacuuugggccuuguaagaauuguagccuuuuuuccuuuucuuuucucccuuuuuuuccuuuuuugaauuguaaaauaauuacaauguuucucccuucuuuugucuucccuccaaacccucucauauaccccucuuuagacuuuuggaaauucguggcuucuuuuuucacucauucauauauauguguguguguauauauauacucauauauauauucauauauauauauauuuguaaauaccaccugcucggucuguauaauguuacuuguaugaguguuuucagggcugaccauuugguacuggguaaccaaucaucaugcucgcccuggggaagggcaccucuccugcucucagcguucucagguacccacaguugucuguguaggguugagaccuccuggccuuucuccauccacuuuugggauguccauggguuuuauccuuguuacagcucacauuugggcaguuauauugguaagaccuauggguguuuuauuuuguuuuguuuuugaaauaggcuuucacuauguagcacuggcuggaguggaucuuacuauguagacagacuauccuugaauucacagagaucuaccucuggcucccaagugcugggaagaagaaaguauucuuagcugauaaaccauuucuccagccuuuacuguuuaauuacauuuauuuggguguggguguggugaggggagugugucuuggaucuuguguggaaauuagaggaguugguucucuccuuugauguggguccugggaucagcucaugucuuagugucaagucuaacaacuccaaacacugagccaucuucugguccugguuguauuuuuaacguuuucuuaauuugcugcagcuugaguucuaucccaugauuuuuuuuuuaauuuuuuuuuuuuauuauuuguuuauuguauuuugggugcacuguaacugucuucagagacaccagaagagggcaccaaaucccacuucagaugguugugagccaccaugugguugcugggaauugaacucaggaccucuggaagaacaaucagugcucuuaacacugagccaucucuccagcccuuaucccaugauuuuuaauacuuacuaugacuguaccugucaguggcuguccaguguuauguuucuuuccugucuuugaaauggugucucacuguguucacagagaucugcuugccagugucuucccauuaaagugguguggcaccguaccugacauaaggagcauuuuaggucaaauaugucagcacauguuuauaauccuaguccuggagacguggaggcaggaagauuaggaguucaaggccauccuaggcuggcauagucaguuugagaccagguugaacacaugagacucugucugaaacaagcaaacaagcaacaacagaaagaguacuuuagauguuaucaccaggauuucuguuuaggauagucuccaagucagagcugacaccuucgugccugucacccucuguccaagccguuccuuguuccuucucaggaagcucuuuaucuauguucuugacucacucagucuuuuucauacuaaaguaagagacauuuugucauuuugaaucuacccaguauccuguuacugaucggcauuuagaucuaggcccugaacucuguccccagcucuccuuucucuccccauugcucuuugucucuuacccucucuucguccgccccuuucuguucugguuacuccucucucagggcuaugucagccuguuggcucuauucuccuuuccuucugcccuuuuucuuaguauugucaucucucagauucaguuugaacauccuuugagcuauuagaguccuguucuccaucuagugaaagcagccuucccacaaacccuguuaccuucuuaaaugccuguccuggucucccgccauagugcuugccuauaaacccaguauucuaggaggcugagaugguugaaggccagccuagguuacagaguaagacuuugucuauaaaacagaaacaaacaaacccucaguaauaaauacaugcuugaaauucuugcuuuauguuacuuuguauguugucuccuguuacccaguagaccuucaaaugauucuaagcaggcagagugaauaaagauuccuuuccaccucaaacuugguuugaauucucaaaaccucuguacauugguguugggucugggucguagucugucauggagagucuccggcugcagguccuccuaugugcccagccuguaccuuggagagccagcagcaacggguaauuggggaagaguuggugucagguaggagggagcaagccuaaaauuuuaacaugcaggaggauuucuuucaguuugagcucaguuucagcugcagagugaggcccugucuggaaaaauaaaacaaaaaaggcaagaaacacuucauaucaccugaaagagugauauauauauugauaagaugucccugcagagcccucucagagcucucacuuuggcacagccuguggacguggcuuuuuuucaccccugcuuuguucagccucuuugcuuucagacaauguggacuuuuccucagcccaagcugucggcuggcugggagcagcccuugcugggacucugcucagccgcuggcaugggcugccuaauuguuucccugagaacaauggcuacucucuguagucaggaagagggguucaugaaaggggcuuuuuuggggggggggaugcuugagagcuuuguggcacugcagccugcgugagaugaacuacaguuucuuccugccucgaguggguguucccugguucugaauggaccccuugugagcauggcacaccgggaaguguggguugccaaaggaaagcguccuugggagugggcugucagaaugguauuuguccagacucaucaacuuaaauacuuauugaaaauagaggcuucccuguuuuauuuuuuuauuuuauuacuggcaagagcugagaaauaaaaugauaaaguaaaaauagaugccaagacuuagggagaaggauugacugugagaacucuuugaguggcuauaacuguguuuagcugcucuuuuggggagauuuuucuucugaauauauauguucaugcuugaaugugacuggcaugugugcagucaccugcagaggccagaagaagacaucagauuuuccgaaacuggaguuauaaggcaguuguacucuuaaccacugagccaucucuccagucccaaagauuaauuuuuaggggaggauaguuaacaucagauaaaguacuucacagcucagaucagaaggguacuggcuggccuggaauguggucccgugguccaggccuuugagagaggaaccaaguauaguucugacauugauauaucuggaugugggaugagugauucucccuugcaguucuggcuguuuuacuuggcaugaugucuggccuucuagccucaagcuagaccuguguucucucucugaauguagcucugcuuugugacugccacacuuaccauuugcagaaggccacaggauagaaaacaaaggguuaugacugcuucauuugggagugcuucagaggguuuccuguggcuccugcagccaaccuucuacguaaccuugcagguuggccuagccaggggagagagcugaagguuaagggccagugacaaggucugaggaaagguuuuaggcacuuuaccugaacaggugguauagguuuuaauagggaccauggaaagagggacccuagcauaucuguaaguggauacaggaauaggcccagggcuugaugaguacagagguacuuguuggaagaugcuaucauagagaugcaaaggacccaccagaagguuuguaauaugagggaauugauuuugcaggccacugucagcaguacaagugcuuguuuauggagucucauuucccugcacuuccugcguagauguaucuugcaggccugaauggcagcacuuacaguuuuuugguucauaagcucauuaaaauuaauucagucauaguuuuguccuuuuggcuauauuuacugccuuguugaaacugugaaugaaaucuuuuuugaugaagaauaaguaauggaaacuccuacucaauugcucuuucuccaugccuugaaggguacugguuuagaguagagccuuugguuguauuuccuggcauauaaugcauauggguacuucucugcuacagcccccugccaaucuggccacaaacuuuuccaucuuccgaguucuguguaagaaggccuaaguacagaauacggaaucagugccuuagagcugaaaucacuagucaucuaaccuuuuaggcuaaaggggauuggguugguuguuguugacaggguuucucuguguaucccuggauguccuuaaaauucauuucguagaccaggcugaccuuguuucuagugcugccauugaaggcauguaccaccauacuuagcuggggaucagaauuuuaaaucuggcauuuaaagucucugauagaagaugucuuguguacaaaccugagguuugaacuggagucuccuccaaacauucuggcuuuugaugggaaggagaccuaggcagccacugggaugcccagaggcaugacauuaaccccuuugccauaggaccuauguuaagcuguggccuuaaacuaaaaauaaucccugagcuaguguugaaaauuuccuccuguugucuauugugucucuggaccagggggcugaaaacacuuucagucagagcagagaaugcccgaccucccccccccccuugccccaccccccugucucugucucugucucucucugucugucugucugucugucugucugucucucugucugucugucugucucucucucucucucucucucucuccaugguuuuaaggcguuuauuguagaaggguagggagaggagaagaguagagaaguaaaaguggggagggggagcaagagggcaagagaguaagagagcgcgugaccuuucuugaaucaggggcaggaguuuguauuucacaaaggugagaggagcugaacaugucagccaauagaaauuccuuguguaugucacugagggagaggacucgaacacugaguucaucccugagacagacaccuguggucgacauuguucuagaauaauuuuaguugcccuacucugaggaccguaguuguugggguuugagaagugggauucauuuagacagacauuacaacuaauuauuuuauaagaaauguguaccuuauuaaucuuuaugcauuaagugaugauuguaaaacaagucauucgggguauggaccuuccuucuccccagacguaugugcgcuugcguuugugugcggcaagguacuaagcugggccuaugacuugagcagugugugucugccaagaguaauagaggggacuggaaagaguguuucaggcuggaauaaaguaagcugacaaggaggguguauuacucguagaaaaguccacaagaaucuuugauuuuuaauuuacauguuuuuacuggucguguuuguuuguuuguuugcuuuuaccucuguguguguguguguguguguguguguguguguguguauaaauuauauguaaguacacuguaguugucuucagacaccccagaagagggcaucagaucuaauaacgggugguugugauucacugugugguugcugggauuugaacucaguaucuuuggaagagcagucagugcuuuuaaccgcugagccaucuuuccagcccgcugguuuuauuuuuuaagauuuacuuuuuuauauauguaucaguguguuugccugcaugagucuaugugcucauguguacaguugcuagaggaggccagaggagguuaggagcuccagaagcugcagcuacagcuacccagugugggugcuaggaaccaaucccaguccucuuaacugcugagccaucucucuagcuuugcuugguuguuuuuagagacagggucucaaccuguaccccagacuggccuucaacucaucucuccuuagaucugccucuugaguucugggauuacccgugagcaugaugcccagucaaaguccguauguccuuaaggaccgugacauccuaguguguguuagugugucccagugcuguguggcaugugacaggaugucaugugauagggcacuacugcuuuccuuaggaggugaugaguuggauuucccagcaggaauuguaaaucauuccucuagcuuaucacacaccucagguuagagcuugguuuauuauggugaucauuuuaggccaggccaugaugguaacauuuauaacucacacuuuugucucuucuaggugucugcagcagggaaggaggccuuaccgucuuggcuacacugggacccacacagucauauuuuggaaggccuuccucuugacacugauaaaggugugcauuacaucucagugagugcugcacgccugggagccaauggaagccacgucccccagacuuccaguguguucucuaucgaggucuacccugaagaccacaaugagccacagucuguacgggcagccucaucagacccuggugagguagugccaucugccugugcugcugaugagccagugacuguccuuacagugauucuggaugcugaccucaccaagaugaccccaaagcaaaggaucgaucuguugaacagaaugcagagcuucucagaaguagaacuucacaacaugaaguuggugccuguagugaauaauagacuauuugacaugucggccuucauggcuggcccaggaaaugcaaagaaagugguagagaauggggcucuccuguccuggaaacuaggcugcuccuugaaccagaauagcgucccugacauccgugguguagaaaccccugcuagggagggugcuaugucugcccaacuugguuauccugugguggguuggcacauugccaauaagaagcccacucuccccaaacgacuccggaggcagauccacgccacaccuacaccuguuacugccauuggacccccaaccacggccauucaggagccaccaucgcggauagugccuacgccuacaucuccagccauugcaccuccaacagagaccauggcuccuccugucagggauccuguuccagggaagcccacggucaccauucggacgcgaggugccauuauucagaccccaacucugggcccuauccagccuacucgggugucagaagcugguaccacgguuccuggccagauucgcccaacacugacaauuccuggcuauguagagcccacagccguuauuacuccuccaacaacuaccacaaagaagccacgaguguccacgccaaagccagcaacgccuucaacugauucgucaacuaccacaacucggaggccaaccaaaaaaccacggacaccccgaccagugccccgagucaccaccaaagcacccaucaccagguuggagacagcuuccccacccacucgaauccguacuaccaccaguggagugccccgugggggagaaccuaaccagcggccagagcucaagaaucacauugacaggguagaugccugggugggaaccuauuuugagguaaagauuccaucagacaccuucuaugacaaugaggauaccacuaccgacaagcucaagcugacccugaagcuucgagagcagcaguuaguaggugagaaaucguggguucaguuuaacagcaacagccagcucauguauggccugccugacagcagccaugugggaaaacaugaguauuuuaugcaugccacagacaaagggggccucuccgcuguggaugccuucgagauccauguucacaagcgcccacaaggggacaaggcuccugcacgguucaaggccaggcuugcaggggauccagcaccgguggugaaugacauucacaagaaaauugcuuugguaaagaagcuagcuuuugcuuuuggggaucgaaacugcagcuccaucacccuucagaacaucacucggggcucuaucgugguggaauggaccaacaacacucugccccuggagcccugccccaaggagcagaucauagggcugagccgcaggauugcugaugaaaaugggaagccucguccugccuucuccaaugcucuggagccugacuuuaaggcucugaguauugcugugacgggcucuggcaguugucggcaccuccaguuuaucccuguggcaccacccucuccuggaagcucagcugcaccagccacagagguuccagacagggaccccgagaagagcagugaggacgauguuuaccugcacaccguuaucccagccgugguggucgcggccauccugcucauugcuggaaucauugcuaugaucugcuaucgcaagaagaggaagggcaagcugacccuugaggaccaggccaccuuuauuaagaagggggugccuaucaucuuugcggaugagcuggaugacucuaagcccccgcccucuuccagcaugccgcucaucuugcaggaagagaaggcuccccucccaccuccugaguaccccaaccagaguaugcccgagaccacuccucugaaccaggacacugugggagaguacacaccccugcgggaugaggauccuaacgcaccucccuaucagccacccccacccuucacggcucccauggagggcaagggcucccgucccaagaacaugaccccauaccgaucacccccuccguauguucccccuuaacccacaagcgccuggguggaggcagggguagggcaggggccuggagacaacuugguguugucuguagagaccgguggcccacaggccauugcccacugguccccaacaccugaccuagcacacacugacaacagggccuggacaagcccgcccucucugguccucccaaaccccaaagcugcuggagagacuuugggggacuuuuuuauuuucauuuuuugccuaacagcuuuuuguuuguucauagaaaagucuucgcugcguuuuuugauggcucugaagcacuguuugaguagagguagaaggagggagcgaggaaccgugaaugaacucgcaggcagugcugggcggccccagcucucugcauuuugccuuuaacacuaacuguacuguuuuuucuauucacgugugucuagcugcaggauguaacauggaaaacaguagcuaaagauuacauucaaaggacuuucagaaauuaagguuaaguuuuuacauuuaaucugcuguuuaccuaaacuuguacguauaauuuuuggguggguaugggaaauugcuuugcuaaaaauaagaucccaggguguuucaaacuuagagaagaccaagggacaguauuuuuuaucaaaggaauccuauuuuuucacacuaugucaacuugguugcucugauaucccagagccugacugagggccuccugguccuggcucgggugccagggcccuggugcuggguucgcucucccgcuguugccaggggcuggaagcuggaggggccucuugggccauggacauccugaccucuaccccaugcacgcuaguggccuaccaccaagggggucuucauuucugugggaaagggacuccaaaaggcauugguggcuauggccuccaaccuaggugcuccaaggugggccagcugcucguaggggcaccugggaaggucgaaggacuccaccucaucaaccuuucuuuucccuucucugugguuugguuugguuugguucuguucuuucccuucccucuuaaaaggaauaucacggucuuugaaacacucagugggggacauuuuggugaagaugcaauauuuuuaugucaugugaugcucuuuccucacuugaccuuggccacuuugucccaacaguccacagcccuaccccauauacccugccccucuucucuggcgcuccaguccugggccgugggccuguggcuggggaggagugccagcaauaguucauaguaaaagucugugggcucucaaagcuaauuuuuuacuaaaguuuuuauacagccucaaauuguuuuauuaaaaaaaaaaagauuaaaaaauggugaugcuuagcagcaguuuguauaagcuccuagugucaacuccaugggacugauggcuuugcucauuuggacccuccccuccuucuuuuccuaauggguuaaauucuggauuacauagaggcuuccuuugccuuuuuuagcagaacaucguccaucugucugcaucucugucccaugacucaggggcacccacucugcuuugauucuccuccuuuggaagaaaccauuuugagcaugccuuuucuugaugucugaguuauuucggguaccuuuuagggaggaaugccuuuugcaauaauguaucccuucccugauggaggguggguggguggacccaggcucccuuugcacacggagcaguaccuucuaagccauaucgacuguugagcagagggugugcugucucaggaaggaaaggccaguaguucagaaggguugcuuccaaauggugguucuucugcuuucuccacaaggccuacccuuccugcucagcccccaggaggguucuuuguagugagcacuccccaugcgggagucugccgaugagugcuucauggauggcuggugacugggccuugugcucccaagcucugguccgagcuggaguuucccugaugucccagagucaagagcagggaucugauccgaugaaauuauuucuggugaccucaucaaaaauaaauaaauaaauaaacaaauaaacaaaucccaguauuccaggugagggcuuugggaagcccuccagauaacucuuguugcucuuagcaaccccaccauugggcauugccauguagagaggaggcaggcccaaaguggccuguugucauagcaacuggaggcaguggggcagugaacagaauaacaacagcaacaaugccuuugcaggcagcccccucccugagccggcgauggccaucagacucugagacagagagccaaucucacauucaaguguucaccaaccacugacguguuuuuauuuccuucuauaugauuuuaagauguguuuucugcauucuguauagaaacauaucaaacuaaauaaaagcagugucuuuauuacaaugucauugccucugacugucuauuuaccugggaucuucugguuccugggcgugaauggugggagaggaucaaucaugguagagaagggcagcucagggaaccucugcagaagcugccauuucugugccgccgggaccucugccaauacgcaagcugcuucuagugcuccuucugccuuuagucaagacuaacuuuaguccucaguuuccucauuugccaagguaggguauaac

SEQ ID NO: 5311 - RNA, 6072 nt, Mus musculus
cugggaguuguaguucuuuugguugauaagggacgccaauaagagcuagugguuggauggagacugugagcggugauuuugcuugguuguaaucucccaaaucaugucccguguguuggugcccugucaugugaaaagcacuguagcccugcaagugggcgacaugaggaccucucaaggucggccuggcgugcuggucgucgaugucacuuuucccaacaucgcgccuuucgaggugagcaaccccccauauaagcgaucaaggcuucugggcggggaauaccuaguaacuugggcguuuccuaggcauuuacacagcuucuacagugucucuugcuuuugcgaauugggccuauucagaagcauuuacagucuuuauuaauaagcuuuauuaaauagacuagaguuucccguccuauccucuucagcaucucuucccagugcccaggauaucacuggaacuacaauuugaaucucaguacaagugagaggauauuugauuucggccguagcugcaaucgucaaacaaugaugcaaacguaccauuccaguggccccugccacaggucaggugcaaccuagccuucaucuagguccuccuggugacuuguuuccaaucccuaguuguucuuccauuucaacugacagugacagggcguugcaugaccucaacacaggacaaaggcuaccucuaauggcauagcauccuucccuuacccacccucuuggcucuaugugcuuuguauuacaauaugucauucucucgcaagauguugcuucccaacaaucuggggaaaccuaguuaauugauccgacccuggaaaaucugagucaguguguuugagguggaucuuugacaucuauauuuuuauuuacuuauuuaauauuuuuauuuuaaaaaagcuuuauuuuaaaucuaugaguguuguuuuugcaugucugcauauauaccuugugcauggcugguacuaguagaggccagaaaaagguucugaauccucuggaacuggaguuaugaacagcugugaggugccguguaggugcugggaaccaaaccugguccucugcaagagcaccaaguacucuucauugcugagccaucucucuaguccugauaucugugcuuuuguguguuuuguuuuguuuuguuuaaguuccauaggugaugcuggugugcaucgagauggaaacuacugcuauggcaguugguacucuaggcuccccaaaccccuccagugcaggauccuacuauucuucuuuuuugcuguugcuuuuuguuuuucgagacaggguuucucuguguagcccuggcuguccuggaacucacucuguagaccaggcuggccucaaacucagaaaucugccugccuuugccucccaagugcugggauuaaaggcgugggccaccacugcccggcccuacuauuauucuuuuuuuuuuuuuuaaagauuuauuuauuguuauauguaaguacaugguagcugucuucagacacaccagaagagggcgucagaucucauuacagaugguugugagccaccaugugguugcugggauuugaacucaggaccuucagaagagcaguuagugcucuuaacagcugagccaucucuccagcccucuuuuguuguuguuguuguuguuuguuuguuuguuuuacgagacaggguuucucuguguagcccuggcuguccuggaacucacucuguagaccagacugaccucgaacucagagaucugccugccucugccuccugaguacugggauuaaaggugugcgccaccacgcccaguuccuacaauuauucuuauucuggucuaaaucugcuaauucugagagagagauggagagaacuucugcuaguaccaggcuaaaggacauacucagguucucucacucugguacuuuuuaaaauuugcuacuuuugggagggguggggaucucaaaaaucccagaguggccaagaauaggggaagcuuaucaugaacuucugauccuccugccucuaccccucaagcacuggauuacagguauacaucacagguguacaucacagguguacaucacagguguacaucacagguguacaucacagguguacaucacagguguacaucacagguguacaucacagguguacaucacagguguacaucacagguguacaucacagguguacaucacagguguacaucacagguguacaucacagguguacaucacagguguacaucacagguguacaucacagguguacaucacagguguacaucacagguguacaucacagguguacaucacagguguacaucacagguauacaucacagguauacaucacagguauacaucacaggccugguuuauguauuacugggcaucuagcguagaacugcaaacaugcuaaccaaggcaagcacugcaccagcugagccacauccucagcccaauacauuaccuuaccuaucuucguugguccacuuagcaagcucauccagguuucacauguccauuuucugcuuucuucgggguuaagguucugaccuccgaugccaucucagauauguugggaugguuuguuugaaugacuuacagaucugugagcacuuuuaggaaagcaaaauugcauuugggccacaguaauuguugaauugucuagcaaaagugugcauucuagccgggcggugguggcgcacgccuuuaaucccagcacagggaucccacuuccacggaggcagaggcaggcggauuucugaguucgaagccagccuggucuacaaagugaguuccaggacagccagggcuauacagagaaacccggucucaaaaaaccaaaaaaaaaaaaaaaaaaaaaaagugugcauucuaaaaagaagagacaaugucacugugucguuuguauucuaguugcaggagaucauguuuaagaauuacuacacagcuuucuugagcauccguguucgucaacaaagcuccaugcacacagcagccaaguggguaacuugucuucgggauuacuguuugaugccugacccacacagugaagagggagcccaggacuauguaucacuguucaagcaccaggucagcugggccucagcauggccagggaauacuggauggggacuuccugccuauggauugagcagaaaagcaggaggaaagagucgggcaaaacugggcuggacuauggcuuucaggcugguacuuuggaggggccacuguucuguccuucauuuagacuuggagaagcauuugguuuuacuguagauugggagguuuuugguaaacgagcuaggucuucagugggucuuuuauguauuuguuuugugagaaaggguuucucuguguagcccuggcuauccuggaacuugcuuuguagaccaggcuggccuugaacucagagaaaggagcuuccugccucugccucugccuccccagugcuaggauuaagugugcaccacuacgcccugcucaguggguccuuugguaugugugucagaugcugugugacaugaacagagugcuggagcugcgucugauucugcggcagccaucaccacuguggcugucuuucacaguggaggaacugcagaucuaccaacagggaccaaaggcaagugacuuugcaaaaccuacugacuaacccuuuacuguaaaagcuucuggcucugacgaggagagauggggcacuggggugggucacaagcaaggauagugagacucugaaggaagcccucauggaagcuggaguaugaaugcaggaguccaugaucagaugugacugacguucugugucagaauccccuggccuuugagaccgcucacuacuuuuguugcuuauguuccuggguuccccuucugcauaaaaggagaguuuuaugagggucccuuugauguuaugguucugaacauggauuucccagugucuuaggcucaaggguccuuuucuuugcucccaggugccagagcucuuagauucugccucauugaggucauuaugccuuugcuuugcagagccccuccuuggcguuccccaaguggcuuucccacccaguguccaaugagcagccugcuccccgccuugagguaagcucucuaacacuggguauuaaccacauauacaugguucuaaugucuagagcacaaaaaaagugggccucuggcuauccuggggcuaccuggaaauguagcucagugguagaauacuuacuacccaacaccacagacauuugggucuggaccuagggccuaugguucaaugucuucuugggagcucugugggcuuugagucaucccugguuuaagcaugggucuugcuuaaugaccaucaggcuauaacuguucuucaaguuaucugggaauguuacugguuucaucugcagugcuccauagcuuauauauaucuaagggcauuucuggggaaagauucaugaccauguuccuuccuucuggagcagggucucccagaucccagcagaguguccucugaggugcagcagaugugggcacugacagagaugauucgggcuagucacacuuccacgaggaucggccgcuucgacgugaguaacagugucccucccccuugcuuccaucacuuugagcggcucaacacugaucguuucuuguguugcagguggauggcuguuaugaucugaauuuacucuccuacacaugaacagcagcuucuacgugagauguuggcuuucugugcccaucuagaugggguuuggccaccagaggccguucccugugcauccaaguucuaucugggcaaaaaucugcagauugggaauucuugauacccauccaguuguuuuagcaugaauuccuagugggggcacuucugucucugacugucugacauguaaauucagucucuuccucucagaauucaccgguucuaauuagaauccuugagcuccucuugcuuguccugccaacacgaacaccccagucugcuaccauuuccccccauugcugagauaaaccugucacuuguagcaaggaagccacuguuguuuugacacucaugaccugggaagcuugaggaagacauacccucuauucauuccucugcuucugcuaguagcccuuguccuuuuguauuguauccaugaaaagaaaauguccuagagccaggcauggcacacaccuuucaucuuagcauucugugaguucaagaucagccaggucuacacacugaaucccaaggccaaucagggcuacauagugaaacuccauacuaagaaaggaaggaagaaagaaaagaaagaaaaaaggaagaaagaggaggaaggaaggagagaaagaaaauagcucucuuugaaauugucugcuuccagccugggaggcgaagaugagacuucugggagcuugagugcuuaagucccuacaauugcuccugaaaaguguucugugucaguucuggguaggugcuguuggcacagcuggggccagagcacgaguccucccuucggacuauuugucaucagauucagcaugaaguacauccaacgaucccugucccuucucucaguugcuucugcccgucaugcucagggugcugagagagcccugggggagugcguccaagccaacgucucacugacacucauugaggcugaggcccuccauuaccccagagcaaccacuaaaugaggaagacuacugcucuuuccugugaucagauuguuucccucuaguccuuccuggcuucguccccgggcaguauuauuaagccgugcugcaaggugucucagaucuggaaaauuggacacgaguauaugcaacaguuuucugggaaagucuggccaccuuugguagcuaccuugcaucucugcagucagcccucuugaagguccugucuucaccuacaggaucauaguuaagccccacugacaggguaauuaccauaguccaguguucagggaacaaugguccucaguacacuugggcaaagaggauccugaaguggcaggggcuaugcauaauucacagcuguguuccuaaguuccuagagcuggagcuaguguacggcaagaucaauaaauacuuguggaauaugu

SEQ ID NO: 5312 - RNA, 4730 nt, Mus musculus
gcgugccuggcagaguaguggcuucagugugacuucagugugccggccgcaccaguugcgggugacaaugcaucggauagucagugugguagccccucuggguuuucgccugcaggcacaacccuugguccagagucgcccacucaguucuguacaggugggauaaaggaugcuggaauuuguuauuggucuuggagggugggggaaggaaacugauggugacuggggcccugguggcacuaagucuggcugucuacaggaugugcuccgcaggacuccacucuaugacuuccaccuagcucauggaggaaaaaugguggcguuugcaggguggagucugccuguacaauaccgugacagucauguugauucacaccugcacacacgccggcauugcucucucuuugaugugucccacaugcuacaggugagucagggaggaucgggccuucuuccacgucuacagaacugagcucugcagcuuugaggcuaucuuagaagacuaaaguguuagggacucuagagggcuaacucaggagaucugaugaugauguaucuuugaucucuccugccugcuccugugguguguuuuaaugccccggggcuugcuagauagaaauugguuugguaucucaguaagguguuagaucgccuugaauuuuuagauguugcuugguugcacggaggcugggagggauccuggaauugagaagguaggaccucugcccucuccagaaccaaaagaccaguagucacuucugggcuggacuggaggaugcuugccuugcagccuuuuagauuacagauauugcaguggccuggggcuuucccuauuuucccuagaccaagauauuuggcugugaccgagugaagcugcuggagaguguagugguuggagacauugcggaacuaaggccuaaccaggugagccuacuuuacuucuucucaaaguguguuuucagucacgagccaguaaacagcuuacacccuugccucaaguguaaucagcagccaacggcgcacgccuuuaaucccagcacuugggaggcagaggcaggcggauuucugaguuugaggccagccuggucuacagagugagccagggcuacacaaagaaacccugucuugaaaaacaaaaacaaaaacaaacaaacaguguaagaagcacaaagacaggucagauacagcuuuucagggcuugcuaucuugauggagucuuuugagucauuuccagauauucagcuuuggagcaauaucccagccuuacuccauuggguugggaggccagagaccaccauuuauauacccugaccucucaugcuucccauaucuuugcuaauuaaagugugguccuuaaaccaggagccucuccaucuucuaggaauaugcuaaggcacugcucuggaccugcuaagccauaaccuugguuuuacuaagaucccuaagugugaucuaucagucucagguuuugucccuccaguggcaaaggcuaacaauguuuguuuguuuguuuguuuuaacacauugcugaagaacauagugggagccugcgagaucaugaagaugguuuuugaagcuuuuaagccuggagguuugcauauggguggaguuaccuggguggagugaagcaguaguuccuaggucucagaguaugaaaugaguuucuaagaacugaguagugagggagcugagucuggggagacccccugagaugggaggagugaggauguacuugacagauggagagcaaaggccuggagccuugagccuuaccuuguacguuuuacccaguacuguguucaugaguuugcgguagcugaauggacuuaaguauguuucuggcucauacugcuuggcuuccuggaucuggagacaaacgaugcucuucuuuauucauagggaacacucucuuuguuuaccaacgaagcuggaggcaucuuagacgacuugauuguaagcaauacuucugaggggcaccuguauguaguauccaaugcuggcugccgggacaaggacuuggcucucaugcagguacugcugcugcacuuuauucuagguacuuuguguuuauaaagaaguucucaaugcagauaggggcucagagaaugacucuggauaacagaacagucaauagacucaagagcaggccuucccugguacaaaccaguguuugaggauaggcacuagaggaguuggauaaagcucacccugaaaugagcauccucaggugaggggaaggaucugcaauguccagucuauuguaggagcucaauaaugaucauagacacugauguguuuuuuuuuuaaagauuuauuuauuauuuauuuuauauguaaguacacuguagcugucuucagacacaccaggagagggagucagaugucauuaaggaugguuguaagccaucaugugguugcugggauuugaacucagaaccuucggaagagcagucagugcucuuaaccacugagccaucucuccagcccugauguguuugucuuauauuucaggacaaggucaaggaguuccagaacaggggccuggauguaggccuggaggugguagagaaugcccuguuagcucugcaaggugagaugccagauuggaguuagagccagcccuugccuuccuggcuuuauuugcauggaggcuauauggggaagauguggauaugauaucugcacaccacaguuccaaaguuaaccauuguuucucuccucucaccuacugcaaggcuauccauaggcuagggacaagggcauucucucuccacuugcagaguugggcuugcuugggacuucuucugcuuucuaaauaagggcuguaguccaggggguguuggguucaacucccuugguuauucucuuugaucuaggacccacggcaacacagguguuacaggcuggggugacagaugauaugaagaaacuacccuucaugacaagugcugugauggagguguucggugugucuggcugucgugugacccgcuguggcuacacaggagaagaugguguugagguaagucaagaaguaauuacucuacauguuaucacauuucuagcaggaagaucuuaauucaagguggcuagguuuccauagugaauuccaggcuaaccaagacuauauagugagagccuaucucaaugaaaacaaagccaaaaccaaaucaaaauccuaaaagaagccaggcgugguggcacacaccuuuaaucccagcacuugggaggcagaggcaggugaauuucugaguucgaggccagccuggucuacaaagugagcuccaggacagccagggcuauacagagaaacccugucuugaaaaaccaaacccacccccccccccaaaaaaaaaaaaccugucucaaaaaaacaaaaaauaaaauaaaauaaauaaaaaauaaauccuaagacaaaaaagaucuacuuguaaagcuuagaucggauagcgcaugccuauaaucccaaaaccugggaaauagaaacaguccaaucauaaauuacagaccaaccuuggcuaacugucucagacagaggaauaggauugggaaaagugggcaauacacuguagugguagagaguuuuacuccugcaugaccaaaaguaguaaaaguagcuacagcauucaagacacugccuaucugcucucuguuccuuugugcagauaucagucccagcaacaggggcaguccacuuggcaacuacucuguugaaaaauccagagguaaagcuggcaggacuagcagcccgagauagccugcgccuggaggcaggccucugucuguaugggaaugacaucgaugaacauacuacaccuguggagggcagccucagcuggacacugggugagccgggcuagcagucaaggggguccugagagcuagaauacucuuuaaugaagccagcuagcccaggacuacuccuaagguuguguagucuggaacaagugacucagccuugcugugccuucauucccugaaggugcuacuguggcuuugucuauuauaaacugaggguccuacauauggcuuccagaggguaggugaugguugguugacugacuguaauucaggggaagaauaguagagcucaagaggccaagugauguuuaauugguugucacuuggagucuuaguaguaaagacuuccugugcuuagggcuuuugugaacuauggcuuacagucugguguguuauguuccagggaagcgccgccgcauugcuauggacuucccaggagccaaaaucauuguuccccaacugaagggugagguacagcggagacguguggggcugauaugugaaggggcuccagugagagcacacaguccuauuuugaacacagaaggcacugugauagguaaguggauggggauacuggcuggcagguguucaggauagggauacugagcuggcaggguggugcuaacuuauggccuaugccuggacagguacugugaccaguggcugcccuucacccagccugaagaaaaauguggcgauggguuaugugccauuuaaguacagucgaccagggacacagcugcugguggaaguccggcggaagcagcaaaugacagugguuagcaaaaugcccuuugugcccaccaacuauuauacucucaagugaagauggcccauggggaagcccuucccuccaggaguguuucucuagagggcauggcauagugcuuagucagaacaguggaguacaacucccacggguggaa

SEQ ID NO: 5313 - RNA, 31940 nt, Mus musculus
agggguuuuuaaaaccgcgcaggcgcacccagccccacccugcuugcuuaaaggaugagugauucggugaggauaaaauagcaacucgcucuuuuauagccccgguguucccgucaugcuccacgcgucugccaugauugguuaagcgucuagcucucagggcguggaugcguucuugagcaaucguggcugaacugagagugugcgcgcgugcgcggggccgcgacuggcgccagcucgagcccgcagggcgcucggggccgcgcacgucgcuccccgcccucccgccaccgcccgcccucguucgcucgcgcuccccgcccgccgcccgcgguccuccgucgguucucuccauagcccgccgucucccacggagcugcccguccuuggcucggagcucgcggacucgcggacaagcguccucagcgcgaagaggccggacucggaguccucgccuugaggugagcaggagcauuucccuccagccgccucggcuccgggcccggcuggucggcugaucggcaagcacuuuuccggccuccggcccgucgccugcccgcggucgcgccccaccugcugcucucggcccgcagccccucgccccggccccugaccuggggccccgcgcccgaggcggcggccccgcccgcgcaguccccggaagcgcgccccgccgccuccagucccccuucccccgcccggccgggccugguggagcccuagccgcccgcccuccucgucgcuuccucucaggguugcgccgggcugggcgggggcucccggccgguccgcgaccgcgcugggguagccugccacugcgaagcgcguguggcugucgggaguuggacuaggcaagaaacucuuuuacaacuccauuuugccuuuugcauugaacguggauuauuaaucccguucuauaccgggugaagacagugaggguuuggguggauuuucuguuuugagugccguauuauuggagauuguguaaguaaaagauuguuuugaaaucuuagcgguuaugacucuaugggggaagguauuuuccagucgaaaaaacacauaauaauuuggcgagguugcaucaaaauagaugcauuucugcuuaaaguuauuacuucaauuaagaaucacugauggguuccccuuuucaggucgguuucguaaaauugcauuuuuugcaggcaaguugauuuaaaaaaaaaaaaguucauguuuaguagcugauaguggaaaauuugacaccauuuuuuuucuuuuuugccccagaauugguucuacuuguauuuucuaauagucaucacuaaauuuugaccuauuaguuauuuauuugguuuugucuucugguauauuuugaaauaagugcuuuuugcauguuauauauaacauuauauauguauaauauguaguacacguauaauguacaucccccaugccagucugaaaggggaaaacuuauauuuuaggaugcgguauguggugagaauuuuuagccacuuagugucacgugcccaaauguguauguaccauguggaauguuuuuuucaccuuucauuggcuaguuugagcauuugacucacguauuauuaaacuaagaaaacaagaucaggucuuaauauugaagacucugagauguuguuuggaguauuucuccggagcagugacguuucuuagggacauaaaauauauggagcuuguuuuuuuccuauuuuauuuuccucuuugguguuggcuugggacacagugaacaggugcuguaucucugagcugcauuucagccuuacaacuugggaucaaacucuagugcucaacuuacauagcuucuacucaaaaaucuacugaacaggagaauaggaacauccacucuacugauuguacccccaauagauguaguauuuuagacuggggaggaaaaaaaaaacuuuaggauuuacaaaccaauuccguuuguaggugugggaacugagcuuagggaauuuuuuucucuuuccuucugugugugugugugugugugugugugugucugucugucugucucucucucucuuucuugagaaaggcuuauuacuccgcagagagaacagugggugugauaauaccagaagaaccacugaccuaagacuuaauuuaaaaaaaaaaaaaaagacacugggucugaccugagaccuggaacuuaauuuguagauaaagcuggucucuaauuuccacaugcuccuagugcugccuccggaacagugcugggaucacugggugugugccaccauuccugcugagacuuaaaauguuugaaggucauacaucuaguuagacuacaacuauuuuuuuuucuguuauucuccaugugcugucaguuaaaaucagaauuuccagguuacuucagguucuuuaccaugcagauuaugcauauuugggaaacaaauuucauguuuuuguaaguaguuccuuucuggcuaggccuugccuuugaguguguugguuuucuuaaggaccggguuuugagaguuuacuguuagcaaagauaagguaaugagguccagcuagaauguuuucaagacuccuuugagucaguuuuaaauggaauuggugagaauuugcauguaucaaguagaccauggucuguacaugugugagagugguuuuguuggagugauuucauaguccuuuaaaaaguccaucuugcucuauuagggguguaaguaaguuacuagaagagugaaaacagaucuucagagcugggugugguggcacacgccuuuaaucccagcaggcggauuucugaguucgaggccagccuggucuacaaagugaguuccaggacaacgagggcugcacagagaaacccugucucgggaauaaaaaacaaaaacagaucuucaggcgcuucuuaguccaugggugggguugaaguaguaagaagaggucaaguaagaaaagccaaacuagucuuuugacuuguccuuaaagagccaaaagaucaguuaacuucauugaaagacuaauuuaagaucagaggguuuuuauagacagcauacuuaguucuauuguaucauagcuacuagcaaugaugacaaauugugcauaaauguugaauauaaaaauaggaaguaggugaggugacaaaccuguaaugaaacacuccaggcauuaggaggauuucagauuugagaccagcuuaggcuauauaacaaaauccugcuucaaaaaaaaaaaauguuccucuuaauucuauccaguggaacucaauuguugcaccaaagcauuaagaauguacguuaccuaucugucuuuuguuacugggaaugaaaccuaacuuugauugguagcuauacgauuagccucucucuaucuuaacugauugguuacuuuucagccugaagcuuuaacccggggcauuacauauccuaggcaagggcucugcugcugaaguacguccugaacccugauuuuacuuuugagguagucuuauuacauugucagggcguaauuaugaacucaccugcagcuuucaaccuuccucagucuccccaguaacuggguuuacagcuaugaggccugacuguaaccaaguucguuuuauuuauuuauuuauuuuggaggcaguuacacucuaggugagguuagcuuggaaacuuacacuguggcccagauuggucuugaguuuguagccguucucccuuaguuuaguuuagcccuccugagugcugggauugcagggguugcagguaugagccaccauaccaaacuuacaauauuuaaguaugcaucuuacuuacuguuaguguuuuggugacauuagauauuggugacaauaaguuuugaaaguaauuugaaauuaauuauuguaaaaucccuaauucuggugacuuuuuguuugauuggagacaagcucugucuggcuuggagcuuuguaguccaggcugaccucacaagugaggcaauccugucugcuucagucucucucucucucuuucaagauuuauuuauuuuauuuaugugaguacacuguagcugucuucagacacaccagaagagggugguggaucccauuacagaugguugugagccaccaugugguugcugggaauugaacucagguccucuggaagagcagugugcucuuaaccgcugagccaucuuuccagcucccugcuucagucucuagugcaggaaauauaggugugagccaccaucccagacuuauuuuuaaccuauggugcucuaguauucuaagugaaggguuguauauucauaauuauguagacuguguuauugaaaacaagcuaggcaauaaagcugcuuauuauuauugguguuugcgcugucaaaugaaucugaauguacuuaaaauuuuucuucugacugugccuuuuuaauucuaagugauagacgugugaaauaaaggaccauuaaguuguaacuaagcuuugguuaauaccaaacugaacuugauuugggaauagggguugggaugucuugagaaagguuuuugcuaauagagcuagguugagcuuaaacucaucccaguuguuugcucccacuucccaagcgggauacuacuagcaucugacaucacccaccccuaacccccaccccuggcugggggggggguagauagaggaaauauauucagauuuguuuauaauagaaucuuaaauuucaaaugcagauaagaggagaacaagcagcuaaugaaagagugggagguaaaauggguuuagagagaugggcagaggccagaucauguaguaugagaaauuccuugggcuuguucuuuuuguguguuuuuuguuuuguuuguuuguuuuauucuuuugggguuuucauuuuauuuuugagacagcauuucucuugucugucuggaaacuuguccuguagaccagacuggcuucuaacucacagagauccauuugccucugccucccaagucccggaaauccuuguuuuagcuucuuaggguuauagacaugagccaccaagccuugccuggcuuugguuguucugagguggaauaccuaucagguguuagauuuguugucuuguuuugaaguuggguaauaauaugaucugcaaaaaauuuuuugagagacagggucucauggaccuugggcugaccuaaaacuagcuauagagccaagaaugaccuuguuccucucaccucuacuucccugguucaggcauuacaggugugaguguaacaauuccuggcuuuuuguggugccuccccaucaucuguagcugcaguucuaggauaucugacaccuuuuggcuuccuugggcaccaagcaugcaagugguccacaguucuauauguaggcaaaauaucuguacauaugaaaacaucaaaacucuuacuaacuugacugguuuuacugcaugccuguuauuccagauuucagaauggcagaggcaggaggauuguuccaagguugaggccaucuucagcuagauauagaaaaaaaaaacaaaaccagcagaaaaaacccaacaagugauccagacuuguugcacaccuauaauccuagcucuugggaagugauggcagagaagggucaggauuuuaaguuggaggccacugagccauuucucuugucuccaagucuuuguguguauguguauaaguuuaugucguacauauuugugggcauucuuguggagucuagauugacguugggugucuuucuucauugcuuuccaccuuuuuuuuuuaaaacacuaaacaugcagcucaugacugagcuagacauacuggccaggaaguuucagggaucuuccuguggugcugagguuacagauguacuggugccaccaugcccaaguuuacaagugugguacagauccgaacucagguucuuucucaagcucacgaggcuguacugugagcucucaccagucugaguuuacuuuguuuccuuuuauuucuaagccaucaauuuacaaacagcugccuuucugauuuuaauuucuuuguuaagccuguauuaaaaagggaauaaauaauagggccugucuggccugucuuaggguuucuauugcugugaugaaacaagggaaccaaaagcaacuuggagagaagggucuguguggcuuuaacaucauaguccauugugggaaaccaaggcaggaacucaaacgagauaggaaccuagaggcaggagcugaugcagaggccauggaggagugcugauuacuggcuugcugggccuccuuucuuagagaacccaggaucaccagcccagagcuguacuguaccuuuccucaucgauaaaugucuaagcuugccuguagcugacucuuuugggagcaucuuccugcucuuugaugacucuagauugugucaaguugacauaaaacuaaccagcacacuugcuuauuauguaugaggcccugaauuggacuucagcaccucaauauuaacaaauaaaacuuuaaaaaagggaaaugcuauuugauaauauguuaaauagucuaggaaguaagauacaacgaucacuguaagucuucuagcuuaggugauuggagauuuauauaaugggacuggagagcugaucgguggguaaggcacauacugcucagugcccggcacccacauggcggcucacaaacauccauagcuacaacucacggagauaaccuccaagggcaccagacauauaugcagugcccauauguaaucucaggaaaacacuaauuuaguacauaaaaaaagaaauaaagauuuguauaacagagccaacaagauggcucaguaagguaaagaugucuauaccaccaagccugaccccugaaguuccaucccuaggagccacauguuggaauuucauagaaucaauucuuauuuccauacucugaccucuacaugcacuguagcauuugcuucugcacauuugcauguguauaugugugcacauacacaaaugaaugaauggggagauauauauauauauacacacacauauauauauauauauauauacauacacacugcacauacacaaaugaaugaauggggauauauauauauguauauauauauacacacacacacugugcacauacacaaaugaaugaauggggauauacacacacguguguguguguguguguguguguguguauauauaaauaaaauuuuggagucaaauguggagguucacuccuuuaauuccaaaacuuggaaggcaaagaaauuggaguucaagacuuuccuuguauauguagugaguuucuaggccaaccagggcuaugagagacucuguuuccaaaaagaaaggaaaagcauagcuuucaggcugguugagauaucucagcaaguaaagguacuuguuacaugagccugacaaucuguguuugauuccugagacccauaugaugcaaauuccccaaguuguccucugacuccucucaccacacaaaauaaauaaauguaaaguuuuucuuuuuuucuuucuuuuuuuuuuuuuuuuuuuuuuuuuucuuuuuuuugguuuuucgaaacaggguuucucuguauagcccuggcuguccuggaacucacuuuguagacuaggcuggccucgaacucagaagugugccugccucugccucccaagugcugggauuaaaggcgucaccaccacugcccagcaucugucuuacuuuuagaagacagcauuuauuguauuugaaaaguaagauugauuauguacauuuuuauuaugugaagaaguccaugacaacaucaguggacaugcuaauguggaagggggaaguuuguauggagggucacaaaacuacaggcaaaucaauaauggcugcucagaaaaauagucuuucuauuauugguuuuuccauugcagagugguuguaucuaaguauuugugcaguggaggggaggagugauguguaucuguuuuguugcugcuguuguuguuuugagacagguucucuguagaucuggcugaccuggaauccacaauguggaccaagcuagccuggaacucaagagaucuaccucccuuugcaucguccugagucugagauuuuagauguaugccacugugccaggcauguguguguauuuauauacauguauauuacuauagucauacauaugcagacacauauaaauacauauuuuuuuugugugugggaagguuucaagacaagguuucucuugguaauccuggcgguccaggaauucacucuguagaccaggcuggccucaaauucagagauccucccaccucuucugggauuaaagaugugugccaccaugccuagcuaaaaguuacuuucuuuuuacagaagaaggucauggugguauaaaugauaaauuuuucuaauguuaauaguuuuuaccuugauaacacuaaguugagcagaagcuccaguguauucaauauuugacuucaucucaccaccacagccaaggaaaguguugcuucuaaagguguaacgaccuuuauacuguuuugcaagaggcacuaaauauccucauugggaauucaugaagcuaccaaggcaaucuguacuugcaacuacuugugaugagucucugugaugagugugugugguggaagugguuugguguugagcaccaaaucaacuuuaaguugauaacaacagugacaaaaauccagaucugggaauagguagauucugcaaaauuguguguguguuggggggguagugaacacaacccauaaaacagcaguucucaaccugugggucauggccucuuuggcaaaccugucucaaaauauuuacauuaugccugggcgugguggcgcacgccuuuaaucccagcacucgggaggcagaggcaggcggauuucugaguucaaggccagccuggucuacagagugaguuccaggacagccagggcuauacagagaaacccugucucgaaaaaacaaaaacaacaacaaaaauuacauuaugauucaugaccauaguaagaguacaguuaugaaguagcaaggaagguaauuuggugcgcggggucaucgcggcgcgaggcacugggcugcauuacagcugaagcuuuagggccacaaggugcugaaagguuguagcugugucgugguuaaggauugugccaaagaaucucagguugaggauguaauugaauaguauuucaaaugcaguuaaauagugcuguacauuuuccugucuggauggacauuuacauucugucuuuauccuaauaaaaugaacuuauaucucuuauuuuucauagccuugcaucugagaaguuccagguacuuuguacaacugcaucccagaaccuguguguuuucagcaccuuuauaagguauguaaacaaauauuucuucuugcauuuccuuuuccucauauugagagauuaauacgaaaucuguggaaauaauuaagugauucucuuguucucugauuuugaaagccuuugaauuuuuccuguuguuuuguguaugcaugcaugugcacaugcuuguggagaugggguggggggcagcugugcaagucagcgcucugucugucacaugguaccagggauugaauuaaggccaucagcuguggcagcaaggaucuuuaucugaugagccaucuugccggccucguuuucuuuuacauuuguuuguuguuguuuuuaagauuuauuuauuuauuuuaugcauaugaguacaccaccauugcucucuucagauacaucagaagagggcaucaaacuccauuacagaugugagccaccaugugguugcugggaauugaacucaggaucucuggaagagcagucagugcucuuuaaccacugagccaucgcuccacccuuuuuuacauuuauugauauguguuuuggggagcaaugugguagucagaggacacauggaagaguuaauccuuuccuuccaucguguguuucuaggauuuaaauaggguagucagcuuugauagcagacaucuuaacccagacuccucacuaggccuggcacuuucuugacuuccuucccucccucccuuccuuccuuccuucccucccucccucccucccucccucccucccucccucccuccuuccuuccuuccuuccuuccuuccuuuuucuuuuaaaauuuauuuauuauguaugugaguacacuguaguugugcauaugguuguaagccuuuaugugauuguugggaauugaauuguuuuaggaccucugcucgcucugguuuacucuggucaacucuggucaaccccgcuugcuuaguccugcucgcucccgcccaaagauuuauuuauuauuauacauaaaguauacuguagcuguuuucagacacaucagaagcgggcaucagaucccauuacaggugguugugagccaccaugugguugcugggauuugaacucaggaccuucggaagagcagucagugcucgcucuugucaucuugccagccuuuuuuuuuuuuuuuuuuuuuuuuuuuuugcuucgagacaagguuucucuguguagcccuggcuguccuggaacucacucuguagaccaggcuggccucgaacucagaaauuuaccugccucugucucccgagugcugggauuaaaggccuuugccaccacgcgcagcuuguuucuguuuuucaagacaaaguuucuuuguguagccuuggcuguguagaacuagcucuguaagaccacacuggccaggaacucacaaagaucugccucugccucugccucugccucucugccucugccuccuguugcugcaauuaaagcacaugccaccaccaacuggcaacagauaaugcuaguuauguuaguggauucuggaaagaggugcaucaugagugugcgucugagagaagugccaggugcugcaggaaagcacuaaauggccugaucgcuggggaaugguggcgcacgccuuuaaucccagcacucgggaggcagaggcaggcagauuuaugaguucccgaacagccuggucuacagagugaguuccaggacagccagggcuacacagagaaacccuguuucgaaaaaccaaaauaaauaaauuaauagauaaauaaauggccugaucucaguugggagcugagggaugcccuugaaauacagguguaacccuaagccacaucuuugcacaucuuugcuuuaaaaaaaaaaaguggaugcuuuauuguuuuggcaaaaaguaguuaccaguuuuggguuuuagaauuccagaaauuaaugucuccagaacuuucgguuauuuucuuaucuguuaguacaguacucuacccagaauucaaccaaggugguuuuugcacugcuuacauugagacacacaggcagaucacugcuacacagaaaccaaagauucuuuaggauuuaacauuggagguuagagagacggcuuggcugcuaagagcauuuggugguuuucuagagcacugguucucaaccguccugaugacccuuuaauacaguuccuauguuguuguaaccuccaaacauaauugcuacuucauaacuauaauuuugcuauuguuaaugauuguaauauaaauaucugauaugcaagauauuugauaugugaucccaguguguauauaauguuauguccucuauauccagcgaaacuccucccacccccgcagcuggucaugaccuacagguugagaacugcuauccuagaggaaccaaauccaguuuuuagggcccaaccuucuucuauuaacuccaguuucaggguuccagugcccucuucuggccugugugggcaccagacaugcaaaguguuauacagacauguguaggcaaaacacccaaacacuuaaaauuaauaaaucuuuaagagaaauuaacacguaauaagacacagguuugaaaauuugaaagaaguauuuauauauaccaggcuaccaggcucuuuuuuccuucugagacccaggucuuucuguauagcccuggcuguccugggacucuguagaccagguugaccucaaacucacagagaucugucugccuaugccuccugagugccaagauuaaagguauacaccaccauaccuggcaaagucacaugauuuuuauuuguuaaauuuucuauuaaaauuuuuagguuuaauccuagaaggcuuagguagcuuuugcuuuucugauacucaucagcaucauacauauuuucaauuuagagagaaacccaagauguguaaauuucagcauaauuguuugagauaaagucuuagaauuauguacuuaaaguaaugucaugggauaaauguuauacccucaguguuuaaauguuauauccucuauaguaaaggauucauuucauuuuuucccccgcuccucauuucauauuuuugaaauucuaagguuuaaacccaaggcuuugcacauaugccagaggagagcucugcugcugaacuguaccccaacccacccaucaccaagcccuugacaaacgggauuguuuugcaguuagugucccagugucuagaagcgguagaaagcuugcuguaaccaucccuguuucuucugcauaauuagccuuuugaagaugcaugagguaaaaugauaauuaucuuaaguaugcugaauuagucauuuuuaaagcugugguuauuuuaucugcauggaaauuuauucauuaucuuucuaaaauauuacaaacaucuugauccugcagaggcauaguaacucagauuguuuccacuucugcuucuugguggaggacuguuuugagccuccugauaauuaauguuuggcuaauaagugucuuuagugcacuuacugcuaacuagcagcaucaccucagaugucuuuguuagcuucugguaugucaaaaggaagcuaagaauuauugaagaaauagauacauacacacuguaaugcuggaggcagaggcagagccuggccugcauaagcaaguuccaggacagcuggggcuauuacucaaagaaaccuugaaaaaccaaaaagagaggagagagggagaaagaauaugaucuauguagucucuaaaaagucaucaaaacuauccaguuuaguaauguagguuguagaagagucaggugcgauauaugccaguaugggguggggggagaguuaguaggucaaggccagccuuuacucccgugaaccaucucacugaugucuaugaucugacaaaggaaacugguacugaaagcacugaagaaagugagaaaguagggauuuaccuccuccucuaguggagcugacgagccagugcugcaaaugacugacauucuggucuccugccaccuuuguuuuuauaacugaaaucaguuucuaguaauugugccugaucuauguacaccuuaccuguuuaugccauugauguuuaacuuuauugaacagucaugugguagguguauguguucuugugggaaucaucucagaauuugaaaucugaaugaaauguuuggucaguagaguaauguauugcuuuggauagugacaauggaucagaguccaccuggaccucuuucuagaacuaaaauguguuagcugaucuaguccagaugugacuaggauuuguauuagagugaauaugaaguuucaucuucacccagauagaguaaauuauuaugauuaugacaagaucagcuguaggaacaguaacaugauuuccagcccuuuucucuuuugcguagaaaugcuuccuacaaugcaagaaagaaacguuauagggaaaacgauuugugugucuaaauuuccuuuuaagaaaaaugcccuauuugaguaacuaugauucucuucuaauuuaugaaaaaguauuugcaaccuuuagugcuuagcuguuaauaacaaguguguuuagucuuuuauagugaacuucauuaugguaaaaaccuguuuuuuagaauuuucuaaggguauaguaucucccccacccccauuuuuuaauuuaauuuuauuuauuuuuuauuuuuugacauaggguuucucuguguagcccugucuguccugaaacugauucuguagaccaggcuggccucgaucucagaaauccgagugccucugccucccaagugcugggauuaaaggcauuuaaaggcaugcaccaccacaugcccggcgcaugugugagcuacaucgcucucgagcgcucucucucucuccucccccucccuuccucccccccucucuuccccuuuuaaucccagcacuugggaggcagaggcagguggguuucugaguucaaggacagccugauguacagagugaguuccaggacagccagggcuacacagagaaacccugucuggaaaaaaaaaaaucaaucaaucaauacaaacaaaacaaaacaaaaacuaaucagcauaccuagggaggcuacauagaguuaaaacagcaguauacuccuaaagucugugguauagcuacaggucuuuacuucauaagcucccaccugcauccauccauuggacauucuucugcuggcaagaaauuccccaauagauuccagucugaaauccugaguuugucugccucuuuccagggucucaugucacuugaggucugugcguacaccuuggggcuggguuuccuggcacuucagaaugcugugauaaugaacagugcacacucuacucuuuauaaagacauugugugcuuuucccacaugaagacugugcaccaguaauuucaugcuaauggccacagcagggggaucagaaauuagaccuauuuaaggcuauuaguuuugggacagagcaguugaucaaagaauugaggaaauugguaaugacaucaauagcuguuuuuuuguucuuuaaagauuuauuucauuuauaugaguacacuuguagcugucuucagacacaccagaagagggcaucggaucccaauauagaugguugugagccaccauguaguugcugggaauugaacucaggaccucuggaagagcaagcagccagugcucuuaacugcugagccaucucuccagcccccaguaguugguuuuuaaaaacaaugcaaaguaagcuauuccccauccccaccccacccccuucucucucucucucucucucucucucucucucucucucucucucucacuuugagacaguaucucaugugugcuaccacacuagguuucuuuggugaggauugaaccaggggcauuguguguuagguagagucucugcuuggugagcuacaucucucagccugcucuucucuuaucuagcuuuuccaucuaucucucucuauauauacuuuuucauuuguauuuaucagcuaugguuaaagacaaugcuucacuuauucuguaccugcagcuucaugacauaaaaagaauauuaacuggucucauuuuggccuaauaacccuugacuucaagggugacccuuuuuccugcuuagcaguucuaagauugcuuaguguuuuuagaacagugaagcaucucuuucuagugcaaaccuguuuccuuucccagcaucacugccaacuguuacuugcuuuuuugagaaaaugaggaccagggcuguacucaguugaugguggucuuuauuaccagcagcuauguagucuaggcagaccuugaauuuugcuucuauuuccucaguguggagauuauagaugggaaccacuacgcugcuauuuauuuauuuaccugucuacuuauuuaguguuuguggguauguugccugguacucacagaagucaaaggagggcuuuauuucaccuggaacuggaguuauagacaacucugaguagccaugugggugcuuccaaccaaaucuugguccugugcaagagcaguaugugcccuuaauggcuaagucauuauucugacauacacacacucuggccccccacaccuucuuuuuaagaaauagugcuucauagagcgauugauugcuguguugccagggaugaacuucugcugcuccuagcuucaccucccaagccacugucauggcuaagguuacuguugcuggccaggcagugguggcgcacgccuuuaaucccagcacuugggagguaguggcagguggauuucugaggccagccuggucuacaaagugaguuccaggacagucagagcuauacaguuaaaacagaaucaaaacaaaacaaaaaagauguauuauuauggggcuggagagauggcucagggguuaagagcacugauugcucuuccgaagguccugaguucaauuuccggcaaccacaugguggcucacaaccauccguaaugagaucuggcgcccucuucuggagugccugaagacagcuacaguguacuuacauauaauaaauaaauaaaucuuuaaaaaaaaagauguauuauuauauguaaguucacuguagcugucuucagacacaccggaagagggcgucagaucucauuacggaugguugugagccaccaugugguuguaacuuuuauucuaaaguguuaaccauugcagugauugacagaacagagagagcuccuccugaugcaucaguaaagagcacuuugacccuuuacuucagcaaaggaagaagucuguuaauuaaggacauguggcuagaaccaaguccugccagucaaacucuauuagaaaaauccuucugggaugggcuagucuaucugaggccaggcuauguaaacuauacuaaaucucugagcucccuggguuucaccuggaaagucuaaaauaacuucagccuuggcaaugaauaugcuuucuauauauuuuccaauaggggagauaauauguaaagucagaauaaagaaugugguccucacugagcgugguggcccacacuuuuuuccgagacaagguuucuagcuguccuggaacuuuguagaccaggcggccuccaacucagaaaucuaccugccucugccucccgagugcugggacuaaaggcgugcgccaccaugcccgacuguggcccacacuuuuaaucucaucacucaggaggcagaagcaggcaggccuuugugaguuuaaugagaaccaagguucuuacacagaaaaacaaaccccuuacugucucaaagagagggggaaaaaagacaagaauguggucuuuuuagcugacuguuuuucuucauaauauuuucaagauucauccacauuguaucauguauuacuauuucauuacuguuaaugaugaauaauauuauuauauggcuauaucacauggauagcuuuuaauuguguauuaaagauuaauuuugagcuggcagugauggcaugcaccuguaaauccagcacuugaaagauaggagagccaggcuagguggugcaugcuucuaauuccacucuagagggaggcagaggcgggaagaucucugaugccagccugggcuacaagcagccaaggcuacauagaugaaaccugucuugaaaaacaaaacaaaaagggcagaaggaucaggaguucaaaguuauccuuagcuuuuuagaaauuuucaggcuaucuucaguuccauaagacucuuucucagacacacacacaaaaaacggagauuguuuuguuaauuaaaagcuaagggaaaaaaagauaaaaaguuuggcauauuagaaaguauggcauacuaaaguaaucauuagugucuuggggguaucugcuguucauuaaguuaguauuuucccuuuuuuauaaccuuaaaaaaaaaaagaugggcugggaaccuuuaauggaggcagagccugcagaucucugaauuccaggacagccaggacuacacagagaaacccuguccugaaaacccaagaugaggaggaggaagaggaagaggaguuguuguuaaaaaagauagguuucacuaugucuuuagguggcccagaacucacuguguagaccagguuugucccaaguacuagaaaaaaagcaccugccccuaacuccuggcuuuauuacauuuucuaaagguuaauagauacaaguuaauaauuucuuuuagucuuuuauuauuuuauauguggguguuuuccuuuaccacuugcaugcuugauaccuguagaggcccaagaaaggguauugggucccccagagcuggaguuguuauagaugguuacuaggagucaugugggugcuggcaauugaacccaggucaucuggaauagcagcuaaguguuuuuuuagcugcugagccaucucuccugugcugcuuuccgccccccccccccaacucuccucuccuucugccucaucucaugcaacaccacagauaaaccuuuauguuuucauacaaauguacuuucauaugucucauuacugagcgcuuacuuugaauucccaaucuagaagacucuagaagguguguacaaaacuaggcuaacuagcuggguguggugguacauaccuuuaaucccagcacucaggaggcagaagccagccuagucuaacccagcccagguuuucugauucuuuauuguuucacagguguguguguguuugauuuccguuuugcuaaauuuaauguuuucaggguccuucgagaaacagucauuacaaagccagcaguaaugguacauacuagcacuugagaauaaaggcagggagaccuaugucagccucuacuccauagugaauucuaggccagucuuggugaugagagaacacugaugauacauuauaaaggaguuagauauuuuaucaguguuacuucaaaacauguccuuccugugauuuugcuccuccuguguagcuauguauuauguucauuccaugcugacugcagcuagaaaauagacuuggaggaggaauagguauaugugcuaccuacagugaaagaacgugaaacuucaggaaugauucaagcccaaggaaagaugauucuugccuuccuuguguaggguaggucacaugggguauuuugggguuuuggaugguuuguuuguuuugagacagggucuacuguguagcucuggauguagaccagcuggccuuaaacucaaagagcuccaucugccucuaccuuccuggaguugggcuuaaaagcaucugcuacuuugcucagcuccaagaggaucccagugcuacauuuggaggcaacacccauuuaggagaauggugauuuagggccagaaacagauuuuggaacaaaagggaauacuugagaugaacaaguagggugcuucuuucugggaaaagaaaagguuuuugguaaagauauuucucugcacugagggaguuaggaauguucaaggcuaguuaguagauaagauaugugguucaaaaugugggagacuuagaagauccuaaaugcuagacauuuagcauugagaauacccagccauaggaacaggguaacuuuuguacuuguggggaaaauagggagcagaugaguguagguguuggugugcugugacuuucuuaaaacaacuuucaggagucuuuccuuccaucacugguacuagggguggagcucuggucagucauuaggcuugcaucucagcucuucuacucaaugagcaaugccguuggccuuuauaucugcucagaagaacuuaaggcaauagaaauagauaauuuauuaacaaaaaaggcauucccaagaacagaagugagcuaauaaacugaaaaaggacacauaauccaaagccuuguuuuuuauacaaagcagacggccacccuuguuuccauucccuguauguacuugaaaguuucuuuaugucugaugucuuaaccaccugcagcaagacaagacuauacuguuggucaaaaucaguggccuuaucuggccacuuguguguuguguauuuuaaaggcauguacacaucuuuauauuuuuuuguuuguuuugagacagucucacuauauguauccuuggccaaccaggaaguugcugcuuagaccaagacuggcuauauagagaucccccccauuucuaccucuuuugugugggggugggagggauugggaggcaguguuuaggaauugaccaguuuguccuucuaccaaguggguccugggcauugaacuugugucaucaugcuuggcagcaguaccacuuuccagaaaaugguaucagauuccuggaacugauaugagugcucagaauuaaacccaagguuuuugaaagaauagucaaugcuuggaccacugugccuucucuccagcccagcagcaaauagauuuuugcauuaagucaucgugcugccugauuuuuuuuuuuuugcgaugucucuguagcccuggcucuccuggauauucauucuauagaccaggcuggccuugaauuuagagagcuaccuguuaccucaggagggcuggggauuaaagguuuacaucaccacugcccagacuuuuuuuucaaauuuuauuuauuuauuuauuuauuuauuuugguuuuguaugguuuugaggucuagagauuaaacucauauguuugaaaaacgucaaauguucuaccacugagcuaucuaucacaucuccaguccuugaacauagacugcaguccagguuuaaaaucauacccagcuacgcuuugcaaaauuuauuuuugcuucuauuuuuuagaaacauacgccgggcagugguggcgcacgccuuuaaucccagcacuugggaggcagaggcagguggauuucugaguucgaggccagccuggucuacaaagugaguuccaggacagccagggcuauacagagaaacccugucucaaaaaacaaaaaacaaaaaaaaaaaaaaaaaaaaaaagaaacauacacacuauagcuucugcuggccaggaauggacgagguagcuccugcuggaaguuuaucccuucugccugggccuuccaaguacugagauaacaggcaugaaccaccaugucaggcuguaaacuuacucauuuuccagguuguucauugucaguuuauaaaaauacaauugcugucuuuugacagacuuucuaugcuggaaauuugaacucagauccuuuagccuaagcagcaagcccuuuacuaagccagccucuugaccgauuuauugguuuauuuugguuugguuuugguuuugguuuuugguuuuucgagacaggguuucucuguauaacccuggcuguccuggaacuuacucuauagaccaggcuggccucgaacucagaaagugcugggauuagaggcgugugccaccacgcccgacuuguuuuguuuuugagucucacuguguagcucuggcuagucuagaacuuacugugcacaucagacuggccucaaacucccguagaucugccuguuaccaugcucaaacgguaucccacauuauuacauuauuauucacucugaucauugugugugcuuuguuuuuguuuuuaaagauuuacuuauguaauguuauuaguacacuguagcugucuucagacacaccagcagagggcaucagaucucauuauagaugguugugagccaccaugugggugcugggaauugaacucaggaccucuggaagagcagucagugcucuuaaccgcugagccaucucuccagccccaauguguaccuccuuucuacccauauggcuacuaguaugugucauaaucugaggcuacuuauguauucuuaugcauuuuaaauaauaucuuuuguuuuauguuuaagugauggcugccaucaggaagaaacuggugauuguuggugauggagcuugugguaagacaugcuugcucauagucuucagcaaggaccaguucccagaggucuaugugcccacgguguuugaaaacuauguggcggauaucgagguggaugggaagcaggugaguacaagucccgcgagggagagucggugccauuguguguuggguacuguguacacagcgugaccaaaauguuagaaacagaaauccauuuucuuucuaccaccuuuuuugggggggauuuggacgaauugauugguugguacuuggauguugagacaacucaagcugguuuuuguuuuguuuuuguuuguuuguuuuuuguuuuuguuuuuugagagucaggguuucucuguacgguaguccuggcuguccuggaacucacucgguagaccaggcuggccuugaacucagaaaugcgccugccucugccucccaagugcugggacuaaaggcgugcaccaccacacccggcugauuuuuauaucauuguugaaccaaggcuggcuuugaacccaugauuuuucugggcuccaucuuguuuauuuuugaaucagggucuuauauauucaggauuuuccuuccaccacuuacuacauagauaauuacagguauauguaauagugcccagcuaguguaguggguuagacuagcugcucugcucuccagaguuucucauuauagagcacuuuuuugggcuaagaauacaaauaauguagggaauacaagcugggcauggugauucaugucugaaauccuacaguauaaauuccaggucagcuugaguuagagaguaagguuguccguuaaacucaacaaacaaguauguauguauauaggugaguaaacggcucucaggauauagcucaggauaguagugaccgccgcuauucagucuccagcaccacaugaaccagauguggugucacggguuucuaauccuaguaauggcagcaagagacaggaaaaccagacauuuaagguccuuuucagcuucucagcuacauaacaaguuugaggccagcccggagaacaugaggucuuauuacaguaaaguauaaagguauuccagacuagcauaagacauaguagcauacacacauaaucccagcacuuggcaggcagaguaaacccugccucggggaaagaaagaauauugguguagugauccagaccuguaguuagagcaacuuagaaacuuggagcagagagaucacaaguuaaaaugagcuugacaacuuggagaaaucucucagccuuagugcgcacgcgugcgcgcgcgcgcacacacacacacacacacacacacacacacacacacacacacucacacacagaggacugguuauguaccugaacacccuugggcuggggacauuggaaaccugcauauucuuugaaggugaccuaccuuugcagugucuugccacuucagucucaguauuugcauagaugcuuagauccaaguguuucuguggaccugauggggacugguuuuuacggaugucacauauaaaaccauagguggaaguuugcugaggucuuuuugaccuuugacuguugccaugauagccuucuugauugagauuugcauaucuauaacuauaauuuccuaaguuugggagucagcaguauuuccucuuugacauauuuucugagccuggauaucuuggauaaaccaggaucuugucuauaggaaauuuauugaugaaacugagaauguagcuuaguugguagaguuuuugccagagccugcaugaggcccuauauucucuucuagaauuucauaaaaacuagacacgggaagcacauaccuacagaguugccauuagcuacuccugaauuuggggacaaccuaauuuuccugcaaccaugucuagaaaagaaaaauagcaugcuuacuuaaaucuuugagcagggcaguaguggcgcacgccuuuaaucccagcacuugggaggcagaggcagguggguuucugaguucgaggucagccugaucuacagagugaguuccaggacagccagggcuacacagggaaacccugucucgaaaaaccaaaaucaaucaaucaaucaaucaaucagucagucaaucuuagaguaauaauccauaguuaucuuuccugugcuguuauucuugaacacagcuuaccaggaaagauaggagaguccuucauuuaagaagacaucucugaaauaagggaguuugaucugaaaaaggguauccauagguauugucuaccucagagcaauucaggagccaccgaaggagaaaaguuacuuagucuauuagucaaaguuugauuuucuuccuuggguggccuuuuguucucauaacauguuaaucuaauaaauacuuucauuauuuuuuugaaauuauuauauaguuaaccuuauuugcccuuccaacucuaucuaaaauagugguucucaaccuuccgaaugcugcaacccauuuucauugcuucuccauaccugcgauuuugcuucuguucaagaauugcaacauaaauauuugcugugcaggauauuugauauuugauaucugagaaaggaacuaacucguuugacugcucaaagccuuguacagguugaaaacuacugcucuaaaccucccaacaccccucucugcuuuucaaauucauggccucuuuuuuucaguguguguguguauguguauguuuccaaauauauaaguucaccgggcgcgguggcgcacgccuuuaaucccagcacucgggaggcagaggcaggugaauuucugaguucgaggccagccuggucuacagagugaguuccaggacagccagggcuacacagagaaacccugucucgaagcaaaaaaacaaauauauaaguucagccugcucagucuguggggcuucuacguauauuauauccaccugccucucuguucugccucccaaguaauuguugggaauuggcacuaguugguauacucuuuuauugggaaagacuguuuccccagcucucagcuguuugcccuuuaguucuuuguauaugcuuuuauaauaaacuauacugucuuauaaacuauagugucuuauaaacuauaaacauuuuuaauuguagcauuuugugcuguuuauaaauuugcuguuugauaaaaauuuuaaacaccuuguauuuggauuugauucucauaaaaaugaauagcuauuuuuacuauuugggaaagucugcacauguauaguaauauuaacauugugguuguuuuuccugucacagguagaguuggcuuuaugggacacagcuggacaggaagauuaugaccgccugcggccucucucuuauccagacaccgauguuauauugauguguuuuuccauugacagcccugauaguuuaggugaguagcccuacaggcugguuguuugucauuauucagauggaugacaucuaguauccuggauccuuucuggguaucaagugguucagauacauauauucugacacucagaaaaugagucaugccuggcugugcuggugcacaccuauaaucccagcccugggaggugaguucggggccagccuggacuacagagcaaguuccagggcagucaggcuacacaaagaaacccuguuuugaaaaauaaaaauagucuuuacaccaucuuuuugcacugucaccauggugacaucaagggcaucagcaaugcugagaagagaagagaggcaaacucuagguccugaucaggccauacuucagaguuauuguuugguuccuaacugugauaacaaaacaugguuacauuggugaauuagaggucauugaugauuacagaguuggggaaaucgaugugaaccucaaaggcagguugaauaaguaagugcagagcccuagauuugauauguaacucagagaccuagaaaaauggcagaaugguuacauuguacugacaaccuggcgucauggaccauggagaagcaagaugaaaacauaagugaggagaaauccuggguuuuuggguuugguuuuuuuguuuguuuguuugguuuuuugagacaggguuucccuguguagcccuggcuguccuagaacuuacucuguagaccaggcuggccucgaacucagaaucccugugcugggauuaaaggcaugcgccaccacaccccacuggguucuuuuuuccuaaagaucuaaaacuuaaaaagcccccuuagggggcuggagagauggcucagcagaaaagagcacugacugcucuuccaaggguccugaguucaaaucccagcaaccauauggugggucgcaaccaucuguaaugagaccuaacacucucuuuuggagugucugaagcuauuguguacuuagauguacuaaauaauaauuaaaaaaaaaaagccucccgggcuuugaaaauaaagaaaaacaaaaacugaaagggacaggagucaguggugcccagaguuucagagccugaguuuagaacaugggcuguggcuuccauuucauucuaggucucucuugacuuguauguguugggagugguugguuuguuuguuuauuguauaugagugcacuguagcugucuacagacacaccagaagagggcaucagauucuauuacagaugguugugagccaccaugugguugcugggaauugaaaagcucuccaacccaggaguguuaauuuuuuaaaauguucccauggugagggccagugagguggcucaauagguaaaggcgcucucaacgagccugaugcguaaauuuggucccucuugaaggaagaaacuguuuuaguggagccuacaguuaaagagacuuuuaauuguaaaaagacuuugaauuuuaagagauugaaauuuuaagaauauguaaagacugugggacuuuuaaaguuauuuagaucuuggggaugaauaagaauuugaucuuaugaguuguucucugcccuccacaggugagcuguagcaccugugugccaguccgugugcacagcaaugaacaaguaaagagugccucacacuuacagaauuaaaucuuagggcuuaaaacgugcucugccgucugggcagugauuuuagcacuugggaggcagaggcaggaggaucuuugaguuagaagccagccuguucuaaggacuaguuccaggacagccaaggcuacauuacauagagagacccugucuugaaaaacagaaauuaaguaaagguuagcuguaugggguugggccuaucuguaaucccagcauuugggaggcagaggcagaagaauuguuugaggccagucucaacuauacauuaauuuuugggcuagccagaacuacaugauaaaauccuuucucaaaagccgaugguggcgcaugccuuuaaucccagcacucgggaggcagaggcaggcggauuucuaaguuccauuacagauggaagaaaaaacguuuccuugcacauucuguuugucuuauuuuggcagccaagauuaaauauuagaaaacagaggaaaagauaugaaagacuuauucacuucacuaauaacuuugagaguaaccaaaagccuguuaaagucuaaaauuucacuuuaaauaagaaauuggcuugggagugggggcuugugccuuuaaucccagcacuugggaggcagagguaggaggauuucugaguucgaggacagccagggcuacacagagaaacccugucucaaaaaaaaaaaaaaacgaaaaaaagaagaaaaaaagaaaagaaaagaaauuguugagaaauagccccuguuacauccagauaauuacaccauaauaguuuaaauuuuaaagcuaauuuaaaaaucaagccauggaccuaagguggcagaggacuuaacuugccuagcuuacauugagaucccgagucagaagugaaagcaggaagaccagguagcucaggauugcccuugcccgugucguggucugaggcagucugggauccaugagacugcuucaagaaagaaucaucauugaacccagaucccuacucuaggcacagcucuaccacagagcuacaguuccgccuugaaacauuggaauccuuguacacaucucaaucccauugcuggcugaccuaugacaaucaauauugcuucguggaaccucugcugucucauuaauaguuggucuggaauauacauuguugagagugccuaggguuagaaaacuuguuauuuuaugaugcuaaaaauugaacuugggaccuuguaagcgccaaacaaguguuuuuccaagcauaucaacuccucucaagcauccauagaaagacuuaagagggcugaauagauggcucagcgguuaagagcgcugacugcucuucagaaggucgugaguucaaaucccagcaaccacaugauggcucacaaccauccauaaugagauccgaugcccucuucugggaugucugaagacagcuacaguguacuuacauguaauaaauaaauuuaaaaaaagaaagagagacagacagacagacagacagacugacuuaagagagccagguguuaguaacacaggacuggagcuagguguagacacuuuugaguucaggcuauccugaagugaggauuaagaccucacccccaaaagcacaccagggaacuguagugggcaugcuccugaucuuagccagcucuugggaagucaggaggagcugcaguuugagacaagccuagaccuugagacuguuucucuuuuacacaaagcaagagguuuuguaagcuuugggcaagagauuauccuguggaaccaagaacaagauaaagaauguaaccuuggggcgacuauaaccuuucuaccaccaaugacaggcauggccgguggugagcauucucucaguggaacagaaucuagagcucuucccacccuugagaaguucaacaauacuugaugggacagagagaggcuggugaccuucagugcuuguagaguggaaguuagauuuugccuucucuucucuucucucuuuaaaaacaaacaaacaaaaacccuggcuguccuagaacuuucucuguuaaccagacuggccuuaaacuuagagaucugccugcuucugccucccaagugcugagacuagaaguguacucuaccacuggcauugugcauuuuuuuugugauuuugaaaucaaugcacuuguuuucauuuuauagggccccaaauguuucuuuguuuuaaacagggugggugugggugugcgcacgcgugcgcacaugccacggugcacaugaaugucagaagacaccaagcaggagaccacucuuccucuaccacaugggucccagggcucaguccucaggcucagauucaagcaccuuuuaucugcugagcuguucugcuugucuccaaugugcuuuuugaaauaagaguggaaaaggaaaugccuuuaguucuucaaagugggauuaaaauguauccucaaauuuugugcauuuugucuuucagaaaacaucccagaaaaauggacuccagaagucaagcauuucuguccaaaugugcccaucauccugguugggaacaagaaggaccuucggaaugacgagcacacgagacgggaguuggccaaaaugaagcagguguguugugggggcaggaagagcgagaguuuacauacauacacauaagguuagacagccuuggcucuccugaaauaucaggugcucugauguuggggcuucuccuguaaaggagaaguuaaagucuuuaacauaaauucaaaaagaaauaaaaauuaaaaaaagaaagaaagaaauucagguuucccguacucaguguccaggacagacacuguuggcauucacagauuuaguccccuguaaagcuagguacaggcaggcaguccucuaccugaccuguugcucccuugucucuugcacugcacucaguaagcuauggacugggaguccaguucaguugcuugccuagcaccagggagggagggagggaggaugaauggauggguggauaauauauaucagcaccaucauagcaaaaaaggcugccucuggauuccuugcuuaaucuuccagaguuugucugaccucuucucucugcgugcaaaaggggcacaaguuuaauagacacaguaguucuaggguauucauuauaaguuugagaugcacuauucucaauugugggccaaguauggguugcuauaagucuuuuuuuuuuuuuuuucugguuuuuuaagacaggguuuuucuguguaguccuagcuguccuggaacucacuuuguagaccaggcuggccucgaacucagaaaugugccugccucugccucccgagugcugagauuaaaggcgugugccaccaccgccugguugguauaaagucucuuaaaccaggaguaguggcacuaucuguagucucagcugaugcucugcauaagagucauguugggacuggugaaauggcucagugguuaagagcacugacugcucuuccgaagguccugaguucaaaucccagcaaccacaugguggcucacaaccaucuguaaugagaucugacacccucuucuggugugucugaagacagcuacaguguacuuacauauaauaauaaauacauuaaaaacaaaaaaagaaccggaaaaaaaaagcaauguauuuaaaaaaaaaaaaagucaugcugacugugguagcaugugccuuuaaucccagcacucuugaguuccaggccagccugguuuauagaggaaguuccaggauagugagggcuacacagagaaacucuguuuagcaaaacaaaacagggcuggagaaauggcucagugguuaagagcacggucugcucuuccagagguccugaguucaaauccgggcaaucacaugguggcuuagagcauugguaaugggaucugaugccuucuuaugauuugucugaagauggcuacaguguauauguauaaauaaaauaaaucuuuuuuaaaaaagaaagaaaaagaaaacagaaaaggacaagaauuagcugaaaacacuuuuuucucuuuucuuguuuucuuuucucuucuuuuuuuuuuuuucuuuucuuuucaacuaggagccgguaaaaccugaagaaggcagagauauggcaaacaggauuggcgcuuuuggguacauggaguguucagcaaagaccaaagauggagugagagagguuuuugagauggccacgagagcugcucugcaagcuagacgugggaagaaaaagucugggugccucaucuugugaagccuugugaacgcagccucaugcgguuaauuugaagugcuguuuauuaaucuuaguguaugauuacuggccuuuucauuuaucuauaauuuaccuaagauuacaaaucagaagucaucuugcuaccaguauuuagaagccaaccacgauuauuaauaauguccaaccugucugaccagccaggguccuucugacacugcucuaacagcccucucugcacuccaccugacaccaggcgcuaauucaaagaauuucuuaacuucuugcuucuuucuagaaagagaaacaguugguaacuuuugugaauuaggcuguaacuacuuuauaacuaacauguccugccuacuuucugucaacugcaagaacucuggugagucacuacuucagagcuuuccuuguuaacagacuccauugccagagcucugggguggguauucaguuuuuugaaaucuugcucagccagaaaggcccaaguccacgcagcuguugcagaguuacaguucuguggucucauguuaguuaccuuauaguuacuguguaauuagugccacuuaauguauguuaccaaaaaauaaauauaucuaccccagacuagauguaguauuuuuuguauaauuggauuuccuaauacugauauuugucauucccacagaaaguguauugcuucuuuucuuuuucuuucuuucuuucuuuuuuucuuuuuuuuuuuuuuuuuuaagaaaguguauuuggaaauaaagucagauggaagaauucauuuuuaaaauucccauuuugucacuuucucugauaaaauauggccauaucccuuauucagcccuauauaucauucuaguaccccuuuccagacuggacuaaguaggaauuugguuucccgccugaggcaguuauacuuuggagguggcauagccuuucucaccuggacugcagggucuggcucuaagucacagugcuccuuucuccacacuguauccaaguugccucccagaggagccaccaguucuuauggguggcagugggugggggugggggggucucuucucuccagcugacuaaacauuuuucuguaccaguuaauuuuuccaacuaauagaauaaaggcaguuuucuaaauuuccuguauucucuuguguguugcuuucgccggaaagacuccccuggagaggcuucuugaauggcaccagcuccuccuacucccucccucuucuaga

SEQ ID NO: 5314 - RNA, 1444 nt, Mus musculus
caauucugauauucagcacuuuauucuuaguagugaaaccaccuuucauuagguggaaaggcaucgggaauggaugggaccagcgcccaucugaggggauuuuccuggaaaucagguguuucuccgugcaaauuuagaggaaacaccaucauggaagaaccgccccccagagugcagccaguaaucaccaagccaaugccagggccgccuuaggaguugccagacugcugggacagcaggguuucuaugucagguucgaugucgaugguacgaaagcggcggcuguaccugcgcacgggaacaccgucggggcccaccaggaacuucucaaaguuccaggcaaugucguugcggcacaccggagaccaaaugauguacuuggggucggucaugagcgcaguggggucgucacuggguguuggcaaggcauuccgcaggaagguaaagagcgggugagccuucucaccauucacuucgcacuucucaaacaauguaaaauugggcucgaacccgccaccaggucggacguacuugagggaauucagaaucucuucauucuugccauucuccuagggaagacaaaggcauuuauuuaugugcuaggauuucggaaagaaugugcuuuuuaacugcaaaacagagguuucccgaugagucaccaggaaguugcccuccuuguauaaccgaggauaggccugcauuccagcuguaguaccagaggagaaaguaagcggugucccgcccgugggagccuagagcccaaggccacccaucucgccccauauaccugguguccgaacugauugcacgggaaaccgagcaccaccaguccacgaggucccagacgcuucugcagaucguucaucucgguguagucccggaucguggugccucagagagacgcgacauucucaaugagcagcaccuugccccgcagggagcccaggcucacaggcuccccgcccgucagcgggcgcgcggagaaggcauacacgguggacugugccgccgcggagagccgagcagcacacauacuggagauguugggacucaaacguggaauccguacuagcgcucacagggcccugcaccuccuuuuaacuggauggugcugagaucacguggcaucgcuuucuuuccggcuggcagccagcucuaagucucagggucccgccuuauccggccucuacccuccccccaucgaggaacagggaagagggugcggccgggcuaaagcgccuggaggugccuagggcgggucuggucuagcuccuguagcacuagucuggaaggaagcugcuugcuuaggcggggaucuuccagcucugucuuacucaaccguuucuuaauuagucuagagucccgccuaggaagauggccucuggcaauaacaacggcuaaagcagcucacgcacagcucccuuauauuguguaacuuuaccca

SEQ ID NO: 5315 - RNA, 969 nt, Mus musculus
cucuuguuucuucuucuucgggaaaacaccaaaugguggaugacgccggugcagcgagagggcccggaggacccggggcccaggauuaggaggccgcgguggcuuccgcggaggauucggcagcggucuuaggggccguggucauggccgaggccguggucaaggccccggggcucguggagguaaagcugaagacaaggaguggauccccgucaccaagcugggccgccugguuaaggacaugaagaucaaguccuuggaggagaucuaccuguucuuccugccuauuaaggagucugagaucauugacuucuuccugggugcgucccuaaaggaugagguucugaaaaucaugccagugcagaagcagacucaggcuggccagcggaccagguucaaggcuuucgucacuauuggggacacaacggucacguuggucuugguguuaagugcuccaaggagguugccacugccauccgaggggccaucaucuuggccaagcuuuccauugucccuaugaggagaggcuacugggggaacaagauuggcaagccccacacuguuccaugcaaugugacaggcugcuguggcucugugcuggugcaucucaucccugcccccacaggcacuggcauugucucugcuccugugcccaagaagcuccugaugauggccgguauagaugacugcuacacuucagccagaggcugcgcugccacccugggcaacuuugcuaaggccaccuuugaugccaucuccaagacuuacagcuaccugacccccgaccucuggaaagagacugucuucaccaagucuccuuaucaggaauucacugaucaucuugugaaaacccacaccagagucucuguucagaggacccaggcuccagcuguggcuaccacauaaggguuuuuauacaagaaaaauaaaagaauuaagucugcuuaaaaaaaaaaaaaaugcagcucu

SEQ ID NO: 5316 - RNA, 10799 nt, Mus musculus
caaagucugguucuuaggaugaggguugucugcagcgggcagggguaugguaggggguggggugcuauccucaguuauaauccuauuuuagauccacuccguguuuuacuuccuucccuugcuuuccaacuuuacucaaagucgucagagucucucagauuguggaggagugacugcuagguccgacccuggacagauugagggccuggagggacaccagcccaguacccacacggucgggucagcaucagccccaagggagguggugggcuuucgucuguggacucuuuaucucucuuuaucucuauuuuacuuuucuucaggauggagugggccucaggagaaccagggaggggcaggcagggacagccuuugccaugggaacuucgcuugggccuacuucuaaguggugagggggccuggugaggccuaagguugugggaugugaugguagguccagggguggcaggcuguucccaggggcccaagggauggggcuagucaccaggaguccugcugagcugauugacccacuguccucagugcuggcugccacauuggcccaggccccguccuuggauguaccuggcuguucucgaggaagcugcuauccagccaccggugaccuguuggugggccgugcggacagacugacggccucauccacguguggcuugcauagcccucaacccuacuguauugucagucaccugcaggugcuucuggggccccagaggagagggcugggucaggguggggucggccccagcuaagguaccuauccuacacuccacccaauccaggacgaaaagaaguguuuccugugugacucccgacgucccuucucugcucgagacaacccaaauagucaucggauccagaauguagucaccagcuuugcgccacaacgccggacagccugguggcaaucggagaacggugagccccugaguaggucaucaggaugacuagggcuuguaaccaguaaccgcagaaccuugacccccuauuccugcugcagggguuccaauggucaccauccaacuggaccuggaagcugaguuucauuucacccaccucauuaugacguucaaggugccugcgcgucagcgaacccgccugauuuugcuuugcuucucaguacccccuaacagaguccuagcucuacaacgaagcuucccugagcuccuguguugugcucuaugugugaagcauggucacguccugcauggcuuccauaguugaacaccucugcacaugcucucuugugccccauuccuaggcuaagucagauacagucucucugggucucgugguauuuuaaccugccugucagagguggcuguccucccuggucugaucauggucuggcuuuccuagucuuucccaugugucugagaugcucagcagugaucaugacuaagcagagcucuccguaaccuaggcuggacugaaguccugguuccugcuagucagacauguccuccuuccccauccagacguuccggccugcugcuaugcugguggagcguucugcagacuuuggccgcaccuggcacguguaccgauauuuuuccuaugacugcggggcugacuucccgggaaucccacuggccccgccacgucgcugggaugauguagugugugagucccgcuacucagaaaucgagccgucuacggaaggcgagguaagggcugggacccagcuaguggggucugugauggacgugaagcgagguucauuaucuguggacuucuugcccugcuaggucaucuaucgugugcuggacccugcuauuccuaucccagaccccuacagcucacggauucagagugaguguucuacuauggagauuggcacagucucaguguccggauggggacuauuuggggccucaguaacuauuuuaggugcuuccuagggcaaaugccaagcccaguuuagcucugggagcaauagaaaagaggucucccaaggugaccuuggcagcugcaaccaaugguggcacugguggggacgaggcaacaaggggccaccugcuuaguuggacgagacccucuucccuuucuuagaccuguugaagaucaccaaccuacgagugaacuuaacccggcuucacacacugggagacaacuugcuugacccacggagggagauccgggaaaaauacuauuaugcucucuaugaacuugucauccguggcaacugcuucugcuauggccacgccucacagugugcgccugcaccaggggcgccggcccaugcugagggcaugguaagguacuucggaugacuggaacaggguugccggggagggacaggcauuucuagauggugcugucaaccuccccucguaucugcacagguacacggagccuguaucugcaagcacaauacucguggacucaacugugagcagugucaggauuucuaucaggaccuucccuggcacccugcagaggacggccauacucacgccugucggagugagugagacacagaacucuaaccgggcugugcucugggugagccaaaagcuaguuggucaagcccuaaauaccuaggcuuuugucugaaggguauccaggccuugauggcccucaacccaucugcucuggcuaccagucccaaaagguuuuggagccuugaagccuuaagcugccacccacaaauucuagccuaugguaccauaggcugaugauacuagccccacucgcggugucccuuacccuagggaccugguuucccaauuggucuuugccuucucuccagagugugagugcaacgggcauacucauagcugccacuuugacauggcugucuaccuggcaucuggaaauguaaguggaggcguaugcgaugggugucagcacaacacagcugggcgccauugugaguucugccggcccuucuucuaccgugaccccaccaaggacaugcgggacccagcugugugccgucguaaggcugggauugggcaugagggagggaaagcugagccugcgucaggaacuaggaagcuggauuauaguaccgguucccaggauugguguggucagggcuugggguagaaccagaacagggaaaggggaaggcucaggauggucacugcgauggggugacuuuauacucuccuuuuucucagcuugugacugugacccuauggguucucaagaugguggucgcugugauucucaugaugacccugugcuaggacuggucucaggccagugucgcugcaaagaacacgugguuggcacucgcugccagcaaugccgugauggcuucuuuggacuuagugccagugacccucgagggugccagcguaugugccuccugcccuaacuccugugucgaccuuuaaccccaggccucuuguucuugaugcaguugaaccugcuuuuacucccuaaaaugggcugcuuuucacuacagguugccaguguaauucacggggcacagugccugggagcuccccuugugacuccaguaguggaaccuguuucugcaagcgucuggugaccggacauggcugugaccgcugucugguacgacugagggaucugggguccugggauccuggguuuguucucaaagcacaugggcaaaguccaguggguggacacugagagccuagagucuaguccuggaagacaagcgucuggucuggcaggucaagggucuagaccaguggucugggggcuuugcauucaccagucagugguaaaugcuggacucccugguggguggcaaggaggucuguuccuggcuuccagcaauuccuuuuucccuagccuggccacuggggccugagccaugaccugcugggcugccgucccugugacugugaugugggcggugccuuggauccucagugaguauuguuacaggugcuugggagguggaugggaaggcgaagcauggguccuuugguaaccacagcauuccucaggugugaugaggccaccggucagugccgcugccgccaacacaugauugggcggcgcugcgaacaagugcagccuggcuacuuccggccuuuucuggaccauuuaaccugggaggcugaggcugcccaagggcaggugggagcacucauaugauguggguggugugguagagaggagggguuguggguggugucuuggggggucuagguugcuauucagucuugggggaggucuuggcacaggacaugguguuuggggcuggcuguggcagaagagacagugguucaccugacaccucaucucugcuuugacugcauugacucaggggcuugaggugguagagcggcuggugaccaaccgagagacuccguccuggacuggcccaggcuuugugcggcugcgagaaggucaggaaguggaguuccuggugaccucuuugccuagggccauggacuaugaccugcuacugcgcugggagccccagguuagacccugugguggcugaccugugcugacauucuggguguggaagcacccucuccacuguccucucuccccaggucccugagcaaugggcagagcuggaacugauggugcagcguccggggccugugucugcucacaguccgugcgggcaugugcugccuaaggaugaccgcauucaggggaugcuucacccaaacaccaggugaggcggcggcgcgguaaggauugcccacagaccuccugaaagacgacauugcgcugucgucuguuccuucuuucaagucccuccuccuggcugcuguucgucagguccauggcugugcucacaggaaagacauagauaacacauggccugcuuccucaaggguauaaguuucagaaggcaagacauuaauuggucuguuacuccgaaacagccuuaugauggugacaguugcaguggcguaagauauguaacuggacuaguuaagguuuuguuacauuuuagaaguaauuauuuccuguaucuuuuuccuuucuucucucuucucuucucuucucuucucuucuuuucuuuucuuucuucuucucuuucucucucucucucuuuucugagacaggguuucucuguauagcccuggcuguccuggaacucacuuuguagaccaggcuggccucgaacucagaaauccaccugccucugccucccgagugcugggauuaaaggcgugugccaccaccacccggcaaccugguaaauuuuaauaccaggagauguggguuugccagguucuguuuccagugaugcugcucuguauggaugauugauuccagaaagccaugcuuaugggacucuccuguugagguuguguuagggccucaacagguauauguuggccugcucuggcccagcugcgccucugccuuggucaacauguuugauugcugugaguggcgguguaaaaagcccaggaugaugagugcauggacccugaguggcauccuaucucucucucucccucuuccccaugcccagguuuuugguguuucccagaccugucugccuugagccuggcaucuccuacaagcugaagcugaaacugaucggaacagggggacgagcccagccugaaaccuccuacucuggauuacucauugacucggugaacaaaacccucuugcucauaucagccaugguggcagggccuucgggguggagauaauggcgguggugaugauugggaagggucugugacaaggaaaggcaggccccugucggugcuaaggcaguccucuggcagcacugaugugguccuaugugagauacauucuugcccaucucuucagcugguccugcagccccacgucuuggugcuagagauguuuagugggggcgaugcugcugcucuggagcgccguaccaccuuugaacgcuaccgcugccaugaggaaggucugaugcccagcaaggccccucuaucugagaccugugccccccuccucaucagcguguccgccuugaucuacaauggcgccuugcguaaguauucuugcgaugguuggguaggcagagguugggcccuaggcugaucugcaaucuguucuucuucucauagcaugucagugugacccucaaggcucacugaguucugaaugcaguccucacgguggccagugccggugcaaaccuggagugguuggacgccguugugaugucugugcuacuggcuacuauggcuuuggcccugcaggcugucaagguauuugucugucucucggccucccguaaucuuuucccauucccauuccgagucuccuucuuuccucugguuuugccucuucuauuccucugcucugacuuggaucccacacucucagauuggggucccuugccccuuucucccacuccccaaccuucccagccugacugccuccugucaacucaaucucuaccuugucccuagccugccaguguaguccugauggagcacucagugcccucugugaagggacuaguggacagugccccugccgaccuggugccuuuggucuucgcugugaccacugucaacguggccaguggggauucccuaauugccggccgugugucugcaaugggcgugcggaugagugugauacccacacaggcgcuugccugggcugccgugauuacacggggggcgagcacugugaaaggugagccuagagcagcuacggugguuggugguugggcuggcugcuugcagauaacacucauucauuucccuacaggugcauugcugguuuucauggggacccacggcugccauaugggggccagugccggccuugucccugcccugaaggcccugggagccagcgacacuuugcuacuucuugccaccgggauggauauucccagcaaauugugugccagugucgagaaggcuacacaggugagugggcaggacuggguaugagaucagggucagguagcuaagcuaaguaaucaugguuuccucuugacuggacagggcuucggugugaagcuugugcccccgggcacuuuggggacccaucaaagccagguggcaggugccaacugugugagugcaguggaaacauugaucccauggacccugaugccugugauccccacacggggcaaugcuugcguuguuuacacaacacagaggggccccacuguggcuauugcaagccuggcuuccaugggcaagcugcccgacagagcugucaccgugaguaggacugugggaagagaugguuggguggcuucugcugaagauagagccccuugauuguugugucugucuuggcuugcccaggcuguaccugcaaccuucugggcacagaucccaggcggugcccaucuaccgaccugugccauugugacccaagcacugggcagugcccaugccuuccccauguccaaggccucaacugugaccauugugcccccaacuuuuggaacuucaccaguggccguggcugccagccuugugcuugucacccaagccgggccagaggcccuaccugcaaugagguacgaaauccuggagauuuggguagagggagccagcaauuugccaugagagcucuaccuuucauagagacucugagccuuccucuguguguaccccaguucacagggcagugucacugucaugcuggcuuuggugggaggacuuguucugagugccaagagcucuacuggggagacccuggucugcagugccguggugagaaaucuggacugacaggguagauaaagacaaucucgucugcaucaccagggccuaauacugugcuuuggcuuuucuugcagccugugacugugauccuagaggaauagacaaaccucagugucaucguuccacaggccacuguagcugccgcccaggcgugucuggugugcgcugugaccagugugcucguggcuucucagggguuuuuccugcuugucaccccugccacgcuugcuuuggagacugggaucgugugguacaggaccuggcugcucggacgcggcgccuggagcagugggcucaggaguugcagcaaacaggagugcugggugccuuugagagcagcuuuuugaacaugcaggggaagcuaggcauggugcaggccauuaugagugcccgcaaugccucagccgccucuacggcgaagcuuguagaggccacagagggacuacgguacggauggggcuaaaauaaaaaauauggugggguggagcaaaggcccgagagaucuggacugaggcuucucuaaacauguccccccauugauacagucaugaaaucgggaagaccaccgagcgccugacucaguuagaagcagagcuaacagcugugcaggaugagaacuucaaugccaaccaugcacucaguggucuggagagagacgggcuugcgcuuaaucucacccugaggcagcuggaucagcaucuggagauccucaaacauucaaauuucuuaggugaguugcuggguaaccaggcggguaggccaggcggacguucagcugacugacccccuucgacccaacuuaggugccuaugacagcauccgacaugcccacagccaguccacagaggcagagcgccgugccaacgccuccaccuuugcaguacccagcccugugagcaacucagcagauacccggcgucggacggaagugcuaaugggugcccaaaaagaaaacuucaaccgccaacauuuggccaaccagcaggcacugggacggcucucugcacaugcccacacccugagccugacgggcauaaaugaguuggugaggugcaaguauggagagggacagguggguguggguguucuucccacaggaccuugauuuguuuugugccuggcagguguguggggcaccaggggacgcacccugugccaccagcccuugugggggugccggaugucgggaugaagaugggcagccccguugugguggccucgguugcaguggggcagcagccacggcagaucuagcgcugggccgggcucggcacacgcaggcagagcugcagcgggcacugguagaagguggcggcauccucagccgggugucugagacucgucggcaggcagaagaggcacagcagcgagcacaggcagcccuggacaaggcuaaugcuuccaggggccagguggaacaggccaaucaggagcuucgagaacuuauccagaaugugaaagacuuccucagccgugagccucccauguggcccaggccaugugcuugcuucccuugugucuguguguacuugagucucggugucugcaauggacauguguuuauaacccuaugucuggcccugagucccuguccagucaaugucccuaagucugugucccuuauauagucccuguuccuugguuacauccuuaugccuguuagcaaacuccuauugcaugugcagucugagaccccagaauaccaagauuguguucccaaggucaugcaggagagacuguuaagcccuugccugugucuccauagaggagggagccgauccugacaguauugaaaugguagcgacucgggugcuagacaucuccaucccggccucacccgagcagauccagcgccuagccagugagauugcagaacgcguccgaagccuggccgacguggacacaauccuggcccauaccaugggcgacgugcgucgggcugaacagcuacugcaagaugcgcaccgggcacggucugacccccaagccugguccccauuccugaaaccugguccugauaccuguagacccugaucuccccucuuccucaggagccgggccgagggugagagacagaaggcagagacaguccaagcggcacuggaggaggcucagagggcacaaggagcugcucagggugccaucuggggagcagugguugacacacaaaacacagagcagacccugcagcggguaugacuuccuuaggacgaggugaugggcauguacuaaggaucuggcuugcuuugucugggacagggaggucuuacuguguagcccugggcagccuggaaguuacagagaucaacuugcuucuccuucucaguugcugguacuaaagguggauuuguuaaaccugggccuuucuguggcagguccaggagaggauggcaggugcagagaagucucugaacucugccggugagcgggcucggcaauuagacgcccuccuggaggcccugaaacugaaacgggcaggaaauagccuggcagcaucuacagcggaagaaacagcaggcagugcccagagccgugccagggaggcugagaaaguggguugggcgaagcccucuggaugggguagggguauuauaguuagaauuccacugaauuaguauaccgacccugccucuuacaucugcagcaacuacgggaacaaguaggugaccaauaccaaacagugagggcguuggcagagcggaaggcugaagguguucuggcugcacaagccagggcagaacaacugcgggaugaggcucgggaccuguugcaggccgcucaggauaagcugcagcggcuacagggugaggaccauggugggcgggagcuagaaaggugggcuugcgugagaaaagacuugaacuauuucuugacccuucuagagcuggagggcacauaugaggagaacgagcgugcacuggagggcaaagcggcccagcuggaugggcuggaagccaggaugcgcagugugcuccaggccaucaacuugcagguccagaucuacaacaccugccagugaccacucccuagggccuagccuugucgccaagcacuguucugcacacgaucguccgcacauuaaagagcuccuggcuagcaagagcuuucaauaaaccugugugaaccuccucu

SEQ ID NO: 5317 - RNA, 11738 nt, Mus musculus
cagaggccgagcaccggaaccccuccucuuccuuucccgcccuccccaaagcugcccuucaccaagagcucccacucuugccggaagugcgucaucagcucggcaccccgccucccguagccguagcuagaagucgaaacaaaacaagcggcugaagcagcggcgaaggcggcgguggcggaggagccgggacgggggaggggcgcgccggaaccggaaccgacccgacgccggaaccggaaucgagagcguguugccagggcccgaagagggcugguggcggcggucucgcucggugaguggugugggccucaagucgccgguuuggccgcagcgggggaaggccgcaagguuggcccggggcgggccuguucaaggucacgggccgugccagccccgacaucucgagccucgcggcgugcucggccuaccgaugccgaccgagccguuaugcuaccccuguggccggccucucuguuuuuaagaggauuagcggcgagcgaggguggcuuccuggaggaggugguggcaggccugggauucggaggcuggaggagggcagcauccuagccggggcguuggucugcguucaguaacucugcgcagcuucucuaaccagcugggaucuccggauaguuucucugccgcuucgacggcuuucagagcaugggggagggauuccggcugugaaucgggccucgguguaaggaggaaacggcgggugcucugcccagaggccuggacggacugucacuaaagauuccgcucaucacucuuaucguccaaggguauuuuuaucaccccacucuccccuaagggaacacaggcuacaguucaaucuccuucgucucgcaagccgggcuugaggcugccagggcuaguacuaggucuacguuccaucuccacccucacuaguuuugagaacuucacuuuggauggagggagcccgaauccacacacaggugggaaacagaucaggccuccguggcucagagcugaugaugaaggaaggaaccuggagacaggggugaugucuguuucguuguuaagccuaucaccgugucuuaaaacuggaguccacuccucauuuuuuuuuuuuucgagacaggguuucucuguguagcccuggcuguccuggaacucacucuguagaccaggcuggccucgaacucagaaaauccgccugccucugccucccaagugcugggauuaaaggcgugcgccaccaccacccgccuccacuccuaaucuuuaaggcugaggagagagagaucgauccuucuuuagguggaaacaaaagaucaaguuucaggagcugguuuauggcaaaaaauaggagccggcaggaagcagacuagaugcuuuaguaccagagccuuucugguuaguggcagcaccuggggccguuuucagcuucagagucugcccuucugcugcucugacuauuccuuggucucccucucugcugccugacuccuucacucucuacuugucuggcggugacuaagcagccggcgagagugaaggaagcagagcaggcugcucagagugcagaccuguggguuggagccauggcucucauccagaggaugauccuggucccaggccacaacugccuugaccuagcacuuccucagugcagccuuccagcguuguggguuucuguagauacccaggaggcguggccugaagcacuugccacugcuugaauuauuuauuuccucacaggguagccucacagugcgcauggcugccucagcuggugagaauccugcccauuaggguucagagaggccugcguugcucagcccuuguaggcagggagcagaucacuuggccuuggcagugacucguggucuauuuucauuaggcucuugguucuuugcugaagaauuuggccacaaagaguugccaagauagcugggccgggaagaaagcgccgcagcccugacccagacgcuguugccgacucugggccacucuggcuggcuaccaagcggcucaagaugucugcaggggccagugcuacagggcccaggagggggccgccaggacuggaagaggccacuaguaagaagaaacagaaggaucgagcaaaccuggaaaguaaagauggagaugcuaggagagguaggaggggcuuuuccagagugccuacggcuucccuuaucacuggacaugcaaguauugggguggggguggggguccugucucuuccuccucuauccugguuugauggggagaaaaagauccauggcaggcuggguagaaccugggcuuuccaccugagagacguggcuaagauuaaugagaugggagugucuggggucuggcucacucauuccugucuguuccuuuuguugccagugucccuuccucgaaaggaaccaaccaaagauggugaguacugagugcuacgugagagaaaggagaauuuagcucccaucuggagcgguaggcuuggcucguguaccugucugucaccauuagcaccuuguugagaccccucugaucucuaccccucucucccuguagaauuguugcucgauuggaggcagagugcagaugaggugauuguuaagcugcgcgugggaacaggucccguacgucuggaggauguagaugcugcguucacagacacggacuguguggugaggcuuccaggugcguccguguaccccgagaacagggcuaccuuugagugcucugauacccccacuccagguuacuuuugccacucuuuuuacagauggucggcagugggguggugucuucuuugcugaaauacaaaguucuugcaccaaagugcaggcucgcaaggguggucuucuacagcuaguacuacccaagaaggugccucugcucacguggcccucucuccugguauguuccaguugcguguaugggaguuggggauacccaauguauucaacagggccuaauuguuaucucuuuggcagaagaaaccucugggaacccaagagcuggugccagguuugcagugccaggagaacgggcaagagcugucucccauugcccuggagccaggcucugagccccgcagagcuaaacaggaagcccgaaaccagaagcgggcccagggccguggugagguaggcucgggggcuggcccugggacacaggcagggcccagcgccaagagggcuguucaccuccgcagagggccagaaggggaaggguccauggauggccccggcccccagggugaugccccgucuuuccugucugacucagcuacccagguaagaguuaggugccuguuuuucuaucuggguauuuggagauaggggaaggaauguggaccagagaggguaccacuggccggaccagagcuaaucuugccucuguuuuuuuuuuuguguguguguguguguguguguguguguguguguagguugaggcugaggagaagcucugugcuccaccaaugaacacucaaacaagucucuugagcucagagaagaguuuagcccuucugacaguagagaagacagugucccccaggaaugacccagucgccccgguuaugguccaggacagagacccugagccugagcaagaagaccaagucaaagaggagauggcacuuggggcugauccuacagccuugguggaggguaacauggggacugggcaggcgggcccccagauuggguugcaggguuggugggugggcauggaguaguacaguaacaggcuagaauuugucuuggguugguggcacugagccauggucucaaccuagaaccagagucuauggugaaccuggcauuugucaagaacgacucguaugagaagggcccggauucggugguggugcacguguacgugaaggagauccgcagggacagcucccgagugcucuuccgagagcaggacuucacacugaucuuccagaccagguguguggcugaggcuggggcagguucagcagugugucucggauggggaugugcuucaggcguuucucuuuguccuuccucuuccucugcucugccucuucagggacggaaacuuucugaggcugcauccgggcugugggccccacaccaucuuccgauggcaggugaagcucagguggguggugcgcagccccgucacugcugcccucacuugggcucccaucucucgggcuuguucagcuucuccuguuucgccugaagucucugaacucagcuuuuccuugacagaaacuugauugaaccagagcaguguacguucuguuucacggccucucgaaucgauaucugccuccggaagcggcagagucagcgcugggggggacuggaggccccugcuacacgaggucugcacacgagcucccuucauugccugagccccacgugguuaggaccuccccgcgacuucacacaugcugcuaaccaccagcccucucauucccccuuuuuaaggugcaguggguggugcaaagguugccgugccgacaggcccaaccccuuuggauucaaccccuccaggagguggcccccacccccugacaggccaggaggaagccagggcuguggagaaggaaaaacccaaggcucgaucagaggacucagggcuggauggugugguggcccgcacccccuuggagcauguagccccaaagccagacccacacuuggccucgguaagaauccucagcugggggcuggugagauggcuuaguggguaagagcacccgauugcucuuccgaaggucuggaguucaaaucccagcaacuacaugguggcucacaaccaucuguaaaaagaucugacucccucuucuggagugucugaagacagcuauaguguacuuacauauaauaaauaaauuaaaaaaaaaaaaaaaaaaaagcucagcugggauggcacgaaugaggcugcagaacaucagggcuccucugucauggcucccuuccuuccgcagcccaaacccacguguauggugccuccaaugccgcacaguccaguuaguggggauaguguggaggaggacgaagaggaagagaagaaggugugccugccaggcuucacuggccuugucaacuuagggaacaccugcuucaugaauagcgucauucagucuuuguccaacacucgggaacuucgugacuucuuucacgguaggucagggccaggagacugggauauaggcagaggugguaccucugucucuuacaccacuacuugacuguuccuagaccgauccuuugaagcugagauuaacuacaauaacccauuggggacuggugggcgccucgccauuggcuuugcugugcugcuccgggcccuauggaaggguacucaccaagccuuucagcccuccaagcuaaaggugaguugugcucacccccccccccacacacacacaccuuguuuacagagggacaggagggcuagugaguguccugugagcggauaguuaagauuucucacuaacacuuuggccucuucaucuaggccauuguggcaagcaaggccagccaguucacaggcuaugcacagcaugaugcucaagaguucauggcuuucuuguuggaugggcuacaugaagaccucaaucgaauccaaaacaaacccuacacagagacuguggacucggacgggcggcccgaugaggucaguugggguugucgaguguugucuuguguguccuggcccuuaguucuccuuaguucucacugucuuccuucaggugguagccgaggaagcauggcagcggcacaagaugagaaaugauucauucauuguggaccuguuucagggccaguacaagucaaagcuggugugcccugugugugccaagguacgguggguuccccgagagagaugcccccuuguuaguugggcugguuuggccagacuacuuggaaacauuuguguuuucagggaauucugggcaaaauuugggggaggaauugggcagaaccuaaaggugccugugguuagaagaaaucaggcaagguaggcguccagacugaagucagaggcguuugugugcacaggugugguguugcgaggauaagugagguccaccaauguuguggguaagguuggaaaggcauguggagagcagaugaagggaaccuuggggaaaaggccaagccgccaggagaggggcaucgaucucuccugguggcuucuguuccucagucuagugcuuuaccacugaaguuugcugauuggcugagagcccugacagccuugacucgugugacccccugucaccucugcauccacaggucuccaucacuuuugacccguuccuuuaucugccgguacccuugccacaaaagcaaaagguucuccccauauuuuauuuugccagggagccccacagcaagcccaucaaggugaguaaccagcccccuucccuucucuccccuucugucuggccguccuaaggaaacaggacucuuccugugccccacgcugacuugaccuuucuugccaaaguuccuggugagugucagcaaggagaacuccagcgcgagugaaguguuggacucccucucucagaguguccacgugaagccugagaaccugcgccuagccgagguaccuguccuucccaggcuucugcauguguggccauguuugugagguuguaguuguuuguguuuuguucuuuuaaacauuuuuaugaguguugugucugcuugucugcauguauguguguguaguauguuaugugccaggugucagguuaaggguguugaaccgcauggaacuugaguuauagacaguuacaagcugccacguauuugcugagaauggaacccagaucuuuuggaagaauagucggugcuuguaauacugagccauuuuuccaguuccacuuauguauucuuuuuuuccuuuucuuuuuuucuuuuucuuuuuuucuuuuuuuuugagacagaguuucucugugcagcccuggcuguccuugacucacuuuguagaccaggcuggccuugaacucagaaauccgccugccucugccucccaagugcugcacuuauguauuuuuuucuucucuggauaaggcguuugcuaguaaucccagggguagaggcccuccguuccuuauggagggucagugagguugaugccugcucaggcuuugucucagguucucuaaagugcuuucugccccagggcaagcauauuccucuuuuaguccacauaucauguccugccccaucucaguagacuccagugcaggacuaagcccuccguggugccgugaagcagagcuggagaaaggucgcaccacaugccauauguguguccuuucuccccagguaauuaagaaccguuuccaccguguuuucuugcccucccacucacuggacgcugugucccccacggacgugcuccucugcuuugagcugcucuccccagaacuggcuaaggagcggguaguagugcuggaggugcagcaggugaguggggccagccugaugccacagggcccuggugggggcagucacugcugccugcccuugcugagccagaugacccacccuagcgcccccagguacccagcaucccuaucuccaagugcgcagccugccagcggaagcagcaaucagaagaagaaaagcugaagcgcuguacccguugcuaccgugugggcuacugcaaccagugaggagccccauggcucuccccuccuauuuucucuaccugccuuuugcuuuccuguccuucucaagcccuccacccacuucucuguuuuauugggccuugggggaggcagggcuggcauaccuaguccccaagggcaucagacaagucccugauaauauaguuacagcacucagggcuaaccuuuucuuucccuccagguucugccagaaaacccauuggccugaccacaaaggccucugccgcccugagaacauuggcuaccccuuccuggucagugugccugcuucacgccucacuuaugcccgucuugcucagcuacuagaagguuaugcccgguaagagcccagaggcuggacugguauacacagggagcagguguuccaagugugacaccagugggucagaguucuuacuugccuugcugucugcugccagguacucugugaguguauuccaaccgcccuuccagccuggccgcauggcuuuggaaucgcagagcccuggcuguaccacguugcuuucaaccagcucucuggaggcuggggacagugaaagagaacccauucagccuucugagcuccagcuggugaccccuguggcugaaggggauacaggggcucaccgaguauggccgccugcugauagggguccugugccuagcaccaguggacucucuucugagaugcuggccagugggccuaucgaagguugucccuugcuugcuggugagaggguaucucggccugaagguaggaucugcuaaaaugcuuuggguacugcacugaaguguugggaaggcuguucccaccagaguggacaggugagcacugaugagugugcuuugucuuagcugcugugccuggguaccaacacucaagugaaucugugaauacccacacgccccaguucuucaucuauaaaauugaugcaucaaaccgugagcagcggcuggaggacaaaggugccugaugcugugggugggagucauaggguagcuuguaccaccugcucugcgcagcuaugugaccauggucccugcuucucucuaggggagacaccauuggagcuaggugaugacuguagccuggcucugguguggcggaacaaugaacgccugcaggaguuuguguugguagccuccaaggagcuggaaugugcugaagauccaggcucugcuggugaggcugcccgugcuggccacuucacccuggaccagugccucaaccucuuuacacggccugaagugcuggcaccugaggaggccuggugaggauugggcagcaagcagguaguugaccaugguggagggaaacuugcugcuucugacuccuccucugucgcucacagguacugcccacagugcaaacagcaucgugaggccuccaaacagcugcuguuguggcgccuaccgaacgugcugauugugcagcucaagcgcuucuccuuucguaguuucauuuggcgagacaagaucaaugacuugguggaguuuccuguucggugagcaaugagugaggccugcugacuguggacagggcacagguaucggggcagccugggcucccgccaacuaacugccucacccuucucugacugggacuacaggaaccuggacuugagcaaguucuguaucggucagaaagaggagcagcugccuagcuaugaccuguaugcugucaucaaccacuacggaggcaugaucgguggccacuauacugcuugugcacggcugcccaaugaucgcaguagccagcgcagugacgugggugagggcacacacagccagcaggauaggugguaggguggugguccaggccguguucauacucuucccacccugcucuaggcuggcgcuuguuugaugacagcacggugacaacaguagacgaaagccaggucgugacgcgcuaugccuauguucucuucuaccgucgucggaacucuccuguggagagaccccccagggcaagucacucugaacaccacccagaccuaggcccugcagcugaggcugcugccagccaggugaggcauuggggaggccuaacagguuaguugggggacagaguuggggccuucaggucuacagaauuuauagacuggguucuucgacauucaggucucacccagagacauccuggaagauagccuagggacacagucaaagguguacauauauauaaacacgaugccaccagugugcacaaaagaauaggucaaagacuuacccugagcacaccaggcaccgugcuuuauacagacuuaacccuguuguccccuggcucucccucauagucuccauaugcuggccucgagcccaucguuuguggucacccuccuguucugauguguauuugagauauucccuaucagagauggcugcugccuggauuggcugucacacucucuguggugaacaaaugucccuacugaaacgucaggcucuucugugucauuugcugacacuguuccguagguccaugagcacagucacuuuguucucuggaacagcuaccuucuuucuguuauccauauucccuugagaccucccugugucaggcucagagacacaacacaguggucaggaucuggacuuugguaauccugaggagauugccauggguuggcuacguguccucugugagcuggucccuucugugggaugucuggacuaaagccugaccagguaaacgccacacccuugcccaugaaaaccuccauguggauugaaggcugucuacaggaggucaagacugucaccauucuuauacccuagugugcucagcuuagaaaucugcauccuagcuaccuaccaacuucccugcugcuugaucuggaacgugggggcuuacacccaguuaccuugaugggacugucuuggcuaggggucucagggaaacugggccuccccauccucugggugcugauggcccuuuccacauaccauaggcuucccggauuuggcaggagcucgaggccgaggaggagaugguaccugaggggccugggccucuggguccuugggggccccaagacuggguggggcccccgccacguggcccuaccacaccagacgaggguugccuccgauacuuuguccuggguaccguggcggcuuugguggcccuugugcucaacguauucuauccucugguaucucagagucgcuggagaugagcucaccugcaggcaccugcugugagcuggccuaccugucugcucaccaggucaugccuaccuuuguggugggaaacaacucugggcucugagccucaguguauguaucuggugggagacuuguggggacugcagucucugcaggggcagaguauccuaggguguguguccauccaguugucugucguccuguuucucugacccuuguccuagggcuuggcccugcuggaacuauuuccuguauuuaaaguguuaauaaaaugaguauucaggcccaaucuugucucucugucuaaaugccgcugcugucugcgccugccugggggcccuuccuugggugcaggggcucugagccagcacccgggaugccaggcaguaugcugggcagcccccaacccguccucguauucuguugcagggacuaggcccuggccaggcccccgagguggcccccacgcggacagccccugaacgcuucgcccccccuguggaccgcccagcccccacguacagcaacauggaggaggucgauuagcaggucccuggcugauggagggacuggguuugggagguccccuacagagggccaucucugacauuuuuuucuucugucacucagaggacacuggcucuaccaaugggaauuuggggggacaugauuugagggugggaaccucgcaaguugugaccucuuguuaacuugguccccagauuaguaggccuuggccuuuccagcugccuucagugcugcguguuugguucucaguuguaccuucaauucuuucugaccugcauuacaaacauuauaauuuuauucuaaaaauuguaauuuuuugcauuuuggaagugacugcugcuguuuaaauauauuuuaaaaauaaauaauaaauaagcugacuuagugacugauccacaac

SEQ ID NO: 5318 - RNA, 8250 nt, Mus musculus
cuuuugcucuccgacaagaggauagugucggguuccuugggcugaggggggagaggccacgccugagucuaccugcagcuuuguugcuaaacacuuucccuuuccacgcccauggcaauuuuuuuaaagucgcacggacccaacccugucaacugccuagaaccgggaaggcggaagcuaacugccuggaaaagccaguccgcucgcucucugacucauaaauggcguugacuaccuggcuggccccgccccuuucaccgaggaaggccaccauugguucucuucaaggcuucguacuccuauuggucaaugagcaaaggucgcuguucagaugaggcccaaaguuucuuuugguuuccggugugccugcuauggcuacuccagauucgcuagcgcuguucaccggccuuggccuuagcgagaacaaggcccgcgagacgcucaagaacgaggcucugagcacucagcugcgcgaggcggcgacccaggugcgagcccuguucccuggccuuagcugcuugcugugcuccagagcaacgugggacuggguccagaucuugauuugcuccggguguccugcucuugccuugugggaagaggaagacacuuuaaagugauucauccuaacucacugggaauggaucuuuuuucccccggcccccugacuccaggcacaccagauucuggguucuaccaucgacaaggcuacugggguccuccuauaugacuuggucucccgacucagggauacucggcgucguucuuuccuugugagcuauauagccaauaagaagauucacacgggacuccagcugagcggugagucccgucuguuuuacuaguccaccuucaaucucuucuuuagcaaagacucgaguuugcuuuuucugucaaguguugcuuuuuggacagcagguucuggacaggcacugaggcauggagguagagaccucugguguggauugcagaguuaccacaaugagaagccugcuucagaacacauggcuucucuuuucucuggucucagugcuucucuucaguggugccagggccuaaccucuuaggcaucuaaguaaccgaaauaguuaccucuucacuguacuaaggcccuaucuacccacuucuuggagcugacuugucuaguuaauugccccuccguuuucagcugcucuugaauauguucggagucauccccaggaucccauugauaccaaggacuucgagcaggaguguggcgucggugugguggugacaccggagcagauugaggaagcuguaaguccucuccuccaggcaucagauaucuccuccuaguucuucugccccugcaaaggagugguguagcuuuucuccacagacccacagugagaguggcuguuggucuccugacugcuucugaagagguguucaugaaccauauggcuuggcuuucugcagguggaguccaccauaaauaagcaucaguugcagcuccuagcggaacgguaccguuucaacauggggcugcuaaugggugaguuggaucuggggcagggaguuacuuggaagugcaucauucugauuguuccuuucauuuugggcauucaugggaagggcgaugggagugugagcagggacagggugcuaguguucugacaggguccugguccugagucagcugggccuucuuugaggaggggaagaaauccucccuuuuccuccuugcagcuucuuauguuuauccucuuaggagaggcucgggcugcgcucagaugggcagacggcaaaaugaucaagaacgagguggauaugcaggugggcaccucccuaagaagaugcuccggagauaaagggaacgagacccuguccuucuucugacagggaaaguggagcccaguguggagggaguagcgcuuaacuugggucucugagugagggugacccccuuucuugggaagcugcuuccuccucucacaugugcaugcuguggccuuuauugauaucuggcaaagaaucacaagaggacgaugacugagguacauuguuuaucgugaugcugggcccacguuauuuaucuguaaauggcagcacucguucucugggcccaggauaaguccucagaaaggaaaaagcauucaaggccaguagaaccaugugaagaagccagcugggcagaggcagguggaucucuaugaguacuaaucuggcccucauagugaguuccagaccagccgaggauauauaguaagaucccaugucaaacagcaaaacaugugaugagauacagcgggaugggguggauagguuggcuggcagaaaagccaggaagcccuugguugucggggaaggacuccaucaggagauucuugagagaguacacccuugucuguaucuaucugcucaggugcuucaccuuuuggggcccaagauggaagcugaucuggugaagaagcccaaggugaggcuaggaauugcccaagauaacugggagugcaguagaacgagagagacuuacagcuggagaagggaucgucugaacccauuucaucagcagaucuuuccuagaaagaaugaugugauuucuaugccuuucuuagguggcaaaggcacggcuggaagaaacagaccggaagacagcaaaagaugugguggagaaaggugagaagccgagguuccuguuacauucugcugcagacuucugggcauucuaucugaaggaccuuacauacagacuucucgggcccucccguauucucaugacugcgauuccugcuguugccuuugcauagagaccugagaaguuuggcucuguagcucuugucacugggaauuggagaugaggggucaccucagaucugguuuuaggauauucauggauauuuuccuagugggaaugauaguuucaucuagaaggcaagggccgggcggugguggcccacaccuuuagucccagcacuugggaggcagaggcagaggcagaggcagaggcagaggcagguggaucuuugguuuguagccagccuggucuacagagugaguuccaggauagccagggcuacacagaggaacaaauaauuuaagagauaauauuguuuuuauacuagguugucuuagucaugcauaugacagauaguuccacauugucaggccuucuuuguuaaaaauagcucauuaaaauauaacuuaugggcuggagagauggcucagcgguuaagagcacugacugcucuucuagagguccugaguucaaaucccagcaaccacaugguggcucacaaccauccauaaugagaucugcugaccucuucuggugugucuuaagucagcuacaguguacuuacauacaauagacaaauaaaucuuuuuuuuuaaaaagacaggaaaaaaaaaagaaaaaucaaaaagaaaaacaacaaagaugaggcaagguucuugauuucuucugcaggugaaguggcuggccagacccugucucugauggagcagcuccggggggaggcacuuaaguuucauaagccaggugaggggguaacucgaaauucuggggugugcuggugguuagcauuacagucacaccuguaagucaggauccuugccugacagcugcuccuggucaucagcucuauucugauccuggcaggugagaacuacaagacgccaggcuaugugaucacuccauauaccauggaucugcugaagcagcaccuggagaucacugggggacagguguguggggguguggccaggcagacacuugacugccuaggcugccucaucucaucuauuucaguaggugaucugagcuuuggucccauucccuuuaucccauuccuuuacuuagguacguacgcgguucccuccagagcccaauggaauccugcauauuggacacgccaaagccaucaauuucaacuuugguuaugccaagguaagcauuugucuagguccuggcaaguaauaugaucacugucuacucccaugacugcauuccagaaagguauauuucugucuugccuuuuguagcugaugacagaggcccuagagaaaaacuccauguaacagcuauugucaggaaauacuggguuaauggggaaaauuaaaaugguucuuuagauaggguuucacuguagaguccugauggccuugaauuguggcgaucacaugccucugcuucccagguacugggauuaaaggggugcaccgcuaugccccauggaagaugcauuucuucaauuccuuauauuaacuuuucaauuuauuuuuuggcagucaucaauagaagacauuaauuaaaaaaauauuccuagguggcugaaaagauggcucauugguuaagaccaguuguuggccuugcagagaacuugguucaguucccaucacccacaugguggcuuauucaguuuucggggauguuuucuucugaaaucaucuuuugcccucugagggcacugggcacacacauggugaaagcauaugcaugcaggcaaaacacucaaacacauaaaucuaaagggaaaaaaaugaugugugugugugcacgagcgcaagcacucaugcauacucaugcuauugaacauucauggaugucaaagacagacuuugguggaguugguucuuuucaucauagacuuugaggauccaacugaggucauucagcuugcuaggcaacuccucuuaucugcugaacuaucucauuggcugccuuuuacauuugauaagcuuggacuuugagaauguaaggcuaaugguauggacucuagggcugaugggugugguccuccaacucucuuaggccaacaaugguaucuguuuucugcgcuuugaugacaccaacccugagaaagaagaagcaaaauucuucacugcuauuuaugacauggugaccuggcuggguaugaugagcuugaggccugggcaggguuggugggaaguagaucucuuuuguaggccauggccgugcccguuaguguuuccuacuggcuuuucauacuauguucacaucacuccagguuauacaccuuacaaagugacauaugcuucugacuauuuugaccagcuguaugccugggccguggaacucauccauggguaagguuagguccauaauguugagcccggucagcugaccagguccugggccuccuguacauucauaucccuucuucacaggggucuugcuuaugugugucaccagagaguggaagagcucaaaggccauaacccuuuaccuucuccauggagggacaggccuaaggaagaaucauugcugcucuuugagguggggucccagagggcagcuugguuuggguaggccagugugcgaagcaugagacacacccguguuuagagauagccugagcucuuguucuccucaggcaaugcgcaagggcaaauuugcagaaggagaggccacacuucgaaugaaguuggugauggaagauggcaagauggaccccguggccuaucgagucaaguacacgccacaccaucgcacaggggacaaaugguacacauuggcaugaugaagggugaaguagcagggcuguggauugggcagagagacugguuggcuagucuaaugcuucuguuccacaggugcaucuaccccaccuaugacuacacacauugucugugugacuccauugagcacauuacccacucguuguguaccaaggaguuccaggcucggugaggaggcugaagucauguaguggguauagcuagggggauuccuuauguguuuaggguguauauacauaugaguggggcugugggugccacaguauguguugagaucagaguacaacuuguggaagucagcuuucuucuuccaccauauagguuccagggauccaacuugauuuuccagaguuggcauuaaguuucuuuacccacuggacccucucguuggccucuagugcuuuuucuguggucuuuuuaugaccccacagauggcuaacccuuuucuuccauccuagacggucuuccuacuuuugguuauguaacgcucugaaagucuauuguccuguucagugggaauauggucgccucaauuugcacuaugcuguugucucaaagcgcaagauucuccagcuuguagcagcuggugcuguucgguagguguggucauggggucugccagagguuguagcucuuguggcaugugcuguuuaagaucuucugaccacccucuuauccaaagggacugggacgauccacggcucuucacacucacugcccuacgacgacgggguuuuccaccagaggcuaucaacaacuucugugcucggguauaauucaguaggcuuagugggugaaagcaggcuggguguggcccuuuuacuugugguaugacugaugaguuuuccuaccagguuggggucacaguggcacagaccacaauggaaccucaucuucuggaagccugugugcgugaugugcugaaugaugcagccccacgugccauggcuguucuagagccacuacaaguugucaucaccaacuuuccugcucccaaggugggccuaccucugugugugugugugagcaugugugaaugccgaguaucugagauaacagcuaucugucuccugcuacagcccuuggacauccgagugccaaauuucccagcugaugagaccaaggguuuccaccagguuccuuuugcuuccacugucuucauugagagaagcgacuuuaaggagguaagugggguuuacugcuaggucuauuuuuaauagccucuccuuccugcuuuacaugagccaaucccuaacaaacaugagguugggagaagccuuguucuuggaugauguuugcagcuucuguaucuuccaugcuucuuuucuuuaggagucagaaccaggcuauaagcgccuagcuucgggccagccugugggccugagacacacugguuaugucauugaacugcagaauauugucaggguaagagacagcugcagucuuucuguacagugccugcuagggccaagauuguguguugcuaacagucuucauguuggucccuggucugauuccaucuuccucacuucuagggcuccaguggcuguguggaacgcuuggaggugaccuguagacgagcugaugcuggagagaagcccaaggccuuuauucacuggguaucacagccuuuggugugugagauucgccucuaugagugccugugagugaacauagcuggaauugagacugucacaggaugggaauugcaugcuguggcucuccagcaagggccugacuuucacucuggcuacagauuccagcacaagaaccccgaagacccuguugaagugccugguggauuccuaagugaccugaacccgguaggcucauagaaugugaggugaggguggugggcuucugagcuggacagccacuuggauucucugucugcaggcgucacuacaagugguagaaggagcauuaguggacugcucuguggcuuuggcaaagcccuuugacaaguuccaguuugagcgccuuggguacuucucuguggauccagacagccaucaaggacaggugcuuaauuugacccaccuauacccuucuguguacugaugguggaagcuguucacugugauaaacacucucccuacauccccuuagcauucuccaaauaaguugggagggacauucauuacuuuccaguuaaguccaagcacaaaauuuuauagggcucuaacuuuuuuuaagauuuauuuuauuuuauguuaguaugcugcugcugucuucagacacaccagaagagggcaucagaucccauuacagaugguugugagccaucauguugugaauugaacucagaaccucuggaagagcagucggugcucucaacugcugagccaccucuccagccccggcccuaacuuuuuuacucuucaaaguagcaggcaagcuuagaguuugucauaauccucaugaaacuaaggcacagcacaggcaucuaguccuuuaucugaaauuacagaguuauugacaaccuugguaccucaccuccaugauaccucaccuccuaggugaugaaggggaaguaagaagcccgguucgggguuguuggucauuuuucuucuacugccuuucagauugucuucaaccgaacugucacacuaaaagaagacccaggcaaaauaugaacugaauacauguggcccuaccucauccuggaggcugggggugcccuucagcacuccacacuccguuucaauaaagaauaacuaaaucccucuggcgucucucuguugucugccu

SEQ ID NO: 5319 - RNA, 8250 nt, Mus musculus
aggcagacaacagagagacgccagagggauuuaguuauucuuuauugaaacggaguguggagugcugaagggcacccccagccuccaggaugagguagggccacauguauucaguucauauuuugccugggucuucuuuuagugugacaguucgguugaagacaaucugaaaggcaguagaagaaaaaugaccaacaaccccgaaccgggcuucuuacuuccccuucaucaccuaggaggugagguaucauggaggugagguaccaagguugucaauaacucuguaauuucagauaaaggacuagaugccugugcugugccuuaguuucaugaggauuaugacaaacucuaagcuugccugcuacuuugaagaguaaaaaaguuagggccggggcuggagagguggcucagcaguugagagcaccgacugcucuuccagagguucugaguucaauucacaacaugauggcucacaaccaucuguaaugggaucugaugcccucuucuggugugucugaagacagcagcagcauacuaacauaaaauaaaauaaaucuuaaaaaaaguuagagcccuauaaaauuuugugcuuggacuuaacuggaaaguaaugaaugucccucccaacuuauuuggagaaugcuaaggggauguagggagaguguuuaucacagugaacagcuuccaccaucaguacacagaaggguauaggugggucaaauuaagcaccuguccuugauggcugucuggauccacagagaaguacccaaggcgcucaaacuggaacuugucaaagggcuuugccaaagccacagagcaguccacuaaugcuccuucuaccacuuguagugacgccugcagacagagaauccaaguggcuguccagcucagaagcccaccacccucaccucacauucuaugagccuaccggguucaggucacuuaggaauccaccaggcacuucaacagggucuucgggguucuugugcuggaaucuguagccagagugaaagucaggcccuugcuggagagccacagcaugcaauucccauccugugacagucucaauuccagcuauguucacucacaggcacucauagaggcgaaucucacacaccaaaggcugugauacccagugaauaaaggccuugggcuucucuccagcaucagcucgucuacaggucaccuccaagcguuccacacagccacuggagcccuagaagugaggaagauggaaucagaccagggaccaacaugaagacuguuagcaacacacaaucuuggcccuagcaggcacuguacagaaagacugcagcugucucuuacccugacaauauucugcaguucaaugacauaaccagugugucucaggcccacaggcuggcccgaagcuaggcgcuuauagccugguucugacuccuaaagaaaagaagcauggaagauacagaagcugcaaacaucauccaagaacaaggcuucucccaaccucauguuuguuagggauuggcucauguaaagcaggaaggagaggcuauuaaaaauagaccuagcaguaaaccccacuuaccuccuuaaagucgcuucucucaaugaagacaguggaagcaaaaggaaccugguggaaacccuuggucucaucagcugggaaauuuggcacucggauguccaagggcuguagcaggagacagauagcuguuaucucagauacucggcauucacacaugcucacacacacacacagagguaggcccaccuugggagcaggaaaguuggugaugacaacuuguaguggcucuagaacagccauggcacguggggcugcaucauucagcacaucacgcacacaggcuuccagaagaugagguuccauuguggucugugccacugugaccccaaccugguaggaaaacucaucagucauaccacaaguaaaagggccacacccagccugcuuucacccacuaagccuacugaauuauacccgagcacagaaguuguugauagccucugguggaaaaccccgucgucguagggcagugagugugaagagccguggaucgucccagucccuuuggauaagaggguggucagaagaucuuaaacagcacaugccacaagagcuacaaccucuggcagaccccaugaccacaccuaccgaacagcaccagcugcuacaagcuggagaaucuugcgcuuugagacaacagcauagugcaaauugaggcgaccauauucccacugaacaggacaauagacuuucagagcguuacauaaccaaaaguaggaagaccgucuaggauggaagaaaaggguuagccaucuguggggucauaaaaagaccacagaaaaagcacuagaggccaacgagaggguccaguggguaaagaaacuuaaugccaacucuggaaaaucaaguuggaucccuggaaccuauaugguggaagaagaaagcugacuuccacaaguuguacucugaucucaacacauacuguggcacccacagccccacucauauguauauacacccuaaacacauaaggaaucccccuagcuauacccacuacaugacuucagccuccucaccgagccuggaacuccuugguacacaacgaguggguaaugugcucaauggagucacacagacaauguguguagucauaggugggguagaugcaccuguggaacagaagcauuagacuagccaaccagucucucugcccaauccacagcccugcuacuucacccuucaucaugccaauguguaccauuuguccccugugcgaugguguggcguguacuugacucgauaggccacgggguccaucuugccaucuuccaucaccaacuucauucgaaguguggccucuccuucugcaaauuugcccuugcgcauugccugaggagaacaagagcucaggcuaucucuaaacacgggugugucucaugcuucgcacacuggccuacccaaaccaagcugcccucugggaccccaccucaaagagcagcaaugauucuuccuuaggccugucccuccauggagaagguaaaggguuauggccuuugagcucuuccacucucuggugacacacauaagcaagaccccugugaagaagggauaugaauguacaggaggcccaggaccuggucagcugaccgggcucaacauuauggaccuaaccuuacccauggaugaguuccacggcccaggcauacagcuggucaaaauagucagaagcauaugucacuuuguaagguguauaaccuggagugaugugaacauaguaugaaaagccaguaggaaacacuaacgggcacggccauggccuacaaaagagaucuacuucccaccaacccugcccaggccucaagcucaucauacccagccaggucaccaugucauaaauagcagugaagaauuuugcuucuucuuucucaggguuggugucaucaaagcgcagaaaacagauaccauuguuggccuaagagaguuggaggaccacacccaucagcccuagaguccauaccauuagccuuacauucucaaaguccaagcuuaucaaauguaaaaggcagccaaugagauaguucagcagauaagaggaguugccuagcaagcugaaugaccucaguuggauccucaaagucuaugaugaaaagaaccaacuccaccaaagucugucuuugacauccaugaauguucaauagcaugaguaugcaugagugcuugcgcucgugcacacacacacaucauuuuuuucccuuuagauuuauguguuugaguguuuugccugcaugcauaugcuuucaccaugugugugcccagugcccucagagggcaaaagaugauuucagaagaaaacauccccgaaaacugaauaagccaccaugugggugaugggaacugaaccaaguucucugcaaggccaacaacuggucuuaaccaaugagccaucuuuucagccaccuaggaauauuuuuuuaauuaaugucuucuauugaugacugccaaaaaauaaauugaaaaguuaauauaaggaauugaagaaaugcaucuuccauggggcauagcggugcaccccuuuaaucccaguaccugggaagcagaggcaugugaucgccacaauucaaggccaucaggacucuacagugaaacccuaucuaaagaaccauuuuaauuuuccccauuaacccaguauuuccugacaauagcuguuacauggaguuuuucucuagggccucugucaucagcuacaaaaggcaagacagaaauauaccuuucuggaaugcagucaugggaguagacagugaucauauuacuugccaggaccuagacaaaugcuuaccuuggcauaaccaaaguugaaauugauggcuuuggcguguccaauaugcaggauuccauugggcucuggagggaaccgcguacguaccuaaguaaaggaaugggauaaagggaaugggaccaaagcucagaucaccuacugaaauagaugagaugaggcagccuaggcagucaagugucugccuggccacacccccacacaccugucccccagugaucuccaggugcugcuucagcagauccaugguauauggagugaucacauagccuggcgucuuguaguucucaccugccaggaucagaauagagcugaugaccaggagcagcugucaggcaaggauccugacuuacaggugugacuguaaugcuaaccaccagcacaccccagaauuucgaguuacccccucaccuggcuuaugaaacuuaagugccuccccccggagcugcuccaucagagacagggucuggccagccacuucaccugcagaagaaaucaagaaccuugccucaucuuuguuguuuuucuuuuugauuuuucuuuuuuuuuuccugucuuuuuaaaaaaaaagauuuauuugucuauuguauguaaguacacuguagcugacuuaagacacaccagaagaggucagcagaucucauuauggaugguugugagccaccaugugguugcugggauuugaacucaggaccucuagaagagcagucagugcucuuaaccgcugagccaucucuccagcccauaaguuauauuuuaaugagcuauuuuuaacaaagaaggccugacaauguggaacuaucugucauaugcaugacuaagacaaccuaguauaaaaacaauauuaucucuuaaauuauuuguuccucuguguagcccuggcuauccuggaacucacucuguagaccaggcuggcuacaaaccaaagauccaccugccucugccucugccucugccucugccucugccucccaagugcugggacuaaaggugugggccaccaccgcccggcccuugccuucuagaugaaacuaucauucccacuaggaaaauauccaugaauauccuaaaaccagaucugaggugaccccucaucuccaauucccagugacaagagcuacagagccaaacuucucaggucucuaugcaaaggcaacagcaggaaucgcagucaugagaauacgggagggcccgagaagucuguauguaagguccuucagauagaaugcccagaagucugcagcagaauguaacaggaaccucggcuucucaccuuucuccaccacaucuuuugcugucuuccggucuguuucuuccagccgugccuuugccaccuaagaaaggcauagaaaucacaucauucuuucuaggaaagaucugcugaugaaauggguucagacgaucccuucuccagcuguaagucucucucguucuacugcacucccaguuaucuugggcaauuccuagccucaccuugggcuucuucaccagaucagcuuccaucuugggccccaaaaggugaagcaccugagcagauagauacagacaaggguguacucucucaagaaucuccugauggaguccuuccccgacaaccaagggcuuccuggcuuuucugccagccaaccuauccaccccaucccgcuguaucucaucacauguuuugcuguuugacaugggaucuuacuauauauccucggcuggucuggaacucacuaugagggccagauuaguacucauagagauccaccugccucugcccagcuggcuucuucacaugguucuacuggccuugaaugcuuuuuccuuucugaggacuuauccugggcccagagaacgagugcugccauuuacagauaaauaacgugggcccagcaucacgauaaacaauguaccucagucaucguccucuugugauucuuugccagauaucaauaaaggccacagcaugcacaugugagaggaggaagcagcuucccaagaaagggggucacccucacucagagacccaaguuaagcgcuacucccuccacacugggcuccacuuucccugucagaagaaggacagggucucguucccuuuaucuccggagcaucuucuuagggaggugcccaccugcauauccaccucguucuugaucauuuugccgucugcccaucugagcgcagcccgagccucuccuaagaggauaaacauaagaagcugcaaggaggaaaagggaggauuucuuccccuccucaaagaaggcccagcugacucaggaccaggacccugucagaacacuagcacccugucccugcucacacucccaucgcccuucccaugaaugcccaaaaugaaaggaacaaucagaaugaugcacuuccaaguaacucccugccccagauccaacucacccauuagcagccccauguugaaacgguaccguuccgcuaggagcugcaacugaugcuuauuuaugguggacuccaccugcagaaagccaagccauaugguucaugaacaccucuucagaagcagucaggagaccaacagccacucucacugugggucuguggagaaaagcuacaccacuccuuugcaggggcagaagaacuaggaggagauaucugaugccuggaggagaggacuuacagcuuccucaaucugcuccggugucaccaccacaccgacgccacacuccugcucgaaguccuugguaucaaugggauccuggggaugacuccgaacauauucaagagcagcugaaaacggaggggcaauuaacuagacaagucagcuccaagaaguggguagauagggccuuaguacagugaagagguaacuauuucgguuacuuagaugccuaagagguuaggcccuggcaccacugaagagaagcacugagaccagagaaaagagaagccauguguucugaagcaggcuucucauugugguaacucugcaauccacaccagaggucucuaccuccaugccucagugccuguccagaaccugcuguccaaaaagcaacacuugacagaaaaagcaaacucgagucuuugcuaaagaagagauugaagguggacuaguaaaacagacgggacucaccgcucagcuggagucccgugugaaucuucuuauuggcuauauagcucacaaggaaagaacgacgccgaguaucccugagucgggagaccaagucauauaggaggaccccaguagccuugucgaugguagaacccagaaucuggugugccuggagucagggggccgggggaaaaaagauccauucccagugaguuaggaugaaucacuuuaaagugucuuccucuucccacaaggcaagagcaggacacccggagcaaaucaagaucuggacccagucccacguugcucuggagcacagcaagcagcuaaggccagggaacagggcucgcaccugggucgccgccucgcgcagcugagugcucagagccucguucuugagcgucucgcgggccuuguucucgcuaaggccaaggccggugaacagcgcuagcgaaucuggaguagccauagcaggcacaccggaaaccaaaagaaacuuugggccucaucugaacagcgaccuuugcucauugaccaauaggaguacgaagccuugaagagaaccaaugguggccuuccucggugaaaggggcggggccagccagguagucaacgccauuuaugagucagagagcgagcggacuggcuuuuccaggcaguuagcuuccgccuucccgguucuaggcaguugacaggguuggguccgugcgacuuuaaaaaaauugccaugggcguggaaagggaaaguguuuagcaacaaagcugcagguagacucaggcguggccucuccccccucagcccaaggaacccgacacuauccucuugucggagagcaaaag

SEQ ID NO: 5320 - RNA, 2394 nt, Mus musculus
cagaugguuucuccuuaaaauggcuccaagucuggggacagcuagagccagcggaagggcacgccguggcagugcuggaguagcuguucgagugggacugacugggccaaaccggaccagacgugaaguagaccgcgccuggagcaccaccccgcccuugcgcgcucugcgcgcgcguaccgagagucucccucccccugucuugagcugagucuagggccuacuggcgcaugaguccuuggcgucccgcggcaugggcaucucugcgcaccgguucuguccuggccucagaggaacuuugucgcguucucuauccgcuggacuagacgggugggaugcuugacacaaauggggcuuggcugugggguucuuugcagggccgguugcaaugggcuuggggggaggcuguccugccgcugcuaugugggccaguuuggccccuggcacuucaugagcuggcaccgucaccagacaaaagguccuaagcuuuggggagucccagaaguggacacauggguuuacuuccucucgggucucacggaaucgcuucccucuugacggauuccgaagccugcccgguacaaguggcuccugcuugggacucacagggcuaauccagcccuucugaucuaauccggaucaggaccucgucccgggggaugcccccaccuucuauuguucuggggcccaggugagcgucucauucucacuagacugguuuaaaacaccuacuccuuccuacucagcccacugggaagggaugggcggguuccgguuuggccucagggcgagugaccugggagcaagagcccuccuccaauggcuggacagcgggcaacggaaucccaaaagcagcuguugucuccagagcauuccagcugcacuuggauuucguucccugcucuccugccugagcagcgcccuggcccagauaauguggucucuauucucagaaacacuacacuacugggccauucugaucuccaucucucaggugcacccccagacugaugguggcagucagaggcgacgaaaaaagcucgggcugauggcccugucuggaaucccuggagaacucugaccagggagguccuggguccucucucugaagggccgcaauggcggugagucccacaaggccgcccagcccgcagcucgcuaaagauagaucuucacuuccuggggaaaacccaccccaaccgucuucauggagggagaguagcuaaaaucaccaacuugcuggugggucccagcccugcuagcagcugaacccacaccacagcauggaaagugcuuuggaaugacacgaucacucccguugagugggcacccaagaagccaucgggaaugucguguccgcccagugcucuuucggcaccucccaaacagggccucauagccccggccuucccgaacuuuuccuaucucuagaugucacuccucuccggagcaaaguucaccgguuggauucauucauuacugggggaaguggaguuucacguuacuuggaaacgaaagaguuuggacauagaaaagcucaccugcagcuugcucuaccugagagcucugcuuauuugggucuucucaucaucacauuugucuuaaacugaccaguugccuaaagaaccaaaggugccgguaacaccaguuuaaaggaaaaacauuaaaggcugguaauccuggaaucaugaugacuaauuccucggguaucaagaugggcaauucuauccgauugggcuuuuacugggaauaaagacauuccauaccgcagccgaggaaaggcguaccaauaaucagaacucaaauuuugcuuuguuucguuacuuuuccaaguaggcgguaaagagucuuuaauggaagacacgagugguggcacacaccuuuaaucccaguacucaggaggcagaggcagguggauuucugaguucaaggacuuucuggucuacaaagaguuccaggacagccauggcuacacagugaaacccugucuugaaaaacaaagugucauuaaugguacagccuuauuccuuugacauuucgucucgugcgucuggccuuuaauuuguuuaaauggggcagaaaaagaaaaaagagacauaaacacaaagaugugaaacuuugguggcaaagugucuugccugguaacaaagauccguuaucaaaguaauaauucggggugacgauuuuuuuaaaaaggaggaaaaauggacccucaaauuuggagguuagggcucaugaauacaggaaaggccaucgggagggagagcuggaggcguggguagaauguaagcucacuuggcaugcucgaucgcucugguccauucaggagaguccacggccggauccccgcccccgccaggcggaccucccggaagcucuacggauaacuuacuu

SEQ ID NO: 5321 - RNA, 2394 nt, Mus musculus
aaguaaguuauccguagagcuuccgggagguccgccuggcgggggcggggauccggccguggacucuccugaauggaccagagcgaucgagcaugccaagugagcuuacauucuacccacgccuccagcucucccucccgauggccuuuccuguauucaugagcccuaaccuccaaauuugaggguccauuuuuccuccuuuuuaaaaaaaucgucaccccgaauuauuacuuugauaacggaucuuuguuaccaggcaagacacuuugccaccaaaguuucacaucuuuguguuuaugucucuuuuuucuuuuucugccccauuuaaacaaauuaaaggccagacgcacgagacgaaaugucaaaggaauaaggcuguaccauuaaugacacuuuguuuuucaagacaggguuucacuguguagccauggcuguccuggaacucuuuguagaccagaaaguccuugaacucagaaauccaccugccucugccuccugaguacugggauuaaaggugugugccaccacucgugucuuccauuaaagacucuuuaccgccuacuuggaaaaguaacgaaacaaagcaaaauuugaguucugauuauugguacgccuuuccucggcugcgguauggaaugucuuuauucccaguaaaagcccaaucggauagaauugcccaucuugauacccgaggaauuagucaucaugauuccaggauuaccagccuuuaauguuuuuccuuuaaacugguguuaccggcaccuuugguucuuuaggcaacuggucaguuuaagacaaaugugaugaugagaagacccaaauaagcagagcucucagguagagcaagcugcaggugagcuuuucuauguccaaacucuuucguuuccaaguaacgugaaacuccacuucccccaguaaugaaugaauccaaccggugaacuuugcuccggagaggagugacaucuagagauaggaaaaguucgggaaggccggggcuaugaggcccuguuugggaggugccgaaagagcacugggcggacacgacauucccgauggcuucuugggugcccacucaacgggagugaucgugucauuccaaagcacuuuccaugcugugguguggguucagcugcuagcagggcugggacccaccagcaaguuggugauuuuagcuacucucccuccaugaagacgguugggguggguuuuccccaggaagugaagaucuaucuuuagcgagcugcgggcugggcggccuugugggacucaccgccauugcggcccuucagagagaggacccaggaccucccuggucagaguucuccagggauuccagacagggccaucagcccgagcuuuuuucgucgccucugacugccaccaucagucugggggugcaccugagagauggagaucagaauggcccaguaguguaguguuucugagaauagagaccacauuaucugggccagggcgcugcucaggcaggagagcagggaacgaaauccaagugcagcuggaaugcucuggagacaacagcugcuuuugggauuccguugcccgcuguccagccauuggaggagggcucuugcucccaggucacucgcccugaggccaaaccggaacccgcccaucccuucccagugggcugaguaggaaggaguagguguuuuaaaccagucuagugagaaugagacgcucaccugggccccagaacaauagaaggugggggcaucccccgggacgagguccugauccggauuagaucagaagggcuggauuagcccugugagucccaagcaggagccacuuguaccgggcaggcuucggaauccgucaagagggaagcgauuccgugagacccgagaggaaguaaacccauguguccacuucugggacuccccaaagcuuaggaccuuuugucuggugacggugccagcucaugaagugccaggggccaaacuggcccacauagcagcggcaggacagccuccccccaagcccauugcaaccggcccugcaaagaaccccacagccaagccccauuugugucaagcaucccacccgucuaguccagcggauagagaacgcgacaaaguuccucugaggccaggacagaaccggugcgcagagaugcccaugccgcgggacgccaaggacucaugcgccaguaggcccuagacucagcucaagacagggggagggagacucucgguacgcgcgcgcagagcgcgcaagggcgggguggugcuccaggcgcggucuacuucacgucugguccgguuuggcccagucagucccacucgaacagcuacuccagcacugccacggcgugcccuuccgcuggcucuagcuguccccagacuuggagccauuuuaaggagaaaccaucug

SEQ ID NO: 5322 - RNA, 2891 nt, Mus musculus
cuguuccauuuagucuuccggucgccauggcgaccgggcgccuugggguuggcgagacgcuggaggcccuuaaugcagcuguagggccugguagcccagugugguuuaaggaaacccaugcccggcaccuucguguucgagacuucuuggcaccgcgaagcgcgcuacaggcgcgcuucagggacggccaggugggugcgcuccuguggggcaugccuagcgggauccacggaacuacggcccacuuacacacaucugccugcaggugccagagugcguguuccgugcggucuccugccugcagggucccggaguggccccuguacugcgcugcgcgccgacacccgcggguuuaucgcuccaacuacagcggcccgcugucuucgaacauguacucggugcccuggccuccuaugcuacucccgccaaaccugccucaccaggcccgcgaguuguccuacacugcccagcacugcgcuguaauucggggacgcuccgauugagccagcugcgugccgugcucguagccgaucaucuaguacggguacugcgugcucauggguaagugcguguucgaagcuauaauggcaaaagaccgaacauuuggggauagaaaaggugggagucaugauaaucuaagccugguccgcaggcugagacagccucccuugcuuugcaggguacgugugugcucagugcccccggugcgggacccucacaugucaacuuuccuccagaaacuucggguggaauggcccacugccucgaagagcaccucgaccgaaacacugagaaccuguguucuugcaaaccuuaaugguucuaaggaagcgacgcugcccccuggcguccuaggccgacugugucugaaggaacugguagaacagagaggcacugcuggcuaugaccccagcauagaccacuguuuggguaggacaaacggcagaacaugggugggguugugucucugcacugccaggcacuucaacaccucuuguuuucuguagugacugaagaugugcucucugugcucucggagcugcaggaggcugugcgccacuggccagagggcggccacccaggcccggugaguggcugccuugaccucugcccaaacuggauuuuuguaucuuuguaguaacugccccaucucuccucaggcugggcguccagaugcugguguagaugacugcgugguuauacacgugguuagcugugaagaggcauuccagcaacaaaagcuggauuugcucuggcagaaauuggaugaccgggcuccucacaagcagguugguuaccaaaguuaaccaaaccaccuccgaccucaggccuggaauaccaugggguuuagagacugaugugaccauaggcacccgugcuacaagugcaaauguccugugacuauguagucuuaagaaaaaggaugauggugucuugaggagguacgaaggaaggcuggugguuacagauugggaaaaccaagguagaaaagcaacugauauaguucccugaagcggggaggguagugccaacugggcugagcccuuccagucuuucacagaaacaccugguguguggucccgugaaaauggcugguguacccggcacccagcugacugccccucaguacuacaggugaguaugaaagggaugccauccacagccaccaacagcguaaagguagggacagcuuucacugagaccuugcuuacuggcucgcuuuucuaggcucagacaugcucaggugugcgaggccucagcucugaagcacggaggagaccuggcacaagguacaccugggagauccugcgugugcgcugagguggaagcaggucacgcacaccucuggccugugugcuucgucuucagacacugaccagccucucucgcaccccagaccccgccuggacugagaccuucgacauccucuccguggcuaccaucaaauuugagaugcuaagcacagccccacagagccagguaagccucccgacaccaggacggaggaugcagguacagagccaaggcccucugcagcuauguuaccauuccccagcuccuccuggcccacagcaccaucucaacaaagggcacaaagagcgggacuuuugucauguauaacugugcccgccuugccacacucuucgagggcuacaaacauggaacggagcaaggucuguaucccacuuuuccgcuugugagcagucuggacuucucacuacuccaugaugaggugaguguugguccugauaaacguccacaaggcuuggacuugucuuccuagcacgcuugucucccgcagggugaguggcugcugcuuuucaacaguguccuucccuuucuggaccugcugagccagacugugagucuggccggcaccccaggccuccacaucccuguccgcacggagaugguaaggcacagaagacauuucacacauuauucuuuauucuggguuguaacacaagaaaaaagacaacagcucaacgacucaacgucugucucuagguaugcaaguuccuggugcagcucagcauggauuucagcuccuacuauaaccgaguacauauucuaggggugagcauacagcaaggggggucugcgggaaaugugggcaaggcugagcacacgggaaaugaggaugcgccuggcugcuuuucuuucaggaaccucggccacaccucuuuggucagauguuugcucgccuacagcuuuugagggcagugcgugagguguuccacacaggcuuggcuaugcugggccucccuccgcugagccacaucuaagggcccaauaacugggaauguuuauaaaagcaucaacugggaaagaaacaagaccucacagauguugggcacuuaaagucagaauaaauacaguuucauccuauu

SEQ ID NO: 5323 - RNA, 2891 nt, Mus musculus
aauaggaugaaacuguauuuauucugacuuuaagugcccaacaucugugaggucuuguuucuuucccaguugaugcuuuuauaaacauucccaguuauugggcccuuagauguggcucagcggagggaggcccagcauagccaagccuguguggaacaccucacgcacugcccucaaaagcuguaggcgagcaaacaucugaccaaagagguguggccgagguuccugaaagaaaagcagccaggcgcauccucauuucccgugugcucagccuugcccacauuucccgcagaccccccuugcuguaugcucaccccuagaauauguacucgguuauaguaggagcugaaauccaugcugagcugcaccaggaacuugcauaccuagagacagacguugagucguugagcuguugucuuuuuucuuguguuacaacccagaauaaagaauaaugugugaaaugucuucugugccuuaccaucuccgugcggacagggauguggaggccuggggugccggccagacucacagucuggcucagcagguccagaaagggaaggacacuguugaaaagcagcagccacucacccugcgggagacaagcgugcuaggaagacaaguccaagccuuguggacguuuaucaggaccaacacucaccucaucauggaguagugagaaguccagacugcucacaagcggaaaagugggauacagaccuugcuccguuccauguuuguagcccucgaagaguguggcaaggcgggcacaguuauacaugacaaaagucccgcucuuugugcccuuuguugagauggugcugugggccaggaggagcuggggaaugguaacauagcugcagagggccuuggcucuguaccugcauccuccguccuggugucgggaggcuuaccuggcucuguggggcugugcuuagcaucucaaauuugaugguagccacggagaggaugucgaaggucucaguccaggcggggucuggggugcgagagaggcuggucagugucugaagacgaagcacacaggccagaggugugcgugaccugcuuccaccucagcgcacacgcaggaucucccagguguaccuugugccaggucuccuccgugcuucagagcugaggccucgcacaccugagcaugucugagccuagaaaagcgagccaguaagcaaggucucagugaaagcugucccuaccuuuacgcuguugguggcuguggauggcaucccuuucauacucaccuguaguacugaggggcagucagcugggugccggguacaccagccauuuucacgggaccacacaccagguguuucugugaaagacuggaagggcucagcccaguuggcacuacccuccccgcuucagggaacuauaucaguugcuuuucuaccuugguuuucccaaucuguaaccaccagccuuccuucguaccuccucaagacaccaucauccuuuuucuuaagacuacauagucacaggacauuugcacuuguagcacgggugccuauggucacaucagucucuaaaccccaugguauuccaggccugaggucggaggugguuugguuaacuuugguaaccaaccugcuugugaggagcccggucauccaauuucugccagagcaaauccagcuuuuguugcuggaaugccucuucacagcuaaccacguguauaaccacgcagucaucuacaccagcaucuggacgcccagccugaggagagauggggcaguuacuacaaagauacaaaaauccaguuugggcagaggucaaggcagccacucaccgggccuggguggccgcccucuggccaguggcgcacagccuccugcagcuccgagagcacagagagcacaucuucagucacuacagaaaacaagagguguugaagugccuggcagugcagagacacaaccccacccauguucugccguuuguccuacccaaacaguggucuaugcuggggucauagccagcagugccucucuguucuaccaguuccuucagacacagucggccuaggacgccagggggcagcgucgcuuccuuagaaccauuaagguuugcaagaacacagguucucaguguuucggucgaggugcucuucgaggcagugggccauuccacccgaaguuucuggaggaaaguugacaugugagggucccgcaccgggggcacugagcacacacguacccugcaaagcaagggaggcugucucagccugcggaccaggcuuagauuaucaugacucccaccuuuucuauccccaaauguucggucuuuugccauuauagcuucgaacacgcacuuacccaugagcacgcaguacccguacuagaugaucggcuacgagcacggcacgcagcuggcucaaucggagcguccccgaauuacagcgcagugcugggcaguguaggacaacucgcgggccuggugaggcagguuuggcgggaguagcauaggaggccagggcaccgaguacauguucgaagacagcgggccgcuguaguuggagcgauaaacccgcgggugucggcgcgcagcgcaguacaggggccacuccgggacccugcaggcaggagaccgcacggaacacgcacucuggcaccugcaggcagauguguguaagugggccguaguuccguggaucccgcuaggcaugccccacaggagcgcacccaccuggccgucccugaagcgcgccuguagcgcgcuucgcggugccaagaagucucgaacacgaaggugccgggcauggguuuccuuaaaccacacugggcuaccaggcccuacagcugcauuaagggccuccagcgucucgccaaccccaaggcgcccggucgccauggcgaccggaagacuaaauggaacag

SEQ ID NO: 5324 - RNA, 6432 nt, Mus musculus
aagacauuucacacauuauucuuuauucuggguuguaacacaagaaaaaagacaacagcucaacgacucaacgucugucucuagguaugcaaguuccuggugcagcucagcauggauuucagcuccuacuauaaccgaguacauauucuaggggugagcauacagcaaggggggucugcgggaaaugugggcaaggcugagcacacgggaaaugaggaugcgccuggcugcuuuucuuucaggaaccucggccacaccucuuuggucagauguuugcucgccuacagcuuuugagggcagugcgugagguguuccacacaggcuuggcuaugcugggccucccuccgcugagccacaucuaagggcccaauaacugggaauguuuauaaaagcaucaacugggaaagaaacaagaccucacagauguugggcacuuaaagucagaauaaauacaguuucauccuauugugagagugaggcguguucuugguccuccuaugcaacacccuacuggaauacuugcgagaacuaugguacugccucgccuccccagagcacacugagcgugacacagacagcugaucccugcucuacugucugcagucaggcccugugcucaguucuccacccacugggauaacucagucauaccaguuguaaaccucaagucccugaccugccagagcacagcgguggccaaacucagggcucacaggccagcaguccaugucggccacaucuggcacaugguacacagugcuauucaugaaggugggcucacccugucccagacgccagaaggucagccgcuggucuauggaggcugagaccaugagcuugggacuuaggaucuugacgccugucacaugggcagcaugugcgcaggggacggaauauuccucuaggacacauaacuggggcaccagcucagccuccccaucagcuucuuccggcucuggcaucuucacagcaagugugaagacaugcagggacccauccucacugccacuggccacaaggugguggcccucagguguaggcaaagugugcaggcuauugacgccacagcuaugggcuugcacggucauggagggggugcccaucucuggaggaagagaguggcuguuagcucccgcuuuuaucuugugagagagguaaugaggggugucacgguacucacgguagggaagcccagggugugcuggaagcuccaggguaguagagccuuuguccauugccguggugagaucccagaaggcuaggcugccaucuguagcugcacugcacaggaucagccuccuggaagccaggagaggacagccagaucaguaaaagggauggaaaaacaggagcccuuacccaacccacagagggcugccucucaccgacgcugguuaggugccucaugugugaaggaguggacuuugaggacacaccgcuugugguggaaagacucagcuaggagaugcagaauucgcccagaguccugcaggagaaagagccugggggcgaggaggaggggugguggucugggaaccguccuggagagcucacacccucccccuccccucccccuccucugcccuaugagcucaccucacugcuccaucacuacaggcugcagccacaagggggccagggccgaggccaggccuaucguugucaagcucacaaauagcaagagacauguaccuguaggggguacacaccggucagguggggccugcagucaggagucaggacuuuccuauaacccucucacgccccgcccaugacagggaggccgccuuaccuggucucaggguccaccuugaucaucuugugcuuguuccgcugccggucccaguacucauccagccggugggaugaaaggugcaugacaugacaggcaaggcggcugggggugcuagcguccggagugaccaugacgcugaagcagugaaucuccgcucggcccccugcagacacuaccugagcagugagcccuggucgaguauccugugggccaccuggggugccaacagcccacacugccagggcucgcacagaggagauaugguuacagacagaagugagggcgugggcugagccugugguggugggaagugcuaggacacagacaguaguguccucacugccuguuaucacuaugucaaucagaccaggccccucacugccaggcuccagggagucaggaugcuccaaguuggguaccucaaauucagggcccagggucacugugcccacacgcuuuacacaugugauuucacggccaugcagacccucccggagaaucacauugggccggaugcagccaccuagagcccgauagagcaugaccucaccauccuucagguagguaaaggccauggcugccucaguaucagaaaaggcccaggagcggugcccucccccacaguugacgauaugcagcuucucaugggaccgggggcuccacacuacaaacucguuggcauggaaacccaagaugaccauacuuccaucaggcaccauccgaagcccagcuacccaguucaugccucgacaggcuuucugccuuaggaccggcuggagguggccgccauguacaaagagcuggaaguaggagcuaucccgcccugugcuguauagguagccaccauggcagguaacugaggucacacccuguuucccaugcagagaauggaguguagagacggggccuauuccuguugggacacucucagacccaccgcucccacuaccagcuccaggugccucagcugcaguaauagccuugcuuccggccccaggcuuuuugaauagacauggucugacagggaauagcaucacagagccacggcgguccccacagacgaggaagucacccgggggcaggaaagcacuacaugugugccaucguugcuugcuugggggaaggagguaccggcaacguuccuugacaaagauagccuugccagugggugcagcugagaucuccaaacaagcuaucaccccaccagggcccgaugcuaacaaaagcagcuccucguaaccacgaagggcccagcucaggcugugcaccuuccccuggaacaguuucugcucgacggcagcgguggggguguugaugggaaccaccuuaacaagacccuccccguuggccaaggcacagaguccaaagcccucgggcccaggagcugccucuagcaggcaguaagaccgaaagcgauuguccuccagcagcugcucccaggacuugaccucaaggucguagagguacagggaccccacaucagucacugccaggacucgccaggaaccagccagagucacagccuugagggcaccuggccggcuaggagauuugaaggacagggaugagacgcccaagccuggguacccucggccugccaggugccagagucgaaugccugagucgucucccccagugaccacccaggccugccucucgugaguggcuauggcccggauaccucggccccgguggccccgaaaggcuugaaggaucucgccuucguggcuccacaccaagcagacacagucuucuccugcacugaugagauaguucucuaagagcuucaccugccacacucgggcacugugcccaaagcaguggccaauauucugaacccgacccccaggcacccggaggucccccaccuuccagagacgaacacuucggucuucugaagcaguugccagcaggcccuugcuuuccagguaugacaugcuaaagaugacacccacauggccacuaacccgccggucaggggccacggguuuguugucuguuaaagcaguggcuggguaccagaucaggagcucauuggaaaccgcgccagccacgauggucaguuccuuccaggugucaccaaccaggcaggcugaggacaggguacaccugucugugcaggggacguccugcagcaugcacccuaucacugggucauacaguaccaccgaguuguggcccaaggccacggcuacguuacccucgauccagcggacaucccagauccagucggacauguuccacaggccagagcgccagagcucccgaagauggcuuugaccccagcugacuuucacaacuuugaggcccuugcucccaaacacagcuaucauggccucagaguccaggucuccuuuaggcucuggucgcacucggaacccauggaugagaaagugaccaagcagguucuggacucucuucaccauucggagaugcccaccaagguccaaguuguacaccaguaaaucaggccccucgccuagacagagguaaagagccacaucagcaccacacacgcacgcacgcaccugauccuaggacgcaugaguggagcaggccacuccuuagcauacagacucagaauauaccaggacacagcauccuaccaaacccgugccuccacuucagccggaccucaacugcaaaggcacacuccugucagucacucguuuuugugguaagguucucucagagagcccagguuggccuugaauucaagauccucuugccucaaccucgaaucugcugggacuguggcaguaugcugucaugccuggcuauccaucacccuuaaugacagucacuaggauuuccucuggugcacaccauccuuacacuucagauggaaagcccuugcucugcucuagcccaaacucucagcuccaccugccucugcaugcauuuuccagauucucccucccuuagggaaaaggcugugucgaccuuugcacccuuuagccaucagcauccuucaucagucuaaucccugaggcucaacagaggcgaugggguggguagguaugugguuuuguguguguguguguguguguguguguguguguguuugugugugugcaugcgugcugaagcugcccacacuuuggcaggcaggggugaggcuugcauucuggccccaccccuggacagcugugagaucguccuuuguaugcgacugagacuuaaaagcaacaaggcuugggaggagagaugaggugcagguauuaagaaccuggacagcauuuaacacagcagaaucaaagcuagcgucuucugaguuaggaacauuccuaacuugugcucaagaggggcuuguccagggccucccucuauacaaauccacauacuucccggggaaucucuuacacccccauacauguguauagaacccacagacguuuucuagaaugggacucucagcucccuuuuggucaucuugcagccguuuguuucccacgaucuccuccuccucggacucgucaggauuccucauuaccuuacuccucucuuaaugucucuuucuucaaaauucuacggauuucauuuccugaaguuugccggucccaccuccagagaguuuagcucacuggagcaacccaauguuugcacuugcacacacacgcacgcacacgcacacacacacaucaacucuagaauauacccucaccacaagacaaacacgcagcccugcugaggcuaauaauggcugacccaaggccuaauugucagugccaaggguccuuguaaaacccaacaccaccaucaccaaaggauggcuucgcaucaggcccuacugcuuccaggacacuuggcaccucagagccaucucagaccuuuaccaccagacacugagacaugugauuacuaacccaguuggcucagaccccccaguugguucuccagaggaaccuaagccccagccucucuggauacugcucuacucagaaagcaauuuuuuggcccccucaucuuugggggcggagcuucaacccucuccagaagccacacucccgccacacccccugaggcugcccuuuuuuuuuuuuucuuccucuccagggguuuugaucauuugcguucaccugagggugcaacgucccucccccaacauggaacgacugcgucccccacaccuucaagcgucucuguccacccuuuccaagcuggcugcaauuuaugaagagcugccacugucucucgagccccgcccuccuccgccggccuguguuucccgccaccuccgaaccugccuuauuccccccacucccaccccucgccaguccccagcccgcugcccauccuccuccccagggcaucccuuuguccggugcgaccacccagggagaggcuaguucuucgcccgcuagcacgacuagagccgaccaagccucacccgccagcagccuguccccaacacacuccagacccguaaccgggaggaguaugagcucggaagucgcccgcggccagacauaguccccgaaagcguccaugacguuccuggagcugcuguggcugccacggacaagaagagagcugcguucucgcgagaaccagccgucuggagagccgcgcugcagagcuccgaagcccuuagcuacagguagcaaagcccuggcgcugggcugcggacguccaau

SEQ ID NO: 5325 - RNA, 2386 nt, Mus musculus
caguauucauucugugauaaacugcaaagcuggucaaccuagcagauggauggacagaacuacaugucgcuaagauggauaaagggauagcagcagggaacagagagaaugacuacagacgauagacaaauacauggcucuauaggaggccaguaagacggcucaacaggucaagccguugcucuguuucucucuggcucuuugucucugucucucucucacucacaaacacacacucacaccacacacacuauaauaauuuuuaaaaaauguuuagacaggugaacagaugaguggacagacagacaagauaaaagccaauagaagucugaucagagggauguauaggguccucgguaaauugauaggucuggagcauagagcucauccaagacuccuuugucuggagccugugucauucagaaggucuccugcaugagugaacgagugucagcgcagccaggaaaggcaaggagcacgaugggaaccaugggcaugggaugaccuccuucuuggcuauuggccuuucuguaaaggaugccagaguuguaacccugcauccugggcauuagcaaagauguagcucauagguuuuuaaaacugaaguauuuauuaagcaccuacacucugcagugagugcaguaaacagauuuuuuuaaucccugcuuucuaaagguggacaagagaaacuccuauuaccaacagguuccucuuggaaucgccuucccuugaggccuucauggcucuguguucaguucugucuaguuuuucuuuuucacauuuuuuccucucugucuauacccacuuaccccgggucgugguuuuguuuuuaaaauauuaacuaauugaguccagaucccucucuguagcccaggcuggccucaaaauuaaggcaauucuucagcaucaaccuuccucuuacugggauuacaggcaugaaccgagaggcccagguuucagguuuaaaugccaacuucauguuaaucgaccccaaaaguguuugcccaguucaggcucuuccugguucaguguucagcuguugauagacagccugcccucuggcuguguguguuccuugacuguuuccguauggcuguugucguauuguuuguuuugcauucaucuguugugccaggagcuugugcugucucaggaacacaccacuuuuugacaugaccgugauuugaguaccuaaaccccuacaagucucucuccagaucagugucacaguucccgcccagcccccuguugaccuugcugccuucagcccacucuccaucuaucagccuguggauuaauaaccacuccccagagaggcuccagaggcagcuagacucucaggcuugcccacucccgccuaucuaugccuccucugcuggccuccagcucagucucaaagugcacugcacacacggugcccagucagggcuggccucagugguucucuaugccugaaagaucagccuuccacaggcuguaccucagagcucucacacccucacauuuuagacucuaacuucucgcucuguccucagcacuggagacuaccuuuauuuucuacccuguucuacuuccuuccucccccagcaauuaugaucauauggaauauuuuuuacuuuuuuuuuuuuaacacaagaucucauucacuguaggcugauuuccuugccuccaacucucaagagcugguauuacaggugugcauucccuggcuuuuuuuggucuguuucuucaguauuggggauugaauccagggcuucauauauacuagguagacacuccgucacuauagucacuauauucacagcccuuuauacuuuuuaagguagguguuuauuauccuuccagcuaaacuccagaaauauuugcagauuuguuugccuuaaagaagaugcauaaugcucagugguaaauauaauaauaauaaagauaguaaaacauuggggcaaugagagaauguggcugccauuccaggguugauggccugcugugcuauucuaaauuccagacugcuuuuacuucagacuaggcuggucucagagcaauucuccuucucccucugagaaggaucaccagaaaugcaaguucauccucaaagcccuagcugcagucucucuuaggacaacccugugcaacuguacagagugaugaucucuacugaacagacucaagcccucgggaguuuggcucccacgccugccuugcacaggcagcucuucuccaggagagacaacccacaugguauaggguguuccucagcagaacgaugaguguggagagccucuggggccaaauggggggcacuugacauugggccaggacaaggaaguaggcuucaggcacgaaucugauuuuggacuagaacaaagauuuaauuuuaacucauuua

SEQ ID NO: 5326 - RNA, 10479 nt, Mus musculus
cggggcggggcggggcaagcgccgggcggcgcggcacucagggccuggcuucccggcaccgcaaccuucgucgcguacccagccccggcgcuucgcggcccggcccggcccggccucauguaccgcgcgcuguaugcguuccgcuccgcggagccgaacgccauggcguucgcugcaggcgagaccuuccuggugcuggagcgcagcagcacgcacuggugguuagcagcacgggcgcgcaguggcgagaccggguacgugccgccugccuaccugcaucgccugcaggugagugugucccuccgucccaggccucucgaccgaaccccuucaccagcacgcagaaccgauccaggaagcucagucagauucuucgggacuucuaccagacaaggagguugagacucugaccuuaagucccaagagccguaaggacugagaccccuccggaagggccgucaacacccacccgagacuaggccuuugacauuuaaccgcaggcccgugaaaagcuuaauucuggaacagggacucucugucaucgauaaucagagccuccaucugcauugaauucucgagcuggauccagagacuuccaguccauucauuauccaagucccuuagaccuccaaacccuauucguuccccuuuccugaaucccuaggaugcccaucucccaucaaucuguagccuccaccuuuaacuguaaagaucaccgugcccaccacugacugugccaccucauacaccaccuguuuccucaaccacccuccagguucuuaguccccaccccacccacacacuuggaccccagagccacaggcauuccugucccuuaugcgagucccaauuccuguaguaucucuguaucccgaacccgcccaccuaucaagcucuccccaaggacaauuccccaacccuucaggaaccaaggccccuggccccugcugauagacaagguucccuggcacagcccccacuucucccaagccuccacuccugacuucucugguuuccuuccucugaaaucugggcgcuccauccuggaaugggagcuguccacacugugaggaagugagccuccuucaugguuucccguucugaagauggccugguccccuuccaguggagccugcuccaguuccuguuugcucaagaguaguccugcugcagugucuccagcuagccuauucugacugcaggaggaaggggacccagggcagucugggcuauuccagacucauagucccuagcuauggaaacauccugucccagcccaguuaaggacagaaauacugugauaaauuuggaaaugucaucuggucuugcuaaagacgagggacccuugguucuaggguccuccucacagacucucagucuccucuagagguguucaggugagaaaaaucuaaacugugucacacccagcucagcuuuuugagcacccaggucucuuuggagacuuugaggaagcccugccucuuugucaggcccuguggagccucugcucuagccagggucaguggggcuggaggguuugggaaggaaagaucuuucucggaucacuuccuguuucuuucgucauaccccuagucucaguucccccgacugcgaauuucugucucauuuuuacuccaccugguguuugcccuucuuuuucaaaacuuucccuuucugucgcuguugcugucucucccugccccgcccacacaccuucugccaucugaaggacuuugcugaccccuauauuuauuuggcccuauccagggaagccucuuaaacucacuccggaacuaaacacggugacuuauguguacagucugaggcuucgggaagaguaccuugagcuccaggccagcccugggccacauagccacuuccaaaccagcuugagcugcagagauucucaucucaaaagaccagccacccagccaacuaaaacaaacgggacuguacccuaaugugugcuuaggucuguucugggguuccugucccgcagcuggccaaccccaccgcuguaauccacaccucccuccaugccagacagugggguagaacggacuccuggguuacugaggacggccacacaggcaggaaucaggccagucucucaagucccuccuuugucagaagcagagugccuucccaaagguggucugaaaaaguggcgggacagcuugggaggguggaaggaagggagguccuuuugacccguuuuuaccucccagcgcuugggaaggucccugugggugggaaggucccuguggggacagggcuguuuuggagugugaccuuggcuuugugaaggagcagcauccagagugacugauuagggaucccagacaugagagucuucccuuuuggcaucucaugcugggcucugagccaagcccagggagagacuagguuuggacuccuggucccaaucugggauuccuaugguuucucucuauagguuuuuagaauugucuuugccgagagccuguguaugcaagccccuaaauguaaacuauaaaauaccaucacagagucccagguaacacgauuugaccacuucauucuguauuccauuuuggcugucuucuaguguccagaauucuaggcuaguuccagauugggcugggucugggcugaccaaucccacuuggcacccaggucuaacuacccaccuaccuuuagggcauggaacaagauguccuccaagcuauugaccgugccauugaggcugugcacaacacagccaugcgagauggcggcaaguacagccuggaacagcguggaguccuucagugaguaucugggaaguggagguaauaccuucccuugagcguguugguggggccagagacacuggaggcaguacuaggguuagugcgagguuccacagagugggaugaaugaugggaaagauggacgaugaggagccuguacugugaggucccagaaucccgcaggggguuuaaaaaaagauuuauuuuaaaguguauauaugagagaaaguguauaugugugugagaguaugugcaugcauguguguguguguaugugugugcaugcaugugugugcaugcaugugugugcaugcauuugugugugcaugcauguguguuguaugcauguguguguguacuuuggguguagagaggagccuucccaucauggucuguuugucucucuauuaggaagcuuauccaucaccggaaagaaaccuugucucgaagaggcaccucagcuuccagugcuacgguuaugaccccauccaccagugaccaccauuuggacgcugcuguaucuagacagcccaauggggugugucgaacuggguuugaacggcagcauagccugcccaguucugagcaucuugggacagauggagcccucuaccagguauggaguaaggguaucuuuuagaaggaggugucugggacuaagacuucauccagaggcccaaggggucugcucaggugcagcuagcagcugucuuccccuagaucucaauucuguucucucagguuccaccacagccucgacgagcagcuccuaccaccccacccccaccggugaagcgccgagaccgugaggcccuggugaucucagggaguggugagagggccaggcuuggguaguugggaugggaguacccugcgcuuggaaugguugcucugcccauguugggcaaaugggagcucugaaugggguaaauauagaguuuguuuggggccuccaggcuuggugaggagauagggccuaacagaggaacuaggucuuguacuagggucagguucucuaggccaagaagcuuggugcuccccaacaggcugccccagcauagcuuuuacuucuuguucacagguggccgcacagccauacccucuggagguaguucugugucuaguggcucaucagccagcagcaccuccauggacacacucuauacuggcuccagccccucugagcuaggucccagcugcucacccacacccccgccgguaccucgccgaggggcccacacuacugugucccagccccagcccucucccuccaaggcaccauccccugagcccccuacggaggagguggcagcugagacaaacucaaccccugaugacuuggaagcucaggaugcccugagcccagagaccacagaggagaaggcagccgcugagacaguugugccaaggaccauuggggcagagcugauggaacucgugcggagaaacaccggucuaagccaugaguuaugccguguagccaucggcgucguggugggucacauccaggccaccgugccagccagcucaccuaucauggagcagguccuccucucgcugguagaaggcaaggugagggugggcagcauggccaaggagccuucccacccucaggcagccugcuaaucccaccccgcuccugcccucacgccuuuguccaggcugugugacagguauuugucaagcucuggcccuuggcuuuuacugugcuggguccuagagucauuugaguugacccaugaaggagaaagggaggaagaacguucuagacagagacucagcuuauaaggaacaagagacaggaccaagcauggcucacaggaaggaagaagguggauggcauaucugcaucagaggcagugugggagccggugagccuaaggcaggugauaagggagaccaggaugagaugggacuaggggaagcuucccaucaccuggagggguuucccacuggugcuccuucugugauuccggaugcagggaaagaagcgagacagcauggggugagagaucagugccuugccagccuugacgguguagagaaaagggggcuugguuaacuauggacgcuugcuuaguuuugauagugguuuaggugccagcuuggaugguagugagugacgugggcauuucaagaugacuguggucguuucucaagguuaggguacugguguuaggucuggugcugcacgccuuuaauaccagcacucaggaggcagaggcagguggcucucuggguuugaggccaucuugguuuacaaugcaaauucuaggacagccagagaaacugugucucugagaaaaaaaaaaaaaguaggucacucauuaggagaaggaacgcgguagugaguccugacuacgauaggguuugagugggccaaaggugguacuuaggcuccaccuaugauaucugguuggagugaguagagggcaguaggccaguguuuugugugccuaugcugagcauagcagcuagugucuaguaugacaggccuggugucacauuguguggaaugggaugaggauggauccugagucacauucaaggagugacagaguucguuccugccucuugggagcugcucagcaaguuccagggugggagcugggauguugggaauucccacagcugagccuugagcagagucuuguaccaggagguggaaacuggaguuggccuacacaguguaaauuuugugggaccucaguucaaagaaugcuaagcuuagaggggccaggucuuggaggcuuccuggagcugguggugugcagaggucuuacugagucauacccugccuucuccccacaggaccugagcacagcccuacccucagggcaggucugccacgaccagcagagacuggaagugauuuuugcagaccuggcucgaagaaaggaugacgcccagcagcgcagcugggcgcuguacgaggacgaggacgucauccgcugcuaucuggaagaacugcugcacauccugguauggggcagggacggacccucgggccugccggcgugggagcagugagccuccccuggaccaucacccuucagccauuaggucacuucugcucaugcaugcucaccucacacugggugacucucacucuuucucuucccuccagacggaugcagaucccgaaguuugcaagaaaaugugcaaaaggagugauuuugagucuguccuagccuugguggccuauuaccaaaugguauguauaagacaagggaggggcacagaggcaugugggcagacguaagggcacuuagcacacggguucuucugccaggaacaccgagcgucucuacggcugcugcuccucaaguguuucggugccaugugcagccuagaugcagcgaucaucuccacucuggugucuuccgugcugccuguggaauuggcacgggacaugcagaccgacacgcagggugaggugggguggcccuccuuaccacucggaggcuguuuucaccgucugccggggaucccuggccuugcugacuccuuccuuaccccccacccccagaccaccagaagcucuguuacucugcccucguccuggccauggucuucuccaugggagaggcgguacccuacgcacacuaugguaagaaucaaacccuaagcagugggcacaaggccccagagguaagaaccaugcgucucuccagggccugaagaccuacugacuagagaugguguucuuaggcucacagaaagccagggaggcuggaucguauggggagcaaaaguuggauuuguagauuuccuuaugcuacucuuuuagaacaccuggguacacccuuugcccaguuccuacuaagcaucguugaggauggccuuccaauggacaccacggagcagcugccagaccucugcaugaaccugcuucuggcucucaaccugcaccugacaggugggguggggccaucuggaaggcagcugagcagugggcuuuucgggcuucgcgggcuucugugccuacacucuuaccugucuccauccacgucucuccgcagcuccugagcagaaugucaucauggcugccuugagcagacacaccaaugugaagaucuucucugagaagcugcuucugcuucugaacagagggggugagagccuagaagucugcaugggugccgcuugcguacacacuugacucugucacgugcccuccucugacuccugugaaccccugucuucuagacgacccugugcguaucuucagacaugagccccagccaccacacucuguccucaaguuccugcaggauguguucagcagcucugccacagccgccaucuucuaccacacagacaugauggcgcuuauugacaucacugugcgccagaucgcagaccugucaccuggagacaaggugccugggggccgcacagcagcuuaaccaaaaggggugacuaugacauugagugcagaugagggggcagggcugccgcugccagggccaagugaguguggaagacuacucggaaaccaggacauggcagccagccguguauguggcagacuggagcaggaugucugaggcgagcuggaaucgcuuuucagaagaggaagagacacugccuuccugugagagcagaguggaagccaggaagcccggggcaggaguggguggugaaguaggccaggcuuggguguguugcaagugggcccggaagagccugcuuugggauugguuuugagcagguagguggauagaagaugguuaauggaagaggcccaaagaacuucuuagggaaagauaacaguugugcuuugaaggagucaagauuaaggacaagccaggcagugguggcgcacgccuuuagucccagcgcucaggaggcagaggcagccggaucucugugaguuugaagccagccuggaagccagccuggucugcagaucaaguuucagggcagccagggcuacacagagaaacugucuggaaaaaccaaauuuaaaaaaaaaaaaaaaaaaaaaaagauugaggaccagugcuggggcuagacagugcuggggcuagagcucuguggauagaguacuuuccuuucauaccugaggucugauuucagucccuagcacuaaaaaaauacaguacucagaagacauugaagugccaaggcaccggaggcagcaagugaacugagacuagagacgugggguuguguguggagucaugacagaaucugaugguauaaucagcagaggcauuagcugugacuccgcaggcucagcuaaggacaaauucagggacaaacccaagugagcaagagcaagccacagaccaugugugugcagggaggagccgcacugcgcuguuaggagcucucggcggggcggagaauuagucuuugaauuugccacauggaagccgguggugacuggcaagcaaugccagugugguggagggaaucaggucugaaugggaaguuugagaaauuuuuaaguuucuccacugggagaguggagaugggaaaggacuuggaagcaauaaaugaagguaaccaauuuucuguacagagaaacagaaaaacggggacaggguauuguaaggugggaggugcugugacaugcccuggucuggggcaaggcuccaguaagcauagagaaaagagccaugugcugcagagauugggaggugcacaggugagacagagguggccagugguggacucuauugcuuguucuaaugaggacaggaagggcaggcgcuucaagcagaagagaaggcacaagaccagcugcucaggccgcuuagggucaagggcagaagauaggcagugguacuauaaggacagaaagcagaggucagcaggggguuggaaacaggugaaucgaagaggacacguauguuccaggccucaauugaucaacugauugaacagugguuccuuccuaacgagcaugggacgcacuguaccuuagacaugacggggagcugauggguuuggugucagauguguggauuugaggugacugagauaaguagaagaugacaggcaggcgauuagacauucuugcugggcgcuuucaggaaagaucugcauaagauguacgagggcagauuguuguuucaggccauggguguaauuaagaucuucuggggcaagagacguggagaagccaggacucugauugacacacaugguaccuaggcgaccuggcacuaaaggacuggcaagaccagggcagccacauucucuggaugcguggcuggaaugauucauucauucucuucuccacagcuuugagagccauuuaguguugaguaaaauagagcagugugagcugcuuuguugucccauagucuacuggccaguaguggucagucccccucugggggcaguugcaguaccauuccaggaguugcugaaccaggcugcucuuccuacagcuacgcauggaguaccucucccugaugcaugcugugguccgcuccacgcccuaccugcagcaccgacaucggcugucagaccugcaggcuacacugcggcgcauccugacugaggaagaggccucaccccagugccagauggaccguaugauuguccaagagauguacaaggaauucccggaccugggagagguucccagcuagcacuucucuuuacucccuucucugcagcccugggagggugcagagaacucaggggcuuggcucuaaggauguucugcaccgacacugcgaggugauaaaagauuagaagggaccugagccgggccccuuaccuaaaggagagucaggguaaggggccagauguaggauuggggaccacagucugggaacuguauuggggcagaggaaaugcgcaaggcugaauacccucuguuugcugguaggcugccucuucagcaugccacccccaucccccacucccaugugcauacccagaguccugcugcugcuccaggcugggcugcugccaucccuaccugcugucuggucugagucuugacccucagcaagccauguccuuagggugagggaggcaccuucugccagcucuguucuuugccuuagcuuugcagugaguguugcucaugugcagcccuucccccauagggacugcuguccccugacccccugcuuucagccccagaggccuuggccagacuguugccuugaaagugggauccuagagacaggccauccguccugcagccccauggaacaggaugauggugcugagaaagccaaugauagaaucuauuuucucuggaaaaaaaaaaaagaauaggccaaaagccauguguauuuuccuauguacuacagcucaccuucagaaauaaauuacaggcaccaggagcugggcuucccuguaugaugaugcggggagacgacggggaggguggcgggggcucaggaccucacagcuccagcuuaaacugcuaucugcagcccaaagaggugaugguccuugaccagacuggccucccugcugugcuuccucuagggcccagcggcaggcagccacgcacccugggacacaccuguagguaucuuucccuuuuggguuccauucuuaucuucuuggccacuguggugcacaccuuuaaugccagcaccugggaggcagagacagacagauacucauacucagccuaguuuacauaauuccagccauccagggcuguacagugagagccugucucacuaaaaauacaaguaaaauaaaguuguggagucccgcaguucca

SEQ ID NO: 5327 - RNA, 1244 nt, Mus musculus
cgcuauauugaucagccuccaaacuuggcaucggugaugagcugcaacgcaaggugcaggggacucauucauucugacaccgagacaggagucaggccuaggaccccagaacauugcccugggugcgguucccccggcugagugguuacuacuucaaacaguccaagaacuccuggccaagaccucuggcccgcccccaaaugguagcuaugacaucaccagcaaccaaucaacgcauucucucgcuccuggguuucuuugcuucggggagguuuggcucacucggguugcacuggacgaggcugcugugaucugacccauggguaucagcuguaguguuuggggucguuaagucuuaagacucaagucagaguuccgugacagauacaccauuugugcguguagguggacuauguacagcggcacuaaagaaaguacuccguaggauuguaguuccugacuagagaagagaggagcgggaccugguuuugaagcgcccgccgcucuguggguccacagacuagcuaguggaaagcgcaaaucucagguugaacaaggaggaaaccagcuggaaucacagaggagaccccugaaugaccuuagggaucuggacuuccgguacgaguugccugagcagcacuuuuaggaugccaucccggcucuugccgcgugggcagauguguuaaguaaggcaccuuggcugagggaaaucguuccguuuuccccucaugcagggcuggugacuggccuccaccuuugacgucuccguggcgucuacuagagacgacauucgaggcggcugcgggcgugagacugucucccacuuuucccccguuuguggcugcuguugguaagccguucccucaccuuguuuucucacauauccucacuucuguguccaacccacaguagucgcucccaaugcacuuccuggaaagagaaaaaugaggagccuaaaggagguucagcuggugaaggugcuugguguccaagcuugaacgcccgaguuugaucccuggaucccauguaagaguggaagaccgaccccacaaaguuguccucugacaaccauccacacuuucaaaugaaaugcuguugguuccucccucugcuuccaagaccagcuuugucccuaccuccuaggaacaaguaagaccuccagguggccuucucaauaguuccaauugcagggucuacgcaggucucagagacgcagauuugaugugaggcaagaccagacagua

SEQ ID NO: 5328 - RNA, 31292 nt, Mus musculus
cagugccggcaggacuugcugcggcgcgggagcaggcugacuccucgcacaggcaagaucgggacuuggggugggggguacucgguuuccacccgccaaaggcuugggagacaagagacagagagguuggguuccuggcuaacuguuucuaucacucaggaugaggcugcgacuccuggucgcugcgcucugcgcugcagagauccugaugggagcgccggaagugugggcccagcccagagauagaggugggcaucuuucggggcucagcacccugucugucaccuaugcaucuacucaaacuuuaucccugacaccuuuccaccgaugagucccccaaacucuucguggauucuuccuaaacucccugaauucuacucugcauuccccaaauugccuccuaucccauauggcacacaaauucuagcucccuggaugcaggcugauccucuguccucagccaccggacaacagucccuccacgcugauuucagccccgcagcuacaccccugcuugcagguuauccucccccaaggugcuccugcccucccugagaagcucuguucagagucccacugcgguuuccuccaacacuggcagaaauacgccuaccugggcuccguuugcagaggaacauaaagccuauuguccuuccaguccccaagucccaggggaccucagugccuagaggaugguggguggcuguauucccuaaaaggucaugaucucuccucccugcuucagugaccugcacacgccuuuaugcugcugacaucguguucuuacucgauggcucgucguccauuggccgcagcaacuuucgagaagugcgaggauuccuggaggggcuggugcugccuuucucaggagcagccagugcacagggcguccgguuugccacagugcaguacagugaugauccacagugaguagucgacguggggucaggacuguaggccccaagaccccuuaacaggaaggagucuagaaauaggcuuuggagagcccagaaaggcccucgccaacaccucuucuggagagagguggggauaacuuggaagaguguucuuguccuaaaacaccucucagucaguguccugggguugugguggggugggggugggguggacaggaugauucugcuuccugaucugcauagagagagagaguccaggagcuccaggcguugggcuccugguggagucugcauguuugggcucugccagcucuucagcccucuguucaucagaaaugcuuugucuggccagugaccacuguccugaaacugagcccuuccuccuacaauuauuuaaucagauauccugcccacacacaccaccaccaccaccaccaccacccccgccccaggcuagggaccuagaggguuccaggccuguugaggcucagugacauugcuaugucaagcagcaucugaggaggcugcuaacguggacacuuccgcgguagagggcuggggggggguggggucucagaaccaagggugcuugccucagagcucacucaucucaguggccucaucucagaggcagggcuggaagagaucaugacccccccccccgccuuguguuaccccguuuccuccccucaggacagaauuuggucuggauacacuuggcucugggagugacaccauccgagccauccgugagcucagcuauaaaggugguaacacucgcacgggggccgcucuucaccacguuucugaccgugucuuccugccucgucuaacacguccugguguccccaagguguucccuauaaaccuaccaugccugcaaaugugaccccaaaauaaaugucugaaacaucccugacugcucuuggcacccaucccaggucugcauccugaucacagaugggaaaucccaagauuuaguggacacagcugcccaaaagcugaaggggcagggagucaagcuguuugcugugggugagaaccaaguugaggcgagaggucuguuggagugggggaccauucagagaauguguaagcaacugagcccggcuugggcaucacuucaggaaucaagaaugccgacccugaggaacugaagcguguggccucacagccaaccagcgauuucuucuucuucgucaaugacuucagcaucuugaggacccuguugccucucauuuccaggagggugugcacaacugcugguggugugccugugacccugccuuguaaguuucugccuguucuggguacccuaaccccagccugggagugccgaccuaugcacuccuugcccaugaccugauacuacccccaaccccauucacagcugaugacacuccgucugggccccgggaccuggugcucucugagccaaguagccaauccuugcgaguacaauggacagcagccaguggcccugugacuggcuacaagguucaguacacaccucugacagggcuagggcagccacugccaagugagcgacaggagguaaggauauuaacagugacugguggcugcuaaggacuuggcuggacaaugagaugaccuuuggcccugggcaggugaacaucccggcuggugagaccagcacgcgucuccagggucuccggccacuaacggacuaccaagugacugugguugcccucuaugccaacagcaucggggaggccgugagugggacagcucggaccagugagcaauucugucaaccuuugaccccauucuccuaaccacccagccccuaaaccccuucuuacuuuuggcuuuaccaaucccuggcggguuuucccucagcugccaaggaagggcuagaauugagccuccagaacaucacaucgcacagccuccugguggccuggaggaggguaccaggugcuaauggcuaccguguaacauggcgggaccucagugguaagugagaggcauggacugacaaaguuaucgauucuuacaucuauaaggcccacugaacccucuguguacucgcauacaggugggccaacccagcagcaggaccugagcccuggacaggggucaguguuucuagaucacuuggagccuggcacggacuaugaggugaccgugagcgcccuauuuggccacagcguggggccugccgcuucucugacugcccgcaccggugaggagccugagucccuuuuucaggcugggcuggacaggcacagcaggguacagaagccacugauacccaugugcccuggcagcaucuucuguugagcaaacccugcaucccaucaucuugagcccgacauccauccuccuuuccuggaacuuggugccugaggcccgcggcuaccgcuuggaguggcgucgugagaguggucagugcgaguggacaaagccaggcgggcaggauuuggggcuuggcuucggcucaccugguccugccauccugcaggcuuggaaacaccacagaaaguggaacugcccccugaugugacccgccaucagcuggaugguuugcagccaggcacugaguaccgucucacgcuguauacucugcuggagggccgugagguggccacuccugcaaccgugguuccuacagguaagggcucuguaggucuauacauuauccagaaagucuagugacugcagccagcuucauguucuccucucucgaagggcuagagcagcuggugagcccggugaugaauuuacaagccauagaacuaccugggcagcgggugcgagugucuuggaacccagucccuggggccacugaguaccguuucacuguacgcaccacccaggguaaggcagaagcagccugaaaaguccccucaucccgaagucccagccugcagcacccucccacucuggcuugguuccuacggccuccuucaucuuuuuggccaucugcaucccgggaacuguugaccccagaacugccucagggucugucuuuccucuccucuaccccagccugcucuucaguugucuaucuccacucugcccacaccccugcuguggcucauccaucucgacccccacaguucuacgacccacgcucugcugucccucucuagggagaagagggccccccuguggucacuguggcucaaaguagucagagccugacucagucacuugauucuuugccugagcgcuccuucagucucuuacauucccaccgccuccccacuaaggauccucuaauacugaucucucgcgucccccaacgcucacccaucauccugugucagucuaugggugacuugccaacuugcaucacaggcacagacucucaucaugcuauguccuaacgccccgucugucacccaguguccccauucauuggcgaccuccuguuauccuguguugccaucauggaccccuuagccccacaucauuuucucuuacuguuuuccucucuccauugcccuuccccauccaaucuccccaucucccacgaugucugguaguuuugccuaucacugacugcuguucuagaucccuguguggugcucaccccccuuccugcccacccugccuuuucucaggggucgagcggacucuauugcuuccugggagccagacaaccuuugacuuagaugauguucgagcugggcuuagcuacacggugcgggugucugcucgagugggugcucaggagggugaugccagcauccuaacgauccacagaggugagcaccuuaggagacuuacgggcgauggcgaccgacuugcucccuguccucacacugaccuuucaccccuaucuuuaacccccagauccagaagccccacuuguugucccaggacugcggguugucgcaucagaugcaacaagaauuaggguggccuggggacuugucccuggagccaguggauuucggaucagcuggaggacaggcaguggucaguguggaguguguggauuguuugcugaggggagcucucagaguguguguguguggggggggaguaaggggacaugcagaaaccaggccgccguuucucucugaucccagguccagaguccagccggacgcugaccccagacuccacugucacggacauccugggguugcagccuagcaccucuuaucaagucgcugucucagcacuuagagggagagaagaggggcccccuguggucaucguggcuagaacuggucagagccugacccggcccccuggcucuuugccucuugugccccuuagacuucuguggcccccuuaaugguguacauuuccaccuugagucucagcccacccaucccuacucucgagccuuccccuucacguucaccugucucucccauggcucccucugucuugcucuuauuucugcuacucgucccucagaaccuaucacuuccuccuccuccuccuccuccuccuccuccuccuccuucuccucuuucuccuuuguuggacccagcucuccuuggaccuuuacuuuguccuuugccugagguccucacgguccccugaugcuuccauagaccccucucagucagaccucgucuuucagaucauugcgaccugacagcucggcuuccuacuguaaaaccccucauugcccuuuugugaggucccugccuccuguaaacacucauagccuucccuugccaaacaguuccccaucuucucccaucagaccugccuacauugccagauugcccauuaucucccucuccagauccacugggcccagugaggagaguccacuugacucaggcuggcagcucaucugucagcaucaccuggacugggguucccggugccacaggauacaggguuuccuggcacucaggccaugguaggaggcagggguuuaaggagggcucugggaggagguucugaauacaguggaggcuaaagauucuuuugggauccaaguggagcauugggcagucggacaaguccugggguuaucuccguccuugaucccagguccagagaaaucucuguugguuucuggagaugccacgguggcugaaauagaugggcuggagccggacacagaguauauagugcgugugagaacccacguagcugguguggauggagcccccgccucugugguugugaggacuggugaguagaucccagccagcuauuccuuggcugacccagccugcuaugucuuucugacugcugccccugcucagugcccugucuauccugaaccucccaggguuacugagcguccauucauguuugugaccuuggccgugcuacacuccccccgaaacacuaaccuccuccccucaaaguucccuccacugaccuggccacacuaaccuugcccagccuucauuaccuaugccugccuugcuacucuuguuucugcuagacccccaguggccccucacuuuuaccuugccuuugucccuagcuccugagccugugggcagugugucgaaacugcaaauccuuaaugcuuccagugauguucuacgggucacuuggguaggagucccuggggccacauccuauaaacuggcguggggacguagugaagguaaggcuccagguuuccauccuuguccuuccuggcuacaagugcccucucugcuaagcuccccacagccccccuaacuuuuacucucugccggccuguccagguggcccuaugaaacaccggauacucccaggaaacaaagagucugcagagauacgggaucucgaaggaggagucagcuacuccgugagagugacggcgcuuguuggagaccgagagggugcaccgguguccauugucaucaccacacguaggaggguguuuggguuggaagaagucuuggagugaggcuguguucaaggggcuuuuggggaaggaucugugcugguguuggagagggaucaaggauuuauagugagccuguguggguaaaguucggggaagaaauguauucagagggguugguuagccuagagggcagagccucccugauuguaaugcuuucucuuaagcgccugcgaccccagcacuucuggagacucuucaaguugugcagagcggggagcacuccuugaggcugcgaugggaaccaguacccggagcaccaggcuuccgccugcacuggcaaccugagggugagagacacuggaggagggaguugggaccaauuaagggagagggccucugggcaaaguugcugaaaggagugggcagccaggucugcagaaucaaaagcaucagggggcuuaauccacaaggugggugggcguagucagccuugaggagaugcaucuggugaacaggcuaaagacgaaugagaaagauuguugggagaauggaugugaugggucagcgugguuggugagagucagugagauggggaccgccaccccuguuaucagucaccacccccugcauauucuuggcccuuacauucauacuucucucagguggccaggaacagucccugaccuugggaccugagucuaacagcuacaaccugguuggucuggagccagcaacaaaguaccaaguauggcugacuguccugggccagacuggagaaggucccccuaggaaggugacugcauacacuggugagccucucagagcacucaccggccuguggugugcucuucccccacgccgaugacaugcccuaauuuucugcacuccagacucuaagugcuuccuguaggcucuccccuaaggcccuggcggagauuccagagugaucucccaggaugcuucacuaaaaugaaccugcucuaaaaucuugcaucucucucucucuugcucucugcauccauccucagauccguuggucuuugauuacucuuucagagcccucucacaucccgagcacugaacuacgcgugguggauaccucuauugacucagugacuuugaccuggaccccagugucuggggcauccaguuauaucuuguccuggcggccgcucagaggaacuggccagggugaggggaagaccagaaagugguaacuggggcuccauagagaaguuccugcuuaaccaaaucuuccucugcagaagugccgagggccccacagacacugccagggaccucaagcucccacagagugacagggcuggaaccugguauuuccuauguuuucucucugacaccuauccagagcgguguacgagguucugagaucucugucacacaaacaccagguauggaagguacuguggagaagccugaggggaccauggaaugguuggccauccuaguaacucggcucuuuugugcagcguguucccauggcccaguggacgugguguuccucuugcaugccacucgagacaaugcucacaacgcagaggcugugaggaggguccuggaaaggcuggugucugcacuugggccucuugguccacaggcugcucagguuugguucuaaugaaagccagacuccaccuguuccuggcccuccccucuacugguuccugaccagccaccaucacuccaucccuuuuuggguucaggcuuuccccagcucuccuccaggcucuggauuaucucuccuauucuaccaucguaacugacccccugggcugaucauaccucccaugucucuaucucuguccuacucacauguccuccccaucuugugucugcuccuacccaggucggccugcugacuuacagccaccggcccuccccacuguucccacugaauaguucccaugaucuuggcaucaucuugcgaaagauccgugacauccccuacguggacccaagugguaacaaccucgguaaggaccacaaucaguguggacuccuggggcuuucccaucagguucugugucucgggguucugacacgcacuuuucccaggcacagccgugaccacagcucacagauaccucuuagcauccaaugcuccuggucgccgucagcaagugccaggcgugaugguccuguuaguggaugagccucugagaggggacauacucagccccauucgugaggcccagacuucuggugagcuguagggcuguuggagaagggccuugggaauagagguggcccuggugacguugucauauagauugcuggaucucuuuuuagggcuuaaggugauggcacugaguuuggugggagcugacccagagcagcugcgucgcuuggcaccaggcacggaccccauccagaacuucuuugcuguggauaauggcccaggcuuggacagagcagucagugaucuggcuguagcccugugucaggcagcugugaccauagagguuuggagaaggccucuggggacugguaguacagaggggaccuugggguucuuuuagaacuuccuggucucaaggagcgucuuuguccacagccgcaaacagggccuugugcugugcacuguccaaagguaaguggccagaguugaaugggugggcaaaggccacaguuagaccugguuguucuuacccucuucugacaugucuucuccuagggccagaagggggagccuggaguaacgguaagccacccuauggaggugaacagcagguugagagucaauggggcagagggcaguggauaacacaggacucacugaucacuccuuuuagggacugcaaggacaggcuggaccuccuggccccccuggucucccggugagugccuccccaccccugccucucuugugccuggcuuacagccuccuuaccugcucuccucacucagggcaggaccggugcuccaggcccgcaagguccuccuggaaguacccaggcaaaaggcgagagggugaguguggaacucaucgacugucucuagggugcucccaccagggugcucccacuaguuuuccuggaggguguagggaaaaagaaagaagcagaauuagcgguaugaauuagaguuagggcuggacaugguggugcacacuuguaaccaacccucgcacccaagaggcagaagcaggaugagacacaacuuuuaggcuaaccuagauugcacagccagauccugucucgauagauagauagauagauagauagauagauagauagauagauagauagauagauagauagauagauagauaaacaaauaaauaaauauccacagaauguucuuagaggccugagugaugauuauaaagcacaccagauuaggggaagguucggaguggacagaaagggcuuuaggauccucuuggagaggcugggcucuuagagcuggcaugaaauccauucagcugacagcugcugcuccucugccccaccacucggcucugguaacacuugggagccugugggguuggaggcgugguggguggcauggagcucuuuauguaaacugggacacuggggaaggaucuuuuccugcucugaccucucugccuuucuagggcuuuccuggcccagaagggccuccaggcaguccuggccucccuggaguuccugggucuccuggcauuaaggugagcaaggcuugccuuugccaucaccggaggacacguccuugaaugggugcuguaauuuugacucuucugucuuugguucauuuucagggcuccacggggcggccuggcccucguggggaacagguaaguguucucuuucugccaucccagugccugcuagggugagagccugcggcuggggccagcaauggcucaugaggaucucuccaagacucauccgagucuaacuacuaccccucuacucugcuuugucuguagggagaacgagggccucaagguccaaagggggagccgguaggugaaagggaaauggggccaggauauucccuggaggaguggagugccccaggccaaacccuguacaagaccugaagcaugcuaagaacuggaacaccaugaagggugucucccaccuccccuacccugagaacugcuuucugccccacacagggugagccugggcaaaucacuggcgguggagggccaggguuuccuggaaagaaaggggacccuggaccuucgguaagucucaggcuauguggccgcaagugauaagggaguaggaggccagcugggaagugacagucaguucuaaagcaccuuacgucuugucuccucuaacaggggcccccuggaucucguggcccugugggggacccaggaccccguggccccccagggcuuccuggaauaucagugaaggugacagcaugacccucaaauagucuuaugaauagcaugugauucagaccugaugagcucacugggauccauacaacccuuacuguuucuucugaccuuuagcccccacugcucagugccucgcuauuccuuuuuggggauuagguuuugagauaauaucucucucucucuagcccuagcuggccuggaacucacucuguagaccaggcuggccuugaacucacagagaucugccugccucugccucccgagugcugggauuaaaggggugcuccaccauacccgguccccauuauuugucgaaccaaauuugacccaaccacucuccuugcaucuuggggaugagggcaugguuuagagucauggggucauaucugucuuccagggugacaaaggugaucguggggaacggguaagugaggagccagguauucuggggauggcuuggaggcugagucucauggccaucuccugacccacuguucuucccuagggucccccgggaccaggcauuggugccagugaacagggugacccuggacuuccggugaggggccuugggguucugcuggggggcgguggcugaguguuggccuuccuaguuuuuugcuuauggguuuguuuacuuccuucaaggggcuuccuggaagcccuggaccccaaggcccagcuggccgaccuggagagaagggagaaaagguaggagccugaccucuggguggcccauaggcagggccuccccuggguuuuccugucauuuguuucuccuucagggugacugugaggauggagguccaggccucccaggacagccugggcccccaggggagccggugaguuagucuucaaccaucaacuccccaaccaucaacgcucaaaccuaagucucugaacuccccauucauccuuuccagggccugcggggagcuccuggaaugacugggcccaaaguaaguaccaguuguggcuggguguguucagaugugacauguuauaguuugggaccuucccaaggugcuucaguguuccaggcuucaggguuagaagauacagcucugaggagcucaaaggcugugguuuugguaguugggaauccauaugcuuuauuugggguucucugaaagugccccucuucucucuccucagggugaucggggacugacggggaccccgggcgagccuggaguaaagguguguagagccuguggggugcuugggagcauccaggucaugcucggcucugaccucuucuguucucccagggugaacggggacauccuggucccgugggaccccagguaagccccugaccucagugccaacuaacuuauagacucuacguuuccugcuaguucugauuucuuguucucaagcccuucgacccaaucagcaaaugacaccuauccucagggaugcagguuuggggaugcaggccuaugaaugcaggcucagggaugcaggcucuagcccucagccuccagguuccagcucuggguuuucugacuagaacagaacugaucaccauucucucgaugaguuucacucuuuccuaccccagucccauccccugggaccccuuucuaaccuggucccccccacgcgcccacccagagcaacaccaauguuucucuuccccaggggcuccccggggcugcuggacacccuggaguggaggguccugagguaagucugugacuguggaaggggucagggaugaggcuuuccuaggucccucccucccuguuugggcucacaaugucuccauguacaggggccaccaggacccacuggccgccgaggagaaaagguagguuacagguaucauacuuccuggcagaugggacacuuggaccuucaguuccuaggugacccuuugaccugucucugucccuguccucucucccuagggagaaccuggucgcccuggggauccugcaguggugagugagggacagaugggguccugauccaacaugguucuggagcacugauacaaacuguugcucagggcaguggccuuggguaggcccagcuuugugauccccuggaugcuguaaucugccuucagacagcuagccgugucccucugacccuucagacaagcagcccugucccucugauccuucagacaucuagcccugucccucugacccuauaacuauuuugaggucaugagcauggugucaggugucagcccauuuuguauaguccuugccugucugugaccuauaggcagagacauccagcuucauaaaucucugucccuguaggggacugguccuaugauaucuaaucaaggcugagcugugucuguccuguugguuuucaggguccugguggugcuggagccaaaggagaaaagguauguccggaggcuguuaaaggggaggucaaggucacagggucuaucuuggguccgaccuagagaucacaggcuuugccugauggcuggguugugggagugccuggagccugguucuaguauugauagccuuugucaccuuuagggagaggcugggcucccugggcccagaggagcuucuggaagcaaaggagagcaggugacugaggggacagcauguugggaggugggacaggugcaggcuauacaccccugaauacugaucauucccucuacagggcgcaccuggauuggcucuuccuggagauccuggccccaaaggagacccuggagacagggugacuaaauuuugggccaggggcaugugacagaggguggagggaaagguaucuagaauucugacuagccuguugcccuuccugcucucucagggucccauuggccucacuggaagggcaggacccacaguaaguauaugugaucuuggaugacccucgugguugguagagcucccuccucucucaaaggcuaucuguugucugaguugugcaucccccucuuucuuguaucccugacagggugacucagggccuccuggagagaaaggagagccuggucgaccugguuccccaggaccuguuggcccccgaggaagagaugugagaggcuggaucuggggguguccuggguguugggaugcaucacuggggccuuaggaccaagacugaccuucaugucucacagggugaagcuggagagaaaggugacgaggggaucccggugagacuccuccccacaacuguggcuuuugacccucuaccugagaaccaugaccccaaggaccuuaggauccuagcagauaauuguguccauccucuggcuccugucuagccagugcccagcccaucucuguccaugccuacugagucaguuagauccuagcccaccugcacagagugacuuucuucucugucacuagggugagccagguuugccuggaaaagcaggugaacguggccuccgggugagucuucacagggagaaauaaugggucaagcaagagggagggaaaaacuuagacaggaauguaaagagagguucugggggguggggugggggaggugagauaugagaggggaaucuaucuaccaggaagugcaggguggugggaaacucucauggauuuggggaugguggcagacauaggcaaaauagaaguucaugggaaaaccugaaaaugccugaagagucugccucaaaccaacuguucuuuucagggggcaccugggccucgggggccugugggugagaagggggaccagggagauccuggagaagacggacggaaugugagucucaaccuguggccccucaccccugacuucagucccaauucauccauccaguucccaccucauccuccaaggggucacuccuacagucuucaccucccuucucucuucugggagaacuucccaaaggccagcaggaccccaugagcccucaugguacuucuaaaccucuccccaguuguugucugccuugacugaccuccuggccuucugcagggcagcccuggaucaucuggacccaagggugaccguggggagccugugaguacuacugcaccugggcuugugugggcugccaucgugggcauugcucaggcaagagaccuggaaguugucagggagaagcacuaauggccacaugcaggcuuggcugccuuagcugcauucugggaauuggcacuggggcacuuucuggaacugggggacagaguugagccugggcaacucugaacuucgaugcucugggcuccuauugaugcuaguaauuucuuuuuccagggucccccaggucccccuggacggcugguagguguugagcuaggucuggucuucuggcauccccuuuucuauccccuguugccuccuguaucuccccgcccaaccuacuucccucacagacccuugacaccuccauugaucuucaucgccucuuacuguccccauugccccuuuccagccuuggauauccucuugaagugcucauauugaucauuguccuacagguggaugcaggcauugaauccagagacaagguacaggggucuggggguaggagugaggccucauguuugggaaguauccaguggcccuugugacaagauauagcucaagugucccuaguggcugaggugcugaucccuccgccaaccugucucugccacagggagagccuggacaagaagguccccgaggacccaagggugacccugggcccccuggagucucuggagaaaggguaagugugaugagccuuguguguguguguggggggggggcuacaguccuggaaaaccucacucugauucuucugucuuuugucuucagggcauugaugggcuucggggacccccaggcccacaggugagugugugcuuugccccuuaaccugcaccauccauugcucugucacccucuaucugaccuuguucccuccagggagaccccgguguucgaggcccagcaggagacaaggugagaggacuggauggguuucgagaggcagaguuggcucgaggacccaccucagucuucaaggcuuccugccacuguguuuuccucagggugaucggggacccccagggcuggauggccggagugggcuggaugggaaacccggagccccuggccccccagggcuacaugugaguaacaguuuucucaguccuguagcccuuuaucucacuuguuuagucuuagccuugagucaugguaccagcaugcucucuguguguccuuuuagagagccuuccuguguggggcauaucaccgguagguuuuggguucacaggaaccauugccugccgaugggcaaggacccucgucccauguuccuaacuuugaaucucuucuuagggugcuucaggcaaagcuggggacccggggagagauguaagucuggggagaugucaagguggcgggugacuuggggguccaggagaggccucaugggugucaucacaaucaaugagaacagggcagaugguucugcugagucuuugggaggagaucucugucccuaaucagcaggucaccggaccccuugcuggcagcugcuuuacacaucuuaacagaauggucuuggaguucuuccuuuaggaaucaaagcuagagagcccuugacuuacaggaucugggccucagaggauuucuacaagaccuuugagucucuacacuggggaccuucuaggcuauagggugccauguccuaagggacagcucaaagaccuucuuaauccuaacaaugauuuuccccccagggacuuccaggccuucgaggagaacauggccccccuggucccccuggcccuccuggaguuccggugagucuugcuuucagaccaucccuuuagccuccucuacugucaccugagcccuaagaucuaaccaacucucugcucccgcagggaaaggcaggcgaugauggcaaaccaggccugaaugggaaaaacgugaguguguuuaagacagugcugccacaccugccaagaaaggcccacguguucacacagcccagaaauacagacagcacugggagcacacguacugacgucuauagacaugcaccaacaccaaacauagcccugaugugacagugcguuugaaguguguucuagggcacaccugggcagccuugugugaguuagaucucugugugugugucagcucgggaggagcaguguacaacaagauaagccacagccacuuguccaggcaaagagccacaaaaccagguugagaacgacagacaugugggcauggagccauagucaaugacacguggagauauguuaacacuugaacacuacauuuagacaaagauguagugaagcaaagucccauggcucgcccaugacauagcugaggacaugcugacaugcguuuauagcaauugucaccaacauauauaugaccacauauauugaaauacauguaagauuuguagacacaaggcaaaacauacaguuucuaaggaacuggggacccaaguguauauguauaaauucaugcuuagauguaggccaugguaugcagauagaggacacacagaacccuguguacauccgcuaagucacauguagauaggugugcucauaaggcauggacucuuacugugucugcaugcaugugaguuauauacagagagcuacaggaggaaggccugagcauguauacauggaugcaggcacacauaggcugcccuggaacaugcagcacuuugcugggauggacagacacagguacucuaagacacacggccauaaagcuacaggcacagauucaguuacagucaucugaagucuauacagacggucucgaagccagaccauuugggcuuacgggucuucugcccucagggagacccuggagacccuggagaagauggaaggaagguaagccccucucucggaggaugcuguggccucagauuggaccacgucuaaaaagccguaucucccuuagggagaaaagggagauucgggugccccuggaagagaaguaagugcuugguuuuuuuuauauucugugguuccugaucaugacccugugagaaauaugguuccacuccucccugggacccuggauaguaacuguauccuccacagggcccugauggccccaagggugaacguggagcuccuggcaauccuggacuccaggguccuccgggucucccagggcaggucgguccucccggccaggugaguaucuaggguaauuguaggaugugggaucaguagcccauuaugcauccugagcuacuguuuuggggugccuugaccuaugugaccccuucauguuccuucauacuucaggguuucccuggugucccaggaauuacggguccuaaggugaguuuguguaucuguguuggguaaagaguaugaugcggggcugggcaggauuaggagacauguucccacugggucauucucuuuccagggugaccguggagagacuggauccaaaggggaacaggugagguucccaccuuuuucaucugucuauggauguauacauaucccgcccccccccccgccgccuugccccccaccccaccccgacugggucccaguagucaauuucuugucuccagggccuuccuggagaacguggccuacgaggagaaccugggagcuugccagugaguaagaccuggcccuugucugcauacccuggcagucacuucucucucuugccccuugccgucggacucuauggguucugcccucuguccucagucacuugcaccacuggguuccuauagcuucuguucaaggaagcagaggugguggagaaaugccagagauaggccucaccccgaccuccagacggcaagagggugcagacacuuucucgggagacaguguggggcaggagagagggccuucucuugccugacuaguucuuuaccaucuuuguguccucagaacgcggagcguuugcuggaaacugcuggcaucaagguagguuguucagaagcugauggaggguccaguggggcccuaagagacaagcgguguccucggggccucgcggaugaguuguagcagcuucaggccugcugauucucugugccuucaccgcucuuaggugucggcccugcgggagaucguggacaccugggaugagaguucuggcagcuuccuaccggugccugagcggagaccuggccccaagggggacccuggugaccgaggcccuccaggcaaggagguaagugacugcuggaugcucagugggugucccugguggagggcacacucuuacagccacaagcauuuacccuucuccucccccagggccucaucggcuuuccuggagaacguggacugaagggagagcguggagacccuggcccucaggggccuccuggccuggcccugggugagaggggcccaccuggcccacccggccuugcgggggaacccggaaagccuggcauuccuggacucccaggccgggcuggugguucaggggaagcaggaaggccaggagagagggugagccuggggcugaccaggaggggugggggaauggugggagagacuggccuucccacuaauguuggccucucccugcucuuuguauccagggagaaaggggagagaaaggagaacgcggggaucaggugcgugcuggggagacucucugaaggggccuucccggagccuuuaccaguuggcacagccuccuguuuccuucugcagggcagagauggccuucccggccucccuggaccaccuggcccuccuggccccaaggugaucacccagccuugugaccggugaugauacuacccuaagauugggccccagagaccccaaaauuuugugugauccugggaccuguacugauccugucacaccaauauggcagacucaucuucccuucaugauuuuguacuuauagguggccauugaagagccaggcccuggacuggcuagagagcaaggaccuccuggacucaagggugccaaggucaguguggggucaaccugugacucaagccuuaccacgccccucgggccugaccugacgucucaucuaaacagggggagccaggcagugauggugacccuggaccuaaaggagacagggugaggcuuccuacccuacuaugccgucuugcuguggggcaugucgugaguggucugcaucuauauguguacacauggcagagaauggggcucagggcaggauguuuuguuugcaggguguaccaggcaucaaaggcgaugugggagagccuggaaagaggggucaugauggcaacccagugaguucuugccccauaagucacaugugugugagaccauggcucuuacauguguugucauauaugcagggcuggaaucagcacugcuuaggagauaaguucuauccuuggccaucgggggcagggugggcaugaagaagaggggguugggugucaggacaaggugcuuuuagaccaauucuuuuacagggucucccgggagagcgugguguggcugggccugaagggaagccggugaguggauuggccacgagaguagccaaccuuggaucugagccccucgcuggguuuauuucuugagggagggaguaggacuaugccuacuaugugcaaauuucagacauagguguauacugccugacagguuuacuguguguaugucugcgugucuacgagcuauuuguaagggcagaccacagguauauggccaucuguucuggagaggugggcaguauaaggaugcucaccagauauagguccucagaagguggggacaggccaaagugaggccuggaccaagguucaucagccccuuccuugugcagggucuucagggcccaagggggaccccuggcccaguggugaguacauuaaaaccuucauuuuguuccuccuauccugugccaaaugccaaugaaaaacauuaccugcuuucccuggguggggcuggcuccuuucaucagacuguccccaacaggguagccauggagacccuggaccaccuggugccccggugagugauggagaaaugaugguuuuagugaggguaggagagggaggggacagucaucugucauuguugguaaaccaggcuuuguucaugagaauccuggaaccccgacagacaacacugaaccccguguucugccuucacgcuuuuuuuccuagggucuugcuggcccugcgggaccccaggggccuucuggccugaaggugaguguaggcacggaaggggaaugggauguacagaugaagaagggaggggggaugccacacaugucuauucccacgauggagcuaagcacgugguuucugggacuuuuacagggggagccuggagagacaggaccuccaggacgggugagugguguagcuguugggguaggucacaaggacacuguggguuugccacuguccugacuccuccuuccagggucugccuggaccuguuggagcugugggacucccuggcccuccuggcccuuccggccucguggugagugaguugcgguagggauaccaugcaguagguccuguguuccauggguuccacauucucccguguccuuugucgcucaccuuauauggccuuauaucugcuccccacuccccaggguccacaaggcucuccagguuugcccggacaagugguaaguccuggugggcuugggcugggauccagggguuaagggucauuaugcagguccuugacugagccccuucuuuucagggggagacagggaagccaggaccuccaggccgugacgguagcaguggaaaggacggagaucggggaaguccuggugugccgguggguguuuuaggaggguugguggugggcuugugauggagcccugugcccagcuggcuggguaggagcugggcaguggggauaggaugauggagagacuugauuccucacacugcucuuucauaggggucaccaggucugcccggcccuguuggaccuaaaggagaaccugggccugugggggcuccuggacaggugacucuugccucugcucccuacucccugcccuaagccucaguuuccacuuaccaucuggaauggcaggacagagcgggaaccaagggcggcuagaccacuuacugggcauuccccacaggugguggucgggcccccuggagcaaaaggcgagaaggugaguauugaaagaaagggcuguggaacgggaaugagggaaagccgcugacauccucuguuaucagggagccccgggagaccuugcuggagcccugcugggugagccggugagugugacaccccugucaguagggguccuuugacccuugguuuaucuaucuucaugauucuuagcuuucacaagauccuccacauuugacccuggccucaggccuaccuccuuaagaucuguuugugacuaacacaugcaugguccuaugacccuaaugucuuuagggagccaaaggugaccgaggacugccuggaccacggggugaaaaggugaguaugucugggcucccagcauaaguguuaggcagaguaggggugaggccgggaggccaggggcccugaccauccucuaugugcagggugaagcuggccgugcaggaggaccuggggacccuggggaagauguaagucugggcucugggcaggaccaagccuggcuugaccaugaaaacaaagaccaugcuugggguuguucauagcgcugaacccuuacugccuauguucuugggaaguuucugcuuggaacacauagcacacagcugcacgcuuuuugguuuccuuauuuguggacuuccauacuugugaacgccagcuuggcuucugugcacccauccuucaucaugguuccuuaccaugacugaacccaugcaggucugauacugccucaucucccaggucucaggaugcagcaguaucucuguaggccucuccuuggccacguguuucuaaucuuguguuccacccccaucugucugaguauuaaucugugcucacgucuaaguuuccugauggaguuuccauugagcgccacaucuguggcccuuccuauucgccugcucacgugugagcucugugugccuguggucacggcugaacucccacgugucuguggucacaucugggcuucccuuggccuguguucucacaagccuaugguccagucuguguuuccagaggcccguaauuaucugaguucucuugugaauauuuuugguccauagagaagcuugguauuaacauucuuauacuauuaaaaaauguguaugaguguuuugccugcucguuugugcacuaccugcuugucuguugccuuuggaggccagagaggacauuggauaucuuacugaaguuguagauaguugugagccaccaugugguugcugggaauugaacccaggaccucuggaagaacagccagugcucuuaaccucugaguuaucucucuagccugaauuacuuuauauagacacguauuucuuauuuuuuagggucaaaaaggggcuccaggacucaaaggucuuaagguacauuuauauggaagggucuuugcuuggaaccaugggcgugugacucuuuaaaccugaugagaccccucuuucccucaaagggugagccaggcauugggguucagggccccccuggcccaagugguccuccagguaugaaggugagucagugcuccuucacagacuccugaggugggaggaggaguucuggggccugaccugggaaggugucuuugugcgaccacuccuccuuugaaucuguuucagggagacuugggccccccuggugcccccggggcuccugguguuguuggguucccuggucagacaggaccucgaggagagacgggccagccagggccuguuggagagaggguaagagggcuagggagcgcacuggagacuuagccaccucgggaccucugaauuugguagcagguggggaggaaggaacugggucccuuccuuggugguacccagucuugagaggaagggaagggugcuucccaagccgcucuguaucucccuugccccacuuucuauagggucuggcaggcccuccagggagagaaggugccccaggucccuugggaccaccuggaccaccagggucagcggugaguagaacugcccacucaagaguucuugguagggauuaggccaugagguugggugugggggcacuucaagcccauagguuccucaucucacucugacccacagggagcaccuggcgccucuggacucaaaggagacaagguagguggcaugcugcuggcuuuccuaugccucacugagcuccuauaauccucuguccucuacugaguccccuuacuuauuccgguugaacucuagggagacccgggagcaggacugccggggccccgaggugagcguggugagccagguguccggguauguauaugucaccacagccagggcucaccaccccuccauuguaguccuugccucagauucccaaccucugacucaguggaccuaaugucauccaucauucagggugaagauggccacccuggccaggaaggaccucguggacuugugguauguccugucgaggagagcccaguggaaugacucaucccugccugacugcagacuguccuggcccucugguucuccucgcuggcucugguccucuuauucccucucuaguccugucuuacucucugucccuugagcugcccuaguccuccacagucccauaacucaccaucacuguuucacacaggggcccccuggcagccggggagagcaaggagagaagguaagagugugggaggaaggccccugggugaguggggguggugauggauauuguaauuaagguccaggccccucccccagcuccuugagauucacauucuuccacccaauagggcgcugcuggcgcugcagggcucaagggugacaaggugagugugguaucagggauggguagagcaggaaacuggggugcuccugacucuucucauuccucccugccccucagggugacucagcugugauugagggaccucccgggccacgaggugccaaaggggauauggugagugggugggucugguucagauaugaacuuggucucccuuggccauaggaaagaauuggguggggcuggcccaggggacuugagagcucagcuuuccagaacaugaggggcacccagcuccugacacugauuucugaccucuugaccuagggugaacgagggccucggggcauagauggugacaaaggaccucggggagaaagugggaauccuggugacaagguacaaggaagaggguggguuuuccucauggggguccugcaggcuguuagugugugugugugugugugugugcgcgcgcacgcgugugugugcacgcucaugccacagagucagagaaggacaaagcuuacugugcgcaguagugacuccaagguggaagagaggauagggacugugcgggagagcuccaguggucauggugagaccaggaggaggcucuggccuacaacuccauaaggaaacagcaagggggcucuuuggauguuaggggugcuccaaacggugucuuaauucuguccuuucuucuggauacuucuaaaggguuccaaaggagagccaggugacaaaggcucagcuggaucgauuggaguucgaggacucacaggacccaaggcaaguuccaccccaggcuuagucacucacgcucacaccugccuuggggauuucuuauguuaaagggauauugguuuccuuggucauguguguucacacaggcucuaugugcagacugggcccugguuuaacugggucaccaaaugauugcaugugccagcuuaaggcaccguuacacugaaggacuuaccucaaucuguuucccauagggagagccaggugcugcagggauccccggugagccgguaagauaccccaaucccauagagacacccuguccucauaaggucuucauucccauuaggccuuuuagggaccuaauuuuuuaugaccuuccuuuucucagaagcuucugccucuaaagugaacucuaugguggugaccucagcccaugcugacccuuguccccauggcaauggguggugacuggaguccccugccugcacucuaaggugguuucucuugaucccucacuuuccugucuugauccauguuaacaccuuuucuccacagggagccccaggaaaggauggaaucccugguuuccgaggagacaaaggagauauuggcuucaugggucccaggggccucaaggugagccaagauggccugguguuggagaauauggggccuagguucagauuugggagcucagggguguuagcucagguuggaaaugucuaaccaguaguaggagcugguuuuaagcucaaagauucaaggugaaauagaaguagcccuuuuuaaaaauuuuggacccagguucuuuguguagugcaggcuaacuuuaacuuaguauguagccaagccuggacuugaacuucugacccuccugcuucuauuucaugaguacugggauuacaaaugugugccaucacacuugacugagaaguugccuucuuaucugcuuuccuaccuuagggugaaaaaggaauaaagggaaccuguggccgugacggagagagaggagauaagguauagauguaacaaugggagauucugggacuguggggcugaugcgggggccaccgaggaugaggagggguccauggggcugaugcaggggccacagggucugauucgggugcuguggggcugaugcggaggcggggauggggagcacagggacugaugcgggcaucauggaaguugaugugagguugugagggcuguggggaugguguggaugggcugugggugcuggggcccaaggcucacuccucuuccugauaccuccagggagaagcugguuuuccuggucgcccuggguuggcaggaaagaaaggagacauggugagugucaggguacacccuaaaugaagaggggcaguugacuagagagccauccucacauuuuuuuuuuccucuagggggagccuggucugccgggucagucuggggcuccugggaaagaaggccugaucggucccaagguacaggggcucuugauaauggacaugagggggguggagucagauaggacuuucaucacgauagagucaaagaaggcuuugggggaucguguggcugauucugagauuucaggagagguuuggggucaggaauagagaguuggcaugaaaagguagacaacaaagaaggggucauguuguaucagggcagggcuuggguggaguugguguuauggaaucacaguagaagcaguaacagaugcuuggaucauacacuguagagggcacggggacucacaaagcucaaggagauacaagagcaggaugucaagguugaguauuuuucugcuucuucuguuuccagggugacagaggcuuugaugggcagucaggacccaagggugaccaaggcgagaaaggggagaggguaaguugaggucaggguuuguggucuggggggagcauugucucugguagugguuuugucuugaagggguuuuaaacaccaacccuucucuaucuuucugcaggggccuccaggaguugggggcuucccaggucccagaggaaacgauggcucuaguggucccccagggccaccuggugguguuggucccaagggacccgaagggcuucagggucagaagguaaggcuuuccaacugugauguuugacuuaacccuccccucccugauauuuucagacagggucuuacuguguagcccuggguggcuuggaauucucuuuguagaucaggcuagccucaaauucagaguugugcuugccucugccuuccaggcgcugggauuaaaggcuugcaccuccaugccugcugccauuuuguuuuuuaacguuuauuuuuuaaauaacaaucauaucaauguuuugcuugaaagugugucuuuguaccacaugugccuggugccaagaaggcuagaaagggaucacauccccuggaacuggaguuacagaugauuuugagcaaguguuggggcuggagagauggcucagugguuaagaacacugacugcucuuccgaagguccugaguucaaaccccaguaaccacaugguggcucacaaccaucuguaauggaauccgaugcccucuucuggggugucugaagacagcugcaguguacuuacauauaauaaauaaguaaaucuugggaaaaaaaucaaguguuggggcuggagagauggcuccgugguuaagagcacugacuguucuuccagagguucugaguucaaaucccagcaaccacaugguggcucacaaccaucuuuaauggaauccggugcccucuucuggugugucugaagacagcaacagugcacucacauacauaugaaauaaaucuuuagggaaaaaaaagaauaucaagugcuguaacugcugagccaucucuccagccugugcugacaguuaaaccccacagcuguacuuacaaucaagugcuguauugcacucccugccuuuccagcugcuguaaaucuggaacccacaagccaugcuuuaaucucugaaccguggucuuucgcuugccuguauucugacccaaacugucacugacccugcuuccuugguccuuguaucugacagggugagcgaggucccccuggagagagcguggugggggcuccuggugcuccuggcaccccuggagagagaggagagcaggugaguggggauaccccagcguggagucagagauuagcaucaccucugauguccgagaucugucacaaccuggucacaccugucacauguagggacgaccaggaccugcuggcccccguggggagaagggagaagcugcgcugacugugaguuuagccuggguggauuagggcacucagaacccagaccccugaguccuggggcucuugacuugauaaugacuugucuuugauuccugcauugugagauccaugauucauggguucuucggggaccuuguggucuuguguucccaggaggaugacauucgggacuuugugcgucaggagaugagucagcacuguggugagugggucugguguggagucuccuuuccuaacugcaucccgggacaccuagaugggggcccgcaauuccccagaacuuacagagggcaaguggagaccgauggcuaugagcaacacagauguugagaacaaacaugcuaacaggacuuccuuaauggggaggggggcgggggagacagagauguggguggcuacacuguguucugaugacuaucuguguggagggguaguguaaggcacagggcuggucccagcugugacacaagaugauccuggagcccugauucuuccugucaugacugcuuucaucuccuugccuccugcgucuggcccuuucauugcugaucuguuucuagcuucuugcccugagaguucaucuccucuacacucccuccuguccuccuccuccucccuuccuccucuucccccucaccuguucucucuccucacuccuuucucccucccuggcuggcuggcucuaucucucuguauaucuuagcccccaugcaugugccuuuugucuguuucucuuuccccaucuuccugccugccuuugcauuuuguucuccauuucucguggucucauucuuccuuuucugucacuuccagccugccagggccaguuuauugcgucuggaucacgugaguagcuuucuguaucuagaaugcucuucauccaaggcaccaacuagaugccuaucgccuggguccucgccuggguccucucaguagggguguggcuaggguggcugaccaugauaaccaaggaugucaccgccugcucugugcuucaggaccccuccccgguuaugcugcggauacagcugguucccagcuucaccauguuccugugcuccgggucucucauguugaggaggaaggugagcccacagggcauguacaaguugggcacaguuaugcauauggguauucacuagagcacauugaauguauauagagucuacacacaggacacacacaaguuucugcacaugggggagauggucuauugugucccagaacuagcaggggucuccucacagcauaccccacccugccugcaggccaggugcccccugaagaugacgaugacuucucugaguacucuguguauucuguggaggacuaccaggagccugaaguuccaugggauggugaagccgagauuaagggcugggaccagagagguucagguagugccaagcagagcccaccccaccgcugaucuuuagcugauuucggauuccucugauuccccacuauccccggugaccuaaccacuacugacccuagaucucugcucccuacccuuggaugagggcuccuguacugccuauacccugcgcugguaccaucgagcugugccugguggcacagccugucaucccuuugucuaugguggcugcggagggaaugccaaucguuuuggaacccgugaggcgugugagcgccgcugcccaccccaagggguccacagccagaaaacagguaugagcauuuagcucucagugaaggcugcaucuacaccuguuagugcuuggccaagacauucccugagucuggaggaccuggagcagauuccagaucccauaacuggcuacauauccccagccgaggagccggcauggucccucuccauaguccuuuuugcuaagggucccucuugagucagagcacacaccccaucccuccuggaggcuuugguauguuucugugcagacuucacguuggggaagaaccucagagggcugaauguuuucugauguguuccaugcaggugcugccuaggacugaggcccggaugaugcgcuugguggccagcagucccuggagguggcagggucucagccggguccugcugugcuccauuuggugcuagaguugugugugcacgugagcauguauauugugugugcacaugagcauguccacuauuucagugacuugguccugugggucuaaguggggggggacccccauggacaaauccccauuguggcgcccgcuuuccuggcagaugacucacuguuggggguggcugugggcagugaauggaugugacugguguccaaccugccccuugacccgaggcugugauaccauggugcugaugggaggggacggggcauuaaagcugcuguuuuaaaaggcc

SEQ ID NO: 5329 - RNA, 19220 nt, Mus musculus
cggggguuccggaaaccggccggggcggggcaaggaggcuagggccgcgcuggucgcggagguugcggcggcaccguggucuugggcuugguccgucuguucguccguccguuggucugucccgccauggcugcgccggcgcccucucuguggacccuauugcugcugcuguugcugcugccgccgccuccggguggugagccugggaggagggggcggugugugcucccuagggaccgggucgggucagacacuuccccuagcugucucuggaaugagccagacaggaccagccuuggagugcuucgacuugacucccugaaaaccaggggggcgucugcgaaccccaccacugacuucaucuugucaccucuucccuccugagcugauacugacuaccuuuguuguguccuucacggugugaaggcccuaccuguuccaggggcuggagcaagacucccgccugggguuagcuucaggcucaaagacagccuggcccuuccagcaaagacuuucccucucagcuuguuuccuggcugggagccccgccgccuguugccucuacagcccuguguuccaggagaagcugggcccuaaggcuggcuuggggaggagacaccucuuucccuuuucaucauuagagggaugacucacuugggcuugggagggcaggcugggggccuauucggguguguauuggaacaguccccugccggucaugggaaacugauucuguugugauggguggcuuccuggaggaaaagggcuguuuccugagggcugacaugaauuuggaaaugagaacagagucagcccaucccccgagugaggcucugggagagcgggacaacucagacuauagagaguuucguucugugucuggagggucucagccuugaagacccacugguguggacaucaguagaugccaccugucuuuaaucucaacacuccaaaggcagaggcaggaggaucucugugaauuugaggccagucuggucuaggcugugaguuuccaggugaacuagggcuauauagugagacccuacccuaaaaagaaagcaagaagucucacuggugugggcuguucagccuccgaaucgcagccuggcucacuuucauguggugaguuggcuaagccugcaguggucagauagacccauuucauagcaagguuuggcccaaaacaacaaaacuguagcccucuuuaccuccaaguuaacuuuucacagccugucauagcaccucuuccccugggccucauucuaguagccccaaggcacaugcucuaucuccugccugaucuggcugggcucucugaccaggguucaugugcuggcucaggacugcuuccagacggauacuuaagggacugucccaugugagccuugaugagggucuuucacgugggguucuccuguguuuggguuucagguuugcuaguguagccuaaggacacggacaugguguguggcaucuucccagaguguuguaaagcuuguugguacccgguguuggcgcccgucucucaacgugaccuuguuuauugggauuugcuuguuuguucuuggacugagagucuacgugcaagggucucacacagugccacacuuucuaauaccaccacacgccuagccuagggauaagugcuuuauggagucuuguguggggaguguuauugugaauggguuaggauucagccugucgguagaggcuaagguucaagccucucucucuuucucugcacuugugcccgacagguaaggcugcuaugcaggucaugaggauuaaauauuggacaguccuguggcuaaaguuggcucggguguguuuguguuuauuuguacacuuucugggcucggcagcuucugggagguggccaggaauaaggccuugaaggaagagcggagucucaggugagggacaggcaagagaggugaggcagaaggguaaucgccgagggccuuugcaauggacacucugccuuggggggcggggggggggaguguguccuugauuuaaaaauaggggauucugagagcaguaaguagcccaaucagauuuacucuuagacaagucaggcuucggccaggaaaccaucagacugccaagggaugcaagguaccuugcuguggacuagaggacagggcaaaggcuuaguaggagggugguccccugaggugaccuaaagcaugcuugugccugguggcugcacaggggaaaucucugccauugccugggguguggaugggaccugaccuaugggacagaggagaacaagccugucucucuaugcuucagcccauggugagcugugcaggcccuuuggugaagacaauucgaucccaguguucuguccugauuucuguugugguuccuguuccaaccaauacugcugcucggacgugcugaggaaaauccaguggaaugaggaaauguguccugagccagaguccagguagguacguggaggggagggggaagggggaggaaccucaguccauucccuggagagcgccuggccccucuggccucucaagauaguggcuguguauugagccagacuguuugaggacuccuauuuuagauaggacucccuacuccacucuguccucccuccuccccccauccucaagggcucuguuuuacucagccuugggucaggcucaguggccucagcugcuuggcucugggggaguacuugaacccacagguccucggggugggcaccagguuaugggaguaccccacauuguguauaagcuguggcucugugucugccacacaagacgcagggcaugugugugugugugugugugugugugugugugugugugugugccccgagagagcucggcuauguccucccagcacagcuuguguguuuggguuucaucuucuucccuauacacuguggucauccgugaggaccaagcugugucucuccgcaucaggcucuguuuuccuuugugcuuggccacagcuugagaggcguaguggucguacuuagcucauggcaggcagccaucaaugcucugcacaagcccagaccacaccaucuaucugugucugcuucagucuguucccuucccaucccaugggcaccccagucuucuguguuuaagguauacacuuguguuugcauucuuuaaaagucuguauuguuuuauggauacaucuuugggagcgggcguuccaacgaaugcccuuacuguuugaccucaguacaguguucacagacucagagcugugucauucucuaaguccaaagcuguuaacacauagcugcagcagugggcaucuugguaccccuucuggaagaaguucuuaaagauaugcauggaacugucaggucccagagaugccaccuagucacuaagaauaauuguugguuguccuuauauuacagaugucuuucccccccacaccccagacacacagagagggucuaacuauagcucuggcuggccucagauucagugaucugccugccucugcucauugagugcugagauuaaaguuuaugcaucaccaggcuuggcuuauagauacuguauuuaaaauuuuucauuuuguuaauuuuuacuacuuaaaaacccuucuucuuauuguuauuaucguuauuaguuuuguucuuucuuucuuuuuuuuuuuuuuuuuuuuuuugauuuuccaaaagaucuauauuguggccuauaaaaggacauuucuuuuauuuuuuuuaaauuuuuuaaaauauuuuuuauuacguauuuuccucaauuacauuuccaaugcuaucccaaaagucccccauacccccccccccacuccucuacccacccauucccacuuuuuggcccuggcguuccccuguacuggggcauauaaaguuuguguguccaaugggccucucuuuccagugauggccgacuaggccaucuuuugauacauaugcagcuagagacaagagcucugggguacugguuaguucauaauguuguugcaccuacaggguugcagaucucuaaagagcuaaagcuccuuggauacuuucucuagcuccuccauugggggccuugugauccauccaauagcugacugugagcauccacuuauguguuugcuaggccccggcauagucucacaagagacagcuauaucaggguccuuucagcaaacgcuugcuagcguaugcaauggugucaucguuuggaggcuaauuaugggauggaucccuggauauggcagucucuagaugguccauccuuuugucucagcuccaaacuuuguaacuucuuccaugggugauuguuuccaauucuaagaaggggcaaaguguccacacuucggucuucguucuucuucaguuucauguguuuugcaaauuguaucuuuuaucucggguauacuaaguuucugggcuaauauccacuuaucagugaguacauaugauuugaguucuuuugugauuguguuaccucacucaggaugaugcccuccagguccaaccauuugccuaggaauuucauaaauucauuccuuuuaauagcugaguaguacuccauuguguaaauguaccacauuuuuuguauccauuccucucuugaggggcaucuggguucuuuccagcuucuggcuauuauaaauaaggugcuaugaacauaguggagcaugugucuuucuuaccaguugggacaccuucuggauauaugcccaggagagguauugcaggauccuccgguaguacuauguccaauuuucugaggaaccgccagacugauuuccagagugguuguacaagcuugcaaucccaccaacaauggaggaguguuccucuuucuccacauccuugccagcaucugcugucaccugaauuuuugaucuuagccauucugacuggagugagauggaaucucaagguuguuuugauuugcauuucucugaugauuaaggaugcugaacauuuuucagguacuucucagccauucgguauuccucaggugagaauucuuuguuuagcucugagccccauuuuuuaaugggguuauuugauuuucgggaguccaccuucuugaguucuuuauauauauuggauauuaguccccuaucugauuuaggauagguaaagacccuuucccaaucuguuaguggccuuuuugucuuauugacguugucuuuugcccugcagaagcuuugcaguuucaugaggucccauuugucaauucucgaucuuauagcacaagccauugcuguucuagucagggauuuuccccugugcccauaucuucgaggcuuucccacacuuucuccuuuauaaguuucagugucucugguuuuauguggauguuccuucauccacuuagauuugaccuuaguacaaggagauaggaaugacuugauucacauucuucuacaugauaacaaccaguugugccagcaccauuuguugaaaaugcugucuucuuccacuggaugguuuuagcucccuugucaaagaucaagugaccauagguguguggguucauuucugggucuucaauucuauuccauuggucuacuugucugucacuauaccaguaccaugcaguuuuuaucacaauugcucuguaguaaagcuuuaggucaggcauggugauuccaccagagguucuuuuauccuugagaagaguuuuuacuauccuagguuuuuuguuauuccagaugaauuugcagauugcucuuucuaauucguugaagaauugaguuggaaaguuuuguucuuucaagaccggcuucuguguaguccugcuuguccaggacucacucuguagaccaggcugcccuugaacucagagaucugccugucucugccuacuaagugcugggauuaaaggugaacaccaccacugcccagcuuaaaaacuuaguuuaaguuagggucuauauagcccaagcuaguuuuggacagaguauacauacaaggaugucucauuccuuugccuccaccucccaaaugcuaggauugcaggugcgcaccacuacaccugguuauaugcaggguugaggauugaacccauggccuucugcaugugaggcagguacacggccaauuuaacugucccuuuugacguuuaugaaauuacuuauuuuuauauuauguauauagguguuuuaccugcauguauuucuguguauuguauacaagcaaugcccucaaaagccacaauccccuggaacugaguugcagaccuuugugagcugcccugugagugcugggauuggaaccaggguccucuggaagagcagccaguacucuuaacuacugacccaucucuccagcucucuuuucucuccucucucucucucucucucucucucucucucucucucucucucucucccccuccaucccucccucccucccucucucucucucucuuucuuucuuucuuucuuucuuucuuucuuucuuucuuucuuucuuucuuucuuucauacaggaucuugcuggguuucccaggucucaaacaaccuuucucucuauuacaaaauaguuggaacugugagugcaugcauuauacccagcuuaaaguaauuuuuuaaaaaccagguucuuauuccauuuagauguaauagcuuaccuaggauguagcucaguagaguucccagcaagaaagccccagacuuagcaaggcaagcugagagagagagagggagagagagagagagagagagagagagagagagagaacacgggcgcacacacaugcacguggcucaaguauauauagaggcuagaggaugaccucagauuugauucuuaggcacuguccguuuuaucuuauuuauuuaagauuuauuuauuggggcuggagagauggcucacagguuaagagcacugacugcucuuccagagguccugaguucaauucccagcaaccacaugguagcucaauaacaaucuauaauguaaucugguguccucucuggccuguagacauacauccaggcagacaguuauauacauaauaaauaaauaagcaaauaaauaaguaaauuuuauucuuucuaaagauuuauuuguuuuuauuuggugugcaugggugguuuugccugcauguauguaauugcuugcauguauguauguacaccauauauauacuaugaccaaaaaguccagaagagggcaucagguucccuggaaccggaguuaaaaacaguugugagcuaucaguuggggcuugggaaccaaagcugggucuuguauaagaacagcaaagugcuuuucaacacugagucauuucuccaguuccugcauuuauuuauuugauuuuuucuuuuauuagauauuuucuuuauuuacauuucaaauguuauccccuuuccuaguuucuccucugaaaauccccuauacccucccccagcuucccaacccacccacucccaauucuuggcccuggcauuccccuacacuggggcauagaaccuucacaggaccaagguccucuccucccauugaugaccuuugauuuaaaaaaaaauuuuuuuuauuuguuuuacguauaugauggguacauuguagcuacauuguagucuucauguguuugcugggaauugaauuuaggaucucucuccagcccaaagauuuguuuguuauuauaaauaaguacacuguagcugucuucagacacaccagaagagggcaucagaucucauuacagaugguugugagccaccaugugguugcugggauuugaaccuucagaagagcagucggugcucuuaaccacugagccaucucuccagcucccuacuuugacuuuuugaugcagagucucuugauguaguccuggcugucuuggaacucuauguagaccaaauugaccucaaagucacauagaucugccugccugccugccugccucugccucccaaaugcugggguugaagaugugcaccaacacauccgggccaccagggggcaacaaggcuucagaaugaucuguaacuuggaaaagcaaggcagagacaaaucuucagggagagccugagcaucgcauaccuucucaccggugcagaccaagcugggagcgauggccaggcagcuuccacggaccuggauuguccuugagguccuuugucuuggacaguggugcacaauggcauagcaccaugguuggguccucugggagcugagucccgcagcauccccucagauccuugucucuggguccuucaguuucaacuggaagcauuucugcuggguuaaccugguguacacccguucuaaucuccauaucagguggaauucagucuuuuuuucuuuuuuauaauuuuuaaaaagauuuacuuauuuauuauguauaaguacacuguagcugucuucagacacaccagaagagggcaucagucaccccauuacagaugguugugagccaccaugugguugcugggaauugaacccaggaccucuggaagagcagucagugcucuuaaccacugagccaucucuccagccccugacuuuuuuuuuuuuuaauuagguauuuuccucauuuacauuuucaaugcuaucccaaaggucccccauacccaccccccaauccucuacccacccacucccccuuuuuggcccuggcguuccccuguacuggggcauauaaaguuugcaaguccaaugggccucucuuuccagugauggccgacuaggccaucuuuugauacauaugcagcuaaagacaagagcucccggguacugguuaguucauauuguuguuccaccuauaggguugcaguucccuuuagcuccuuggguaauuucucuagcuccuccauuaggggccgugugacccauccaauagcugacugugaucauccacuucuguguuugcuaggccccggcauagucucacaagagagagcuauaacuggguccuuucagcgaaaucuugcuaguguaugcaauggugucagcauuuggaagcugauuaugggauggaucccugcauauggcagucacuagaugguccauccuuucgucacagcuccaaauuuugucucuguaacuccuucuauggguguuuuguucccauuucuaagaaaggguaaaguguccacacuuuggucuucguucuucuugaauuucaugcguuuggcaaguuguaucuuauaucuuggguaucuuaaguuucugggcuauuauccacuuaucagugaguacauauugugcgaguuccuuugugauuggguuacuucacucaggaugauacccuccagguccauccauuugccuaggaauuucauaaauucauuuuuuuuaauagcugaguaguauuccauuguguaaauguaccacauuuucuguauccauuccucuguugaggggcaucuggguucuuuccagcuucuggcuauuauaaacaaguccagccccugacuuauugccuacaauauaaauaggcugagaauucuccacaucuucgggguuguuuuguuuuuucuuuuggggggguuguuuuguuuuguuuugugcuggggauccaaccucccugucucccuuuuccaaaucuugaaguuuugauuuguucucucuugaauuuccuaugcacaaccagggcagucacaguguucccucauuggcuuagacaucccucagugucuuucuagggaacuucaaaguucucugaguugcucugucuuuagugucugaguucuuccugguaauuucacuguuuacuuuuuuauuauguuuggugugcgcgcgcgcaugugugugugugugugugugugugugugugcaugcauguauguugugccuuccauguggagggccgauguugacuuucacaagucaauuuucucccugcauguagguugugagaucaaauucagguucucaggcuuguuagcaagcaucuuuacccucugagccaugcaugucauuggcccaaccauggcuuuugccaguccuguguuuauucuuuaaacguguuuagagcuacauuauuuuuaugugcacggacacacaaaugcccagugcacauguagacaucagagaacaacugucaggagccagcucucccuucacugugguauuaaaccucugcccagguaaggaauucaagugaggcuuagaggcaagagcucucucacuggucuagguguuccucuaacuguguuuugucauuuggcaucagugucugcuaaucucaugcucagagccccgugagcauuauuuguuuuauuuugccuuuugaggcaggguuuuuauaacucuagcuguccuggaacucacuauguagaccagaccauccucaagcucacagagauccuccugccucugccugccgauggggacaauaguaugugccacuaugcccggcccuuggggauaauuuucuugucacuuccucuuguuuuuuauucauagcacucuuaguguucaugaaaguuuuugauuaucugucugacauuccaguuauagaacugauugcaggaauguggaauucucuuucuagaggauuuauguuauuuccugauguuagccuaagcacagagacucaugauuagaagggaagacuauucuuuucucccuucuucgugacaaauguuucagguccuguccaaguguauagaaucaucauggcccauuuugugggcuuuaccaccguggccccccaaagcuucuggcaaugaugccuggcuuccuagauaucccuccauuacauuagggaaggccacuaggaggacuuggguggcaggcuuaucuccacugucucuucccugcucucugaagacuuugcauaagauuuuuuuuuuuuuuuaaagauagggucuggguggggcuggcgagauggcucaguguuuaagggcacugucugaucuuucaaaggucaggaguacgauucccagcaaccacaugguggcucacaaccaucuguaauuggauccaaugcccucuucuggugugucagcgacaggauguucauauacguuaaauaaauaaaucuuaaaaaaaaaaaaaagauagggucuggggucgaacaugguagugcacaucuuuaaucccagcacacaggaggaugcaaagacaguuggaucucgugaauucaaggcaaguuucaggauagccggaucuacauagcagggagaccccaccucagacaacaaaauagggucugggauauuccucucuucaaacccuuuucacucuugggaguucuacauuuucauuugcucugcuuuaaagaaaggaaauggggcuggagagauggcucaguaguuagcacugacucuuaagucuggagaggacugagucuucagaggacuggaguucaguucccaacacucaccugacagcucaacugucuguaguuccaguccuaugggguccagugcaccuccugacugcugcaggcacaacaugcacucucauguaguccagaauggcaaagucauccucgggccccagugcaggcaggcaccuaucuccauaccucccaccugcucgaaacuuuaguugcucaguuacaucuggucccugcuaaccaucucugaccgccagccuguaggagcggccuguguggccacuccuuugugagaucgcacauggcuggucaccuuuucuccaucagaagcauggugaacuuugcucucaucuccuugugucucuccuuuccuccagggacccagaagucccgccuacuccuucugcccagcaauuggcccaugaccucuuuacugauaggucaagaaccaacuggggaacaggaccuuagcaucagcccugccuguaaaagaguuuucuauaguuuaguugaggcuggcuuugaacuugcuaaguagcuaugaauaacuuugaauucugauuuuccugccuccguuugcugggauucuaggcauguauuaaugcacuuagcucccccaccccauauagggccauacucuguagccuaaaaugagcuugaauucuaggcaguccucugccuccgcucaugggugcuaagguucugagucaccacuccaaccgugucuugcuuauuuuuuguccuucuugauaaagucuaguaaugaaauucauuccccucuaagaacuaguuaauccccguccugacuacugucuguuuuguucaggauggggucucuugcaacccaggcuugcccuaacuccugauuccccugccucuacuuccucggggcugggauugcaggugugcauugccacggcucuuauuuugguaaacuuugaccuaauaguauuuucuuuuccauucuguauaaccacaaggugucucuaucugucucucuucuucucuuccucccuccccuuuucuccucuucccuuccuucccuucccuucucuccucagaaagcaucuugccauacaguccaggcuggcuuagcucuugcgacccuucugccagucuccagagcugaaauuucaggcauuugacagauuucaacuuagacuguuguuuucggaagaguugcugucuuuucucccaccccacccccaccccacacccccgcauuucuuuuguuuuuaacuuuggggcaacguagcccucacucuugguuuccacccucauccuguuguggucagagcagguacuuuccagaucucaaaguuugagaucugcuguuucuuggccucauaugcgcuguguccuguagauuggcuuuagugugcccaagaagaguguaugguaccccggcuugggaucccaguguguagacugcccauccucggaauguccugugugccccagcgcgguguguuguggggugcagguggggauggaguauguuccucaugcgauuucucuuuucuguuagcagauuuuccacccccgcggaggagacacccgaacaucuggguucagcgcugaaauuucgauccaguuuugacagugacccuaugucaggguaaauaaggccugugggcugugucuguuuuccuggcagaagugacaagggcucaggugggcuugggaguggccucuauguccuaagagggcacagaaucauggggauugugucccagggaaguagugaccauguuugcccacugggaccuuugacccuccuaggagccagguuuccucuguaugcuggggagagagaugauguggguuggguaacugguuggggacugauaguugaagguccgggaugggaucuguauggaccugggggaugcgguggguugguagaggugacuggagaggaagugacacuugguagaggcuacaaugcuggcagugggguggccaaugucuguggcagaaugauggcuaugcuaauagggaaacaaugugagguggugauguggucaugggugaaagguggugauguggucauggguggaagggggugaugcggucauggguggaaggugguggugauguugaaucaaggugcugagacgacagaagagccucagucaccaugugaagcuuuguuggugucugucacugugcuggcuggcuggcgucucugucucggggagccccacacucucguagcccuaaacuuccuagccaggcuccugccuugcuuuucuuucuuccuuuccucccucccuuucuuccugagacagucuuuguagcccaggcuagccuugagcuagguguguagcugagaaugaccuugaacuucugaccuuucccagugauugaauuacagaugugugucaccacccuuagagguugagcccggggccuuccugugugguaggugugagaaacaggacccccacucuauauuaacaaauucaagagacuagagaaaauaaaacagcuuuaaauauaugauucugcagggcaggguccggcauagaaaaaaggccaagacugguauggcugcuagcuucaggggaggggccuagugccaccagucuucugugacucuuagcacucuaagaacacagcacacuaaaaacagaccggaaaaacuuaucucuuacauaggcaagaacucuguuaacugagcuagaacucuaguguuuuuguuguuucuuuugaaacaggcucuugcucuguagcccaggcuagccuggaucucaccauguucuuugggcuggcccagaauuuguuguccucuugccuccgcuuccugauuguuggaauuacaggugugagcucccauguuaccugccuacacuggcaucuugcucccauccucagccacagaacaagucucggaggaaaagaacauggggcaccauggcaggcagccauuggccaugacugugacuuccugaccacagguguugggaggguaggguggagguggguuggugauguucagacugugacuuccuggccagagguguuggaaggguaggguggagauggguccgugguguucagcagcugcccgccaguaaggaagaaaggagagaauggacagacaaacagacuuccuuggcccaguccugcacagcaacgcuagguagacauaaccaucacagggaugagggugcagaggccuugccuugaggguuugggaggaugcacagcaguguuuggggaacaguggcagggagagccaagaugaaggcugggguugagggcaaggaggcggcuggucugaagugccggacugcacugaagugggguuggcaccccgguacugucauggcaugcucagcagaucaaagagugaaucaagagugugugaugcauguggaccgcucuguggagaccacucaggggccucacagugugugaaaaggcugcuuucuauggguggagacagcuggaaaugguggggaggccgcaugcuaggaggaagaucggguuucugggauuucuuuuucuccuauucuucagagccucagaauugugcacagaggaggugguugaggggcaggucuguccacagccaauucucuucuuaaagagacacucaacuggacaccuaagugcuaccucuucugcugagggcacuguuguccacaggguggauuucaugguaggguucagucccugcugcccgacaguggcuugggaccccagagaagcuccccagaggaaagaugcaggggccugaggucugaagcagcucuggccccacguccuaccauugaugguucucuuugguucuuacccucugagagucacaggucacaacaguggucuggaagagcacuucugccaagccccaagugucacacugugcauagguuaugucuuuccucgguguacugaacuuuguuuuuuguuuuuuuuuuuugggggggggguuguuguuguuguuuguuuguuuuguuauuguuuuugagccaggaucucacuagguggcccuggcuggucuggaacucaaacauagacaaggcuggccucaaacucagagauccuucaccugucucugccagacggguaucuacauugacaggucuuuaauucugucauagcauuagccaaggagccugguguuuucgugguuaagaaaugugucgccuugaacuggugcuuugagccgaggucugagagaagagcggguauuauuaaguaggagugaggguuguggggaagaccugcguguguagagacccugaggcagaacauagcugggugcuuggugaucugucuagacuugugaguccuuggccccaccuggcuuuguggguccugcaaagaguaucugauuuuuuuguuggguuuuugggggacagaguuucucaguauaguccaggccugccuagaauucacuauguuguucacauuggcccgaacucuuaauccuccugccucaacagccuccugauuucaggcauuaccuguguggucgcacaccauacuaaauuuuuuuuuuuuuauaaguuuuacugccugguuaggcaaacccuugguuuuaauuguuaacuauacuuacucuauaugcacaggaagguagguacacacacugucaccagugacuaugaaacagcucccugugguccuaggggcugggggagccucaggcacuagagacagcacccaccggggaaacgugaucagaccuggcaggguuauguuguggcuugggagcagaggcaggaaccacugcaggcaucugcuucugugucagccagaaccaggguccugcccugccuaggcaggcuucuggggagugggucaggugggcagaauagcuuagaggcuggggcuagccuucuuuuagaggccugggaacacagggcugggaaagugucaccccuggggccucugcuuccccuuccagcccuugucagugccugccuggcagcuggugcugagcaugguguuugagucgugcugugucuuuaagaggguggcuacagcccggugagucuguccuuccugcugcugacgucaggaauggggaagacuaagggauaagauucgauuuccuuuucuuugaaaggggaggagauugaaacugaguggccucugaugaaaagaggggaaguccugggcugcaggagccccuugagugaaggcggaggcuaacauggggugagcaggcacauucuagagagaggcagagaaauacugaaccuuccacugcaugcaacggaccaugcgaauguguuuuuuuuuuuuuuuuuuuuuuuugccuuuuccugucucugauugcuguggagacaucuauggucucauggucuugucuuggugaaggcuccuuuuggaagccugaagcgugggggagucugucccuuggccaagaggcccugcuaaggcucuggcgcuccccugaacuccgagccucaugguagggugggguggcacuuauguccuucuucucugaucucagagggguagagcccuggacuuagguuuugaauuugccuguugcaguugccagacauuugucuucuauuagcauacagccugggcccugggaccaugggaaaaaaaguugggggcucggugugcuauuggcaguaauuugggugaucugccagucuaugcugugugcugucaaagggcagacccucuauucuaugggugcccagguugggcagggaggccucuuccaaagagcacagccgccucccaucuagccucccugggauggagcuaugcuuguuaaccacgggauagccugggauaucacacagccuguaugagcugcaguuccucagcauguggcagccugucuugacucggaucccaucuugccuggcuuguggcauaugcuugacagccauaugguugcuugguagggagagaccagguguguggguagguggguacaggaugcccgccugggguagggguguguguguguguggugcggguggcuuuacauaaauucucaaagagcagcccuguuguauacaugaggaaucugaggcugaaauggacuuauaccaaacaacuggggaguuucuuaagagucuuuugccaaaagggguccccugggaacaggugaugugaggguggccggucauggugaaaggugguuacacuggcucuuuggcagguucggagcgaccgucgccauuggcgugaccaucuuugugguguuuauugccacuaucaucaucugcuucaccugcuccugcugcugucuguauaagaugugcugcccccaacgccguaagccugccuuuaccgacuugguucacccaugccgauaccagaguuuaccaacucgguccacccgugccgauaccagagcgggaaaggguugauaaccaggaaccuguuuugacuaagcgggaggggcaggcuuggccucuucuggccuagggagcuguaagauuuuaacuaaucaggauucucguugcagcugucgugaccaacaccacaacuacuaccgugguucaugccccuuacccucagccucaaccucaaccuguggcccccagcuauccuggaccaacauaccagggcuaccaucccaugcccccccagccaggaaugccagcagcacccuacccaacgcaguacccaccacccuaccuggcccagcccacagggccgccacccuaccaugaguccuuggcugguaaguaucacuguggauucaguaaaccugcauggucccccaacucaugccucugcuccucggguccuuuccuccuggcuugccugcccacuugcguugcagcccaguguccccacagcuaacccauguccuuucuccuuccaggagccagccagccuccauacaacccgaccuacauggauucccuaaagacaauucccugaaccugcccccagccucuuuggcugccauuuaugucgugugugagugagugauacgcagaguucuuuacugcugucuguggugugugugccuugucuagacauguggcuuccucugcuguugaccagguaggcgcaagucuuaccagugugggucgggaccaaccuguuuucuuccucacuugaaauuguacuuucugaaauuucaagcaaauuaaaaacaauaagguaggagguauuucccacgucaccccaaggugaccagccauggccugucauacuuaggagagcaagcuuuuugcggguacagagcaggcuuugggggguaaccagcuagcugcugcuaggccuuuauucccaggguuuggcugcauuggcagugaggcagguggcugggggugacaccaggugacaaggggacucaguggcagggggucacaccaggcagaacaccauacacucuccaucagcugucugucuggaugucacuguccuucccggggcuguauagagggccacauguguucacuauucaggcuccacugggggaauuuuccuaccuuugcuggcuuggcuccugcucccaggccagggaccucggucugucuacuacacacucugguuucucccugcacugucuuuuuacuguuagccaaacauuuugccuguuuucugucuccagaugugugauaauuggugugagguugaaaucccugguuccuggaggacagacaaccugaccuccgacugucaguuucccuugacaccaucuucauagaaauaccugacuccuguaccacaguccaguuugucccaguagcagggacaccaaggccaauggguuaucuggaccaaaggugggguggagggccuaggugguaucuccggcccagaugugaauaccuccauauucccuguugguuccuguuucacuggcuguuuuagcuuuguguugauugguguuucugagcauucagacuccgcacccucauuucuaauaaaugcaacauuggacccgcuuccccuuucuucagcgccuaggcagcuggccuuggcucuacaccaaaaacuauuucugucuac

SEQ ID NO: 5330 - RNA, 16195 nt, Mus musculus
caggcuggggagacgcuggaaggcgaggggaacggcggcgcgcgggcgguugggccagcucaggcuuucuguggacaaggcugugcuuggcgucuucggaugcugcggguugaagguagucauggccgggacccccgcaccgaacagccacaggaaacagaguggcggccuggagccuuuccccggucugucucgauccauugagaacccuccgagcaagcgggcccggagcuucucugagaccacagucccggaccccgaagacccauucggugagcacgcggaauuuacugcggacgaccuagaggaacucgacauccucgcgucacaggcccugagccagugucccgucgcgccucggaaccuguccagugagugccugaggggccuuuucccccggcggguggugcagaccucugauuuggcggugagacauccagaauguuaaauggccucccauuuagaugguaugcaccccauuguaacccuugggcagaagagcauuagaaggcgucugacagaggcaagagaugaaagagagucuuacacaaaaaugccaguugcccaaagguuaggcauggcaaacaggcaaugggcaagaaaugccaaagcugcuuuucuucuuagagcuuacacucuuggggaauaaguuaagugucaggaggguuugaugggcaccuugcgaauguacuuagcacuuacagcaucugaaaaauaggauuaucccuggaaauguggcuggcccuccaucucuccagcaauauugcauggaaaaccaggcauuggaaaacacucauugcugaccagcugucauaugcggcagugguuagacgcaacuuuccacgaaauggcacaaagcaaugcugccucccccuuccuuggcccuacaucacccgguacucuaccuuacuccaucccuggagccccaccucccccuggaauguauccauuugguucaccaucagucuuuaaaaccagcagauccuaugccuaacauguuguaguaaauaguaguuaugguagagucacagccagugcaaucucuguucagcuaugagcugagagucuagaaagugggugagguauaaagcgagagaauucagauaugcuaugccauaaggauucuuuauguguuuauaccaugcucggagcuguuaccugggucuuucucaacuuggcuuucaagagugacuccuucugcauuuuaugacaaagguggauacauacugagccccgcaguauacaugggauuauuuuuuccagacagguucucgaucucuagcaaggcuagccuugaauuugagauccccauagcucuacuucacaaguguugggauugcaguucugugccaccaugcucaaccuaagggcaacuacuuuuuauacaggugcucauaagguccgccgauuagauggguuaccaaauaguccuauaaggaaaagcagagaagauauuccaguuaaagauaauuuugaauuagaaguacuucagauacaauacaaagaacuuaaagaaaagguaugugacuuuuggguuguuuguuuguguuuuguuuugccuguuugguuguaaugcugagaauugaacucaggacuuuaccuucacacaugcuauacacagacacucuacuguuaggcuauccuuccagcccuaacuuauuguauuugcagcuaauucauucauuuugguauuaaaaagcauguguaaaauauauaaaaacuauaaaacaaacaucuagauuuauuccucugaaaugaaagaagguuggggaaagaaugccugaaauuuuauuuacccuguguauaucccugagccuauauaaguuuauaugcacugcaugcauacaggugcccaugaggucaggggugcuggguccucuggaaucaacacaacuggugugagccaccucauauggguaaugggaacggaaccuggguccucuguaagagcagugagugcccuuagcugcuaagccaucucucuagccucuacagcuuaggucuuuaucugaggaacaugucaucuuagcgguugauauuuguuaguuuugcaggcucucauacaucuuucaccuggccaucuguaggugccuaagaaagccagaaauccaacaugggguuuuagucuguggaggguaugagccguaauguuaaagcugaaagaaucuguguguaaguggugaauggauucugaaacuguucuugcugaauaucuguugacugggcguaauuuacagcugaaagcaauggaagaagaaauccuaauuaagaauggagaaauuaaaauuuugcgugacucucugcgucagacagaauccguucuagaagaacagaaaagaucacauuuccuucuugagcaagaaaagacucaagcacucagugaaaaggaaaaggaauucuccagaaaggugagccagagcauuugugucacgcgcuggggacaguagugucaccuguccauccacugacugacauuagaaggagcagccaaggccaggcaugcugacauaugccuuuaaccucaagaggcagaggcagguggaucucugugagcucuaggccagcguagacuacacagugaauuccaggccagucaagugagaaacuuucucuaaaaaauaaacaaaauagaaacaauaaacaauguugccuggaaacauucacccauuguuuaaguacucgcugcccuuagugaauagcauguaucuuucuuccagggucugcauuuguuuuggaaaaagacugagaugaaacucugcuuugcugugguccugauucuuggcaggaacaaaucacuagcuuagaacuucuaggauaggcuugaauucgagcuccuugguaagucagaaagucaguugcuucugcuuagccagaaggaaauauauuagcugccacaucaaagucuaggaauuuaggaacauaguagggcuucagaugauguaaaccagaaaucucagauucacuguuaugaaaccuguugcucuaucagcagagguucugacuagauagacucauacauuuauuuuuuucuuuuuuuuaaaaaaagauuuauuuauuuauuauacauguaaguacacuguagcuaccucagacacccuagaagagggcgucagaucucauuacagaugguugugagccaccaugugguugcugggauuugaacucaggaccuucaguagagcagucagugcucuugacugcugagccaucucuccagcccaauacucauacauuuuaaaacuccagagcacaguuaagacuugggcuuccucaguugggcauaaauugggaggcugguacaucaagguuaccauagguccaaggccagccugggcuauauaguaagauccuuuuucaaaaagccaaaugaaagauaagauaacgucaucucagaccuaaaauuuuuaaagaagcagacuauuuccagaccaguucuaaaaccagagaugauaagucucauuuaagucacagucagagguagggaagggagaucguguucaaagaaaacugcuagguaccagucucugucaccacuguccuuggagcguguugaugcuugagucaggggucuguccugcacccccuuuccaguguagggagccaugggcagaagcuucagugucugccuccaugaccucuuccagcagcuuuacaugcacacacccuuccuuguaaccaccaccgaagaaagccuguugggaagcccaaacgggucuuuuuguuguuuuguuuguuuguuuguuuuguuuccugaucuggugauacagcccaggcuggcccgaaagucacuccguagccgaggauguucuuaaaguucucagucuccugcuucugccuccugaaugcugccuuggcgggcauaacugcugccaugcccugcauauucagugcuggggauggacccuaggcaaaccccuuucaucugagccucucuuccuuuuccuccuucugcucuccugguacaugcaucacuuacucuauuuccuaacuuacuuaagauguuuugcccacuuaugacccucuuucuaguuuccugacacacaaacacaccaaucacagcacgcacugacacacagguuuugauaaagccuccagaugaucugcucaggcuuccaagaagaccuagaaucucugugccaccaaguacuucacggaugauacgagcagccacacccugugagagcugaagaggauugagaguuuggcagcaguuuggggagcagagcauggggugggggugggggacccacgaagcauguuauugcugagauaaggugucccaccagcucuguacagccgucacuuuuucucccucagucccagccaagucaguaaagcuaaacagguaaugggcugguuuuugaauccucguaaacugcuuccacaguagaaucugcuacaucuuucuagaguauuuuuucaagggaacaguggcuaauauuugaggacauuuaugucacagcagacuuugauaaugcauuuuucauuguuuuccuuuauuagcuugaaguuuggaagcugagggauuuauuauugauuuuuuuuuuucuuuuucuuuuugaggcagacucucacucuguaacccuggcagccucagaacucaauauguggaauggcagagauuccccacgccugccuuugcuuccugaguguuaaaggugugcaccaccacaggcaguuuuugugcauguguauuauagcgcuaccacaaaugucuuugacuuucagcuccaaucacugcagucugaacugcaguuuaaagacgcagaaaugaaugaguuaaggacaaagucucagagcaacggacgaacaaauaagccagccgcucccuccgucucccacgucagguaaggaggaugcuggacucaugguuuaguuuggcauuauuuuucaaaaagccugacaacucucuggguuguugggaugaagggcauuguuuugaggcccucuuuccugaaggaugcagagguggcuuggaugaggcuacguggucugagccgauacaguagaaaugucuucauucuacgugugcuuucucugacugggacagugguaacacggucccuugagacuacaaaaagcuggaaagaugauuuuuuuuuuuuuaaggaaggaaagguuucuuuuggcuccuagugcagggaaugcaacccaucggcaacccauggugugggggagggcaugacagcagggccucccagcugaguggaucggaaacagggaggacagaagcuggugcucagcucacuccucaggucccauccuggaccccaggcugugguguggugcacccaccuucaggguaggccuuccuucaaauuuugaaaacaggccagccuucauuuuuauguaauuuuuuaauuaacauuaucccccuuucuaagcaugaauguauuucaguccuggccacuucaacuauuuuugccuauuugcuauuugagaccuuugucuuacagccccucuuuugcugccaguugcgcucagcuuguuagugaucuguguccugcccucugccucccauagcagucucucaugugucugucagccuugaaauuugaacucuuucugguauggaacauucuccugccuuugcucauguugggcagagugcaaaguugaacucuccuugccuugcaugcuccaggugagacaggaagcugucccucaccucuuuaccugucagcaguaggaagaaggccugggugcuguguggucagugccgaguagcucacucacuuuccaguacacuuucuaguagacccucuuuguuguaaagguucuuuuuaaaauuauauccauuuguguguuugugcaugcaaguaccuacagagcccaggagagggcauuggcuucccuagagcuggaguuacaggcauuuaugaguugccagacaaggguccugggagugaaacuuagaucuuccgcaauagcaguauucacuccuaaugcugagcuaucuccagccccaugguaaacucccuuuuagaaguuuuuggauccaggcacugauuacuaaaaauugggucuucaacauuuaaaacuuuuuuuuuuuuuuggaugcuuaagagaugaaaauaaaugcuaccuucgacacagacugacauaccuauaaaaccucaucaaaaugucuagcuaugaaaaguuuauguuagaaauuuaauaaccagguaguuaaacagaauccuaacugugcucucauaguuaacucuuuccaguccuaggaaaggcucuucugugguucucaagucagaagcauguucuccacauguuggaaaaacaacuuucccuacaaaagaaucuuuuagugcuaacacgccucucuuccaccccugucagacugaggcaggacacagauuucuggugggccaagaggguaagucaaauauuaguaauugguugcuguauaauggacugccccaacuagugccuaaacaacaauauucacuuucuuuuucucaguuucugggcaugagcagcuugauacacagagacacacugaggcugagaguccuucaaggggccucugagacgcuccuguaccacuuuauuuauaauuagacacacugccucucuucccaccacugccacugcucuauugagaaacugggaccccaacuaauggagcauuacacaguaggucacaagcaggcaaagcagucuggauauaagucucaaccacgcuacuuaccagcuuaugugaccugggcaaguguauuaccuaugugaaacagcuaacaugaccuuuaaucauaggguugcucugugaaacaaaggacugugacuuaaaaagaaaaaaauggguaaaguuggugauuacuguuuucaccauauugcuccauuuuaagugaagcaaacauauuaauuuucuccuuagggaucuggagccauuuuggcucugcuuuugacuggguuuacgaagauuauccaaucuuuuaaauauucuauguaggaguuucuggaauaccuguuuuuauguucugcuuuacagucacauuuuuuuuuucuaguuucagauaauaaaaaccacagucugggagguagccucaugaagcaagaugugcagcagagaauucuggcugauggcuggaugcagagaaaagaugcucaagguaccagaagacccacuuuucuauaggagccgucguggcucccauuuucuucuuugaugcacagaauugccuaggggaauugucugagaacccugucccagcuauccuuuagaauguuugggcacacaggagucugugacuuaaagaaaaaaacaauguggucuagugagauggcucaauggguaaagguaucugccaccaagccugccagccuaaguucagucccuagggcccgcaugaucaaaggagagagccaaucuacagaaguugucuucugaucuccacauccccugugcccauaaaauaaauagguagccgggcaugguggcgcacaccuuuaaucccaacacuugagaggcagaggcagguggauuucugaguucucgaggccagccuggucuacagagugagauccaggacagccagggcuauacagagaaacccugucucaaaaaaaacuaaauaaauaaauaaauaaauaaaauuaauuuucguuaguuguggcaugugaugccuuuacucccaauguucuggaggcaaagguagggauaguuaugagagaaauaaguagacagauagauagguagguagguagaucggucaguuggucgauagauaaaaggauguuuuguuuuuaaagcugagaacagguauucugcccccagaagcaucauaacagaguuuaguagcuuagacauggugagucuaaagguccccucauuucuuuccucuaaggccauagaaaaggucuucaguagucaagcuuguaaugcuagcaucuuagaggcugaggcaggaagaucaugaauucaagccagaggaggcaacauagacccugucucacaaaaccgaagagagggagggagggagggagggagaacucucccaugucagaauauucuagagucaccuugucuuuugcagguucuauuuugauaaacuugcuccugaagcaaccuuuggugccagggucaucucuaggucuuugucaccuucugagcaguuguccugagguuccuacuggcacccucuugcagccaccagggcucagguaagccugcagcuccccaaaagcuuguuuaggaguuuucacaaagcaugcacuuuucuggcucugaccaacaggagaucuguggcauguuuggggaggcuaaagaacuuggcagacgacaagugaucuggggucccugaccuaaucuuuuuucuuuuguuuccaguacuuugccugggacuucaggccucaggaccaucaguucuucugaugggccauuuucccccucugcccugagagaagcacagaacuuggcauucacuggauuaaaucugguugccaggacugagagcucacaugauggagacauggcaggcagaagagucuucccgcuccaccagcuuccuggagcugugcaucuccuuccucuugugcaguuuuucgucggcuuacacugccaggcucugcaagauuuagccccagcuaagaagaguggggugccuggggacucugcgacacauaccuccugcaugagcucuggggucgaggcuagcccagaggacuccauucauggcuuggagagcuuuucuguggcaucacucagcguccuucagaaccuggugugccacaguggggcaguugucugccuguuacugucaggcauggggacagaagcugccgccagggaaggaaacuugguccagacuugugcagauacaaccucagccuccagggaggaugcucaugaccaagaccagcacccacugcuaaagaugcuucuucagcugauggcuuccuccucugcagcaucaggucauuuucaagccaguguccugggccugugccucaaaguuuuggugaaauuagcagaaaacgcuuccucugauuuguugcccagguauaaagaagaccccccgggaggcaugauuccaugggucugccugaccucuugaggucuaaccuguggcuuuugcacuuuguucacaccucgacuuaaucccacugcuuagcuauggcuugcuucggggaguucugaaguaaugggaaggggcgcagguaagcaaaggcgcagguaacaggccacuucggaagcguggccugcccuuggacaaaggcuaaauuaggaggccuuugaccccgagaugcggaccaggcgaagaacauauagcccagcauauuucaaugagguagaguuuuauaaggaaguagguagaguaucuggagugucuguagccaugagcuggccgugugggaagucugucaacuuugugucugcuuucucucccacccacaccccaaccccuacccccaccccccaaggacaagguuucuuuguguaacagacuuugcuguccuggaacucacucuguagaccaggcuggccuagaaaucacagagauucaccugccucugccucccgagugcuaggauuagaagccugcaccaccgugccgagcuaaguucacaucuauuaggaaucacaggucacuugcugcuuaauagcgguuuguuggaagugauaguauaaugaauuuagcuuacaaacaaaacaaaacaguuauaaauuacuaacuuagggugcuagagagguggcucagcaauuaagaguucuuguuuuucuugcagaagacccaaguucaauuuccaguaaccacaugguagcucacaaccauguuaccccaguugcagggaauccagcaggcaggcacgcacugcacguacaugcauguagacaaaacauucauacacaaaguaaacuacguaaauaaaugaaucuuuaaagaaaaaguauaaguuccuaauuugggaguugagaacaucaugagcaagauagaauuacaaauccugccagcccgcccuccacccaaccauccguuuguuuuuccucccagcaugcgucuaaggccaacucuacgcuagaauccuaccgcugacuaggugcagcugucucugccaggcaucaggccugugccacugauccagcaccugggaggcggagacagggggaucucugcguuugagaccagccagagcuauacagugaaacccugucuaaaaaagucuuaccugagcucaacauuccuuuuuguuaaaguucuggaucguuguuuuccacaugguauuuucugacuaguuuuaccuguccucaaguaugaaauugaacacagcacuucgguagggaagaacugccauucacaggaccaauuuacacuggcuaguugccuauuucuuaagugcuuaaugaauaaaucucagaaaccacacauuccccauucuguuaguagaccccuguuccuguuuuguuggcccacaggggauucagaacuccgcucuucaacggaugcuucuacuagccaagugcuucgguggcugacuuaggugacacuucugacuucauacacagccugguucagucaauguuugauaaaucccuacauagaagcaggaaaacuugucuaaaaaaaugugaccauguuaggacugucacugugauaagcuauugcccacugccauucagacauguaccccaacagaauacuuuucuguagauuucaucauauucauggacucaagcugaacugcacagccuccauuuuaccuucuagugaaagccagaacggaugcaucucuguccacugucacugugcccaggcuugaaacaaagccugccuuaccaaauagcacaauuccuguacuuucuauaauggugcuauguguaacuuaccuucuuuuuccuuuuugagacaggucuuaguaucccugccugaccugggacucacucuguagagcagucuggcuuagaacucagagaucuaccugccucuguuucccaagggcugggauuacauguguacauccccauaccuggcacaacauuucauuguaaaagaaggcuuuacagcuaugaaaaaauaacuuggaagucaaagguagaaucuuuccagcucuguucaagggccauaguggucuagguaggacuagucaggccagagagcaacagaguuaaaugcccaacuccuugccuauuuguagaaugugcuauaaaaugggggcucaguggcuaagagcacuaguugcucucccagaggacccagguucaauucuaagcacccacauggccgcucacaacccuucguaacuccaguuucaggggaucugacacgcucacacagguguacaaacaagcaaacaaaauaaaaacaccaaagcacauaaaaauaaauaaucauauuuaaaaaugcuauaaaaugaguuuaccccaaauagugaaccuuuccuuuccaaugacacugguggauacucuccaccuccaugcucucuguacacauugguacauaccuacaugcucacggccucgcucccacacaccaguucuccccauacugcuguagguaguguaaauagagcaaacugagcucugggacuggguuccaucccuuugucccuuugucucuuugucucauuccucagugggaagguuauauauauucagucacacacacgucaugguagguagguuuccacgcaggugacaagucaguguuuuccagcaaguggagaaaaccgcuuccuuugccuugcucuaugaccuugugagacagcuguagccaugcacacgcuuguuucuguuagagcccuagccagggcucugcuauuaguugaggaauauuucucgugcugaagguaugcaccagugucacugugugauggcagacauaggaaggaaccccauccagggagucccaucccauuuacuugauaaagguccacauaagggccuggguuuggguuuuuuuuuuuuguuuguuuuguuuuguuuuuuguuuuuuuuagggcaaaagagggguuuugauaugguagugcgacuuacuugguugcauauaggccggguucaucuccagcucugugugguagguccugccucugcugagauuauauauauguaccacaaaacacacacgccacaccauacucaccccgauuaaggccugccauguuuaagucacagcauucuuuuuuuuuuuuuuuuaauuuauuuauuuauuauauguaaauacacuguagcuaucuucagacacuccagaagagggagucagaucucauuacagaugguugugagccaccaugugguugcugggauuugaacucuggaccuuuggaagagcagucgggugcucuuacccacugagccaucucuccagcccaagucacagcauucuuauacuaaaguuuagaccuguuuauuugugacaggcuugaagccaguagacuagagucaggccagcagcuuuggaagccauggcucacuacaguaaguguccuuuuggagagugucauaacugugcucauucuuuagguucuccuguguguucccgguguugccacagugccucggcucagcgcugccgcugcccugugugcuccuggcuguugagcugcucucugugcugcuggaccaugacagccuagcauggcagcuaugcucccacccagguaaagcagggcaggacagucucaacuguccuauaguggggagggagggccugggggcaguacagguucagagccccucaagggcuucuguacuuguaccccagacuacaaugaaaagggggucccauaagcugggcgugguggcgcacuccuuuaaucccagcacucaggaggcagaggcagguggauuucugaguucaaggccagccuggucuacagagugaguuccaggacagccagggcuauaaagagaaacccugucucgaaaaaccaaaaauuuaaaaaagaaaagaaaagggggucccugagugaggccugcauccuuuucagaaggcugccuucuccugaggcuguacauguacaucacaucaaggccugacagaacggccucagagacacaguggcuucagcuggaacaagagguaagacucagacacugcucacccuucacucccaccccccgagagcccagagucuccuucccuugugggaaagugggagcuacaauuccuuuuuugccaguuugucaaacagcaacggguaaaauguagggguuccucacagggauucaauacaagcacauccuggguuauaguggugcucagcagagcugccugggcuuugggggccccgauccugguccuggaagcaguaagcuguuggugagauucaagucugaaagccugagacuaccacuacuuguaccccacuugugcaggcaagcaguuguagacguagcuagagcaccuuagaaaugcccgccaaagcccugugacaaccgucuguucuacaugggauggguacuaucucuucuuguuccagguaguauggcucuuggccaagcugaguguacagagcccugcccccgcuggcauugguucugacugucacugcaauguagaggugaguggccagagaccagcaucauggaugcucaguuaguuaagagcaauccuguugaucuugaaguggugaggugaguaagucucuggaccucaggcugugcccucucacccuaggcagucagagcgcucacugugauguugcacaggcaauggcugacggugcggcgggcaggagguccaaggacccaccagcagaagcagacgauacgcugucugcgggacacugugcugcugcugcauagccuaucucagaaggacaagcucuucacugugcacugugucgagguccugcaucaguacgaccaggugaugccaggggucagcaugcugauucgagcccuuccugaugugacugacugugaagguaagcuagcacgacacuguccuagccuucgugugccucugucagacuccuuuccaugagucuccccuugccuccagagccauuccuggcacauggguauuaccuuccugcucugggucuuugaguaugacagguucccauuugauggugucuauugaauuggccucgcugagccaugguuuuccacaaagaucuguccgaauugccuuugugucacuuuugcucacagucgcugagggagcaaagccugugcauagaagggacugguugguuccugugacgcuagggagcaugggggccuccaagcccccacgcugucgaguuaaccucagaccccucuuccuuuuggcucagaggcugcccuggaugaccucugugcugcggagacugauuuggaagacucugagauggacuguaacugagggccugagcauccagccacaagguggcgccagcucccaccgccgucuuugccauauccacugauuaaaacugcacuuccugcugagaacacaagcuuuguuuccugaguccgauuuguguggcugagagggagggacagggcagaccaagaauugaugagaugacuccugcuggaguugagauggcccccaugguaacugaucugcccugaggaaaaacccugccccucuucgggaauuacccugagucauagcuuugggcgggggccguggugggggcagggguacguuuguggccaaggaggcagcccuuuuuaggaaggccuggaucaaggacugggggaaagacaagaaaaggcagaggcucacgggcacauuugaauccuagagacaacccaguuugaguugucaguguuggggcaguaguccauuuuaccagccagcaggaucacagauauggaucuaggaaggccuuuggggugcuuggggagggagggaggagcgucagcacgagggccaggccuggcaggcuaacagcagggcgggcccuguucaggaggcaggccuauggguggacccaggcaguuuuacuuccucagccacacugcugccagcagcagacccagcggagugccuugcugccugcuucucgguaaguguggaguaaggguaugggguaaggcagaagagaauaggguucccucacccugaagguagucagcacuaggggaagggccucccucaaaaggcaaauaaguaguggauccaucccacuagaacaacccugcccuccagcuucuaguggcccuggauaguaccugcugaagggaagggcugagcugccuuucugcaccccaccucagcccacuugagaccuuccugcugcuacucauuaccccaucuccuccccagguucagcaugggcucacagacccugccccauggucacaugcagacccucaucuucuuagaccuggaagccacuggccugccuucgucucggcccgaagucacagagcugugccugcuggcuguccacagacgugcucuggagaacacuuccauuucucagggacauccaccuccagugcccagaccgccccgugugguggacaagcucucucugugcauugcuccagggaaagccuguagcccuggggccagugagaucacaggucugagcaaagcugagcuggaaguacaggggcgucaacgcuucgaugacaaccuggccauccugcuccgagccuuccugcagcgccagccacagccuugcugccuuguggcacacaacggugaccgcuaugacuuuccucugcuccagacagagcuugcuaggcugagcacucccaguccccuagaugguaccuucuguguggacagcaucgcugcccuaaaggccuuggaacaagcuagcagccccucagggaaugguucgaggaaaagcuacagccugggcagcaucuacacccgccuguacuggcaagcaccgacagacucacauacugcugaaggugauguucuaacccugcucagcaucugucaguggaagccacaggcccuacugcaguggguggacgaacaugcccggcccuuuagcaccgucaagcccauguacggcacuccggcuaccacuggaacaaccaaccuaaggccacaugcugccacagcuacuacaccccuggccacagccaauggaagucccagcaauggcaggagcaggcgaccuaagaguccuccuccagagaaggucccagaagccccaucacaggaggggcugcuggccccacugagccugcugacccuccugaccuuggcaauagccacucuguauggacucuuccuggccucaccugggcaguaagucaagaggggaaauaugaugaauaaagacuuccauagcacugacu

SEQ ID NO: 5331 - RNA, 4096 nt, Mus musculus
ggggggugggugggggauggggaagaagaggggugaucugaggucuaagggagggguauuuuggaaagcaggcagaugagcuauagaacccugucuuaauuaguuucucuugcaaugaaauaccaugaccaaaaagcaaguuggggaggaaaggguuuauuuggcuuacacuuccacaucauuguuaaucacugacaggaacagaacaggacaggacaggacaggaacucaagcagggccagaaccucguggaggggugccgcuuacugcucaguaugcuuucuuacagaacccagggcuaccagcccaggggggccccacccucaauggacugggaccgccccugucaaucacuaauuaagaagaugcccuacagggggaucuuauggagcgauuucuccacugaaguucauucuuucagauaacucaagcuucugucaaguugacauaaaucaagccagcaccccacccccaccccaccccacgggagucugagggugugaugguagagcagccuggcaucagcccuuagugaaguggcagauacggaagacggcuucccccgauuuagagcccucuaaccuuagaggcuuccaggugacguauaugcaguuuuucccuuucuggacacuaugccaauggccuugagccaaaguccuucaaaagcccucaggaugggucagguccuggcuccacagauugccauuggcaagcccgggugugaaccgcccugcauaaagcccucaggagagaaccucugcccaggguuuccuucccagaaagacccagguguuuuccaaggagggaguccagacuugcucaaggcuucugaguucugcauggcuccagguacaggccguggaggagggaaggaaauaagacccuacuucugcaccucacagccaguaugcccugcuuacacaguucagcuuuggugguauuacccccuauuagucagggagcaaaaaggucgggguguguguguguggggggggaaggggugucagguuacauggcuuagugauggcgcaaacucagguccaaagcccgggcucucuucaaacagccaggggugggggccggaaggagagguuggguguuguggaguauugaaagaaggaaaggugggcagggccaggugagaagaggagaagcuggcgucuaggagaccaggugaagaaaguuggggggagaggauggcuccaagggccgggaucuagaagggaaugagggcgcuccgggcgcugggcgaggugcguuggggauagucaagauggugguuauggaacaggcagagcagguguggggcacaagucccucgaacucuggcaggacggggaaaggcuccagugcuguaucucaacgcccagguaauaaggcucgcaaccauggccguagccucuugguccuaagcggcgcgcaggugaggcccggcugggcggggcggaccgcccacgcucccggcuccgcuccucacccuacacgucugcguugccaugacuaccgcccgggcgcugcagcccccauuuaaugagagggguugaucacccccccaggcccuucacaaacucggaucccgcgggaccggaaugcggggucccggauggcuggggccgcguaccccguucucccggcagcuuccggccugguccgggcggcgcgcggggggagggcggcccgacgggcgggggguggggggguggaaggagcggagcccgggccggccgacgcggcuuugucuccuuuguucccagcggaggcagcgccgcggcgggaggggcgggcggcgggcgcaguuuuuuccgccccucggucuccggguaacagcugcggcuccgccagacccaccuccgaggggagggaaggccgccgcgcgcagaucugagcuagcccggagcugcgggcggacgccucgccgcgcgcaucccgcaggagggucgggcggugaguugcgagacuugggcagggaaggcgggguugcaggcgagagccgcgcgcacccagguggaacggcccgaggccucgaucccgcugggcacaggcagccggaguggugucuccgguggguggcuucgguccucagaguugggaccacacucgcgcgcgcgaaggcaaacucuggcggcaccgccuguaacgcgauugggagacagaggagguggagcugcuccuccgcgcccccuccucgcugccgccaccgccgcuuucgggaccggccggccccuuccccgcccucccugggccacugguggggucuuugucccguggagcggcggagggaggaggguugaggaugagucgaagcaaggaaguggaggcuuccccauaggauaacagaucuuucaggcagagacugacaaaggaggaccacgagccuuuuaacacuuggacucugucucgguacccacacacccagccggugcuugacgagcgccuuaauuuauggcgggugucugguaaaugauggcucccuuccacccuacucaacauccagacggcagguguguagugcacaccacuucacugucaaaaaguaacucucccuuuuaaguggauacugggauaggggcgggaguguggguggccgagcucagaaagggaaggccaguuucccccaacucccagacaagugcagauguggaaggggcugaauuugugagucuucuugguugugagagcagcugcaggagaggguuagguguugcuuguccuuugcagaagucaggcaaccagucuugggcccugccguaggguuucggggaguguggguucuaaagaggccuauggggcaggccugggcacaggcagaguuaguuagacuuuggcgaugagccuggacagccugagauguggggaguuagggaggagauacuggcagugcaaguuagggacgugaggcuuggcuccaaauaagcccuaguccgaucauuaauaaaacugggccgauuccucggcuuuugagaugcuaagaggcuugaaagcggagugugagcuccauauuaccccucuagucuggaucuccuuggcagugaaaugggggcucugucaccauguagggaacaccugcucugcguugggucugcugguuacuggagccuucuuauaaaaagcagguacucucugccuuuaaagagcucuugucuagggugggaggacggaacagaagaaaauggucucggggcccacucaugccagguacaccccagaggaguccuuccuccccucccacuaaugggaaaucugaggcucagagcccaaggaagagcaggauagauaggucaggccugguagcugggcguguccauuucaucuaccacacaggguuaccuccucgggagccggagaggccucaggaggcuccucagggaggugauggcagggugugggagguaaugggagacagagggagugggcauuccaggcugagggaacagcccuuguauuggcagggaggaacagaagaacaagccugcaguuuaggcuggaacgaggggcaugugugggggagggugugggggagagggucuugaccuuucucucuucagccugaggguaccccaaaagccugagugugugcacuccacuguuguuuaacaaaauuccagugagguccucauagggacuagagaugccucuguggcguguagcugacguccagugaaaucugugugcuaauguggaggagaaaaaugucagucuccuuuguccuucccugcccgugguaugcagcccuauggaugucguuucuuacagagagucaaccucugaccuguccacugagcuuuuuggagcccucacauuucuguguguuccccucaacuucaguuuggggaguggcuuuguuacugccccuugagggcugagaaacuuuggcaugcaguaggcgcuaagcaaauauuuacaagcucaugaagcggcaagugcuggccucacugugggacccugugcccaaggcccagggucuguagcccaaggugguuggagagaguuaggcagaagcagagagcaggagauggcuucugcucuuccagaggaagaaacaagguagcaggcuuuuuaguagccuggccuuaccacaguccugggcuucuggcug

SEQ ID NO: 5332 - RNA, 25078 nt, Mus musculus
ugagaagaggagaagcuggcgucuaggagaccaggugaagaaaguuggggggagaggauggcuccaagggccgggaucuagaagggaaugagggcgcuccgggcgcugggcgaggugcguuggggauagucaagauggugguuauggaacaggcagagcagguguggggcacaagucccucgaacucuggcaggacggggaaaggcuccagugcuguaucucaacgcccagguaauaaggcucgcaaccauggccguagccucuugguccuaagcggcgcgcaggugaggcccggcugggcggggcggaccgcccacgcucccggcuccgcuccucacccuacacgucugcguugccaugacuaccgcccgggcgcugcagcccccauuuaaugagagggguugaucacccccccaggcccuucacaaacucggaucccgcgggaccggaaugcggggucccggauggcuggggccgcguaccccguucucccggcagcuuccggccugguccgggcggcgcgcggggggagggcggcccgacgggcgggggguggggggguggaaggagcggagcccgggccggccgacgcggcuuugucuccuuuguucccagcggaggcagcgccgcggcgggaggggcgggcggcgggcgcaguuuuuuccgccccucggucuccggguaacagcugcggcuccgccagacccaccuccgaggggagggaaggccgccgcgcgcagaucugagcuagcccggagcugcgggcggacgccucgccgcgcgcaucccgcaggagggucgggcggugaguugcgagacuugggcagggaaggcgggguugcaggcgagagccgcgcgcacccagguggaacggcccgaggccucgaucccgcugggcacaggcagccggaguggugucuccgguggguggcuucgguccucagaguugggaccacacucgcgcgcgcgaaggcaaacucuggcggcaccgccuguaacgcgauugggagacagaggagguggagcugcuccuccgcgcccccuccucgcugccgccaccgccgcuuucgggaccggccggccccuuccccgcccucccugggccacugguggggucuuugucccguggagcggcggagggaggaggguugaggaugagucgaagcaaggaaguggaggcuuccccauaggauaacagaucuuucaggcagagacugacaaaggaggaccacgagccuuuuaacacuuggacucugucucgguacccacacacccagccggugcuugacgagcgccuuaauuuauggcgggugucugguaaaugauggcucccuuccacccuacucaacauccagacggcagguguguagugcacaccacuucacugucaaaaaguaacucucccuuuuaaguggauacugggauaggggcgggaguguggguggccgagcucagaaagggaaggccaguuucccccaacucccagacaagugcagauguggaaggggcugaauuugugagucuucuugguugugagagcagcugcaggagaggguuagguguugcuuguccuuugcagaagucaggcaaccagucuugggcccugccguaggguuucggggaguguggguucuaaagaggccuauggggcaggccugggcacaggcagaguuaguuagacuuuggcgaugagccuggacagccugagauguggggaguuagggaggagauacuggcagugcaaguuagggacgugaggcuuggcuccaaauaagcccuaguccgaucauuaauaaaacugggccgauuccucggcuuuugagaugcuaagaggcuugaaagcggagugugagcuccauauuaccccucuagucuggaucuccuuggcagugaaaugggggcucugucaccauguagggaacaccugcucugcguugggucugcugguuacuggagccuucuuauaaaaagcagguacucucugccuuuaaagagcucuugucuagggugggaggacggaacagaagaaaauggucucggggcccacucaugccagguacaccccagaggaguccuuccuccccucccacuaaugggaaaucugaggcucagagcccaaggaagagcaggauagauaggucaggccugguagcugggcguguccauuucaucuaccacacaggguuaccuccucgggagccggagaggccucaggaggcuccucagggaggugauggcagggugugggagguaaugggagacagagggagugggcauuccaggcugagggaacagcccuuguauuggcagggaggaacagaagaacaagccugcaguuuaggcuggaacgaggggcaugugugggggagggugugggggagagggucuugaccuuucucucuucagccugaggguaccccaaaagccugagugugugcacuccacuguuguuuaacaaaauuccagugagguccucauagggacuagagaugccucuguggcguguagcugacguccagugaaaucugugugcuaauguggaggagaaaaaugucagucuccuuuguccuucccugcccgugguaugcagcccuauggaugucguuucuuacagagagucaaccucugaccuguccacugagcuuuuuggagcccucacauuucuguguguuccccucaacuucaguuuggggaguggcuuuguuacugccccuugagggcugagaaacuuuggcaugcaguaggcgcuaagcaaauauuuacaagcucaugaagcggcaagugcuggccucacugugggacccugugcccaaggcccagggucuguagcccaaggugguuggagagaguuaggcagaagcagagagcaggagauggcuucugcucuuccagaggaagaaacaagguagcaggcuuuuuaguagccuggccuuaccacaguccugggcuucuggcuggguucaagacuuucccugcagccucccccccaccccccccaccccucaaccccaacccccuuggguggcaaacagaggcagccuuguuccugcucccauagagcuucccuguucucuccacacuaaaaauggaaacccccaagcuauuuugggagccgugcccagccagacuggccauggcccccugcucccacugggcugugaccacagaguccuugcucccgccaggcugcuggaccuuccucucagccuuguacccagccuagcuuaggauagggcagccucaggagcgccuugccgcggccucugguauaugggccaauccaggggcaaagaagggaauucugggaaucuuccacauagacagccuggcagcuggguggugggagggccugggcaguguggccugggcacaaggaggggaaaguguuucucaguguagaauaguuugucccauaaccaaacuguguuccuugaggaccacuggaguaugggagagguaguguugccauaguuacuuaggucuaggauuuagaagccuuagggauuuaggccugcaagguaagaaaguaggcacucaaaagucuggggagguccuaggguuggacccaggguuucagggcacaagcaggcaugacuacuucuucagaacccccaacccaccacucauacugcauucuggguucugacucuacaaccugcaggcgagaacauuccgggagauggccugccuuccacaguuuucuaggacuuagugcugaaaccagggaagugugcgugagucuguaugugcaggaaucuaaugugggugguaugugucugucucugguggguggguccgaugugucuaugcagugucuguaggggguggagauuuguaugacucgucauguggugucagaacauagauacaugugcccuggguggcauguuuguguuuguguguacgcgucuacugugugcguaggucccaucugcacgcaucauuguguaucuguaugugcaagugcuccuguguuuguguguaguuguaugcauucaggguagguuguauacacagaucuuaguguguguguaccugcuaguauguugguaccauuuggguuaggguggcccauggcuugugugaaugguauauagcugugugccuugacagagcagagcaggguaagggaaagaugggaagaauaccgagaagggacagcggugcugggggccugacugggcccagauggccauggggcuccuuucuaguugaccuuucccaggccccuugggugccuggcucugcugcccucccccuccccguguaggcucugaggaggcguccucuauggaauguguuugguggcugagggccaagcugggcugggcuccacaggcagacuggguaguggggaggggaguccagggcucccacaugccugcagcccagcccccaguuucauacucugcuuuccccccacuggcuaggugacuccugcucaggucaugccguuaucugcugauccagccggcccugccaggugagccagacuucaccccaacagggaacagugugacucucucugcagcccagaguuccccagugugggggcccugucugucagccuucacucucccagcauggccuguuagucuucugguuaucacccucuggauuccuggccugaaagguccuguguccaaugcuucucguucuuuuguuguuguuuugagacagugccucucuauguggugguccuggaacuugccauauagaccaggcuggucucagauucacagagauacacuugacucugccucccaagggauggaaucaaaggugugcacccugcaccuaauucuugcuuuguuaugacaugcugguggucuauaagacuuccugauccuaccuaagaauucgucguccguauagagggggcccucucccuucucugacaucuugucaccucacuugacucaaagagcaggguuuggaaggaacaagauugaguguggagcuagguggaguaugggcagguacagcucuccugagagcuuaguguccacagagaaggggugaggcuguaguuuccaagggcagugucuucugugucugccugguaccuguagaccugcgaucacccugggccuagugacuacuaggaaucucuguauagccuagguuaggagaagcaucuugguccucagugucacaguccugucccguagcauuggcuuccgaggaccuugcuggccauuugagucucgcccaaccuuuuucucugccaggugaccaugucuguccucggcccaguucuucuccagguguucugggccgggugugucgucacccugcgguccccucugccagcugcuuucacugccaauggcacacaucuacaacacuuggcaagggaccccaccacagguacccucuauguaggggccaccaacuuccuguuccaguugagcccugggcugcagcuggaagccgugguguccacgggcccugugaaugacagccgggauugccugccaccugugauaccugaugaauguccccaagcccagccuacuaacaacccuaaccagcugcuccuggugagcccagaggcucugguggugugugggagcguacaccagggcaucugugagcuacggagccugggacagaucaggcagcugcugcuacggccagagcgaccuggggacacccaguauguggcugcaaaugacccugcagucaguacaguggggcugguggcccagggauugguaggggagccccuccuguuuguggggcggggguacaccagcagggguguagguggugggauuccucccauuacaacccgagcccugcgaccaccggacccccaagcugccuucucuuaugaagaaacagccaaguuagcagugggccgccuguccgaguacagccaccacuucgugagugccuuuguacgcggggccagugcauacuuccuguucuugcggcgagaccugaaggccccuucuagagcuuuccgugccuaugugucucgagugugccuucaggaccagcacuacuacucuuauguggaauugccccuggccugccaggguggucguuacggucuuauccaggcugcagcuguagccacguccaaggagguggcccguggggacguacucuuugcagcuuucuccucaguggcuccucccacuguggauuggccccugucagcaucuacuggggcaucuggaaccucugugcucugugccuucccccuggaugagguagaccagcuugcuaauuacacucgagaugccuguuauacucgggaaggccgugcugagaacgggaccaagguugcugacauugcauacgauguccuuuccgacugugcgcagcuaccaguggugagucugggcacuggccaccaagcaccugcccagaaagucuggggagcugggaguagguaggguggcucucaggacagguguuaggugcuucuuuucaggccuaagcuagaagaguccucuuggcaggaagcaguacaggcaugggcuugagucagggugcuaaagaagugacuuggugaggggaaagcggggggagggggcggggggggggcuggagagauggcucagugguuaauaucacugacugcucuuccagagguccugaguucaaaucccagcaaccacaugguggcucacaaccaucuguaaugagaucugacacucucuacuggugugucugaagauagugacaguguaugcauuuauaaaauaaaaagaagugacuuuauagaagucagcuaagagaguguuuggggcucuaagguaaggguugaauauaggagugagcauuggagcaauggaagaaaaagggaacgaugggauuuggcucagaccuagggaggguauagagaugccacaguugcucacugagucagaaaggugaagaggguccaggcaagugggcugggaaugggggaggagccaagcucugaggccucuaggguguggcuuaggagaaaguauuagguguagcugcuggaggaauuagcuuccagaaaggggauggcagaagauggggccgcagacaaggugagggugaaagaugaaugcacugagguaaggcuaaggagcgggcuacugucgggacggcuggcagagacuaggaccuagggggugguuguccugggagauuauccaggcagggucucaguguugcuuuuuguuaccuguaggacaccccggaugcuuuuccauguggcucugaccacacacccagucccauggucagcugugucccuuuggaagccacgccaauucuggagcuaccagggguucagcuaacagcuguggcugucaccauggaggauggacacacuauugcuuuccugggugacagucaaggacaguugcauaggguauguccuuaggaaguucugaggcugggaugugugacguguggcaugcuacaggccaccccagcugugugugccgcuccucugaggguugggugguauuuaccugugaucuuccucacauacccauaaaccuugcccaaggcugguuguaaugaaccugucuugccugggauucaucuagaccaggcuguucucaaacucacacaaaucugccugucucugccuccaagguacaaguauuaaagacugccuccccccaccugucaaaagagaaaauuauuauucauaaauuguuucaguucuaaguggaggaaggucuugaguuuguggcuuugagcuuggugccaggccuuguggucuuucaucuuaggucuacuuaggcccuggaagaagugcugccccauauucuaaacagagcauccagccggggucuccugugaacagagaucuuaccuuugaugguaccuuugagcaucucuauguagcaacucagacuacuguaaguccuggacacaggccaggggugacugcugggaggggcuucugggcagauacugggacccauaugugggcgaggcacugguuuucugacugccagccucagguccucuuugcugucacagcuugugaagguuccuguggcuccuugugcucagcaucuggacugugacucuugccuugcucacagggacccuuauugcggauggugugugcuccugggcagguuaguguucuaucuaccaaauccccgaccugggcuugugccucuauaacggcuucuugaccuuguccauugacucucagccgcuaacauguggguacccagcccccaguucuuuauccacucacugcccagagcuuuagcucccugccauagcagacacaagagccugguaucaacuucacgugagggcugugaccagggaaguccucaggacuagagagaugucucugccgugugacuucucgauggcugccggagggucacaguuauaugcugguucuucuuagguguagucgccggucggagugcucaagggaccagggcccagagcaguggcuguggagcuuccagccggaacugggcugucuucgagugguggccgugagcccugccaauaucagucgggaagagaggagggaggugaaugaccagagugggcggggccccaguggggagagcuauggagauggauggagaccuuggauuuuugugucguugcaucaaauaccacauguccuugcucagcuauuucucuugggccuuggguuucucuaucuguuaucaaucaaggccagagaguauuugggagggaugccagcaccagccuguacuugaugcccuuaaaugagagucuguagccuaccaugcaguggugccuaaagugugcccuuugcuuucucgguagguuuucuugucagugccaggccugccaucucucuggccaggggagucauauuucugcuacuuuggagaccaacagaguccugcucuacugaccaguucuggugugaugugucccuccccagaccccagugaggcuccagugcugcagagaggagccggugggugagagaaggggccagcccuggaccugggagcccaccccugcuuccaucuugcucuaagaggucuuacugggaugagaaauaacucuagaagauccuagaugugcucuaaguccccuuacuggcuccaggaccccaguguuggugcuauguccucugacccuaguuccugucuauuuggggugccagccucaucccauguagguccccagccuucccuacucuucaguucuggcacucucccccauuuugcagaccauaucucugugaacguggagcucagguuuggugccguggugaucgccagcaccucccucuccuucuaugacugcguggcaguuacugcgucuuccccaucugcaccgugaguuccuuaccuugucuguccccagaucugggcucccuuacuguggucucuguuucaugacugacuggcuguacugugcgcaggugccgggccugugugagcagccgcuggggcuguaacugguguguguggcagcagcugugcacacacaaggccucgugugacgcugggccuaugguggcaagccaacagguuagugggacuccaggaugaggcauguugaggguggagccugggguucccagggugaggguuuucugauggccugggaucugugugcccgccagccuccugugaagcucuguccugagcaccccagcugcuuugugugacagagucacuggagaauggcugcuuguccaucccaucuguuuuggggaggacauuuaagcugagaggcaagaggugugguccugguuccccaccucagcacagacccccggagccugccuugcgugcuucugccuuagagaauuaacgggauguuuuuguuucucuuuccucggucuuuuucccucuuaacauacccuugccugccugccccugcacuugccugcugagugaccuuccugucugucuugaccuuuccuucagagcccacuccuuccccuaaucccuccugcaagggaugaacucaccccuuucccacccacagucccccaaaccacggucacuccuacccccaacagcuucccaauagagccuagggcucccuccacagccucagauguccuaccuggggccaagccuucccggcucagccucuggggcccaugggcagguccuggccccauacuuuccccuacuuccacagagucaccucuucaugagaagccccuuccuccugaccccccuaccauaccuggaaccacugucccugcccccacuggcuugggaccaucgaccacaccugaggaccucuuggccuccuacccauuccccucagaugcagcugcaguguccccugcagagccuggcccugaggcucugccuuccaugguggcucuggaccagcccccuggcacuguuccagacacuacuuucccaggggccccuggcuccaugaagcccguucuggauuggcucaccaaaggaggcggcgagcugcccgaggcggaugaguggauggggggugacacgcccgccuucuccacuuccacacuccucucaggugauggagacucagcagagcacgagggcccuccugccccccucauccuccuguccagccucgacuaccaguacgacacccccgggcucugggagcuggugagguccagcccaggaaggaggccucgggaggggaggggaagacacagccauuugcuuacccugggauugauucuccuuugggagggugagaaccuaguguugccauggaaccaagcaagguagaggacugaggcggucagggugggagccacagacugccucacccuuggugccugcagggagaggugaaucagagggugagcuccugccccuguguggagaccguccagggcuccuugcugauaccgguccauguggaacgcgaaguccagcuucgaggcaggaaccuguggcuuuuccagguguguuugccuauccagcuaucagcuuucccucgagcugcuuggcuaugugacagagucuacccaagccuuugaaagcaggaagaggacaucgccagcugcagccuucuucccugacucagcuguucuggggcaagggcugccugcagccuucaggacccagcuucccauucuaccugaacaguguguccuuugcccccaggauggcccgaggagcagcgagugugugcuggagcuagggagucgggagguggcuguggaggcucagguggagugugcgccgccuccagaugucuggugccacaucaagugccagcagcaucagguacggaccucgggugggcacagacacuggccacaggcugguuguuagccucagcugcugugaacuuaucucaggucaaagcuuugacacuggauaguagauggacaccccagcugggccauaugccuuugcuccccuaacuagucauuuuggucuuuucucugagccacaccccaggccuggcccaaacucuaggcucugacuucacuccuguuucuccaguucagcuaugaagcuuugaagccagaacugcagguggggcuguuccugcguugggcaggcggucugcgcguggacagugccgaugggcugcaugguaagccaccuagggaccacagggcaggcugucgguaucagggcugcucaagguuccauguuacauuucauucccgcugucucuagugguguuguaugacugcucugugggacauggggacugcagccgcugccaaacugccaugccucaguacgacuguguguggugugagggggagcguccgcguuguguggcccgggaagccuguaaugaagccgagacuguggccacucagugccccgcaccucucauucacucgguaugucaggaugcuggcacgugccuucucuuccucacugcugcccuuggggguggggguauccauguuguggaugcacagaacucagaauaggaggcugggacugccucagacacagagguugacagguccuuguccuggaacagguggauccacugacuggaccuauagauggaggcacccgugucacuaucaggggcuccaaccugggccaacaugugcaggauguccuggacauggucagaguggccggaguucccugcgcuguggaugcuggggaguaugaugucucuaguaggugagcugguugggcucaucgugggagggcacuguggcaggauggcuuccuauucaggaccucuuuccuccaugugucugccugccuuucuccugucuuugcuuauggugucagugccuuagugcuggguuaucauggccuggaacucuggcuuccuguguauaccacucuggcagagccuuggcccaggcugauuggggaucauuauagucugucaggcagaaucacugccuggagcuugcugguggcucuucuugguacuacuucuccaaggccugcccuggcugggcucucagaagagccuguugcggcacaccuccagagugcccgggggaauguagaucagucuccaggagcucauaagcagcaggacccaaaccuggcagaggaguaggguaacccuucacuguccccucggaaggacuguugaagagccacauaauuuauauuuuaaauaagauauaaauuaugcuccacuuugcgggagcaugccugcuuguuuccuccggcugguaaaugagaacucccagacccucuacacuguuaauaauucuagaaccuucagacuuagguaauuuaugaagugauuuauggagugugaaauguauuguggcuggagccugccuggcuaguucacaccacuggcucuguuuugccaguauuguaugaccgugacaauguuaaccacuguagacuuaacacucuggaaguucaugugccccaggcuucuguuuucuggcuaagaaccagcauuuucuuuaauuugcucacaucuccccccccccccccccccccgcguucugacgagaggcuucuagggaucuguuguuuaggaucagaucaaguucucauuacuuugcaagugggugcugaccacacggugguagggaagacuugggguggcuggugaggcccucuuacucgcuccucugcuuaaccacaagucaggcccuccagggcuucuuuguaaacccgugucaccucaggggaguacacuccuugcuagagggugugccugaaugacugacccaggaguggcucaucugaugcuaaggcuugcuagugugucacagggguugcuuccaaagggacagggggacggggaagggagagcaccugccaguguggcaggaagaggaucugccaggucacuuugagggcugucugugcagucugguaucccucugcuugccuaucuugugccuacagucuugugugcaucacuggagccagcggggaggaggugacuggcacuguggcaguggaggugccuggaagaggacacggugucucagaguucagcuuugccuaucaggugccugaacgcuaaacaaacccagcugccuggaggccucucccccuguggaugucucagccuuuuugguuuuggcuucauaaggcuccccauccugaggcucccuuauuugucugaggugcucuggcuucugucauccugauuuuuuuuguccgucuuuccccaucuucuuucccauaggauccaaaaguacacuccaucuucccagcccguggcccuagagcuggagguacccgccuuacccugcaugguucuaagcuccugacuggacggcuagaggacauccguguggugguuggagaccagccuugccaccuguaagggcugcuuucuuguucuacaaaguccacacacuccagggaggagucgggggcugggaaaagccagcguggagugguuuagucugccccacgggaagguucuagccagcuuuccagaaaccagggcugugguagaaguacagcuuccagagcuacacagcggagacuucagugggugaggaaccuaagugagccaagauuugagugggugccuagcuccuggaucuggccuaucuucuccccuccacccaggcuccuggagcagcagucugagcagcuacacugugagaccggcccauacccugugccugcugaacuuccagugacugucuuguuuggggccacugagcggaggcuucagcacggccaauucaaguauacaucagaccccaaugucaccucagugggccccuccaagagcuucuucagguguggagcccaaagcaugucuggaaggucuuugcaguucucacaauaggggaggugggaggugggguucugggaacugugaacuccuuacuguugacagaaugggucaugaaugaaccaauuugaggcugggggcugagcuggcugggucugggcccugcagucacaaguggcuccugggcuguguuucagcggaggacgugagauauggguccgcggccaggaucuugaugugguacagaggccaagaauccgagugaccguggucccaagacagcauggccaggggcuugcacagaagcaacacguggucccugagaaaguacguggcuccagagccgucauccagucgcacacccacgagccucuccugcucgcaccaggcuggccgucucuccccuuacccauggccagucccggggaguuggugccaaaggagaugcucccugccuuugcucagccucccaucucacaaggcaggugccucaguugcucuccucucaucucucugcaguuugaggagccgugucucgugaacuccucccaccuccucaugugccgcacucccgcucucccuggcccacccugggacucugggguccagguggaguuuauccucgacaacauggucuuugacuuugcugcacugagccccacacccuucuccuaugaggcugaucccacccugcguucccugaaccccgaggaucccagcacgccguuccggcacaagccagggaguguguucucuguggagguaauacaccuucuugggcuuuucuaguagaacagcauguguaugcuggagaggucaggguggaaagagcaagcugagagaaucuaaagugguugguacagcauaaguccuggcagggguuugacuggugguggccccggucccuacacucccuuaagggaucuguuugguuaaguaaaucguuuggcauguucacuaauuggguagugugguacauauuagguaacaggcugaugcucauuuggcaacugggcuuacguggauaacacuagacccuuuuugugacaugcaugguaaguaguccauacauguguggauagacacauggacuggccacaggcagacgauccaacaucaccuagccgaggguaacucgguuaacugcccagggcgugggcagcugcuuuagguucuccacaguuucagcugugagaagaaaggugagaaagcacagagaaguuacggugagcagucugaaggccaccucugugaccacggcuccacaagcaggggaaacggggcugauagauggcuucaggauuaucccacucauguuuggggacauaggcugagguggucaguguucugagaaacgaaucagugacccaauguuacagggggagaaucuggaccucgccaugucuaaagaagaggugguggccaugauaggggacgggcccugcgugguaaagacacugacccggaaccaccuguacugugagcccccuguggagcagccccugccacauccccaugcccuccgagaggcuccagaugcuuugccugaguucacggucagugggcaggaccugggcuagguugggcaucgugcuaucugggacccuggcucacagguagcuucccacgcagguacagaugggcaaccugcgcuucuccuugggucaugugcaguacgauggcgagagccccguggcuuuuccuguggcagcccaagugggcuugggagugggcacgucucuccuggcucugggugucaucaucauuguccucauauacagguggguggggccaguuguggcagguagguacacguggccagacagagaaggcacagaugagagcagggcucugcaagaagugugugugugugugugcgcgcgcguguguacauacauauauuaaaauuuauuuuuauuuuaugugcauugguguuugccuguauauauuucugugugaggaugacaaauccccagaaacuggaguuacauacaggcaguugugagcugccacguggaugcugggaauugaaccuggguccucuggaagagcagaaccacuuaaccacugagccaucucuccagccccacucuacaaauauuuuauauaagggaucaguccucuggaaaugguugcaacaggccugguggucuccaggaauccucagcucagcccuugggcaugaacaaucuauaaaccauugaguauagcagaguccuaacaaaacuguacuuauaaaaacagcugguggcccuaucuggcaugucgaggguuugcugacccucaggcugagcgauggguagauguggcuugaugggaacgagacaggauggauuguuuugggucaggcuggcuugggcauggucagguuauacugguugacaugguuggaguuggcuuggaguacaguuaagcagaccugaaccgguugagccuagcaagggcuuuggccugcugaccuuucccuucugccccuggugcugguaggaggaagagcaagcaggcccugagggacuauaagaaagugcagauccagcuggagaaccuggagagcaguguacgggaccgcuguaagaaggaguuuacaggugaggcuucuagagcgggaguagcccggggcccucccuacagcugcucuggucacaugggauccacugacauucuugugcucaacagaccucaugacggagaugacggaucucaccagugaccuccuuggcagcgguauccccuuccuugacuacaaaguguaugcugagagggucuucuucccuggguaccgggagucccccuugcacagggaccucggugugccugacagcaggcgacccaccguggaacagggccuggggcagcucuccaaccugcuaaacagcaagcucuuccuuaccaaggugcacucucagcuaggcugccccacccugucuugcuccuagucuucccuaucuaacuguuucugaaccuacccuucacucucuccccggccucaguucauccacacacuggagagucagcgcaccuucucugcucgggaccgugccuacguggcaucucugcucacuguugcacuucacgggaagcuugaauacuucacggacauacugcggacucugcucagugaccugguagcucaguauguugccaagaaccccaagcugaugcugcgcagguaaguggcuggcagggugauagacagcuggagccaggaguagagccagggacuuggguuuggaguguggaauggagcccucuagucccugcugaaccuggccuucccuuccugccaucucaggacagagaccgugguagaaaagcugcucaccaacuggauguccaucugccucuacaccuuugugagggugagggaggggccaacagcuccucguuagggagggucgggcccuuuagagcacuaagccuccagcaauucauuuagcuugccccuucgugccagagcaaagacauuacccaacaaaacaugccccauguacuuuugccuccugccagaggcgcugacugcccacacuuucccaggacucugugggagagccucuguauaugcucuucagagggauuaagcaucaaguggacaagggucccguggacagugugacuggcaaagccaaauacacucugaaugacaaccgccugcucagagaggauguggaguaccgucccuugguaagggugugcucugcuccaucagucuauaacagccuguggucugacccuggauauggagccccugcuggagagagagaggcuguuuauucauuuaauggugguaggaacucauccggucucccacaagcuagcaaacauccuucuaccacugagugacagcccuggcuuugcaggauugagaauugagaaucucagaggguccccgacuuaggauggacccacagaucugugcugcgccagagugucugucuugcuguuucaccaggguugcagccuuguucucuaagcgaguagcugcccggcagacuugccuguaucuccucuccauuacucacaaggguuucuuugaaggacccagcccuucucguucauguugcguggggaguccuggcuuacacaaacuuccuucaggcauaaaagaggguggggugcucaccuggagguucucccauucacccccugagcauuugcaucaaguggaaggcagacaggugaagagaguuaaggacugcuuaguaccgggguggacucagggacuguuuucuuccugguugucccuauucuugacccgugucuuggucacccagcauguggaaccaguccugaaaucucucauauuucuuguauagaccuugaaugcucuucuggcuguggggccuggggcaggagaagcccaguguguaccugugaaaguccuggacugugacaccaucucccaggccaaggagaagaugcuagaccagcuuuacaagggagugccucuugcccagcggcccgacucuugcaccuuggauguuggugagggucaggagcaggguaguuugaggaccuugagaugaugcugggccugagcuggcccgagacugguccuccaagggugaggcuaucccaggugaaggggccaugucuccaccuaggaugagaugggcugcauggcaggaagagauccugggagccccgagccaaauccucucuugcccuugcagaauggcggucuggaguggcugggcaccuuauccuuucugaugaggacgucacuuccgaacuccagggucuguggaggcgucugaauacacugcaacauuacaaggugggaaggaugggagcuggaggguggguaggguagacuaagauugacggaagugucaccagcugugguuagcaggucccagauggagcaacgguggcccuuguccccugccucaccaagcauauucuuagggaaaaccaggauuaugucccuggggaacgugaguaccuccuccucuucuucuucuuccccucccucccucuuaccccuccucuccuucucuucuuucccuccucccuucucuuccuccuccuccucuuccuccuccccucccucuuccuccuucucuccuuccuuuuccucuuccuccuccucuuccucauuguaauuuucuguguuuguauugcucaguccuggggaguagggaaggaagggucuuuggacugaguaucucuugcucuucucagagaagcuuuagccacuccugggggaguuaacuggacuuggguucccaagaggagguggcaccaugugaggcacuaagcucuuacaucuuggcacagggaccccaaugcuggaggauguagaugaggggggcauccggcccuggcaccugguaaagccgagugaugaaccagagccucccaggccgaggaggggcagccuucgggguggggagcgugagcgagccaaggcuaucccugagaucuaccugacacgccugcuauccaugaagguggggcugggagagaaugggcgacggggucucggcugccaugggacauggggguagugugggacuugcaugagggagugccaagagcugucuaagacuggcugaugccaagucuccauccuaacugggcccucugcuuccuuuucuuccccacagggcacacugcagaaguuuguggaugaccuguuccaggugauucucagcaccagccgcccugugccucuggcugugaaguacuucuuugacuugcuggaugaacaagcucagcagcauggcaucucugaucaggauacuauccacaucuggaagaccaacagguaugggaggaacagggcucaggacauaugugggggccucugccuccacagcacaguuacuggcccccguucccccaauuugcagccugccgcuaagguucuggaucaacaucaucaagaacccacaguuuguguucgaugugcagacuucggauaacauggaugcugugcuccuggucauugcacagaccuucauggaugcuugcacccuggccgaccacaagcugggccgggugagcagacuggggggcagauaugacagggacaaugaugacacccauguagcugguggcuguggaguguguggggcacagaucuucagggcuuccucagaguugcagggagaagauagucugugggcagccucugacuuaaggccuucccacuccaggccucaucccagggcucuccagaaaguagccguggucagucucaggggaugagcagaguggaggggggcgccccugcugccaacccuggugacccgaguucaaucccugggacccaugugcugaaaggagagagccagcuccuauaaguugcccucugaccuccacacaugcaugcacacauacaaacacaaaaguaacauguaagaaaaacaaggaagugggccagugugaccaacuguccugguuugcugagaacugggaggguucuggcauguggguuguuuugcuauaaaacugaucauguugggagccccaggagcugaugaccuuuugaacuuugacccuuccuucuccccugucuuccugcugggauccaggauucucccaucaacaaacuucuguaugcucgagauauuccccguuacaaacagaugguggaaagguaccggggagggagugggucugcagaggcaggcaugcgguugaagcccugggugggcccugguggguaccaaggaagggagcucugauuauagaucaucugcuauccugggccuuuuggcagguacuaugcagacaucagacagacugucccggccagugaccaagagaugaacucagucuuggcggagcugucccggguaaggccuccccuucauacauugucaccccucugugaucugccugggagaggacacacccugccaucacacaggcagaguguuccugcaaaaggccagaccugucaugucaucagagugagcaggggucucaucugauagcugucaccuaauggggucuaccaggcgcuugucugugugcagccucugggaguacagaguggaugaaucggcucuaggccuuuaaacuuccaggccaugcugcccaucguucuucacccuccacacccacauuuacagaacuguuccuuaacugacaaugaggacaccuauaccagcacagcuauacuugugggguacacugucaaacccuucuuggucugggcuucugcauuuggucccccuaagaguuccaugaguuacuuuggcugcaccauuaguacugucuagacaaggaggcugcggguccgacaaccucacggaagcccuugggaaacauuugaguaauaucagcaaaguugcgccaaguucccagccauagucccacggcccuguagucgcuuggaaugagugagagggacuucuagcuauagccuugacugggagaggcaggcaggguuccgguggaaacuccagcccugcugaagcuaguccugcaguuucuuccuacuauggagguuuggccuugucccguccugagcugucaccaugcuuugccuugggcucuguucccacugcagggccugugcuuucucauccuucgcugagguccugggccucuuccccacuacagccucuucauuucccucccuuccaucugcccucuucccuagaacugcucugccgaccuuggggcgcgaguggcucugcaugaacucuacaaguauaucaacaaguacuaugaccaggugagcacagcugggccccacugcagggcuggccucgagcucagagugcuucuucggaagcugagugagggucccacauugguucugcucucccugugcccacaaucccccauuaugcuucugcaguggggcuugcccaggcauggugguagugguugggggcaucuggagaaucugucaggaucuggagacgguaugugggauaugccggaagacuaccuagcuaccaucccucccagaucccaagguuggccuuguccugggcaugacugcuucuguggguacagacuggccugggugucauaagccauaggagacauagggugaggugucaagcacaggacgaggcuagaugaguggaccacagaaccaggaggggucuuucucgggccucucuugaccagccuugaugucuaagugcguccguuucacuguuagucaaccuaugagugccuauagaauuaccacagucguguggcgccagugaugugccuaucguugagaacacggaaaccugcguuguggucucagcugaguggccugguaacaaccaagggauccacagccucauuccuuugaugccagccucagcacagggagaggugcagagcugaugcagccuucaccugcuggcgcacaggagagccagcuccucuccccaagcucugccugccgccuguuccuucaugccaaccucauuugugguucuuggguuguucuuuugccucaauauauccucuuggucuuggcacagagaaucaugaaaugccauuagcugucaggaagggcaaugggguuggcuaugacagaccuugugagaaagccagugguuaugugaggcuggcuucuacacaaaaugagcguggugaggaaagagcauuagguggugaguggcgagugucauucccuggcagccuguucuugaacgucugcgugugggugcucaacuguaucaacacuggagaggcaggaaguucgaguuuuaggcuauacugagaccaugccucaaacacccuagaaaacaacccaggcgacuguucuguuuucacccucaccagugagaccuacagucagccucaccacuaugucuuuagucacugaauucccauugacuacccugcccaaaugcuaucuguggugaccagauaagucuccucugauucucuugguccugccuuucagaucaucacugcccuggaggaggauggcacugcccagaagaugcagcugggcuaccggcuccagcagaucgccgcugcuguggaaaacaaggucacggaucuauaaggaccagggagucuuugccugcuguugucucuguaccuccugggcagcccuggaaucucaagggagaggccaccaccuucguagaugccuguagugacugacaagcagaguuuaaugaaagguggcucccagucucuugguggcaccagcucauagccucagccccauuggaccugccuuguaggccugggaccuagugguucaguggguagugcuaggccugccccaagccuggugacucucugaccuacuuccugggugacgccagccugcagggagcuggggacuuaagguuuccagagaaugucugguaggcccuccaggccccuggggagacuguacuguucuugagcacugaccuaugucccauugggaaucacagaggaaggaagagaacccgcccgcccacuuccugucuucuucauccauccuccuugaccucaaguuucgcuuccuuuguccuuguucccuguugccaauucccaggagagagagaggggggggggagagagagagagagagagagagagaaagagaugcauuucuaggcugcugcugccucagcaggguuggugccucaggaccacccugucuuccagguggcugguggggagggacagcugcuucaggggagccuuggggagagcagugacccauugaugcuauagcucuucauuaaaggauaacacaugguauggacucaccagccccucugcuaagauagaacuggcagcugcugggagaugugggcaucgugcucugaaggguccccugacacccacggaaggccaccaugagguuggcaagcucucuccggcuccuagguagggucugccagaggcaacacuccccagaaaggagaacuuaaagcacaauaaggcucagggagaguuggggccugagaugugggguucugucccccaucuuuaagggguccaccuugauugcaggucgugguaacuuugccauucauguuccaugaauuuuuaaaagaauuggggaaguauggcguuauuaaaggcgauuccaggcagugugggucucagguccaugacccuguuucuggauuccaguuuccacauugcuguccauguuaagguaccugaggcaggagcucagagcuacucaccugccuguguaguagcuaccuugugguauuuuccuguuagaagcuacaagugagcuucaagaccaugguacuguggugcacuuggcagcuggcgguugagaaugccauuggcuucaccaggcaagggucguggcauccucagagagcuccaccuuggcucauguguauagccagugaucuggccaaccucaagcucuuccccaaguguuugaagacaugggcugauacaauuccaagagucccuucuugcugucuuuuagaaucuuugucuucaagaucgcaggagccauuuugguuuucaugccagggguaaucacagugacuauuucugucagaucccaucuuccccaugccugccagauguggggaaccacagucacagacggccagcagucaggcccucuuuugggagcaugugaacuuuaguacuaaugauaguugucuuaguucagauuuuauccucacgcagaaugguuuugccucccccaguggcuacuccgaccaacuauguuguugacagucucagagaacagggcugacagggggaaugaggucuuggcuagacuucagacagauacaggaagggaggcaccuuuuaagucaacauggcagggauggugacagagacacaccucugcuccaggcuugagcuucugcagucuuugggaguccucugaggcgguaaggguuccugcagaggaaggccguguaccugcgugcuugggcgugugcucaugggaugggcgaguauggaacgugcucugagucacuccugucucacccucacagaacacugugauagaagaugucaugaaaauaaaaauguuaccacuucagagaggaag

SEQ ID NO: 5333 - RNA, 814 nt, Mus musculus
uaaaaauuauucuuuaaucuuuuuuuuuacaguccagucauuauagauuauuaaggcuauauaugucucauuguuuaacaacaacaaaagaaaauuauuuuuaaagcaaaauuaauaaagauacuagaaaagguuaauacuauuugugaaaugaaggaauagaugccagaguuuuucaguauguuuuaaaguugcagucacuucugggguggggccugaaagucaacagauaguaagaagcagaaagggacagaaucccagauacucauuggcacacucuuaagcuuugguaacaaaucacuuuuguguuaauagcaaccaaugaaauuuccaaaaugacagccagagaguugguagcaagagcucacuggcaaaacugaaacggcuacggugcaauccauccucgguuucuggaaaaugaucugucuggguaacuucagcccaugacuuucccugaauaaaaauaaauaauaaaacuccccuucauucucagaaaauuacaaauugguuaugcauguuaccugcugugacuuccacaguugcuccgagaaacuggcuggcuggaaguccuuagcuggugaagaaauaggaagacugacaggaggcagugccaucucaggacagugucuggcccuggaagcagugagcuuugaaguucaaaagaauaaauacaagccagggcuguagugaugcaugccuuuggucucaggacucaaggaagaggcagguagaucuuugggaauuugaggggcagccagccuggucuacacaguaaauuccaaggcuacauauuccacacugagacuucaucuca

SEQ ID NO: 5334 - RNA, 2245 nt, Mus musculus
cacucacugcccagagucucaugaggcaaugagagucugaagcaagcgcuagcccccccacacccuggccggcagccaggggcagggugggccaggaaggcuucuguuugaaacuuugcuggaucagguucaggaugagaauaaaugaggcucuccuggccuggaggaggcagucuugggaaccaugcaguuccagagggacguccccucccuguggcuguggcggucacuaucacugcugcugcuacugggccugggguucucccagacccccagcuacagggaugcugugcuccgagcuguggaugacuucaaccagcagucccuagacaccaaucucuaccgucuccuggaccuggauccugagccccaaggggugaggcagaggaagagccaagaucuaauccuuuuagcgucgucucuccuuuucucaggagaaacuccauaaaucugugccucuuuccaggcugucggcuuucagccuuugggauacuugcuguggcacaagaugccuggggcuuccauuccagggacggggguaggggcgucgggggcagaaucacuagcucugggauuggcucccuuugcucuucguuuuuccauauccauugaggaacccuaccuagccuugagguucccaaggacgugccugauccucuaagacccuguccuuuuccagaaggggagcugcucugcguuauagcuggcugagggcuguucccauucacuguguguggggggagaaaggagggggcuccuuuucucuucccucuguacuucagcacucgauccugucucagcacucagcacguggugauggagggucaccauguugguacgcgucaagaaaccgauccuugaaguugagacugggccugagacgagucuccuuacuuucucuccugaccaggacgaggauccagauacucccaagucugugagguuccgagugaaggagacuguauguggcaaggcagagcggcagcuaccugagcaaugugccuucaaggaacaggggguaaggcagagggcugggggugggggucccucuuguggaacuagucaaggaguccccagggacuuccauccaguagacuaggguuuagggcuuauggcaaaugaauucuaguuugaccaugggcuuucccuucuaagguggugaagcaguguaugggggcagucacccugaacccggccgcugauucuuuugacaucagcuguaacgaggugaguaggaugcagggcacggugaggggauggaacacggguuauccugcggaccaguuaguuccuauuccuaccuagagcagaaagaagagcccccccccccaacccccuuggcuccucccuugagccugaacuuuaagacugguucugucaucccuuaaaguagcgauucucaaaaguuuggcucuuacuugggaggcagaggugggaggaucccuauggguagccuuaucuacauaaugaauuccaggccagacauggcuacauaggaacucagauaguuagggaugcagauucuuaggccucgcuaagacuguuaggacuccagggugaggacuuuuucaccgggaucaaacacaaccugcuggauauuccgaauuccgcugaagcacagagcacucucuuaagaguaucuucucagccgggcgcgguggcgcacgccuuaaaucccagcacucgggaggcagaggcaggcggauuucugaguucgaggccaaccuggucuauaaagugaguuccaggauagccagggcuacacagagaaacccugucucgaaaaaccaaaaaaaaaaaaaaaaaaaaaagaagaaagaaaaaaguauguuuucucagauccuugggagccccuugcuauucccagaccccgaguucucaucuuuuauugagguuaaggauccaacugcgugucccaaaggcugaaaagggucuagaggcucuuggaguaucccagaaguguggucuagguggggaaggaacuuggguggcccugggaccagccucacaagaaacccacuucuucuugguacacagccuggugcacagcccuuucgguucaagaaaauuucccggcuggcuggacuucuccgcaaagguggggagaagauuggugaaaagcuuaagaaaauuggccagaaaauuaagaauuuuuuucagaaacuuguaccucagccagaguaguaggccugccuuggccuguuucuggauuccuaaaauaauaaacuugguaaaagaaacuucu

SEQ ID NO: 5335 - RNA, 18363 nt, Mus musculus
caaggguucaagaucacuuuuauuugcagagccugcaacuguugguuaacaaugcuagcuaugcugguacaaucugcaagccauucuccuggaaagcauucagcuaacagaaucucuacaaaccagaccagggaccaacugggacauacuucaacacgccagggaaggggcugcucauucccuugcucuccacauauuuucaaacaagauuuguuuaauagccaaaugcaacucaaacccauaacaaagcaacuagccaucuucaauaucacugauucccuccccgcccccagaauagaaagcagagggaagaggggagacucuuccuaagaaaaaccuggcuagaccccaauggagcaaagauagcagagaggcugguguccaaggauaucaacaggcaggcaccaaaacaggcugugcagaaucaaagcagccuggccccucagacgagagguguuuccgagagccucacuuccaugggauuagauuaggggguaacugaugugauucaccacucucugacccucaaauuaaaacaugauaaacucugaaccuuugacuucaaaauuuacuacgcccuccugagaaauuccacaguugucuguaggccaggauacauaacagccugggcuucccgccccccugcucacccuugggugcccacccaacacugauuggauauuccgacucauaaaaugacuuuuuuuuuuuuaaaaggacauucagugggcaugcuccucccucacucuguggacuccacucuuucaugcccccccucuuccaccuuggggcacacuacagcauuccaguacuggccugauggaagcugccuaaagugccuuccugugacuccuacaccagccacugucauggggacguggggugaggaguggagacaagacuuuccccgaggaacacugcaaaaugcagaaguaggucugggaagguuagcuuauguccuguagccaagccuggaucuggugcaggcucuuaccagcaucucaguccuugacuuugaguagcagcaauacuggucugcagcgccuccuaggggugacugagcuccuugcgcuguucacaacuuaacaaguuugccuuuuucuuaucccugccccauuuuuuuuuuuuuuuaaauuaaaaguagagguagcuccuaggaugauaaaacucuaccuagaauggcaguauuuugacuuaaugaagcagaaaaguaaaagucuugaauuaaaacaauaauaaaauaauugaugaagcugaauaaauuaaaguuaagagucauccacgaggcccucuccucccuuccagccuaucuuugguauuuggccagcagcacuugggcggcuuuucucuccucgugacaggccagggucuacccaauaaggccuucuucaugggaugcucagugagagcagccuaacacgguguugcagacuccagucugugcugugcuuguccagcuuuggcagacaguccugacagggaaggacucuuacagaacagaagaguguaacggcagggugcccuaggcuccaaccugggaguguaggagacagguccaaggaauggaaggcccaggucuuucuccagguaccguacagcuggccccuuugcuuacugcucugcagcaaagggaaaagggacggggcagagggaagcucaggcugcuaccauuuggcuucagagcuucuucaggcgacuguacaucucucuuuugcucuuuucuccugcccagguccggcucuuggugcggaacuucuuuaggucuucuuuaaagucuucauggugcauuggccgguagcugggggguucacagugagacuaaaggaacaggagagacacggucaggauacgccugccucauaucaucuggcuuccucugccuagagcugcaaggcugggaaggcagcaagcaggugccagugagcaggagccuggcacuuagcagaugcauagugcgcccccagaccccggcaagcagcagccacaaccgacccaauggcccagcaugggggcguggggacaugcucacagacaucucaccuggcacuucaaaaagaacuccuuguauccccccuucaggacauacagcucaggguaguggagcuugggguacucauugccgagccuaucucucucucucacauaucggcaccuagugaaaagaagugaaggacacagucgggucaccuccuucaggcuaggggacaggacacaacacaggugguguccuggcacuccuuccaccugccugcugccgacaccaucugcagcaauagcuuagagccagcgugcucuccauucuguccaugguccccucauucugcuccucucacccaaguagaagucuuccuucuugugccuuuaaacagccgaggccuucuacuuccccgguagcuacuagaaccccgugucucucugcacucugccugagcggcacgaaagccacaguuuucaguguccuacugugugccgccucacaucucauucaccccacucgucuccuguccucuaucugggagcuuccacucauugaccucauuuugaaggacuugugaacauuuuguacaauucuaaguuuuuaaaauaugcuugucugccuccugucuacucugaaaugucccuccaggaagcuagacuuuugguuugcuauguuguuaguguuaaauaacaauaagaauuugagaguggaugcaagcccccacuaucuccauucaugugugaauauucaguccuacucaaauggguggguuguuuucuuuuuuguuguuguuguuugggugacaggaucucacuaugucacuguaaugagauccuguaguagucuagacugaccuugaaucugagugcugaaauuaaaggcaugcgccaucauaccugcccuugaacccaggacuucacaaauacuagagaagugcucuaucugauaugagccacacuccuagccuaacaguacguuagugugcuucuuauaggaucgcaugcagcucaggcuggcuuuacacuucugauccucugccuuagcuuccccagggcuggaaccagacaugcaccaccaugccagaugcuguuuuagaguaucgccagcacaucaacaucugcagaggaagcucuccagacuuuucugcccuuugcuuaaggaacaacugcuuggacguuaugagacuagucgguagaacgcaauacagugggggaaacugggagagccgaaguaaaaaucaauauaaaggaccaacaagagugagucauuuggaaagaggcugaacccauggugauacuacaaaguuacaacugguaucaccguaagacugaacuggagaagccugaaaaucauuugcaaucaaaacguaaagguuaaguucaucaacuacauucaagaaauaugucugggcugggugguagugucacaggccucuauacccagcacccaggaggcaaugaagauggaucuuuggguuggaggcuagcaucaucuacauguccugaguuccagaacauuuaggacucaacagagaaacacuaccuugaaccccuucuccaccaagaaaggaggaaaaauguuugggagagcaagauggguaaaagcugcucagaaauccacacagcagagcacucccccaagcugacuucugaacuccauauacacacuaugguagggcacuuugcgcgugcacaaaauaaaaaaaaguauaaaauaaauacuaaucguaaaaaugucuauuuggccgggugccuaaaucccugaggccagccagccuauucuacagacugaguuccagaauagccaggguuacacagugaaacccuuuuuugaaggggaaaaaaaaaggcuguuugaaagacaaaucaguggacagaaguccaacuaagggaaacuauguuauaauaggaauuauaguuuccacaaaagccauguauacacauaauguguagacuggagcagcacuggagcgccuugugacuuugugaaaggugccuguguuaggguugugacgugugcccugcucuccacugucaggaagccuccgccccaaagccuuauucucugugguacucacauucgagggccucuuucagaggaaaacucacaguggaacacgacaaugacacgcuugccaucaguaggcacaauaggguucuuaaguaagaagucuucaaccucuucuuccaugugcagauucacggcacccuguggagacagcagacacugagcaccugcuaagccacacccaggagucuguaggucccacggcccagcagcgcaguagaccaccugccuguuaugucagugaggcuuucucuguaggccauuucuaaaugucacuucauaaagucagaagcuaauccccacucacauuuaaauccugcuuuuuaugguaauacuaaacaggcaugaccagcuccuuccuucuagaaaucugguguuccaacaugucccuucccaagguaggcagccugacucaacagcagagccuugguacagauaccagggccaugcugccaaacuggcuucuuuuacucaggagcucuggggugcucaaacauucauauuuaaauaucccaaaugcuguggaacucuuuguggccccacugaauagcuuagacaucagggaugccaccuagaaaugcccugaaacaggacaguaugagggagugaaguggaacuggugggaauauucauucaguuuguguauauuggccgucagccaagagaugucacuaucccaccuucuaagacucccaagauaauaagucucaagaauccaaaccuugaugugaccuccuucauacucauauggguaucggcagucaaugauaacaaacucuuuaaugagaccggcaaacuugccauucaaaacagaugccaucuaugaagagagagggaagagggugucauuugcuggcugucagguaacgagauuccaacuccccaaaugcaguggguuccaaaagccugacuuacaauuucuggagaaauauauuucaaauccugaugcuucccagagacuguauuaaagagauaacccuuuagaaaaugaaaaaaaggaaacagaaaauauuuagaggaacgugaaagcuugcaaauauuaagguuuauucugcugccugugugguaggaagcagcuugaaaaacaaaccgagaaacaaacauaagucaauacuauaugcuaauuaccuuucuaugcacuuaaucaacaucuagauauuuaauuauuauuguuuaaggagauauguuuucauuauguagagcaguccagcuccagacuccgaggugagccugcuccugggguaaguuaguaaaugauuaugcucacccucugggucuggucuuaccaccuaaggagucccgagucuagaucugaacacagaaaccacaggucauuuccuuucuccacuggcuuuucuuuuguuacuguuuuguuuuguuuuguuuuucaagacaggguuucucuauguauccucagacacagagaccugccugccguuggaaugcugagauuaaaggugugcaguagcugcagcaccgcccggcaccuucccccaccccccuccuguuuuuuuaucaggaauucucaucuuaguaugagaaaucacuuaaaugcagagaggacagucaggccguugugguacaaguuuaguccuagcauuagggguugggaggaggcagaggcaggcgaucucugaguucaaagccaguagggacuacaacgaguuccaggacagucaggacugcauagaggaacugugucuggaacagcaaacacacacgcagugaggagaucaggugugacucaggaauauaauaacagcauuugggaggaggauauaaguucaagagcaucccuaguuuggaguuuggagccaacuuagaauaugaggugguucuguaacaaauaaaaccacaaagacagugggugugguacuguaggcugaggcaguagaacuagguuaauuuggguaaaauagugaggccacgccuuggaaagcgagacaacuugcucaugugaugggcaccugguugcucaggauggaguuagguagugagaauggaagaacaucuuggcccaagccuaacaaggacgaacaccucagugcuacucagugcuguuuaucccccucaaaaacuccuuguucuuccuuguuuuguucuuuuuagacagggucucucucuauauagcccugguccuugaaguuacuguauagaccaggcuggcuucagucugucuagcucugccuuacaaaugcuaagauuaaagaugugggccaucauggcuagcuguacuguaccauagcucaggcucaugcuuucccagacacacuggucagagugaagguaaccguacagggaaccaccgagccagcaagucucaugaccaccacgugccucauccugacaaguucagcugagcugauuguucuuuagcuuuuacuuuuaaaacugcugccuuggcggcacccaggggcugccuugaggaaggaaggagcaagguaagugggguucuagcaccccuugccaacaccaccggacuagagugacucugcuugcaguuaccuuggagaaaucuccuauaaggucucuugggucacuguccaaaauguucucaaugguuccuuugggggaagacaucagggauagagacugggauggaagcuguaagaaauccaagguagagaaugagaccaggguuuugauuaaaagcucuacaauuauuuaccuuuaccaugccaagaaaaggaaacugaaauaugaaugccuauaguaaguaaaagauucuguacugugacuuaagcagaggaaggauagcuccaugcuaucuaguaacuaguugaauuucccugaaacccacgaaucucugguuggccuggaacuugauaauguagaucaggauagucucaaacucaaagagugcacagagaucaccggcaugccgacacaccaaccagcaccuguccucuuuuacuguucgcaaugagaacuguugaggugauaccaagacaggcgugagauacaaucccagaggcaggaggacugccacaauguugagccuagccagggcuauauggcaagaaucugccuuaaaaauaaaaauuaaaaaaccaaaaaccaaaucaaaaccugaaccugacacuguaacagaagaucauugucauguaucucacaaaauaacacauaauuacuuuaucucaguagaguuccugaacuucugauaaggaagguuuuuguaagaaaacaagauuugaguuguaaagaucauuuggauggcuucuaacuaaacagccuucuguugugauucugcucuacagcuacacaaggaaccacuguguaagcacgccugagaacuguaaucuagaggcaacaggcguaagauuagaacuuugaacuauuucuuuuucucuuccaaggacagcaguaaaccuuucaaggcacgaugacgucagugaggugcucagaggguaagaguacuugaaugugccugacaguccugggaucccaugguggagagagaaccaaggcugcacaguuguccucugaccccacacaugccauagcacacacaggacuugcaccacaacaguauuuaaaagaagggcagaggggagugggcacauuaagauucuuucucaagcccagucugucagguuagagagacccagacagcacucuuugaugcccccuuccuuaaauaggaaauuagagaggcagauagaucuauucuuuguuuagcaauaucaagaagcuggagccauucuauuuuauagauagguucuugugcaccauggcacaggcacaggcacacacacacacacacacaacaaaauuucaaaccaaaacaaaaaccuggguauggcuugugauucuagcacaagggagguagagacagaggaaaaguucucugaccucuaaaugugcacugugguauuuauaucccuaccucuugauaaaugaauggcauaggaaaguaagaaagagcagagauggagcaauaggcacaaugcccuggguucaauccucagcaccaagcaaacuuguccccccaaacacaaaccccacacccuaaaaaacaaacaaaaccccacauaaugcgggcugaagagauggcucaagaacucuuuguugucuccaguacuacaugguggauuacacuguuaguacuugcaguucuaggggauccaugccuucccacccugugggcaccagaauugcacguuguacagacacauaugcagacaacaauccuacacacaguaacagaagaaccaacucccccaaguccauauaccauccgaucacuagaaagcuauggugguuucaauggauguacccacaguuggagcauuaauauggggucccaauugauggcacugcuuaggggacuaggagaagugguggcguagccagaggaaguugccacugggcuucuuuucuuuuucucuucuuugugcuuugagacagaguuucucuguguagcucuggcugcccuggaacucugcuguagaccaggcugggcucaaacucagagauuuacuuuccucugcuccaccauguccagccuuggacaccuaauccuaaugccacccccaggucacucugcuuuuucugcucccaugccuuucugccaugcuuucccucagugaugguaauacccuuaagccccacaccccuuucuguaacuugccuuagcuguggcguguuaccacagcaaucagaaugaagcuaauacaaacaccugaaaugaauagcacauuaccaaccacuacucagaaacagaaggaaugcagcucacacccugcuacugagcacgccauucuggaaaaugaucuggcagcaccugcaagacugaaugaaccauacaccugguccauggcacagcaauucuaccccuaugagauuaucuaggggauaaagaggaguacuggacucuauagaccaguaggaaccucuagacaugacaagugacucaaguuccuuaacaagacagacagaaugcaggaugguggugcacaccuguaauccaagcaccaggaggaucacaaguuccaggccagcccgaaacaagacucugccucaaaagccaaagcaaaauaaaaaccuagcaacagaugacacaaucuucuaaguaaaaacaaacagaagcaaauaaaaguagcaaggcuugcugggcagugguggugcacuccuuuaaucccagcgugugggaagcagaggcaguuggaucugaguucaaggccaaccugggcagccacagauauacagagaaacccuguucagaaaaaaacaaaacaaaagaaaagagcaguaaggcuuaguaaggacaggacaagcaaguugagacguuuagagccacgacuguuguuaggacucuggaucaagggagaagguaacuaaccugggcgggcuccggaacauccgccuucgccuucacagggcugggcacacucuuccuccucuuuguaccccgaggaggcuccucgugagaccggucugcucucuucaacaccgcccgagugcuggagccgcacggggaaggggagucaaacagcccgcaacgaucggccuuagggucagagacagguccaaccuuggauuaaaauccaaccacuugaauggcaguuagucuaaaacccagccccaaggucaacauaguuaaggaguacuuuguuuaguggcucagcuccucagaacuccacaugccgaguaacuuacaagguuugcaggucuccucaugacaaggggagcuguccagaggcuugccaugcaugauggggucuccucaucauucuagagcaagagaaaacugcuuuuaaauacaucuagcagaggggcuaggaagaagaaaaagacccagcaaccaaauguuuugcagguaacucuccuaagaaaugccagauaagccuagauaagaaguuuuguguuuuguuuuggagacagagucuuacuguguuuggcuagcauccugaauguuaaaauuucuggcauggaacaccagagcaggccuguuucuucuugguacaagggauugauugagccuaaggccuuguacacuccccuaagcacaugcuauaucuuaguuccagaaguaucucaaaaccuuucuccuucccuaucguuagugucccucaggguaaggagaaagaucuuaccaguauuaucugaccuaucacccugcuggauuuagucaaacagacagaagacucaaugaacucucacaaaaugaacuguuuuuuaggaggcuucugcaggcugguuagaaugaacagacacgcccacacccacagacuguaccuucauauucucgccauccagaaggucuaugaagccaucauccucaucggacaaaguggcuuuuacaggugacugggguauaaaaagaggacugaaauuuccugauucacuuucauuugaagauagcugaaagacaaaauuagcaagaacucuagaccacuuugauugcuuagguggacugcugaaagaaaggaaagaaaaaaagaaagagagagagagagagagagugagugugugugcaccgugugaaccuagcacccucagagucagagaggggacuguacucccuggcuccugagcucaucuugcagugagaacuaaggccaugugcuaaaggcugugaucagcuaaaccuguugaaaauacaagugucaagccggguggugguggcacacgucuuuaaucccagcacuugggaggcagaggcagggggauuucugaguuugagaccagccuggucuacaaagugaguuccaggacagccagggcuauacagagaaacccugucucgaaaaaccaaaaccaaaaaaaaagaaaaagaaaaaacaaguguuuauggaucacaaaauagcggaucagagaaaguucaagaaagcccaaguaacuccagacaaauggaaacaaggggaguuuguucuaaacucuaccauauuccuuucuuuuuauuucaggagacaggacagucaaggaugagauaaaaccugugaaccucuuucuuccacuucccaaauguugagaucacaggugcacacuaccaaguuuggccucuaaccuagcucuccauuaggacuaaagaagcuggugcuggaaggauggcuccauggguaagagcaaauacugcucuuggagaaacuuugaguuuaauuuccaguaucuccaucagacagcucacagcugccuguaguuccagcuucacaugauccuaaggcccuggccuccuagggcagcuauaugcaugugugcauaccaccccgcuccacaaaauuaaaaaaagugauuuaaacuaaaaugacagcugcccaguauuuaaaugagggauuaugauguccuagacagcaacaaaaucuuuacaacuauagucccauuuaaggcacaccacucgcuucugguagucaaucucuuuuuucuucauugugacuaaguguucccaguguucauucuaucucagucccagguguagcugggacuacgugugucgacauagccaaauaaucuuuugcuuuuuguuucuugaaacugaugcuuaagggguaccaagaucauacaccucaucuaugcaaugcccuaccuugaaaacgaauuugguguaguggcaaacacuugugauccuacaggcaggagcaaaaagaauucaagacuaguuuugacaaauuugaggcuagccuagggauuuaagggauucugucucaaaaaaaaauugcgaguaacagcaaacucuccaguccaaacaaaagccaaaccaguagauaagcacaggcuuuuaaagucugcauccccagcauccauaauacaggugcucuuaaugcuuaggcaguuacagaucuuagcacucucacucccaagugucuaccaaaaccaaucaguuucagauauauuuucaaacuauuaucauguacugaggaaccuauaguuaaauucuaguguuuuuacauguccuuugaugaguauaucaacuucucuaaugaaacuuucuaaucugccaaaugaggcaacuccaguuaauucauaggccucagccaugagccaucaaacaauaacaguaaacuugcuuuucuguuuuugaaacaggauuucauguagcccaggcuguucuuaaaucauagcagagcugagcacaaccuugaacuccuggcccuccucccucuaccuuccagaugccacagcgcgcgcgcgcacacacacacacacacacacacacacacacacacacacacacacucuccauguuguaaauacgaaagccacacacacacacacacacacacacacacacacacacacucuccauguuguaaauacgaaagccaaaccacguaccauccgagcuggggcugaauucugccuguguguaaagggaucuuuacucuccucguagaugugacgagaugcaggucguauuggcuuuuuaaauucaaaugcuuccugcaaaacaacauauuugaaauauuuucuacuguccauaaaacagcucuagggcuggugggguggcuuggcugguaaauacacuuucugggaagccugaagauggauuagaaucccaucccuguaccccacacaguggagagagaacacacuccugaaagcugaccugucuucaugugcaccgcggcacgcucccacccaaggcuuucucuuucacuaaauaaaauuaaggaaaauuuguugagucuagagagauggcuuagcaguaagagcagaguuccuuucaauucauucauucuguauucuguauucugagacaggguuucuuccuggagccgugacuguccuggaccucagucuguacaccaugcugcccuuguccaccugccugucucccaagugcugggauuaaagaugugcaacccccacaacuggagaacacaguucuaaaagacccagguuugauucccaguacccacagguuggcuuacaaccaucaguaauuuguuucaggggaucugacacccucuucaggccuuugcagacaccaggaacauacaugguacacagacauacaccaaagcagaacaccaugugcagaaagaugcaugccuaucuuuaaguuacagaagcacacuuguuauuaaguacuaaaaccaguaacugcuaauaucaguuuuuauuacuaaguacucucugaacauaagcuuaucuaaucaucaaauacaaccugccuguucaguaagaaaacuacaucuacagguucaauggugugccuacgaucuugaagccagagaggaccacuccagaaaguuauuuaaucuaucuauuucuccuuuagagcaaagcuuccaggaagacaaccuugggagaagucaaguuugagucaagagcuacaucuagacuuugguccaguuguacuggaaagguugacaaacugcuccaagcagucaaggagggaauccauuugcauggaauaccucaugaugucucccuaaguugccagacaaaaucugcuuucauacaagacguagguuuuguaaggguuauugacugguauuuuggcaggaaaugggaaacaacaaauauauggaaauagaguggccgagaggcaagccaaucaaucugaccaacuauucuagacaagacacccuguacaguuuaagagagaaagccaggcagggcacacauggacuucuggauaaaacacaccauccucaaagcaaccauuucagauauucuccacagaacuugcauggcuuuggauuuuagcguuucaauccaguguuuauaaaugugacagauacucaucggaggaaauaagguacaggaaaaaggcgcuggccuagcaaaacuccagcaucacaaagcuagguagaagaagcaagauucaaaaucagauuucucuacugagaggcuagguguggccuuuccauuagucagguuagauggcagcccaaccaugucacuugucagcugcugacagacacuuagguuucacugccagcugggguugccauggugaugcuaugcuuacauuuucuuuauuuucauccuggucgaugaggugaaaggugucguggucuagagaaucagaguggcuccucuucagggcugggcuacaucccaggagcuucugcuaucaaaguaaaacagagaaauugaguucacagaggcaagcacaauggaaaacucagguuaccuuuuucuuuuuuuaagauaagguuucacuuugaagacaaggcuggccuugaacuugagaugaccuuccugccucagccucccaaaugcuaagauuacauguuugaccuauuauacccagccaaaacuuuaauucuuaaagaaaugaagugggguuuggaaaaacuagcuuaccaccacauaagugcccagggguucaaccugcucuaacucagaauggccuuccaccuaaucagacaaggugcauugaccucuuggcagguaugauauagugccauaccaacccccuaguaacauuugcauaaaaagaacauuuccugguuugauaaaacugaggugaguacaaaguccacaagaggcuguuacuguugaaguuccucuagguaauaccuuacugccuauguguuuacagggauguagaaaagcaaugcccacuuucucaucguagggaaagguguuugauggagcaauuuacagguauuagcucaaaacaacagaacuuacagguagggaauuuauucucgucagggaaauuucaaggcuguaaugagaucaaaaagguaaacauaagaauaaagagauauucauaugagcagauucacauugcucaaccuagaguaggggcauggcaugguucucauuguagcauauacaagaauaguguucucugaucucaggagcgccccagaucgaaaaaaccaacccaacccaaaccccaagaugucuccuacaauacauacauccguucauuuaaggccuaacgucaaaaaggagagcaggggaaauuacagcuaaccuaaagggggggaaguccugcaaacugcugguaugaagcagcacucauucccaguaguguuucuagcauccgagcaacucagcaggcacagcuaacuacagagcucuaguccacuguaugaagaacguuauucaaaaauuaaguuuugaccaggagcaacagcgcauaccuuuaacccagcacccaugaggcaggcaggcaagccagggcuucaaaaugagauuccauaucaaaagcuaaccaacaaguuucuuccuuuugggagguucuagggauucacccugccuggggccucacauaccacacgagcacucuaucaccgaguuugcacuuuauuuauuuauuuauuuauuuauuuauuaauuaauuauauguaaguacacugcagcugucuucagacaccagaagagggagucagaucucauuagggaugguugugagccaccaugugguugcugggauuugaacucgggaccuuuggaagagcagucgggugcucuuugcacuuugagacaggaucuuacuacauugcccagacaggccuugagugucugauccuuucgccuuaacuucccgaguagcugagaccgcaggccugugccacugggcuuacuuaaggaaaacuuuccuucuaaguagaaaauuuuaaaguaacgaauacauacuuuucuuuacuguccaagggcccaggagaaucuagacagaaaccuuugagaaauaaaaacaaaauucuuaggaaguaauacacauucugguguuaagcaacauuuccuaagugcacccauggauccucuauuugcaaauaccaucaagggaaacaagauugaagaggccaacuaauaucaagauugacugauuuuuuuuuccccagauaguacugaccccucuaaguuuuuguggaguuauuuuuucaaauguacucauuuagggguaugaaaaauacaaccagguaaguucaguuccaaggggccaaucugguguauauagugacacugugucuucaaaaaguagcguuagagagauguuucagaagagcacaauugcucuuguagaggaccugaguucaauucccagccaccacaugcuaacgccaguaacucaguuccaagggauccgacacccucuccuggccuuugaggaaaguacacaccacaugcacacacgagaggcaugugagccaacauccacauauauaaaagcacacauuaaaaaaaaaaaaaagaaaaaagaacuggaauaaagauuuggcgcuucuucucuucauaaacugucucaggagcuuccucuguacucuacuaaaggguguuugucacuucacaccacaccacaccacaccacaauuucuauguguacuguugccaauuaaauuccuaggcaagaugcuucccgaauggcugacuccagaugaaugugaaggcugaacggacaccuggaguggucagggggauggaugguggcccaugccuuuaaccacagcacucaagaggcaagaggccaaugugaucuacauggugagacccugucucaaaauaaauaaauugauuuaauuaaauucuuaaaaauaaguggcuuagugguuaguagcacuuggugcuccuguagaggggacaaauucaguucccagcagccauaucaggcagcucacaauggccuguaacuccagcuccagcggcucugaugccuucugaucuaaacacacacgagcacauacauagacacacaugaacaguaauggcaauaccugaaucggucgauucugaggagcccauucucuguagacugcuguuauuucucacuuccauuuucucacagucacugaaaccaagagaggcaccuccacaugagcaauuucuagcacaugauuaaaaaaaaggugacauacaggccacgaaguagccaggcugccacaaaccaucuuugagagaccaagccaaggacaccccacuuggccacccagaauaccccaguuggcauuuaaacaaagaaaggagugagugguuuggccuugggccacauugucagacaggccuguggcaagggcuggguuuccuuaaaggagagccucagucugagguucugagugagccaggaguaagggcaaaggugacuaggccaggagucccagcuuuucaggguuugcaaaaguuguaagacaaguuuaggaggcgaaauacccaacaucgaaggaaaagcaacuucacuaaaaauaguguuaagcauuuuuguuagugauagugguguaggacuacaaaguccucgaagauuuccaauauggaaaaguuagguaaaaagugauagcuuaaaaaagguaguagauggguagauacaagaaacgugccggccagguggcugcauagauuuuacacaaaugcaagaaaagaaaaugccacgucccuuuguugagaaggaacaaagcuuacaggaaacuaagauccggcgcgggugguucagcaaagagggccuaggaggacccauucucacccucccucccaacccccauaaggguagauuccaaagacuuuucuggaauagagacagcguagagagaaaucugaaaggggugaacaagacaggaugcccagcaggcuuccucgaucuccgcggucuggcucuuggcugaggauagcccuggacuauccgaacggccucucccgcccaacauuccgcccgggagggagggugcacauggcgggcccuagccaggccauuccgggucggagcaucagaaccaaguggacagacucuguuuccugcuggaucaucccgagggccgaccagaggccagcggccuggggcaucgcucgcuggucucucaccugcccaguccuuccagcugguccauggugaccgucagguuggugacaggggacaguccgccagcagcugacgcgccaaacagcaucuuccccgugggcugcggcgcaggcguggggcugcaagcgaagaacaggcggcggcggugggggggcuccgggcccaguuccauggcgccgccgggccugcccggacucccgcuccgucuuccuccgccuccgcugcgccgggccccgccccgcuggcaccggcuucagccgcgugccacgccaccagcgcccgcgggucaaacacaaacacgaccccgcgguucagagacgcggccgccacgggcagcggcgcggaccggcgagcguaggggacucggcaggcgccaggcacaagcaccggugcuucccucucugucccgcgaggcccgcaggcgggcgggcgccugcaaccucaagauuaaauccaaacaaacuccguggaggaagagucuugagaccaccgcuccgacuaacucgccucacuuuuuuucucccuccuugcuccguagccggcucgcagagaaggaaccuucacuucccucaccaccaaaguggccuuagcguuaauugcugcacacucaggauagccgccgccccgc

SEQ ID NO: 5336 - RNA, 2871 nt, Mus musculus
guaguuuuguuagguauuaguuuauggaucauggauguuuucaaaguuaaucagagaguacacuagagacaagcaacguuucccuauucaaauacacugagauagauggcauuuaaagauguuuuauuagcuuaagacuuuuuugacaaugagacaugucacauucuggcaguacccccauacaauuucaaagaagauaaugaacauugaagaacauccuuguggaguuugcuucaaauguggcaagcugccaccaggcaagaaacuggccuugcuucaaacugcugacuguaugcuguccaagcuguggaaaaaaagcaggacacaaagaaagugaagugccaaaugugccaggacagcguagagaaguccuucaugauuccuguuucacagaaaaaucugugagauauucuggaccaguaggccaaagaaauggauguuccaaaguugcagaggaauuuugggugauuguaagggagcuagcaguauuuguccuuucuguaguuaugaaagcugcuuacuuagcauuucuugcuuauucagguaauauuuagccuuuucaugucucugauaggguuggagacuaucguuauagucucauaguuaagcuugaguucuuuaggaauuaagaaaauauuuuaagaucuaaaaagauguuuuuauguugauaaaugcaaguuaugauagaaaaugauuuagguacagaacuuuugauuuaccaagauaggauauauaguagaguacuuucuccaagguugccaaauacaaauggacuggguauuaugaauguaauucuuaccagaguauauagcuuaccaauguuagagagucuuuuauuuagacaaaaagggggaaauguugcaagauauuugaacacauuuugaaccucaagauuguaaacuggaaaaaccuuguugugguguagcuuagcccuagcauacaccuguaacccaagagcauucugguauuuguaaacaagcauuugugguguggcucagcccuagcauacaccuuuaauuugaaagcuaaacaaagucaaugcuaggucaggaggcagagcaugcuugccaacugacaguggaugacagugaaguaaacagaaaggaagaccuuucuuugaugugaaggguauuuaagacagcauggagaaggagaagggccuuuuccuucugggaugucuguggaguaggaaggucagcugggugaguuccuugcuucucaaagcuagcagguuuucaccacagcauuuggcuccugaaucuucauugguauaauugaauggcugggauuuuuguuuuaaaaaccacagguuauacaaagaacaaguaggacauuuucuuauauauuucuuggcuuguuuccaggugaucgguauauuuuuaaaaaaccuuuacaguuaacaugguguuuuucaugaaauauugaggcuucuaauaauacauuuccuauuacauuaauaauugcucaguuucuucauuuccuuguacuaauggaccuggccagccuguauaagaccaaauaugggugauauauaauggauaguuucuauuucugauugccuguugcauaaauaacaagguuaauucugaauuaucuggaauaaauccaagaguaucuacaugcaaaacaacucuuucugcauauugagagucaguaauuauauuaagagguucaggaaaaucuaauaaugccauaagaauugcauacaacucuguugaccuuaaucacaugggcuuugaauuacuuugcuuauuuuuucugacuuacauaaccagcuauucccaacuuacuugcaucaguauaaaaugcaggugcuucaggaauuaguauuccuuuuauaauaugugggggaacccaauuaguucuuuuuauaaacuggagucuuguuuuuaggauauuuacuguugcuacaagcuauuugccagucuucauugguuaccuauaaugaaguaaucucaguguuaguauaugacaguaggauuucuacuuguucuauuccagacaauugacagucuuauucuuccuuucauaauuaaaucagaaaccuuuucuauauaagucuuuaauuuuuuacuuuguaugcuacguaaacccauucuaaaauacuaccuucucuuugcauaaugagccccguaggagaaugaauugaagacaagauaaccaaaauacagucugguuugcgaccuauaugauccacauaugcauucugcugucucuuuucuacuaaaguuaacucucugcucucuuugcuagccaucuuguacuaucuaagucugaauuucccuguaacauuugaaacaaauuauuuaacacuuuaguaguucauccaguagugagcuguagccaauuaauaacucaaauuaauuuuugaaaaucauuggguuugaaacugaucugucucuuuugugguugaaauuuauuuuuauuuuauuggauuuauuauauaacccaaaauaacccagaucucuacucugcuuuuuucagaagcaaucugcaauccccaguaaggugaaauucuuuuuguuucacuaaacauuuucucuaaaguaucugcaucagaaucagccaacaaaauaucuauguaaugauaaauaauggauugaggaaauugccuaugaauuauuucuacugguuguugcauaaaauagaauuguaccauuuaacauuccggguggaaaaacuuuccacugacaccuuuuuuguacagguugaacauuauuauacauaggcacugugaagccaguuuuuuucuuuaucuugcucuugcagggggauaguaaaaaagcagucuuuuaaaucaauuacuauaccuuagguaaaggaacuccaggcugugauggacuacucuacucagggcucucaaaucuguua

SEQ ID NO: 5337 - RNA, 15124 nt, Mus musculus
augaggccuggggagguggaggagguggggguggagaugaagguggugagucuaucaucgacucugcuaagacugcugguaacuguguuguaggaggaaggggagaugcugcuguuguacuugcagccagcuguggccuagaugucacaugaagcaaauguuucuuaaaaugaauucugcccaauuccacucucgauuuugguggcgaagauucuucuguagcaggaaaaguaucuccagcguccauuuuaacuuuaggguuugagucuacuugaagagggggagcuggggaguuuggagaaucacuuugcuuuucauugcuaagcgcagugagaaaucuauucuguaaaguuuucuuuguaaaacugaagcugaaugacaccuuuugccgucccuguuccuccaaauuaacuuuugucuucgugccuuugggcaaaaaucgacuugaagcaacaccuuugaacacugguccuuugaugaaaccuguuuucugcacauuuucaaucuuugccuauaaaagaacaaagcaauuauuacuauaacaaauacuuucaaauugucauuauaauuuaaaaugauugucaaggaaauaaaaaaaaaaaaacccagcaguauaacuuucacuaugcgacaaauggaauucaguuguucauuauuaaacauuuuaggcaagaguauaaagauaaguacaaguauaaagacuaacaaaucacuaaguaucuaugcccagcuucaaacaguucuugugagcugauauuaaugcuccugcucccacuuacccagcccugggacugcaaccaugcacuaccgcucagcucaaguagcaucuucaacaagaauuuccuuuaaccugacauguaaugggcacuuacacacauggcaguaaauagcacuucaguauacgaaauaguuuuccuuauguguuauuuaucuaagauacaccaaagaucaaaucaaacaaggaucuccuagcaucacauagaaucaguagaugauuuaaaaaaaaaaaucaguaacucuaaaaugaagcaaaaacccuaccuguuugugauaugucuauuuuuguuuuaagguaggaaugaaguccaagcaagggaaaaaaaaacaaaaaaacaauuuuaaugaccuucccugguacaacuuagccucuuacagauuucauuuuacugauaaagcagucaaaagagaaucaggccuucugucaaacuagaaacugaaauuauucuaccuuagaacaccaccacuaucugauacacacaccaugguacugcuaauaauuuauucucuaauauuacuaugugaacaacaaaauauaacuaagaagucuucuccauuaucugucugacaaagcuaucucaaaguuucugaaaugguggaggucagaauuuaaaggcauaaccuagguuguugaaagaauaauagaaaaaucuagacacaaauuaaagcaagcaagcauauauauauggguaauaucaagacagacacucaaauccaaauuaaaauuuugccccauaguugagcaugauggcacauuaauccuaguacucaggaggcagaggcaaguggaucucugugaauuccagacagccaggccuguuacacagagauaucccuauuucaaaaaccaaauaaaauaaauucaucaucuacaacaucuuucauauaaauguuuuuuaauuuacuuuggcuuuuuuaagagaacaauuuuccucccgaaugugguaaaauugaaaauuaguuuuaaaacugggcacaguggcacauuacuuuggucucagaacugaucucugaauuugaggccauccugaucuacaaagccaguucaaagacagccaaggcuagauagaaaaacccuuucuugaaaaaccaaaaauaaaaaaaaagaaaggcuuuuacgcuauacauacauauuacauuauacucauagcagugguuuucaaacacuuaagaaaugaaaucuauuuuucaaauuaaauauuacauuaaauauauagaaacaaacugauucuauaacugcaagcuucugucgccuuucuauauuucuugaaucuuuuaaauuuaaaaguuacuuucuuggugcuguagauaggguucagcaauuaacagcacugggugcucuuccagaagaccuuagcacccacauggcagcucacaacugucuguaacuccaguuccagggcuuccaacacccucauacauacauacaugcagguaaaacaccaauguacauaaaauaaaaaaaaaagacuuucuugagaugaguuauuauagcucacaauaaccaaauugauuaaacuauuaacuucauuucacaaccaaaaugauaguuaacuuuaaauaguuucagcuguaauaaaugaacuuaaaaggccauuucuuaaaugacuaauucaauuauacuuaccucauuuucuucuucucuacucccauucagccaagaaaacaugcaaaagaauaaaacagaaucauaaauacuucaaacaaaauguaacuuugaauuaaaacagauccuuauaaaacccauccacucuuucaugcucuauuuuuuguaauaacuguuuccugaagcuggugcaaaccacuaggagaaguaacagaaaccaaaugaguaaagcaguaguucugagcuugaggccuuacuuuuucuaauaaguaacaaaaaaugauuguuacaaaaguaauuccaacauaagaaguaaauauaaagacugagaaauauacaauguagcagcaaaguaggagacaauuuuguuuaaaagaccagggauguaaagaauccagaggauuaauuuuaaugaauauacuuuuggagugaucccaaauaaaaggcagaaauugaaaacagaacaaguucuacaagaaaauucauucacuacugccuaaguauaaaguaugagauagaaagaaggcagcaauuaaaugggauaaggggcagugggcauguugaagaaucacauuuuuacacaaguauagaugcauuuauuucuaggaagacuaaaacaccaagucugguguacaugcguguaccaaggcauacugaagacuaucuacauagaagggaaaagcuaggaagagcgugacaaggauguauauuuuaaguauguugcucuguggcaacucaagcacagcuacaucuuuuaugcgcuccuuaagagaaacauacaaaaauccuauccccaaauguagaucuaaauagcaauucaguugauccacuaacagguauuuauggaaguuagaaugaaguaaugacauauuaugaugaaugacgccaguuaucuaagcuauacagcccacugaggcaaaaagauucaaguucaaauacugcaagggcuacauaguucugggccaaucugcacaacuuaguagacccuacuucaaaagaaaaagauuuaaaaggacugagaaggagcaggcacagugguucaugcguuauaauccaauccuagagaaaaagaagcaggaacuugacugaguaaaggccagucuugguuucauaguuaauuggaagccaaccagggcuacauaagaccugccucaaaacagggugacugagguuauaauagcucagucagagugcuugccuacaaugcaaauggcccuaaauucaauccgcaccaagacagaauacugcaauaccacaagacaaaaacuguaguaaagauauauuguuaagaucuggagcacugucaaagauaaagaguuuuuauuuucagugggucuuaagacccacugaaauuucauauacauaauuuagaacugcuguacaucaauugucugaugaauauuaucacccauauauaauaucuugccaggcauaaaagcacauauacuaucaauggcaacaguuaauugaaggauguuuuugcuacaugaguauagugauuaaccuguaaucuuagcauucaagaagcugaggcaggacaaucaagaguuguaagcuagccugggucacuuggcagacacuguagcucaguuggcaauauacauaaagccuuggguagauugcuagcacugcaaaaacaaguguggcaccacacaccuuuaacacucaaacucgaaaggugggaugcaggggaaaagcaggaguucacaaagucauugucagcaacaugacaagcucaagccaaccugggauacguaagucuaucguaaaccucuaaugcuguggcugugguagagccugccuuucacuccagagcuugaggcggaagcagguggaucucugugugaguucaaggccagccuggucuacaaagagaguuccagaacaaccaggguucuuauacagagaaaaacccugagaaggcucaaagaguugagaucauuuguugcuuacaaaggaacuggauucagcucccagcacccacaugguaguguacaaccaucugugcuccaguuccaggggauccaacacccucuucaguccuccaugagcucuaagaaugcaagugguacacauacaggaaaucaugcacauaaaaauaaauacccuuaagaaagguuugguuuaaaaaaaaaaaaaaaaagccagguggugguuggcccaugccuuuaaucccagcacucaaagacaagcugaucugaguucuagaccagccuugucuauauaaugagcuucaggccaaucagaccuugucucaaaaguguugaccagcuaagcuggaaagaugacuguguaguuaagagcaaaggacccuagcaccccuugaccccccacacacacauacaaacacacacacacacaaugcaucuaauaaucaucuguaacuccaguuccagagaauuuaacacuuuacacacauacauauaaaaaaauuuguuuuuaaauugagaaugacugucuaucauaaacaaagcccuguggugguggcccaucaccuuuucauuacuuuauuuacuuuacauccaaaucacccccccccaacccccaccccaucccuggagcaaacaccuuuaaucccagcacuccacuccagaggcaggcagaucucuggguuugagugaguugcaguacagcuauggcuacacagaguaaacaugucuagaucaaucaaucaaucaauaucaaucauaaucuaauauugguagagaaaaggauaaaauuacaaacaagcaaaagaaaaaaagcucuugaauccaaccuauuauguuggugugcaaacccuucuuacacauaagugucuguguggcuuuuuaaauuuaaacugauauuuucuagguguuguaaccaaacuauacaagccauuaaguauuuuguuucauuccuuaauccuaaauacagcuaguagcaaaaacauauaaauuagagaaucagugaaaaauaguagaaggaaguuauguugaaagacaucaguucagcagaugaaggcgcuugguuuaacagccaggaacccacagggaggaggacagaaaaacugacuccacguccuccgaccauaugcaugccacaguaggugcauacacacaucacauaaccucccccuucacacauacaauaauaauaucaaaagcuguuuugaaaaggaagaaggugcuacaaagagauagagauagucaaacuucaaaauaaaaguugggccauaugguaugugucuguacugcagucccagucauuuaaaaggcugaaguagaacugcuugagcucaacaccaaacuaaacauuaccaagauucuuaucccaaacuacccaggcaugauuauauaucugaauaccuauaauccgaacauuugggugagagaaacagaaggaucacaaguucaaggccaucucuaguuacauaguaaaguucaaaacuagcuugagcuauauaaagacccuaacucaaaagaagggacagggacagaaagaagacuagggaauguaguuaaaaaugcuugucaaacaugcaugaaaaaacuggguuuaguagccaucacugaauaaacuacgugugguaauccuagcucaagagguagggccaagaggaucagaaacccaaggucauauucaauuucauagugagggagacccugcuucaagaaaacaaaaguuagaacgcuuuauguuucuaauuugaaaaacacauacauuggggcaacacccacaacugucaauaacuccagucacagaguaguugacauacuuuucuggccugcacagacacugcauguaugugaugcacaaacauaacugcuagcaaaacacaguaaacaaagcacaauagaaaaaaaaauacaugcaccccaggggaaaauuuaauaauaaacauacaacuaaaauuacaucuuuucccaaaacuauaaauaugaauaaacuuccuaaaaucacacuggcugcucuucuagagguccuguguucaauucccagcaaccacauggugucuuacgaccaucuauauagggacccaaugacuucucuuggcaugcagguguaccaaugauagauaaaagagauacucacugcauauaugcuaucauuaugaaugccaaaucucaaugcaacaacaacaaaaaaucagcacaagucugagguaaacagcuauuauaaucaaacuaaaaggucagaagcuuaucuauugaauguuuaaauuguaucuacucuguacuuuuaccagauuugaguacuaucauaguagucuuucagucuuauucuuacuuaaccugagcuacauuaaacaggacaaaaaaauaagggauaauuaagcagcucuuucaaauuguuaauuaagacuuuuauacaaauuaacuaccuuuuaaaagacaagaaucucacuauauagaccuaacuggccuggaacuccuuaugugacuaaacaggcucaaacucaaguaucugccugcuucugccucccuaguacuggaaacaaaaguauguaucaccaugauugaccacaaguuagcuuuuaaaauccugcauucaaagauuaguucccagcgcccacauggcagcuuacaacccaguuacuggggaucugaugcccccuccuuagggcuccugugggcaucagaugcagacaugcaugugacaaacauacauaugugcaggcaaacacucaaaaggcacagaauaacagccagguggcagggcagcaugcuuuuaaucccugcauuugggauuaugauuauuuacugugaagaaugaaaagaaaaaaaaaguuaaguguaagggaaggugauuccuuaacaagaaaagacauaaaacuaucauuuggcuggccuguaacccaugcauucagggagaggcgggaugaucaccagcucgaaaccagacugggauguaguauacaagguccuaccagccucagcuguacaguaaguuaggaaccagccuacauuacaugggacucugaaacaaaaagcuuuaaaaaaaagggugugugugugugugugugugugugugugugguagcacaugccuuuaaucccaguacucaggaggcagaggcaggcggauuucuaagucuacagccuggucuacaaagugaguuccaggacagccagggcuauacagagaaacccugucucaaaaacaaacaaacaaacaaacaaacaaaaaaggcacccaggcaugguggcacaaacacacaugggaagcacaccagauuucugaguucaaggccagccuggucuacaaacgcaguuccaggacagccagggcuacacagagaagcucugucccagaaacaaagaaacaaaaagggcagggacuggagagauggaccagauguuaaaagcaucuuccagagguccugaguucaauucccagcaaccacauggugccucacaaccaucuauaaugagaucugacacccucuucuggugucugaagacagcuacaguguauucauuuauaauaauuaucuuugggccggagcaagugggguacauacauaaaauaaauaaauuuuuuuaaaacagaaaaagacacacaauaaguaacuuaggacuaaugagaaauguggacugagguaagagacagagacagauguaaaagaaugguauagguaugacuagaaccacagggaaagcaauagggacuguucccugaacauuuaacugaguuucagagcaaugcagguugauucacuguuuaucauagugacauugagacuucaaaguuuagaaaguuuacaacaaugugaccuugaccacugaucagacuugaauucuuugaagaucuuuauuaggaaauaauuacagucacaagaaguauccuuguggggcuggcgagauggcucagugguuaagagcaccgacugcucuuccgaaggucccgaguucaaaucccagcaaccacaugguggcucacaaccaucgguaacgaaaccugaugcccucuucuggaguguccgaagacagcuacaguguacuuacauauaauaaauaaaucuuuuuaaaaaaaaaguauccuuguacucuuuacccaacaacucucuucaacaguaaccauacaagcuuaaguauaauaugaaaccaggaaacuauuauagguccaaauucuaguucgauuuuuguugcugagauaaaacaaugacccaaagcaacuuagugggaaagaguuuauucaauuuacauuucuagguuacaguccaucaaucugggaagucaagucaggaacuuaggcagaaaccauggaagaacauguuuuguuugaggguucaggcucaguuagcuuucuuauacagcccaggaccaucugcccaaagaauggcgcugcccacaguggacaaggauuucuguagccauguguauauuaauaaaugauuuguucuacuuacauguuaaaccugguguugucuggcuacucaaauaaaguauacaauuaauaacuauuuaucaagaagccaaauaucagacaaaauaaucaaaauguaaguuauaccaugucuucacaaagaacauuuaggaccacuguauagcccuuccaaaagagaaggucuaaacuauacuuggcaaggaagugggcaguugcaagagcuauauaagucagaaacuaccacuugcuccaaauucuugcaagcccacagcaguguucccaguaagcagcccuucuaucagccugcuugcacaauuauauucuuaucaacacccacaucaucccaaagcuauuuucacuaccauguuagcauuugacagaaaaagcacucuaaaauaaaaggcagcuuuaggaacucacaccaacuuuagaacucaauuugaguaaccauuuacuuacucagcuggaaaagacacuaagcaaccacuaggccagaacaaaauggggggggggggggggcuaccaggccuuauuguuuuuaaaaugcuucaucuguauucagcaaauacagguaaucacaaacuaccuccaaauuuauuaaaauacauaaagaagauccugguaucuugucucuccaacagcucagccaaaaaugaauuccaaaaaaauugaggagcaaacugggguaaaaugccccacuaaguaaaaaggcucaccaccucaguuugaacuacaacucaaguuagaggggagaacuaccuccccaagugguucucugcccuccacaccgcagcauagcauucacaugcccacuucacagacacauagauuacucccucauuuccauacaaaugcacagauaacaaaauagagggaaguaauacaaauagaaaauuuuccauuacuuguuaaucuaggcuaaaauuauaguacaauggcucacaucuauaaugcaaguauuuguuaaauugaguaagaaggacuguaaagucucaaaauaauguuauaccauuacaaccugagaugcuggaguagaaagugggcuuuucuaccauugguucugugcacauggcuauagucccagccccagcacuuuagggaccaauguuagugggauaacaauuuccaggccagcuuaggcuauacaauauaacccugucucaaaaaaagaaugaaacacacaagcuagauuuuucucaaaaagaaaucuaaaucugauuauuggugauucuagauauaaacaaucuccaaaucuuacaauagcuuuuaauccaguauaaaauaaggcccuacucuauaguucuagugaaagaauaacaggaaugaugaaguuggucagccuugagacuaaccaagcuggucaucuuuugcugucauucaacaugacuauucuaucgucucagcaaaagugacaagauucaugcaacaauaacaaauacuaggguuauacuaggguuaaaaguuauuacaaauaccuauuaagacuagaucagccagguauaguagcaaacaacuucaauuccaacacugaggaggccgaagcagucagaucucugugaauacgaggccauucuggucuacagagugaguuccagggcagccagggcuuuguagagagacccugucuaagagagaaauaaagaugaugaugaagaugaaaaaaaaaaucaacuguaggauauguggccuuuaggaggcagaagcagguuuaucucugaucccagccuggucuacacagcaaguuccaggccagccaaggcuauaucaugaaauagacccuuucucaaaaacaaaacaagaaaaaagaaauaaaaaaagaaaagauagaaaaggaaggaaggaaggaaggaaggaagaaaggaacucauguuggccauaauggugauuuuaaucuaugcaaauuuuuaaccacugcucucuaucaccaucauuauuaucauuucuuuaagucagggucuuacuaagaugcuaaagcuggccuugaaucaacucaguaacacaaccaugccuugaauauuuauuugauccuucugccucagacuacuaaucaaguaggauuacuggucuauaccaucaaaccuaucggugguguacacuugcaauccuagcccuuagaaggccaaggcagaaguugaaggucaccaggagaugccagugagauccugucucaaaagcaaauaacaagaggcuuacauaacuaaaccuuaacaguggcgcuucaaaagaguauuccuugccaggaaugguggcacaccuauauucucagcacuuaggaggcaaaggcacaacaaccauggaguucacacuagccuugacuaccuacuaagauuuuaucuaaacuauacaccaugaugaauuuuuggucuauaaugacugucuuaauaaucucauccagucuggugguuuguauauuaccuaaauagaugacuacaaaacuaucuccaguuuagaccuuuccccugaaaaccagacuaacaaaacaauccaacccaaaugucuaacaaucaucuccacuuacugugccuaaaaaggcacuacuauucccagcuugcucuugacaucaucccuaguucauuggacaacagauuucuaacugcucagaccaaaaaccuuacaaucauccuuauuuucucucacauaccaccugugucauucauuaaaccauguuagcuuaauccucagcauccauccauuucagccaccagcagcucuccuuucgcuucuuuacaagucuuccuucaggccuccacucuguuccucuuugggauacuauaaaugauccucugaucaacacucacggugggugcacaugcagccccagcuacucagucagcugaagcaggaagaucauuugagcucaagaauucaaagccagccuggguuccucuaaaaaaaaauaaaauaaaaucaaacaaaaaaacccagccaaaucuuuagaauggcucuacaaaauuuuaugaaacuccgcaccccuccuacugugaaccaauugacuaucacuuucucauuucauucuggccacacugagcagcuuauacuacacuggcacuuaggguuaggguuaggauuagaguuaggugaugguuacugaccgcccugccacucccucaacucuccacacaacauagacucagauaugucccaucucaacuuacucucccaaggaugcuuaccagcuuaccccauuuuauacugugacuuaacagcaaaucaccuguauccuauaggacuuuccaaagcauuuuaccuuuggccauucuguauaauguauuguuuacaggccucauuaggauguaaacugcacaaagacaaaguuuugcugaauacaucaauuacuccuacaguaucaaccuuagucaagauaggccuauguuuaaaacaacaaacaaccccaacaacaaacacuuuuuaucauguuugucuccuugaguaggacagguccuggaggacucugauugguugugcuaugcccucacuauguaccccugcacuauauggaaaccuaggcaguuacucaaaugauuagagccacuucacuuuaauacaaugugauuuauacugcaagaaaaauccaaggccuacacacaugcaacuacuuaaagagugaguggaagacaauacagaccaucugggccccaacucaagcuccaaucaaagcaaauuuacauuucaccucaacuucucuuuuucaaagaaccauuugaaacuaacccaagucugaaagggaaggacggccacuucacaaccaguuuucccccacagucacaccucucaaauuucccuaauaacuccagcuaaagguacuuacuugcacacacacugugccaagagcgaaggguucagguauuaucucauucaauuuucuccaaagccccagaaaguugcuagcauugggauaacuacuugcaaagugagaaaacccaaauguaaagacaaagccauucgcucaagguuaaacuccuguuuaagagcucacagggucugcuaaugcuucacucuucuuuccuggccaggccucauuuucuuuccauguaaaacagguaauacuguuguucaagaugccugccaacaccgucaggccaguauuaagaaaacauucuaugaccuauacaaguuaauaaacaguaucagagcuuacuugacacucuaaagccaagagagcaguaaaguacgagaccaggagagacacugagcauccccuccugugcacaguaaaggcagacuucuccacguugucacauauuaugaaaaauguuuuccuccaauaaaaaaaggauguaauccuuagagcuuugaagcuucacugugcaaccuggaaagucacugcauggcucuuugcccuuccuggggggcuagcacaugacuuuguacaugauaagcacgcaaccuacauuaauugaaugauacaaauuccuuuugagguuuuucaagucucaaagcaaaaaccuuuaaguguuauuccaaagccaaaaacccaggagaagacaaagccaugcugguuuccuacuacaaguaagagaugagcuuugcuguaagagcacaucaagccuucgcagagguggucuggguaccaagauuaucugucaaguaaagacaaacuaagaugggccacuaaagggcuucuguaaacuuagaaaacaaguauaaaacuacucaggcuguucuugggucaaaaacaggauugucaaaauuuucccaaugaaauuuuauuuuaaggcaacaugaggauuuugcuuuguguguggagauaacacuccaacaaaauaacuuuuguguuacaacacuaaagaacuauuaaguaagauccaaauguuucugagccaaggugaaaaacuuuggcaaagguucccccaaaaauguguaaugugguaauuuagugaaaaguuuuguuuuucacuagacaucccuucaaaccuuaacuugggaaugaauuuuguugcuaugugcagacaucaauacaagcaaauugagguaaaacaaugguuuuucuuaguugucagcaccugcaaucccagcacugaagaagcugaagaggaaggaucccagguucgaggccagccacaguaaauucaagagcagccuaggcaacaaggugaaaccauuuaucuaaaaacaacaaaaugaucuugugagggcuuagggaagcuucgcacggacuccugacucugaaguggaagcuugcuuuuuuacuuauguuguuguuuugaggaagccugccugcaauccuaauucaguugguaucucagguguacaccaccaucugacacccaacagaaauauaaaaaugcccuagguguacugaaaagaaacuauacgacaaaacuguauuucgcuuuacaaguacacuaucuucuuuagagaagacuauacaaagggucucuuaacuaaaucuucacacgcaguaaagccauccuuguagauaagauucuagauucuauuaccuaagaaauaggacgccaaaguguucaagcaucauaaucaagaaauguuugccagguuuucacuuucagguuaaaaaacaaaacugcugucaccucaacaacgggaccagacaaaccuugccaccauuacaaaacccaagcgccaaaggugcagaauaugaagcucaucgcucuacugggccagaauugaguguccaaggaggagggaaaacaaaaaacaaaaauaauaucaaaaccgggaaugcaacgcgggucuccuccgcggaucgaagcggggagacgcgcgguaggcccuuccgguccgaguugccgucaccgauaggccgggcgaugggccgagcuuccacccgagcccgaggauucucggccuacacgagccggcgcccugacgccggcgucggccuuugcggcgccucggacuaugcaccgugguuugcaacagaagcccgggacgccaccgaguguccuggaggagcugcgcggaacgccgaaccuaagcaggccgaccgaggacgcggcaacggcagaggaggccguggccgccccucccccaccgggccgcccgccccaaccgccgcggcgacgcgagcagccuucuccgcgccaggcccaaccgccgggccagccgaggccaagcgaggcggccuccaggagcuccgcccggccugcccuccaccacgaccgcgagaagccgcccggggcccguuacuccgcgcgccgccaccggucaggacgcgccgcccucgggcuggagcgaccaacgacagcgggagaccgcggagcagagacuuacucaggggucgggugcucgggaucguagaaaucccccaucuucgguggcggcugcugcgacggcagcggcuucaugaggagcggcuggaggcggcgacgcuagcccccuccccgcggcaggccgaugcgggggaggggaccggaggggaggcggccgc

SEQ ID NO: 5338 - RNA, 3323 nt, Mus musculus
uagguuagaacaaaacuccaaaggugccuuuaauaugugauucuuaaaaagaaauagaaaaaauaacaagcacauaaaggggcagaacgagaaucugugggcaaagccaugcccacucucuuacccacccccccaugucccucgcuucuaucuuggagaggauggagaaggaacaugaaguggccggaucuuuuguguucugcugccacaacagcaagcugaagccagagaaguacuaggaagcccaugaaagacaugaggccagggcaggcagcccugggaggcggcacucacaccaccgaggagcucucagcuggcgagcucaaaaccuggaccacaucuucucggccuauggcagccagagcauccuccagcacucugaggguagcucuauugccuucuugggcagcccaguuccuuagcaggguauaggcuggcauuuggucacaggccaugguuuccacagccucagcuugguagccgagguggccugccagcuccugccagcccuuggcuggcucacccaucaucaggagccgcuggacuuccuccugcugcugcuguggaauaugcagguaaagcuggcagccaagguccgggugugguccugggugggggugggggugggggugaagagagaaguguuaguggguaggggaggcacuaguuaaauacaaaggacuacagacagacuaggaaacgugcucacccuggcugggaauacagggcuccagacuaggaggagaguccacgaagacguugcugucaccacgccucuggucccugucaggguccccuagcucuacaguccgagcuuuagccaacuguugccuuugcuuaugugagcgccagcuguagggggcagagggcacuaagacaaggaacugccucagaguccaggcauggaggggaugccacaggacaggacccagaccaccuaccauuugaaggccacauaggccagcagaccaaggaucacuguagcuaggagagcacaguagacaggaaugauguugcucgaggccccuggaggcucagggggaaauagggaggagguauugggggcuagggcucccccagcuccuacccacauuccuucccuguccccguccugccccugcagggcuguaucugugaagacagacaguggucaagauagggagccacggcagccucaccuagguagaccaucuuggcagaacuuuccaaauacauuagaguuuaccauguguuaaaggacuacauggcuggcccuggagcggcaagaauggcucagcagacagacacaugccaccaaguaugacaaccugaguuugaucccccaggaucccugaaccacacgugccugcuaagugguuacuggggcuuguaccgccucaggacaggaguucuguucccaacaccacauuggauggaucacagccaccuuuaacucaaucuccuggggggguugaugcccucuuacacccucugugggcacucucacacacagacgugcacauagguacacguaaauggcccuuugcuugccauuguggacagucacucccagaugugccuugucaucuuccggaagcauccaaacgucuugcuauugcaucuucuccuaaacgcacagcaggaucuccucuggaagccuuccuugaccuuucucuuuucacccugguugcaccaccucugcuuaccacagcacaagauuggucggcuuccaggguagacugugagagcacacugaugugugcuggugucaugggaucauaaaaauaaaacuuaacuggaaguaaauacuggugcucucucacuucugccuuaaguccaaugacugacuaguccuuguacccaguguagacaggguucaagggucagggacuaaagagcccgugaauggacuuguacacgacccacucuaccucccaaucugcccgcuaccuaggaucugggacaaggaaugccuaccugaauagaccacaccuuugcugacguuauaaagcauggugcugccaggcgcugccugcugggcuguuuuuuggugaaggggaguuguguagagaacugaguugacggagcuuggagccugcuucucuugaaucucagaaggaggaacucugcagaaauaugaagaaauccucagaucugcugucaggagucccugggggcagcguguguguccauccugauucacaccagggcuggaacaguuucuccugugucaaauagguggagguaacaacuggcuccugcuagccaaagcugguggcaugggguacagcucaggauagaaaucacccgaucucaaagaccuucccaaguaccugggcugagucuggggauguuaaaaggaggguaaagauacauggacugugacccuaucucaggcugaaacaucccuaggaacuggugaucauacacaucugccaaaacccagcaucccaagguccccaaggcaagcccgcuuacacugccuaaugcucccucuguccccuccagggccaguggccagcccuuuccugggcagggacuaagugaacugauaccuuaaugguucagcaaacucauagaccauacagaucucagagggccugaaauggaagaacagggccaacucagaccaaggacccaccuggacccuagaguacuaaaucugcugagaccacucccugcagucuacggaggaggagaggcuccagaucugaaggaggagagagaucuggcuuggauaaguaagagauuaaaagaggcccuucaaguccccaacggcuacugcugcauagccaauggcucuaacacguggugugucuauaguagggcuaucagcaguucggugcuguagucagguaaaccucugauguggguggccccuuuauggacuuuguaucuuugugucgccacauugggaguugggggcuucugggauccuuggugggugggccuguaaaccaguagcagcagacaggccuuggaaucugccccacccauccugagcagccggaguggaacuucuucagggcuccccacccaucuccaagcccaaaaugggaagaaacaauucaacagccccugcaggcccauacacaccccaacacagacgcugguacccacaggaucagagcacuaaaggcgggagacagagaaaguucuggccccuuccaccuagcaagagcccggcuagucauucccuccuaaccuucugcggccaccccuccgagggugccaggauccacucagcuaggaagacgacgggagucccuggagagggcagguuccggucugcccaagagugagccaaggcaaggggcgggccagugggggggugguguugaaga

SEQ ID NO: 5339 - RNA, 3323 nt, Mus musculus
ucuucaacaccacccccccacuggcccgccccuugccuuggcucacucuugggcagaccggaaccugcccucuccagggacucccgucgucuuccuagcugaguggauccuggcacccucggagggguggccgcagaagguuaggagggaaugacuagccgggcucuugcuagguggaaggggccagaacuuucucugucucccgccuuuagugcucugauccuguggguaccagcgucuguguugggguguguaugggccugcaggggcuguugaauuguuucuucccauuuugggcuuggagauggguggggagcccugaagaaguuccacuccggcugcucaggauggguggggcagauuccaaggccugucugcugcuacugguuuacaggcccacccaccaaggaucccagaagcccccaacucccaauguggcgacacaaagauacaaaguccauaaaggggccacccacaucagagguuuaccugacuacagcaccgaacugcugauagcccuacuauagacacaccacguguuagagccauuggcuaugcagcaguagccguuggggacuugaagggccucuuuuaaucucuuacuuauccaagccagaucucucuccuccuucagaucuggagccucuccuccuccguagacugcagggaguggucucagcagauuuaguacucuaggguccagguggguccuuggucugaguuggcccuguucuuccauuucaggcccucugagaucuguauggucuaugaguuugcugaaccauuaagguaucaguucacuuagucccugcccaggaaagggcuggccacuggcccuggaggggacagagggagcauuaggcaguguaagcgggcuugccuuggggaccuugggaugcuggguuuuggcagauguguaugaucaccaguuccuagggauguuucagccugagauagggucacaguccauguaucuuuacccuccuuuuaacauccccagacucagcccagguacuugggaaggucuuugagaucgggugauuucuauccugagcuguaccccaugccaccagcuuuggcuagcaggagccaguuguuaccuccaccuauuugacacaggagaaacuguuccagcccuggugugaaucaggauggacacacacgcugcccccagggacuccugacagcagaucugaggauuucuucauauuucugcagaguuccuccuucugagauucaagagaagcaggcuccaagcuccgucaacucaguucucuacacaacuccccuucaccaaaaaacagcccagcaggcagcgccuggcagcaccaugcuuuauaacgucagcaaagguguggucuauucagguaggcauuccuugucccagauccuagguagcgggcagauugggagguagagugggucguguacaaguccauucacgggcucuuuagucccugacccuugaacccugucuacacuggguacaaggacuagucagucauuggacuuaaggcagaagugagagagcaccaguauuuacuuccaguuaaguuuuauuuuuaugaucccaugacaccagcacacaucagugugcucucacagucuacccuggaagccgaccaaucuugugcugugguaagcagagguggugcaaccagggugaaaagagaaaggucaaggaaggcuuccagaggagauccugcugugcguuuaggagaagaugcaauagcaagacguuuggaugcuuccggaagaugacaaggcacaucugggagugacuguccacaauggcaagcaaagggccauuuacguguaccuaugugcacgucugugugugagagugcccacagaggguguaagagggcaucaacccccccaggagauugaguuaaagguggcugugauccauccaaugugguguugggaacagaacuccuguccugaggcgguacaagccccaguaaccacuuagcaggcacgugugguucagggauccugggggaucaaacucagguugucauacuugguggcaugugucugucugcugagccauucuugccgcuccagggccagccauguaguccuuuaacacaugguaaacucuaauguauuuggaaaguucugccaagauggucuaccuaggugaggcugccguggcucccuaucuugaccacugucugucuucacagauacagcccugcaggggcaggacggggacagggaaggaauguggguaggagcugggggagcccuagcccccaauaccuccucccuauuucccccugagccuccaggggccucgagcaacaucauuccugucuacugugcucuccuagcuacagugauccuuggucugcuggccuauguggccuucaaaugguagguggucuggguccuguccuguggcauccccuccaugccuggacucugaggcaguuccuugucuuagugcccucugcccccuacagcuggcgcucacauaagcaaaggcaacaguuggcuaaagcucggacuguagagcuaggggacccugacagggaccagaggcguggugacagcaacgucuucguggacucuccuccuagucuggagcccuguauucccagccagggugagcacguuuccuagucugucuguaguccuuuguauuuaacuagugccuccccuacccacuaacacuucucucuucacccccacccccacccccacccaggaccacacccggaccuuggcugccagcuuuaccugcauauuccacagcagcagcaggaggaaguccagcggcuccugaugaugggugagccagccaagggcuggcaggagcuggcaggccaccucggcuaccaagcugaggcuguggaaaccauggccugugaccaaaugccagccuauacccugcuaaggaacugggcugcccaagaaggcaauagagcuacccucagagugcuggaggaugcucuggcugccauaggccgagaagaugugguccagguuuugagcucgccagcugagagcuccucgguggugugagugccgccucccagggcugccugcccuggccucaugucuuucaugggcuuccuaguacuucucuggcuucagcuugcuguuguggcagcagaacacaaaagauccggccacuucauguuccuucuccauccucuccaagauagaagcgagggacauggggggguggguaagagagugggcauggcuuugcccacagauucucguucugccccuuuaugugcuuguuauuuuuucuauuucuuuuuaagaaucacauauuaaaggcaccuuuggaguuuuguucuaaccua

SEQ ID NO: 5340 - RNA, 5585 nt, Mus musculus
uacugggagauggaggguggccuacgugaugacauggcguccggagguggcucccugggccucauagucuuccucuugcuccuucagccaaagcccugcgaggccugggcagccgccucuguacucucuacuuccgguuuccccucaggguuuagugaagccccgagggacaacccaccgccacccacccgggugcgcauguccaaggcuaccacccgcucuccuuucaugaacuuuuccuuagguaauuugguaaggguugucuguggcaaggggagggcugggucaagguccacacuaagagcuaaugacucccugagagucacgggugucgcucaggccacuguuguguagaguucgguugccuugccucuggguggcuucaggggauaugacugccuguaugauguugaagccuugaggguaugaagugccugugguguucaacacuucuuggcuaucguugggggaacguguuuuuuuucuguggaaaugcuaacaugaagagagggccuaaugcuuaugaguucuuuucaucuucccucaguguguggccaacccuuuaugaagaucaugggagggguagacgcugaagaggggaaguggccuuggcaggugagcguucgggucaggcacaugcaugucuguggagguucccucaucaauucccagugggugcugacugccgcccauuguauuuacaggugaggagucuuggggagggaucuggagggaaacccugcugucuaaucuaccugccugacagaaacauuccagaacaaaagaaggggguggccgugcuaugaccaucuuguuacuagaaauauuuaggguguggcacaggcaaaacaguugagagauuaauaaagaguuuuagugacagacacaggaugauagagauuugggacauguugagaagcagggacggaguggaagggguauaagagagcuugguggggucauggcuaacgaggcaacacauuuuuuccauagccgaauccaguacaacgucaaggugggcgaucggagugucuaccgacagaauacaagucuggugauucccaucaagaccaucuuuguccacccuaaguucucaacaacuaucgucguuaaaaaugauauugcucuucucaagcuccaacacccugugaauuucaccacuaacauauacccugucugcaucccuucagagaguuuuccuguaaaagcugggaccaaauguugggugacaggauggggaaaacuagugccaggcgguaagacuggugcucagaagaccuucuuccugggguagaaacaaaagaucccaaggggcacagaagagaagcagacuccuuggcaggcauguguguguguuuguguguguguguauguguguguguguguguguguguguguuguuggguaggcaguuuggcagaaaucaaggucauggucagcuuaagugauccuuggucuuguguugaaaucuuuugucacaacgcaaacaucugaugacagcccacagaagguaucccucucuccugggaacuggaaaugugucaaaucuccuuuugcagauuuguggggcaguaugcugaaugguuauaggaauugcuacuuucccaguggacaaaggccaaaugugauggaauucuccuguguggauauccagaucugauuuauuuuauuugguguguuauaaguguuuugccuccaugcaugucuguguaccaaaugccugacugauagcucuugggugucaccgcccccugggacuggaguuauauaugaguugugagucuccacacgcugagggaggugaacccaggucucuuaacugcugagccaucucucuagcaccuuggguggauuuugccucacgaaaggaugaucugcuggccagcuucucaguggaaguuccugccuugguauuuauggaguuccuugugccuaggggaauugggugagccacgggucucuguugguaugcaucuuauccgugagaagaagucaauugcgauaccuuuuaggguucuaucuccugagagccugugauuguguucuagaaagugaagaaaauuggcugggugugguguuacgugcagaacuauggauaguucgagacuagucagggcuauggaaagaccccaucucacugacaaauaaaggauggacaggcuaucuccucucuaccacacugacaucaguaaugaguuugaugggcugucauuucuucauccucucaggucuugcuuccuuucagaaauacuacucuucuuuugucuuaguuucccccccuugaagcaugagaauuggacccagggccuuaagugugcuagugaagagcucuagcacgaagcuguauucccugcccuuucuacuuuuucuuuugaggcagagccuuggacucacucacacuguagcucaggcaggccuugcacuugagauucucccaccuuggccucccauggacuuacagacuuaggccauuaugccuggcucaauccugccuguuacucaauguuuuuccuaucaccguuuuuagguuuacuuucuuccgugucagauggggacaauauuaacuuuuguccagggggauucuuggguguuugcaugcuugcuguccacugagcagauuuagacgcugcuggucuuuuucaucagcaccggauguuccgacagaaauccuccaggagguggaccaaaaugucauccuuuaugaggaauguaaugagaugcugaagaaagcuaccucaaguucuguggaucucgucaagagaggcauggucuguggcuauaaagaaagaggaaaggacgccugccagguacguucacagacuccuuucuuagccccagaugucaaggccugagucauuugcuaacucuuuuacucaagaaaauuaauggggagagucccaacaccccauggcuccaggagcuggccucacccuaucuuucugcguagcacaggauagccuuaaacuugagauuggcuugcaucaaccucccacauguugagauuacggggagacaccacuguguccagcugguuugguccucucuaaaggaccuguguagguggaugugugggguuccuguguauguguugaaguuggggguggguaauauaacaaugcuuugcaucuaguuccccuauguggcaguucccaccacaaagggaacaugagcucauguucacucaguuaacucauaucacaaccugacaacguaacaccauagcuaucagacugcuguggaaguccaaagacaugaacugaagauccucuugugauauuguuuuuagagauaggggugaauaugcguaggggaucggaggucugaguggacuucuuauguuguccuaguguaugguauacacuuguaaucccagcacucacgaguuugaaguaggaagaucaaaagcucaaggucagaccagccuacauagugagugugaggugagucuuggauauguaguaagaucuggucuccauuucagggaugggaagugaagagcagugaacaagagaccuuaggcuuguaccccacacuaggguagaggaugcagauguguuaaauaccuggagcaguaaaauugggcugaagguggccaaguuucuagaguggcccaggcaaacaugggaagugcagccgggugaacauggucagauuuuccuuuuagaucaguggcucccuuggauguauaauuccagaauuaaugucuucagagcaugaagaagaugccguuaaguucugaccagggucuagagcaaccaagcagugaggcaagcaugucugaggugucugagguaaaaugaucagcuaaugagaggguagaggugguaagggguacugagaaagccuaugguugguugguuuguuugcuuauuuuauguguaugaguacacuguagcugucuucagacacaccagaagagggcaucagaucccauuacagaugguugugagccaccaugugguugcugagaauugaacucaggaccucuggaagaguaaucagugcucauaacuguugagccaucucuccagccccauggaagccuauguuuuuuuuuuuuuuucacugaagugauuguuagggucucugaaguagguuugggagaagaauaugcauaaaugggcucuauaauccaccaggaucuugcuguauaggugaggggagaaauugcauuaaaugcaaggagcugcuacauagcaaugauauuuaaugggauaaaaaaauuugucuucguuuuaugugugugagugguuugcuaucauauauuuaugugugcugugugcauacagugccugcagaagccagaagaggguguaggaccccuuagaacuggaguggcaggugauggugggucaccauguggguguucucaaguaauccagcguccucugcagaagggccaugucuccugccccucggaaguagaauucagaauuuaacaccaccaugacuccagaaaugacgaagauaaccucagagcagauuaacacuuccccauuaacucuucacugaccauaggaauaaacccaguuccagcauuuguauauuaauagaagcuugggcguggcaaggaugcuucccugucccucucucuuuccgagucagugucuuaguacguaguacgguaggcuugaacucccugaaauccuucugccucacccucacuagggcugauacuauaggcauaugccacugcacuuggcucuggcuggaccuuugggaugcccaaggaaacuaugagccuguccccugagugucuuccaguguaauuagcgaaacccacuggggcucaauuccauucuucauauuuguuucuuucucuuucuucagggagauucuggaggcccgauguccugugaauuugaaaacaaaugggugcagguaggaguugugagcuggggcaucagcuguggucgcaaaggauacccuggaguuuauacagacguugccuucuacagcaaguggcuaauugccguggugaaccaggcagauuguuugcauccaguggucuuccucgucuuacugcuguguucgcugaccucaugacauccuguggacacggugaucucauuccuauccucuuuagagccccucuuguuugaccuucccaaugcccuuucuucaaaucccuugccccagagagagccacagugaaauaugucggggaucugagagacuugaaaguguucugccuggugcucuggucaccauccuuggccacagcacuccugaguugugcucugccuggcaguaacgaagguuagucaguuccaguuagaagacaaacuggccugccaggucaaucgcagugaccucagcaaggaugucaucaggggaggggcaagugcuaggcauagcugugguuucagggaacucaccucagacugucacacuagaucuagcuuggugaucacacacacacacacacacacacacacacacacacacacacagagcgcuuauguguccuaacuauaauuguuuucuuuauacaucuuuaucuaugacuuuguaaaguuacauuucauauagaauguaauuugcaaccauguucaaagauaaagugaaacugaaaaaauagcuaa

SEQ ID NO: 5341 - RNA, 5152 nt, Mus musculus
ggacguucuccaaacauuuauucaguuuacguuugagaucuccccucuccagaaccucaacgcaacuugggaugacccuggaugugaccacugagguacugaggaagggggccaggcaggacugccuucuugugaagccuaugaggcagaggcuaugcauucccuggcagauucccaaguggguacaagauaauuucugccagcucccaaauacuuaagugccaaccucauaccucuguagggaguugccaguguucccuuccuccaacccucucguucuccaucucucucucuuuucucucuuuuucuuuucuuuuuuuuuuuuuuuuuucuuuuuugagauaggguuucucuguguagcccuggcuguccuggagcucacuuuuuagauuuuuagacuggccucaaacucagaaauccgccugccucugccucccgagagcugggauuacaggugugugccaccacacccgguuguucucccucucuuucaguggucacuaagcugugugauguaaacagagccaggugauauuaucucuucuuggcagauguccccaagaucauggagucaugguucuccaccuagcaggcaagcuggcccucuaguccagguuaguccaccaaguguggguguaucaugaggcaaguaaccagaacaccagucagagcacuuugcagcccccaaucucccugccacagucuacuguggcaauagcugcuaacuggaauuugaagaaagggcagaaagacagaaagggaaaauggagaaaaggcacagugggagacucaaaacucucaggaagacagggccuaaggaggucacagagcuaccaggagggccaagggaaacaccagagacagguauaggaccaagacucccaugggauccauacgggaagccugacuuaagacauagcugacccacucauuguacucagcgaugucuguguaaacugagaggacagggacuccauugcaguugaugccccagcucaugauccccaccuggguccacguguugucagauucgcagacaaggggguucccagaaucucccuggaaaacaagaggaagaaaccaauggcugggauggaagagagagcagacugcauugcaaggugcugggacacuuucuugggcacccagagccucucccaggccuagcuucuuuuaaugacugagaucuaacagaugaaaaucuccuaugaaaacaucaacauucucuaggcaacgauacgugcucggugaugauuaggcacacaggcacaaguggcgaauccaauggagcccagaauagcaguuguauagugaaauauaccuugagagucccuaaucuacagguaccaaaccugucugagaaacgccuaagccugucauaacucauaacccagccacagugguagcccuggccucuagaguauguagccugcagagcccacuccaacaucaggccagugucuaguuaggcuggucgguccugggucuucaagaacuuaaacauuuugagcaucaucauugagugcccuuaccacugccuuagauguucuccugcccuaaccucauugaggaacuuccuccacaugucaaccgcauugccuucaagagccugagacaagucuagcauccauuucuagcaccauucugcauggcuuugccccaaccuaacccaaggacccucacacacaccuuucugccaccucagacucuguuaagacuccuagacgaggaaacaagcucaaaaggcuccagucaggcaucauacaacaaagggacucacuuaucuagaugguaacugaccacgcacaccaagcuucaccucccaguucuggcugggccagucuagaagugugauuuagcccuccaggcugcauauauuccaacuuuaaccauguuuauggccacaugucuuaucccaucacuccaaagacauacaaaacuuucuucagcauaagaccucugaacucuuagacaugccugugcucugucacaacaauaguacccuuuccuuuccaggaaauucaaguuucuacccacgaacagcccaaagccuccuccuucucaagagugcagccuacacagagggaagaaauggaucuggggagccaggcaugguggugcaugccuuuaaaucccagcacucgggaggcagaggcagguggauuucugaguucgaggccagccuggucuacauagugaguuccagggcuacacagggcuaaaaagguggcagauaacucaaaccuuugaggugacaaccaaaccauacaggcuuuaagggucccauaaacugacccaacaaagacucuguccugagucuugcagaccgcagaucaucccuuuaaucacuagguuuuucgauguccccagcugucucuggaacagcguguuacagugcuucuggaggagaaugcguugcugaaccuccuggaggagaauggaugcaaacccugcaucuauagaaagacaagucaggaucuauuccagaagacgggcaggagagaucugcacccccuccagcugccgcggacugugugaauacacaguugaucccuuaaaggcagacaggccauguuccagauaccugucccauaggaaacagacaagaaaaagucuugccagcuggaaaaugacaaccaagcaucugucagagucuuuaugguaggagggucguaguuacugggcaccaguaaagcacuuuugcuuucuauaaugggaccacagaccuuuucagacagguggggccguaacaggguaggaagucuaagacaccccucucugacaaugcugcucuggcccagcccagcaggcaggaagaagcucaagccuuuggaggaagaacagcucaaauuggucagcauuacauuaccuuaggccaaaucuaacucugacuaaaggccaucacuccugucacucaaaaaccuccuagcacaguugugaugugcucucugucagucuguucucacgcucccuuuccugucccagcuggaagcucgccccuuccccugcagaucaccaggcugucccacuuccgaauccugccagacagacucaccaauuucguucuguuggccccagccagucacccagcacacugucccguuuuucacucggaagggcucuucgggaaggcacacgggcuggaugagcgaggaguaauucacggggaaguacagcagagcaagggcaaugucauuccucaugguuugaaugucaaaguuggaagggaaaaugauguccuggacugggaccagggucacacuuucagauucagaaugcagcaugucgucacccaacaucaccauguacuccuccugccugcaaagauggcaugggaccauuacagagcucccgaaggguuugcacacccacgcuacacguggugcaugcuucuaagccuggccucaucucccaugccaggcaggcaucagccugcucccucccuucaaacaauaccucuuucuccaggaccccugaccauccaugccucccagcaagugugguuccuagaccaguguagccuggaaaccugauaaaccagaugaugcucaggugucaccugagacuggauaaaaauccuuggaucaucacuccuuuuacagauaaaaagggaaaaacguuuuuuuccuuuuuuuccuuucuuuuuucuuuuuucuuucuucucuuuccuucuccuccuuuucuccuccuccuucuccuucuccuccuccuucuccuucuccuccuccuccucuuccuccuccuccuccuucuucuucuccuucuucuccuucucuuccuccuccucuucuuucuccuccucuucuuccuccuucuccucuuccuccuccuucucucuuuccuccuccuccuucuuuuuuuuuuggaugaaagacauuaagagaugagggacaagacaccccaaaccagguccccaaauacucacucauauaugcagugggccgcagucaacacccaucgguggcugaugagggagccuccacaaacaugcucauuuugacucugcagacucaccugccaaggccacuuccucccugcagauaaacuuccaggaucuaccucuguaauucuauggccgcaagugucuaaagagaaauuaaaagugaagccacuucuccacaccuccaucccauuucacacauggucaaggucauccucggggagggacucucuccagcccuccaagggcaggagccgaccucggcuccccagcccgacuagguggcccuuugaccucccagacaggccuggcaccaguaggaguaccuguaaaaaacgguccuccuagagagcuccuccuguuuuccaagguaauuuugguuguggucccugaaggagacccugauccuggaaucucaguccugucuacagacaccggaacuccugaagggugcgaaauacucagggauuucaagcgacucugcugugccggggccucugggucacuccggggucuccggggccucuggggccggugcaucacuccggaaucuucccuggguuuguaaguaccaccugaggaagaagccaacaggaaaagcucagcuugagugcgggugcagcugcuggcuccugggccgacugccccuacggcaccagcacugucaccaacgccaacaccaucaccauggccacucucgcccaagccaaguuccaugaagccacaccucccccacugcucccaccaggaccccuguccccagcuaaggccucacugaacaaaggcugaagaagcugaagccagaccaggagggcuaggaagccgccccuguccgcgccacagaagccacccaucccagccuuggauucaggcaauccuuuuucugguagucccccgcccccaccccgcaguagugucucgugcaggugccuuccugugggcaggacggcugugguccugaguuaagcccgaagauguuggaugccucagucauccacucaaaagcuaacuggguagcacugucuuagagacuuugaagguauacuagaucuuaucaauauuaaauguaaagggggcgggagcacuugccucgcuugcagauucagaccuggauucaguucccagcacccacauguuccuuauuacacugguggcucagagccacucauaacuccaguucgggggaaucccaucucucuucugaccugcgac

SEQ ID NO: 5342 - RNA, 6728 nt, Mus musculus
cucaugcuaacacaaauuuaaucucugcucuuggucuuaaauuccaaaaugcugcuccugagcaaucccccacuucuccuggucagucaagcgaggcccaguaacccaccacagcccucccugccaggaugacaaagcaggacccaaguucuccagggaccauuccguugccacccugacugugggauauggacaggccaccaugcaaaacaggaagaggaagaggggaugggaagucauaggcucacugggagcugcagcagccagggcaggagaagaagccaggagguccugcagggccccagcugcgccccauggcucacuugguccuugauccauaugguauauuuggugauacggguguauacacuuagauucgguacuguggcgcaggccuucucccaugagaauaccccagccagaauccaucugccaucgaucucacaagccaauggccccccggggucucccuggagaagacaaaggacugauagaggcucugcuggaaccaaaggaccuacaaugcccacccucuccguucuguucugcuugaaagaaucauuucucccggagugcaccagcuagggggccccuuggcuuuucaguuggagaccacaccuauggauugcagccaguacagucauaaaggacagugagagcaaagugacaguaaggaggaaagaggccaagccccagggaacaggaccccaucccaggacucacuccccaaaaagagaguugccagaaugcucccagaaacucacauagcacaaguccuccccauaauuggugguacagaucauguucuuccggauaagggggacaacuuggggauacaaggucuucuuguggaaaaugcugucacaauucuuguugucuauaaugaauaccucagcuucccaaagcucuggagccggugucaacugggcugcagggagcacaagggauaagcugugaccccucacucugcucagucuggcucugcccagugucguggaccuuccuagccugcaggucagcugggcucuacccucccacaccugugcaucuuccuucccguggucuuucucugcggugcuggcggacacagcaagccccuccguaggcaaggccuugcuugguucaggagccucuucccuaggaagguuuuguugcggaacccaaaaggauacagagucccagcacagccacuuacaacuugggacguuaacccugugauuccucuuuccaugguguuuguucccuucgccccauccgacagcuacgucuaggcaucgggccaucuaucuguucggagcucagcucagauccccugaucuuugccuugcuugguuuguuguuuuuaaaacaggcucauuuuggguuuuuguuuuguuuugguuuuguuuguuuguuuguuuguuuguuuguuuguuucgagacaggguuucucuguauagcccuggcuguccuggaacucacuuuguagaccaggcuggccucgaacucagaaauccgccugccucugccucccgagugcugggauuaaaggcgugugccaccacauguggccuaggcugguaucaaacuuauguacuugaagcugacuuugaaccuaucacuuccugguuccaccucccuaaugcuggauuacagguggcauucauccguaugccuggcuucugcgacacuugcccugucagccucuguacugcucaucccaaugccuuagucugcaacuuccuuucaugcauuccaaugccaagggcccagagcauggcagcuguuucaguuguggcuagggagggacggagggaaggaggaagggagggagggggacuuggugagucccuaagucuugcguuucucuaaaaggcagauggucacgccugccagccuaagcagaacuagccuuacugcagugccgugugaacccugacaaggagcaccauaugaggaaagaccacagccauagccaucacaagggagaggacaauaaagacccaaaggggcggcguccccaaccccauccaacuuaccugaggagugcugcuuaaccuggccccagccagucacccagcacuucgucccgaccuugaaguugaaguugugcucugggagacagaugggcugcacguacuuguugaaagugacagggguuucaaggcagagaagggcaaugucgcuucugaugaaguuccggccccaguacuugggaugaauaaugaugucacccacgggaaucuucaggguccaggaggagccguugggguggagggugcugcuacccaacaucacugaguacuccuuguugcugcagggaguucaggaacccaccuaguagacaucaguuuccccgcacaacuaugcaccugccuccucucgggaccuguccugucucugaaguccacuaaaucuggguuaauccagccuuggguggucaaggucaaagacauaacagccuucucauucagagucacguugagucaaggugugugggugucagugcccauaaauauucuccugguguggggguggugucuggguuuuccuguagguuuuccuguugcccaguuuaggauacagucucuauugcucagggucccaucccaacuuagucagaggaucuuguaagaucuugagccuggcucuucccacucuucaguguucccuccuccugcaugauuuccuauuaguacugagggagcuggacugggcccaugguagcucauggucuuuagguccuggguacacgggucacacucaccccuggaugcagugagccgcagacaccacccagcuucgaucaaugagggcuccuccacacacgugcuuaucuucuaucugaaggcucgcuucccagggccagugguggcucuccuccaaguugucuggccaccagggugugccacaaacugcaaaacaggcaaugcaagguaguacagaguccacagagaggaaaaucagaaugaccaugucacccuuggggucgaguuggaacaaagaguggucuuccacaggaaugcagagccacuuugaauucagcuuaggcuccuucccauuucaaagagaagagacugucauggagaggacaguggaccucaaggguacugaaccgaauaagcaaugacaguuacagagauaaagaaagacacagagagaccuuucagccggagacugagauccacagagggagaccugugcccaaccucaagacaaugcggaaacaaaacagggauuucaagaugagaaaugccuuccuugcacacaggauccuguucuucaaagcuguacuguccgcugcauuucuuugaugccccccuccaaaaaaaaaaaaaaaaaaaaaaaaaaaaaaaacccaaccaaccaaaaaaaagaccuccccuccucucuaugggaggucuuuacccuaagcagucuggagcucacaguuauuaguggucuaccauuugccaagauuuaugaacgaaugaaugaaugaaugaacaucagugcagagauucuaaauaaaguacaaugugcugaggguguguguggcaaacaccuuuaaucccagcguucaggaggcagaggcaagcggaucacugugaguuuaaggccagccugaucuacacaaggaguuccaaauagccagggcgauguagagagauccugucuccaauaaacagauaaaauaauaaaaauaaaaacaaaaaauuuaaagagaggagacagaaaaccucaaaacauauuugcgggaagcaggugugcugcaugggccaagauggugcccugaccccuugccaggcccugugaaacccacauguuuacugccuugcccgaacaugcgcagugaaacugcaugcguaagcugccugccaaguuagauuauuccucgugauccggaucugucagccuaucugugaccgaccugagguugugccuggagugugugugauucugauuggaugaggugguguggagcgagaugaggucaguugccgcuacgguauaaauauagcccuugcccuaaguaaaaagagcuguaaguaaaaagcugcggagaaaaaaagcugcaaguaaagaggacguugcggaagcugugugaacccaucuugguguccgugucguucuugucucugcaggcaaggacugcggcacauauuuaugaaaagaaaggguggguuaugggcaauaauauaacaaagcaaaauuacaaacauguuugagagcguccuaacaaaacugaugguguauuaacuucaaaggccagugaggagcuggagagacugcucggccguuaagggcacuugcggcucucccagagacccagguucgguucucagcacuaauacauugacugauagacaaucaucuguaacucuaggucuaggggauucggcacccucuucuggcacaaggcauacacacacacaaacagucuugcacagaaaaaaaauaacaaaaacuauuuuauguccaaguuuuaaaaaaccaaaacauucuuaggggcuaaagagauggcucaguugguaaagagcuuggugugcaggcaugaagacaugaguucaacccccagggcagggugaagccgggcgugauaguacacacuuguaaucccagugccgggggaagggacaggcaguuugcuggagcucacuagccagacagucuguccuaauuaguaaccucccaaccagggacagacucugucuccagacacagagugggcugcccaugagggacaacaccugaguuugacuuuuggucuccacaugcauuugacugugcgcacacacacagucacacguacgcucacacuacucuuuuaaaugagauuaaauuacagagggaaaauugaaaggagcgaggcuuggacagaagcaagaacauaguaacccugcagucagucauggaccuuaguggaguccugacaccccaaggcaaguccuaugaccccaaccaugcacucucugggucuaaggaaaaagacaggaagucccgggaucugggcucuugagacaaugacccaggaggcuuguuaugcaacugugggaaaggcucaaagccugagcugaauucaaaguggcucugcauucccuuggaggacccaggcacucuuuguuccaaacaguaggguuguguccuggcagcuacauaugcuguuccuaccaaaccagaaaugcuauuuaggcagagacuuugagaacauauuuuuucccaagaucugaaacuuucccugcuaugaggccccacugacccaccugguucgguguaguucucauuauaaccugaggagaaaaggaagacagacgugaggcagggacguuuacaggguagcaguaaagaggugcacagacaaguguacaagcgccuaucuggagacucauguugcccaguccaccaugugagauggggcagggccugggccagaggcaucaggugaauccagaagauguggccgguggaagagacggcugagaggagagaauaccgggaaaugucucaaagaggagaaaaacaaaauaaauauugauuuaaaaaaaucucuccaggaagaaacacaauaguauauuccagagacucuggacgagacacccgacaucugugguggaggagaaagauaauguguggagaugaucggcucgguuuccccgaggucacuggucauccagggaacaaagagggaagaggcaagggaccaaauagcaccuuucagaaacagccuuacaucagagaugaggcuggguggccugauauggguacugaggaggugugugugugugugugugugugugugugugugugugugaucccagcacuaaggagguggagacaggaguuucaggacaucaaggcuacccuagggcucaugagaccuuaaccccaacccccacgaaugaaagaagaaaaaugggggagaggcugagggagaagccacaggaaauuaaaaaaaaaaaaaaaaaaaaaaaaaggauagagauguaaaacaaacaaacaaaaccaggaacaguaaugggaagaacacagcaggaaugggcugaggauuacaugggaaauaaauaaagugcuaaugacucuuggggaaggcuggcccugagagggagggcacauauugggauggugguggagcaggaccgauguaagccccgccucucaguaugggucggacccugcuccagccccaccccacucaggaaacacucucccuuuggcagucagauuuggagggaugucugggggcuguggggcagaggagucugcgaagacagcacucaagggcuuggacucugcuagcgaugggggaaaaaaaaacccaacguuuagaacaucauccuuuugagaggauggacacacggaaagcgggaggcgccugugcgugaagggaggccagggaugcuccgagcaucuccgagccuguugucuccaggaggcuacagcacgacacagcaguggccugaggaaccuaggaguggcagaagagaggcgacagcgagguggggauggcacacagaaguuucagguggcggaaaggaaaggaauagccaaccugagcaagacuggaggggagaggacacagaaagaaaggacaauggagaaggaggugccugccugaccuaaguuuggccgcggaggcagcaacaguagcgccgcaaagcagauuaggauccagcgccucaaggauccaggcccagcguccaggccgcgcaaugacguagccauacaugaauauugucccuaagggcagcagagauagcugcggcgugcug

SEQ ID NO: 5343 - RNA, 6558 nt, Mus musculus
auuuuguucagaguucccauuuuuacugugcauauucaugaacaauuauuauaaaaacugacuugacaauacgugguuuuuauaaucugguuuacuacuacaauaauaaacacuuucuuuccuccacaacaguugaauaauuguauauagcuuggagaaagccuucguacuuuugcagaaaagagacucggguguuuggguuuucugugagggucuugccauucagucuuuguuggccugguacucuguacauagcccagguuggacaugagcuuuuaguaguccuguuguagccuccugagagcugacauuaauagugugcaccacugugcuuggcugaagaacuuagcuuuuaaauucccaguaccuccguaaacaucaaucaaacaauccacucuguuuccccagucuuagucacuuccccaucugcugcucccucugcacagacccucauuacuuccucaacucccucguaggaugcuuuuuccuuuuugagacagggguucgcuacauagaccaggcuggccuugaacucuugagauccuccuaucccuaccuccugagggcugggauuaaagccaucugccacaaugccugguccauuaauuuucuuuuaagauaauaguuuuucuucucucucucucuuuuuucuccccgagacaggguuucuguguaggccugucuguccuggaacucaagaaauauaccugccuuugccugauuuaagguagacaccaccaccucccugcuuaaagauaauuuagcuguuuucagcuacucugaauuuacuuccaguugcacauugggauuuaauaauaaccuucagaacuguuuaaaagucuuaggaagaaaaguaagagaguuacuucuaucaagaaacucaggcuauggcagacagcacauucuuagaguagcuuuuaggcuaggaauguaacucgcuguuacagugcuuggcacacacgccauaguuuuccagaaagaggaggggcugugcagagguaaggccuaguuaguguuuugagggguaacauuagggauucacugugagcaucaagaugaaugacaucuuugcuauggcacuggcauggaauucacaugacaccuauacuuucauaucuagaaaaaggcaggcgccagcuagcauaaaaguggucgucacagacggcguuugacacggagucccggaugcuuugagguccugguccaucacgugaccaucugaaagguugagauacucagucacuaaaggaaauccuuccagcucccugcugccuucacgauccagaacucugcuggggccuaacucaaagaggacaguguauucaccuacaggaucagcaguagcuacauaacacucuuacgcuccccgaagaucuuacaucaaaaccacagauggugcagaccuugguuaggcucugguaaggggacaacagaaccaaaauuccaggaagaaaauauggccuccauucaucuaaucacucuaccguuccuugcuaaucuauauacaauacccaggaugcaaugguaaagacauuugcuuaaugaacuuccacagucaauuuuaaaagcccuagccacauagaguggggacaucacuguuccucugcucugauccccuuugucauugucuccuucagaucuguaaaaugaaggugcugugaccggcuaccacagacuuuuaggaugccagaagaaccaguuuugguggcucacgguucucaaccccagcacccgggcugggauggggcagaaauagggcggaucucugaguucugggucagucaguuacgugguaagaccuugucugaaaaggucaccaguggguagauccugggcuaauggugcauuccuggaccagcacuauggaggcugaggcagggaggcugauggaguuugaggucagcuuagacuguauguagagcgaaauccaggccagccugggauauagaauaagauauuuuaucaaaaaccaaaccaaaccaaacaaaguacaggagggacuaguuguaggguuggguucuaacuaaauggccacccuagagccuguucggaaucuucugcccaaaggacaagacagcagaagucacuucuuccugucuugguggcuaggucuuuuccuguucauugucuccagcagaagccugcugacaaucagucucaaguagaugugugggaacucuguaggugacgggacaguaggggcugagggaguguccuucagucaggaccccacgccuccuaaagauccauuguaucagagauugcacaccaaacagcuccauacccaaggggucauuccucuccuagccagugcuuuaggaacauuccaauggccuuguaucugggacaugcccacuaagaaccccacaucggaaugaccugugccugagggagcacccccacggaucccacacguugggaccucaucuacuuaagguaucacccaccaaugacucuggaucaccaugacggaucuaaggaauccuuucccaggguuagcuaagggagcauucccuaaggacccagcaucugagagcacccaccaaggacugcuaggcuguauggcccugcugcccuuaugcuauuuuauaggcagaggucuggcuggcuggcuggcuggcagguccugucaggucaagaaggcucuggcagagcaggaggagaaagggggucccuugggcaucugaaggaccugacaggauuaaagaaagagggacaauuacuuaccacagccagguagaaaggucugaggaagacaguggagcuggccgugccagcaucugcacagggaacacuucuugggcagccaggugccauggaggauagacccacagugccugggaaagaagugacaacccccacugucagaaauuccucucccuccuucccugcccaucccccauccuguucccucucaacagcacuuacucuuugcgaacaucauguucacaguugcguccauagaaggaaggagggcaggcacagaaggaccccaggaugcaagucccuccauucagacagcaaguuuuauuaagcgacuuaccugaaauguaagagaagucauggggcagguggaggauugaaaagcccauaagcaacgguucaugcagcacucuggcauucacuccccagaguacucggaaagaccuauagcacacgagccuaccuuucagggaaauaacuuucaugguuggaccagauuggucaccuagucugauggucugauagcuggucccagcaugaaguggcaucaggagagaaacugaguaucagagacuaucagggacauucccucucccucucucucucucucccucucucucucucucucucucucucucucucucucucucacacacacacacacacacacacacacauacacacagagagacauacaugaacaugccucacucacuuuuaugacaagcuaguacaacccacccagcugcuaacucacucaucaugucucuugggguaagugcuaaaggguuacuucagagaugugccaagagccaugacagagauggauuaaggcaaaaagucuuacuguucuguauccccacggaaggcacaaacuggaaagaccgaucgcguacggcagguucuuucuggucccaaaugcuguuaucucugauggcaaggucucucccuguauugcauauuuuaggccacaaaauauuguugguguucauaagaaaaacaccuccuccccaccauccaccaccaaguaggguggugcuugccaaaggucuccacacucaggaggaggagggaggauccagugagaggcgacacugagcagcccuguccccaaacacugagugcuggggauguagcucaaugguagugugcuaaguaagcauaagguuuagccccagugcagagggggguugggggggggggguaggauggaggguaaucuggaaguauguccaauaggugcagagccuggguuaaaucacaugaacaacaauggcaacaaaaguuguuggucaaaaaaauaaaauaaaauaaaaaucaaaaccucagcuagauuugguagugaacuugggaggcagaagaaucaggaguucaagcucaaccuugacuguguugugaguuccuaggcaggcugggguacaagguccuuaaagugcacacaugcaggcuggugagauggcucagugguuaagagcacugacggcucuuccgaagguccugaguucaaaucccagcaaccauaugguggcucacaccaucuguaacgaaaucugacgcccucuucuggagugucugaagacagcuacaauguacuuacauauaauaaaauaaguaaaucuuuaaaaaaaaagugcacacaugcccauauguggagggguggggggacagccuggacuuggugacauccaguuucaaaaaccugaaacccaaccauacagggguggcuugcgccuuuaagugaaucugaguccaaggacacccuggucuacaaagugaguuccaaggcaaccagggcuacacagagaaacccugucuggaagccuccuuccuccccagggggaaaaaacaaaacaaaacgccugaaccccaaacaaaagaaaacucaccagcaacggguccaaauucaaacgcacuggaaauggccacaagcaaaaccacacugggagaagaagauuggacaucaguuagcaaaaccaagcguucagcgcaagggcacaggccacgaaggagaccgugaacagcgccaccgcgcugucuccaguaacaaaaccggacagaaguucccucucuuaaaaagccacauguuggagcugcuggagagauggcucagagguuagagcacccucugcuauuccagaggcccagaguucaauucuuccugguggcucauauccaucuaaaaugagaucuggugcccucuucugggccgcaugcacaaaugcaggcagaacgcuguauacauaauaaauaaaucuuuaaaaauaaccacauguagagugacugugugauuguagaguuggaaggcugcgcacuagcagcccuaaguguccuggggcuauguuuaacgacccaguggcggcuguuuaucaugaaccucucucucucucucucucucucucucuaugacuuaguauccuuuugacagucacauaaagaccucggggaugaagcaguguaagcagaucacagcuccagaaaaaacugaggcuggagcccuacccgaugucuucacugauacagcuaauguuugcaucauuuacacguacacaguuaacgucuacaagucacauuuauacuuucuuuuguucugugacuaccaaggagcucauauaagcucuuccauguucauuuagggcaauaugaauccuuguucccaagccacggccacgcucggaauaaacucuuacucuucggaacaagggcuguguuuugaauuaacuguuuaaaacaaguccccagcauccaauauuucaucaugaauauuccuuaggccccacccuuacacacacaauuuuaaaguuauaaaauuaaaaagcuaaaacauucuauucugcauaagcggcauauuuuuccacggugcauuguuugcauauauaaauucuuuuuuugcauauauaaauucuuaaauggcuguauggguuggagaagacuugccaaccacacgcaagcgcugguccgacgcccggcuccacggggaaaaaaaacuuguccugucacuugaaaugguuccaaguucaauugguuuguuauuccuaauguuucuaaguauugaauuuaucucucccauuaacguguagaggcagucuugauuaggcuguaagauuaauauuauguaugcaagagaaggaaagcauuauuucucuggcagucaccgacaugacugaugggacgagcccagagggugcuuuacaaccugagucggaugcccagaacccaaaugaucgaucggacuccagugagucaucgucuaaccuccacucgaguauaugcgagcgagugcccgcgcgcgcgcgcgcacacacacacacacacacacacacacacacaaaggcaauauaaaaaauugacauuuuaagaagccgauggcaaagcaguaucuaacuauaaaguuccagguucuucaggaaaagcagcaauguuacugacaagguucaagcaagacaaaaaucagagcgucauagaacgugauuuuccgaaguggcuaucuccagcaaccaaaaagucaagguuagcucauaccuggaugagaaguaccccaucuucgacggcucguaaaaacguuggaggaaaagacaagaaacacaauauuagcagauggcuuuaguucauaaagccauucucgaaacacccaaaggcuaauuucacaaaaugaaaacaguagauuaaaaagaaagauaugccaaaugagagaggcccccguccuggagagucugugggaaguuagcagccaagaucuccguguagaccggcaggggauggggccucuucuuccuauaaacgguuugugauugaggacuucggaggaauauaccucccuuaaaagaaacuuaagguguugaguaggacccucaggug

SEQ ID NO: 5344 - RNA, 1606 nt, Mus musculus
ucuguaggcaggagauugcaacucucucccggucugucaguuacccugcacccauuucuauccacuuguugauuuuuagcacagggggcuauauagauuauauauauaauauauaguauugggggcuguugcaugcauagccuugaauacauuuaccucaguaucugaagaaacaguggcuuggggcucagugaccagagccccaguccuaacucuuaauccccaaguccugggcaugaugcguucccaguguguacuuugacucugaaaugcacacacugggcuuagcaaaugcccuagguuccuucugaguccgaugguuugugugcuguuugcacaguagguaccuggugauggucccagggcauguuggugauacaguggagaugagaaagaggggucauuugcuucucucaccguucgugagaaacuccuucucccucuggcaccugcccacagcucagcugaaacucuggcccucuccucuacagguuccacuguccuuccugcucucgaaguugggcaucuggccgaguucugauagucuuccacaugcgguggugugagaagaaggccaaggggugggugaagaugaggguguuugcucagagauguaaucagugccccgagccuccauuugcaacuccagaagucacuugggacaacaucucaaggaucuugaacaaccugcucuuccaaauucugaagaagugcuauaaagaaggauuuaagcaaaugggugagauuccuuugcuagggaacaccagucucgaagggccacaugacagcagcaacugugaggccugucuccugggcuuuugugcucagaaugacuuaggccaagccucaaaaccaccagcacccccauuaucuccuaccuccucgaagucagccagggagcccaaggucacugucaccuguagcaacauuuccuccucacggcccuccucuaaaguacagaugccccaagcaucaaaagugaacccccaagccaguaacccuaccaaaaaugaccccaaaguuagcugcaccucaaaaccaccagcacccccauuaucuccuaccuccuuaaagucagccagggagccuaaggucacugucaccuguagcaacauuuccuccucgcggcccuccucuaaaguacagaugccccaagcaucaaaagugaacccccaagccaguaacccuaccaaaaaugaccccaaaguuagcugcaccucaaaaccaccagcacccccauuaucuccuaccuccuuaaagucagccagggagccuaaggucacugucaccuguagcaacauuuccuccucgcggcccuccucuaaaguacagaugccccaagcaucaaaagugaacccccaaaccaguaauccuaccaaaaaugaccccaagauuagcuguaccucaaaaccaucaacuacuccaagacugacaauacaacagcugucaguaguaagcccaccugccccugccccuacaugugucauucaaaugccuucucccacucccaucgacggcagcagagcagcagauguagcaaaggagaacaccagauccaagaccccaaaggcauugcucucauccccuuuauacgucccacccacuu

SEQ ID NO: 5345 - RNA, 108927 nt, Mus musculus
gcgcgugugugugauguguacaggucucacugugauaauucaaacuccuuugcccugccacagguuccaggguacccgggacaacagguguauagcaucauaccugauuuuaugcugggaauggcacccaagguuacagauaugcuaaguaagcacccuauuaccugcgcuacagccucagguggaaaucucuuuaaaaacagguauuuucauuucguucagccacacccacccuccacauccuuucccacagacugcgcgccaggugccucacucacccaaaaccucccaccagaccgcuuugaggccaccuggcuaaguacgguuacgaaacgcucagauaccaacgcucgggaccaggcccggcuugagccagugcgugucgagcgugucucccuccccgucacccgcgagcccugcgcuccgcgguccagccaguagccuccgagccgcgcgcguccgcuaccccgccgccugccacaaguacuuccgggugagcgggucgccggccgguggccccgccccucugccccgccaccgccgcagcugcagccgcugcucgggcugcggcucgucccgggucgcguucgcugugucggccgcggggcgaagggcgcgcucagugugacuccacgaccggccgcggcgcgaggagcccuucuuuuugucucccugcggcccgcgggguggacggugcgggggggugcagaguguggccggcgcucuccucucccggcucccgggcggccgcuccggcccuuccgggcggcgccgcagccucaucccgcgccacacgcagguaagggcaggcggcggacccggcugucuccaggcgcugcccaguggcggcuccgggcuggggucgcccggcggguccccugcucccgcuucgcccgccccccgcgggggaagaagggguuacgccccuuggaccgggcaucacuugggacagcugggugcuccagcucccguugcucccggcgccacacucccgcagacucuguccucagucugucccgggaggggccgccccgggaacggugucaggccgguggagggcguagcuuuuugagugagauuccccccucuccugcuuccuucuugaucugaacugaagcgcgcgggcuuaccaggcucagggcaggacggucaggguuaaugcuugacuaacagcgggcguuauuuacacccacauuguggaguuucauagcuccagucaggccugguuucccuuugcuguggauauccagcaggaagcaagggacauaagagaacccagaggagaaaaguucaagcguuugcuuuguguauuauguuccccaccucgagacauacaaauauaacguagaaacguggcuaaaggguaucccaaacuuucaguauuuguagccccuuuugcuuuucccauuuagugacucagcauuuuugccacgguuuuucuacaguagcuugauugacugaaaacucuguaaggauaacagugacugcuauucguguuguguuaucgcagcgagaagaggugcagucaggguaucgacagauacauucuuaaucaguguuggacuuuuucuccccaguaggugugaaaagcugcaauugcugaagaauguguguugcaguaagaguuaguuggccaaguuuaccguagcuucaaugucuugcagaguuagccccgauuaaccaacaucaugcucuguuuaacaacuacagggauccuaugaccucguauuuaauacacucaugccgaguaagaacuucggaaagugugauucacgucggaagugaggucacacucugacucguagaucgggaucuucccauugaaauagaggaaagccagaccuuuucugcccguuuaauuagauaauuguacucuuuuuuuuuauagcgagugauguauaauguuugguucuguuuguugcuggguggugauugucaugcacuauggcauggaaaucaaacguuaaaauuuguauaauguuuuguuuuguaauacuuuguuggacugcugugauuuuuaaguccccccccccuuuuuuuuuuuaccagaugugggaagacaaaugaagggauuuagaagccaaguaaaugucauugggaaggagagcuaccaccacugagguaggaaauaguacuguguacuauauaaaauagcuuuuugagugggaagcugcagcacuuugccauccuauccuuaaagaugcugaaugagacuauauuaacuucuguucuggaaggaauuguguugaaguuuugguguauuuuuagaauugacuaauuucaaacuugaaguaacuuuuuagugcugcaaugucauuugaucauuuuagucuuucaaaaugagaugcaaaaaaacuuuggaucccagaguucuuuauagggacaaccuugcuuucuuuccaguuuuuuuuucuuuucuuuucuuuguagaguccugauuauuuuaccuugauugacaguuuagaaguccuauugacuaguuggaagauaauaccaaauguauugguguuaacuuaagacagacgucccuuugauucuuugacuaacuuuuuggcaucuuucucccuuuggauaucgauacuuaaauucagaguguucuccaauguugcuuuuuauuucuguccagcugauaggaugaugauucuguucuuguuaacagagauucccuuuuggaaaauccccugugaaaaccuucauuggagauagucuugacgcacaaauacgucagggaaaucuucuuagguuaggauuuaagcaucuucagaaugaagggaaaagagauaggaagcauauuuggcaacacaaaaccaauuugucguuguuguuguuguuguuguugcuaacuuaggacagaaaagugauuucuugcaaagaucucugugaaucuuacccugcuccuuguaugaaaagggacagauuuggugacgugauggugggguggggaugauuguccuucugacguggugggagcucuguugaggauuagcuaaaaggcaguaaaauucuucuguccuuauucaaggacugcugucugcugugccgacuaaacaaucccguuggcagcuuuucucuuaggcaguugcuuucccucuggagagucugagugguggacgugauccuuaccugggaagccauacuccuuagcccuuauguuugcaaauaaacacuagacucugaccccuauucaaagcccagcuuuuaaaacuucagcaggaaaggaauugagcagaguuuaccuuaugaguaaaaugucuuugucccuuuccccauucuuucccuuuaaagcuaauagaagacaagacugucuuggaaacggagugcuuggcauugcacuuuaaccuuucaagcuuucuggucagcggaaaguuagucuagacuuaaagcaguuacacacuaggcuaaacuuauacauuguaaagcugggcuuauccugugagaaugccaguucuuggacagucacugaggcucgauaucuggguauggucuucuuuuagucuagggguuggaaaagaaauagguaaauagacacuugggaagaaaugacauccauagacagagagcucaguggcguuugugccacuuuuaaagauuuguaaaacacguaaaagcaauggucauacgaggaaaagcccuuuccuuucugcacaagcuucuuaccgucccauaacccuacuccccgggccaggccaccauaguuaaugguuuucauguauuucccuccuccugcucucaguagcauguacaguugcauguguuuacaggugccuuuuacccgugaugcaucugagauauguuucuguauuagcauccacuccagucucauuuuaaaaagacuggauuuauucauuuuccauacuuuuacuaauuccauguuaguaaacauuaggucauuauuagucuuuuguauacagcgcuauaagaaagacuuuuaagcaagugcuugaccauuuauaguuccaucuguggaguacagcucugguguaugacugugaaguuggcacuuagauuaugaacaugaaaaauuuguuuuauauuagacuuuauuuuauaguagaagguaauguuuucucaggcacaggaggaggaagaauuaaaaaauuuuauguucuuuacccaucacuuccuuuuaaaaagcauugugaacuaggugacuccaugucacugccuguugucaacaccuggggguuuaagccaggggacagagugugaggcuacuguggucuauacagcauguagugaggcugugucucaaaucaaauugcaacuguguuuuauaaguugauuuaagacauuuugcaguguuaaugauugcauugguaaaugucaaugcuguaguugaagacuggcgcugacagacauaaaccacuggcauucgguaagauggccgcagcuguagguuugucucagaguuuaaauuuucuguuaauuaaaaacuuauauagcugggugugguggcacacaccuuuaauucagcacuugggaggcaaaggcagaucucugugaauucagggccagccugguccauauagccacuucuaggccuauuaggguuacauacaaaaacaaacaaaaaacaaaaacaaaaacaaacgaaaccaccaccaucaacaaaaauaauaagaaacaacuuguauauagcuuucauuuuugcccugcuaaaguuaacugauauuagucagaagagaaagaaauggcccagaguuucuucuuuaucauccauauccuacuuuaaguagagugaaugauagaacccgagagccagaaacccuuuugcaauccagagcacuguugguggaguccuuugucaaagcaggaaguagguauauagauuuagacuuuauucugcaaagaguuaguaagcagaauaagggagguuuagaauuuaaugugaaguucuguaggugacucaugaccagggggacauucaggagccuuuguccuuuugaaaugagacagagaggcucaaguguggugaagcuggagcucaugaguggcaguuucccuggaugcuguccagggucuauuuugaggcccugucaaaacuugccugacggaucuaccgcauaaccguaaucuggccuggcccugcuacaagucaggaaggccugugguuuagggaaaguggcaacugcagagggaguucugagggagggaagccuucagaagacgauacugagggaggggcugagaaucugcugagcacacuuauccuagcacccagguguucucggcuuuagcauccagguuuuuguuuucuguuauuuauuuauuuuuggaaagaguuugauugcagagaacuaaagaggaauuuuuaggauaauguguaugagaaggaacauaggauugucccagcuuaaugugucauagucugauucugggagcauuugacaagaaucaguuacaaugauugucuuacacacacacacacacacacacacacacacacaaugcuauggauucagggaggacacaucccaaguugaaauugucuaacucagagucuuucacacuuuccacugcuaucuuggaguaacgacuguuuuacaggagaguuuggaauucacacagcuagauuaucuucuuacucuguuucucccaugaaagaguuaugaaaucauauauuuuauuaaauuuucuucauuuuauuuugcaugcauguggguguggguauguaaguuagagaacaaguugaaagacuugggucuccuaccaucuggcuccagaaagaucaaauucugguugugaaacuuagggcaagcaagugagccuucugucccugaaguuguaccuuuaaacucuugcuuuuuagcagacuacauagcugucucuuugugcuguguagugaauggaagcguugguguucucuauguuuagugagcacuuagguuuaaaguucucuaggugaucucacuucuuugacuagaaagcuguugaacaacuuacuguuacacccucugaccaagguucauguccuggcucacugcugagcuguuguuccacagucaaggguuucugaaggauucagcuuguagcuguacuuuauaggugugagccuauacaugguugcuggucuuuuguguuacacgagguuaucacuucaggcuguuuacuucuggggucauuaacauuucauggugaugucuuuaggauucaguguaagaagugagcaaugguuuuuuuucuucuguuauuugguuuauuccuauuaucucuuccuauucucggguuuuccucccuagaacaauaaaacaaaacaaaacaagagaacuuugggugaacugaggauggucaagaguugggagaaaccuuuuagugccugucaguguguuuuauuuccugacaagugagcugcuucaugccccugcaacauugugacaggaccacaagcucaugcuuccauuguucuuauuugggaccuuguauaugucuuaaggcuucuucauaggagcaucacguuuuaagcuaguugugauguaguggaugcauuuauugccuuugaaaacacugaguuuuuaggcuguuuucuuaaggcaguuaguuauucuuucuguaguccccacuuucacacagaaacauuuuaacagcuaggaauuaaagucuacugucuacagacaguaagauguuaagauacuuauuuuccuguuaaacaguuuaaccaugcuuaauaaaaauugaauaaauuuagcaaacacacguuuuuacuuaaaaaaaaauuaaguaauccagcuaagugauucaguaguuguaggauuaaagauaaauauuucaguuucaaauaagccccuccccccgcaacuccguguuauggauaaugcuuuauuccugugucuugccaaaugcaccuaguuuuauuuuuuugguuaugguaaaacuuaaauagcauugccauauugacauuuuccauucuuuucauuguggaagacauauguaauguaagucuccucuaccucuuucuuugcgugcuggggauuggguccagggccucgcacauauuacauaaacccucugccucugauguccacccuaagcccuugaaccguguguaauugugcaauucugugccauuacagugcauugagaguguggugcagcugcccaagcauccgucuccaggagguuuucaucagccuaaccuccccaucagacuguaaugcucacuuccuuuagcccuugaaagccacuuggcuacuuugucuccaugauuuaaguacucuacucuagguacagcacauauuugugggguuaucugcccucuguguuuggcuuauuuuauguagcucaaagccaucaaagacacuccuguuguagcauguauguuugacuucuguugaagguguccuaccuuuugguuauugugaauaaugcugccaaggacauggguauaugccuaugcauucaaaucccaguugguuauuuugugcacguaaccaggaagggaaugccaaggacauggguauaugccuaugcauccaaaucccaguugguuauuuugugcacguaaccaggaagggaaugccaaggacauggguauaugccuaugcauccaaaucccaguugguuauuuugugcacguaaccaggaagggaagugcugaguccugcagauuucaugccugaaucuuugagacucccaugcuguucuccauggugccucgcuguuucagucucacccaagcgugcacgcgagugcugccuaccaacccuuguuauuuucucuguucuuuaauuuuuuuuuuuuuuuuuuuuuuuuuuugcugcucaugaaagccaucuuacugaguuugugaagacuaucuccuugugauuuugauuuguauuuucuuaauuacugauaauguugaguaccuuuuugugcauuuauuagccacuucugucauuguggaacacaccagccuuaucguugccucucuagcgcugagauuaaagaugugugccaccuaccugacccauuucuuaauuuaaaauuauuuuauuuuauguguauggguguuuugccucauguaugucugugcgccaugcccaugcaguacucuuggagggaggccacgugacaucagauccccuugcagcugaguuaaaggugauugcuguuagcuuccugugggugcugacagucaaacuuauguucucuggaagagcagccaguauucuucacugcuaauuguagcucuagcuucaugucuuuuaaaucauugguuauauuaccacaugcgggcgcgcgcgcgcgcacacacacacacacacacacacacacacgcacgcacgcacgcacgcacgcacgcacgcacgcacacacacgugcacagugugagguucuguaucuagguguguguacauaugcccacagcauucauauggagguuagagacagcuuuguggagauucuuuccucccguguuuacauggguuugagggaucaagcucaggucgucaucaggcuugguggcagauacuuucucaucugcugagccaucuuauugguccuaauuuguuuuuguuacugaguuuuaguuuuuauauaucauagauagcaacucuauuuacaaguguuuucuucauuagauugccuuuuuuucuauuuauagugggcuuugaugcacaaaauuuaaauuuggugaagucuaguuugccuauuauuaccuuuaauuuuugucaaauuugacaagaccugguugucaaguccugucaugaagauuuucccguauguuuucuuugaaaagacuuauagaucauauacuuauauauacuuacagaucauauacugauauauauuuauagauuauauauacuuacagaucauauacuuagguuuugaugcaccauguguuaacuuuugauguuuugugaugagcuuagccuuucacaccuaagccgucucaaacccaugaguuaacuuuuauauauuauguaaucuaaagggucuaacuuuauucagucaugaguuugucaguaccacuauuuauuggaaagaugauccauucucuuuuggaugguuuuggcaccucuguugacaaucguuugaccauacaugugggaauuuauauaugagccauuuaacugaucuauggaucugcuuuaugcuuguaacauaccauuuuaauuacuauaguuuucuaguaaaauuuuagaccaagaaggauugaggggaaaggguuuauuuggccuaaaauucgagaucacaguucauuauuguggggaagucaaggcagaaacuuacagcccacauucuaccuaugguuagaguagggaaaugaguguauccgugcugcugagcugcuugguugauagcuugcuucacacuaguagaguucagggcccacccaggcagugaacugggucagauaaucuccucacagacacaccacaggccaaccugagcuaggcaguucuuaguuaagacuguuuucccuggugugccagguugucaguuaaaaugaacagcacacugggcuuuuauuaggauuacacugaauuuguggauuguuuugaccacuuuuacaguguuaauagugcggcugucuuucgauuugugaacauggauggugucuuuugauuaacuuauguuuucccuaauuucuuuuacaguauuugcaauguauaucuuuugcuuccuugguuaaguuuauuccuaaguauuuuauucuuuuuaaugcuaucaucaaugaaauugcuuuuugaguuuuccuuuuagauuguugguauauagaagcaaauucucucucgccccccucucucucccucucucucuccuucccuccuuccuucccucucccucucucccucucuuccccuuucucucucccucccucucccuuucucucccucucaucuucuuucccucucucucucuuccucuaucucuucucuuccuuuccccuuccuccccucccuuccaucuccaagguaugucccuaccaugugucugcauuaguuuuuauauuuucuaacuuugcauagguuuuguuguuguuugagagauuuaaagguuggaacuacuguguguaauuauacaaauuuaggagcuuaagacagcaugucuguuauugcccuuguuucugugugacaggagucugagacugguugagcuggguccucugugguguguugagugaggccgaacagaagguguugacccagcugagucucaccuggagacuuaacugggggaaaaauccacuuccaaaucauguagguugccacaagaauugguuuucugugauuuagcacugaggcuucuuuaacugcagaucacuuuacuccugaagacugcuguccccuagcuccuggggcagccugcaguuguuuguaguucuuguauuucaucaagccaccacaggcaucugugcagcagucaccuagcaccacagucuuauguaacguaacacagucacaggagcgccguccugugaccucugcguucucugugggucagaaguaaaucuuaggucccacccauaggccuccuguggcagugauacuuacacagugguguggguacuagcaaagagcuucagggcagggggccaucuaagaauuuguuauagcugguuacaaaaugacacauuguauagaccuucuuuguuuaaagaaauguauguuuuuaaauguuacugucuucagaaguacagaugguuuaauuguuauuuuguaauaugcuuuuaaauguuacugucuucagaauuaugguugguuuaauuguuauuuuguuauugucuccccccucccaaccccugucugggucugacuauaauucaugcugucuuaaauuuacuauauagcucaugcuggccucuaaccaauggugagccucuucagccucccaugugcugggaaugugguaugaauuauuccuagcuuucauuucuuguuuaccuccuacuucaccuccuuguagcauuccaauuuuggagucaacaauugaugauuucauuauaauaagauauuguuuauuacuaagcugcauauuauauuuuuauuaaaaauugcauaauuuucuguuuauauauugcuuccacccauauguuucagcaguuuuucauuuuuuccagauuuucuuguauuuaucagcauguaacauaaguaguagcuaguuuaaggaauauggaaaaauauaaaacaaaaugauuaaagaauaaaguaagcaucaguauucucauuucuaagcuaagaaauuauuuaugacagauaucugggauggucccucgggacuucuuuuccuggcaccuacuguccuccaccuggucacagucacauuuuacacaucaguggcgccccaacuccugaaguuuccuucacucuuguauguauucauuccuacccaaugugcuguuuaauuuugaaaaccuggaaaccuguuugaguguuucagaacaguuuaauugcuuuuguggugcuggagacugaacacagggcuuuuugcaugucuggcaaguguccuaccacugugugauauccaugacucggguugaccacuuuaacagucucuaagucuuaauacagccaacccuuuuuuuccuccuucucacauuuacauccuugucugccguaagcuggaaacccgucagaaauguaaucuguuccauaagcacccagaguuuagcucuaggauucuuaucccuuagggccguggagggcugcgcuggugcuuugcaucuggcuggcacaugccaggagaaagagagggguugugguagauuucagaacauuugauggcaggccuggaccuuguuugcucuugcccacaucacauugucaagaaugcaaugaaaugaccgugcuuacuccacgggugagaacauaacauaacucuggguccaggcagaaaagggaaacagcuuggugaaugggaaccagucuuggcccuggugugucuuuuuugagcggcauauuguuugguguuggaaaaccgaguggcaguggaaggaaagucaggcucuggagaggaaaauugcaagucuuccuugagcccuugguggguggguuuuugggaaaacuugcuaaugaguucugagaaacacguagcucaucauaaucaagucauuuauuguagcugaaauguuuacaagggauugguaaauaucuggaagacgugguuagggaagcagacuacuuguauguuuuugccucugagcgcaccaugaucuguucucaggcauggauagaaguuaaccacccuguugggaaguagaugagcucuuccaggcaucagagaagggaccacaggaaaacucaaggugggcucaagguggacuaaacaacuuaggaaaaccuggauugaauuuagguuaaagggacaucccaaagacuguaguaaccacagugauccucuguuaguuuuuuugcauuauauggcuucaguuuuuuuccuggaauaucagucaucccacugaggacuagauuuauuucuuauaugcucaggucuuuugcccuuuuugauuagauaaacauuuuaauagcuuacugaaaaaagggguaaaauaggugagugcaguuuugagcccuuauguaucuggaaugucuuucauagucaaaguugagaagaguguggcuugauugggcuacaggucacuuguagguuaucugugauuuuugcuucaugaguuuaucuugcuucuauaacuccuucuagaagucugaagguguucuguuagcuuuuauauaacugccuuuccuagucucagaggccugcugcugucucauuuccccuguuuaaauucacugugauagcuugcugugguacucccgaugugagucagcacugguguugagcuggccuuucagucugggagcuguccucagccuccucauggccucucucauccggucagaacucuccucaguuucuccaggguuagcauuucagacccuacucccugugcuuauuuaaauuugacucuuuauuuucugucuuuuuuuuucuucuucugugagauuccugaacuucauuugccaaauugucuaagaaauuguuauaauuaauuaauuauuuugggacuggguuucucuguaguccugacuguccccaaacucauuuuguagaccauacuggccuugaacucacugagaucuaccugccucugcauccugaguggugggacaaaaggcaugcacuaccaccaucaauccauccauccauccauccauccauccauccauccauccuuccuuccuuccuuucuuucuuucuuucuuucuuucuuucuuucuuucuuucuuucuuucuuucuuucuuucuuucggggugggggguuucgagacaggguuucucuguguagcccuggcuguccuggaacucacuuuguagaccagguuggccuugaacucagaaaucugccugccucugccucccaagugcugggacuagaggugugcgccaccacgccuggcuucuuuauuucuuuauugagguaaaauauacauaucacagcauauacccauuuaaagcaauagucuucgcaaugguucuuaaugcauuuacagagcugucuagccaguaccaccacugucugaccccagagccuuuucauuaccuccagaagaagcacugccuucccuucccucccucuaggcugggaagcagggucugccuucugucuuugugugucaccucuaauggacacgcuacagagauaucuacaauauguaaucuuuguuucuggcuuggcuguggauagagucuuggaggucuaacugcauauuauauagagacuuuaaaaguaauguugauuuggggggggcguggcccuuaugcgugccacuuagagaugcuacacaguucuguagaagacacacugcuuauuucuuuuuggagucaauuuuacagguccuuaugcugaagcagucacuguuggcuauccucaguuaaccuuucuccacuuagcuuuaugcaucuuagcuauuuaauuuaaauuauggcuuccaacuggccacccgugccucaaaacuuaggauuuauuggaguuuaaggaaguaaaugaguaauugugguuacucuuuaugucuaacuggaacuaacugaagucuuccauuuuuccuuacauuuauuuaugugcuugcuuguuguacucuugugucugauguagguauguagaggaguugcuucucucuaucgugugggucuugggguugaccucaggucaccauguuugguagcaaguuccuacccacugagccaucacucugcuccauagccuuuuauuuugaaggcauugacaucagcgauuuauguuuaaaauuaugaucauauguguauauauuaaacuuugaguaugaaguugaaaaaaucaaacuaauugaaguaaggaucuccacagccccucuugugcucuaggucaagacccaaggucuccagcccugcgccacaccgcccuccagccguccuucuacccagcuacucuaguccauugugggaaguagaccuuuaggcucuaaguuucuuaugauaacuggcacacagagccagcuuucggugagguuauaguucccauuuguucauuccacauuuacugugccucccgcagugucuaggcugugugaugacacagaagcguggaggaggggccuggguagguagcucggccaaagugugcuuaccuagauaugcaaggcaccacaaccaguuacaacugugaacaagguacagaauuuucagccagcaguucuuauagaccagaugccccuguauucaguuuauuguuauaguuucaaaguugguuauuauaaguuuauuguugcuuuuuguauguguauuacgugugugguguucguguguguguguacguguaugucgagguuagagagugaaacagucagguguccccaguuguucucuauguaucaaggcacugucugucugggugucuggggccugcugcugacuugucuagcuagccagcuugccccagcuugccuuuuacauggcugcuggcaguccagacuccuguccucacacuucuacagcaaggacugguuucuaagcuaucucccagcucagguucaugcuuuucagcuaggaaguagugcgguuacguuuuuuaaaaauauuuuuuauuauugcauauuuuccucaauuacauuuagaaugcuaucccaaaagucccccguacccuccccaccacuuuccuacccacccauucccauuuuuuggcccuggcguuccccuguacuggggcauauaaaguuugcgcguccaaugggccucucuuuccagugauggccgacuaggucaucuuuugauacauaugcagcuagagucaagagcucugggguacugguuaguucauaauguuguugcaccuacaggguugcagaucucuuuagcucauuggauacuuucucuagcucuuccacugggggcccugugcuccauccaauagcugacugugagcaucuacuuauguguuugcuaggccccgcccuagucucacaagagacagcuauaucaggguccuuucagccaacgcuugcuaguguaugcaauggugucauuguuuggaggcuaauuaugggauggaucucuggauauggcagucucuagaugguccauccuuuugucucagcuccaaacuuugucucuguaacuccuuccaugggugauuguuuccaauucuaagaaggggcaaaguguccacacuucagucuuuguucuucuucaguuucauguguuuugcaaauuguaucuuauaucucggguauacuaaguuucugggcuaauauccacuuaucagugaguacauaucauuugaauucuuuugugauuguguuaccucacucaggaugaugcccuccagguccauccauuugccuaggaauuucauaaauucauucuuuuuaauagcugaguaguacuccauuguauaaauguaccacauuuccucuguugaggggcaucuggguucuuuccagcuucuggcuauuauaaauaaggcugcuaugaacauaguggagcauguguccuucuuaccgguugggacaucuucuggauauaugcccaggagagguauugcgggauccuccaguaguacuauguccaauuuucugaggaaccaccagacugauuuccagagugguuguacaagcuugcaaucccaccaacaauggaggaguguuccucuuucuccacauccucgccagcaucugcuaucaccugaauuuuugaacuuagccauucugacuggugugagauggaaucucaggguuguuuugauuugcauuucugugaugauuaaggaugcugagcauuuuuucaggugcuucucagccauuugguauuccauggaaagccaacauucacguggaaacugaacaacacucuucucaaugauaccuuggucaaggaaggaauaaagaaagaaauuaaagacuuuuuagaguuuaaugaaaaugaagccacaacauacccaaaccuaugggacacaaugaaagcauuucuaagagggaaacucauagcucugagugccuccaaaaagaaacuagagagagcacacacuagcagcuugagaacacaucuaaaugcucuugaaaaaaaggaagaaaauucacccaagaggaauagacggcaggaaauaaucaaauucaagggcgaaaucaaccaaguggaaacaagaagaacuauucaaagaauuaaccaaaggaggaguugguucuuugagaaaaucaacaagauaaacccuuagauagacucacuagagggcacagggacagcauccuaauuaacaaaaucagaaaugaaaagggagucauaacaacagauccugaagaaauccaaaacaccaucagauccuucuacaaaaggcuauacucaacaaaacuggaaaaccuggacgaaauggacaaauuucuagacagauaccagguaccaaaguuaaaucaggaucaaguuaacgaucuaaacagucccauauccccuaaagaaauagaagcagucauuaauagucuaccagccaaaaaaagcccaggaccagauggguuuagugcagaguucuaucagaccuucaaagaagaucuaauuccaguucugcacaaacuauuccacaaaauagaaguagaagguacucuacccaacuccuucuaugaagccacaauuacucugauaccuaaaccacagaaagauccaacaaaauagagaacuucagaccaauuucccuuaugaauaucgaugcaaaaauacucaauaaaauucucgcuaaccaaauccaagaacacauuaaagcaaucauccauccugaccaaguagguuuuaucccagggaugcagggaugguucaauauacggaaauccaucaauguaauccaguauauaaacaaacucaaaagacaaaaaccacaugaucaucucguuagaugcugagaaagcauuugacaagauccaacacccauucaugauaaaagucuuggaaagaucaggaauucaaggcccauaccuaaacaggauaaaagcaaucuacaacaaaccaguagccaacaucaaaguaaacggugagaagcuggaagcaaucccacugaaaucagggacuagacaaggcugcccacucucucccuaccucgucagcauuguacugaaggccuaggcagagcgguuacguuucaaggugaugcuuuagucagacgaauuuaaaacuuaaagguggaaguaugaauguuuugucuugugcauaguuuuauaagugcauaguuugacacauuugcuggcuugguuuauaugccauuuuucaucuuuucuaccgauuaggcauauuacauuugccuuuucuuguuucccuugaguuuuccaaaacugccauuuauuacaugauguugaucagugugacguuacgcuauuagccuuagcuugcgccauuuucuguuuuguuuuauuauagauuaaaaagaaauuggggcaaucauguuuauucauguaauuuugauuuuuaaaauuuacuuauguguuuuguuuugucuuauguaugagugcucugucugcauacacaccuacaugcuggaagagaacaccaggucaugagccaccuugugguugcugggaauugaacucaggaccucuggaagaaagccaguguucuuaacuguggagccaucuuaccagccccuauuuuuuggugucauucuuguugccacagcccugccucagccucccgaguguugggagaauagcugugugccagcacaccacgcauaugcuguguuggaaaauguacagcuucucaccuagccccccguggcucuaguacagaugggcuucagagcguuuccuuggcaccuucuccuugauucugacuucacaacuuuuuuuuuguuauuggugauaacauaauuuuuugucacauguaacaauuuauagaaauguucuuaucuguuugagcuucuaaaugcuacuugugacauagaaaugcauuuaauaaagaaaugcaaaaccugcacacugaaaacaugaugucucauggcaaaauaaggaggacgaaauaacugcaagaauccuaugacuuugagacuggggcuuaauguugcuaaggcaguccccaaagugagucauagaguccuuguaauugccauuuuaauucagggugcauuuuucuuugucauuuauuuauuaaaaaaaaaaaaagacaaacuuccuaaaauuuacauggaagugcacaggauucucagaccaaaaaucuuaaaggaacaagauaaaaguuggaugacucacuuuuccaacuuuaacaauuauacaaagccauguauggcuucaaaguaaugaagaugguguacaauauaaagaaaaguauauagauugauggaauaaaaccaaguuaacccucgcgucaccaugugccuguacuuugauagccaggagacuagaaauucuguuuacuucuauaauuaguguggaugggcagugugugggcaugcuaggcgaaggugugagguaagagagcaaugcuugggacugggcuuuuccccuugcgccuuuacaugaguugggacuugaacacguguuguccagcuugcuuggcaagcacuuaaacccaugaacucauccugguuuaccaccugaugucucauaagggcggcaggauaaguuccuagagaaagaguaguauuuucagcaaauagugccaggacaaguagauguucacauguaaaagaauaaaauuggaucccugccucauccguauucaaaguuaacuucaugaaucauagaagcaggaguuaauauucuggccuugggauaggcaauaguuuuuuauguacaaaacuaaaagaagcgacaaaagaaaaagaaauagugcuuccuuaaaaauaacuuuuuucuuuuuauguguaugcguguguugccugcauguauaucuggguaccacguguaaacagugugcacaaaggccagaagaggucaucugaucuucugggccuggaguuacagaaguuuaugagucaucaugugaguccuggguauugaaccuggguccucuagaagaguagccagugcuguugcuugcugagccaucuuuccagcucguacuucuucccuucuuaguagaacagcauuuaaggugaguggauggaggcacugaagagauggcucaucaguuaagagugugugcugcugcugcuguugcagaggaccuagguuugucucaaugcucucacaucaggagguucccuaccucuuauaaguccaguuauggagaucagagagucucuggccuccacaggcauguguacucaugcguauggagcauaugcacuuauguauacguacagacauacuuauguauacacacacagagauaaaaauaaucuugagaaagguggauagacagauaguaggaaaaaaaugccuugcaaauucuugguagguuuuucuuuuuuuuuguuuugaguuggggggucucacuauguaguucuggcugguuuggaacuugcaauguagaccaggcuguccucaaacucaguuugccugcuucugcuucccgagugcugggauuaaaggagugccuuaaaaguagcagguguuuuuaaauuauagaacaaguaaagcuaugugacauuuuguaaaaagccuuuaauuucaaaucuccauauuaauuguauaaaaauaaacuauauuauguauuucucucuuguuuuuugcuuucagugauguucuuuguuaccugguuaaaugguucacuuucacuuauuuguaacuuauuauuguuguugaugugugugugguaaugcacacguguguguguguguguguguguguguguguguguguguggugccaggggaggaugccuggugccugcucucacucuccaccuucuuccucugaagcaccgucucuuguugagccagccagcaaaccccaggcaucuuccuauugucaccuccuguagugcugaagucacaggcacaaagccauaccagucauuuuuaacagggaugcuagggauuugaacucaggucuucaugcuugcacacuaaacgcucugaccccaugaguugucuucccagaccuuuucuuguuuucauuuauuucaacuuuaagucucugucuuuaacacuauaauuuuccccaccguuucauccucgcaggcauagaaaaagggucaugugacgacacuagaacguaguuuucuaucagguugcagagaaugcauuucuugguaaaagugcgucaggcuuggguucucuacauuugauaaccaauuauuauaggaaccgccauucuguucauuuguagaacagcaugcuggcaaggaaggaaaugcaaccaugggcgugccaucuugugaggagaggaaguggacagauuaucuguguguugguauggacaguaguguauguucagaccacaagacuuuaaaaggcauuuuuauagcucuuaggcuaacccuguggcguguaagcauuaugcuucauacaguaugagccuaucgaaaccauucggugcucauucucuuuagagagugagguucuguuugguuuccucuuggucuuauucugcgacaucucaggcauuggcucguauacuuucuuuauucuuuggagacagacucucacucuguacccagagcaccugaacuugaagucuagcaugcuagcaggcccagcuacauuuuaaaauguuuuguaccuuuuuucaguuucuugaugugcuuuuuauuucuguguguuuugcauaugauuuacucauuuuauguauuaaucucauuuugguauuaguaggauugaugucuugaaacaguuccuuuuaguccucugucuccccugaccucucuucuaauucagggaauugaucauucuuuccuuugccaauuguuuuuuuguuuuuuuuuuuccuuuaaaguuaauauguaacuauuuguuugagauuaccuuuacuuuuuuccuuuucaagucaaauguuuaaaaaaguauaauuccuaauucccaugccuuuuguugacuuaguuguucauguuucucaaccauuauuuuuccccaaauauacuaugaaaaaguuuuaaacuauacagaaaaguugcaauaguugauagcuguaacugagugcagugaaccuggugucugacucccuugcucagucuuuguuguugcauacauuaguagcagaugcuguugcaugcauuaguagcagaugcuuguacauucaaacacuaccauuuuagcuugcacaucauuaacugaguuucaaauuuguauagcaaucuuuuuuuuucuuuuggggcaaaauuuacuuagaaaaaaaaugcagagauuuucagugugcuguugaaugauuucuuuagcucuauuuuuguguagaguagcugccuucucuaaggagacugaaaacuguaaagccccaaaccauccccacacucauguauuccucuacauccucaggaggcuucaaaugugcaucauaaagugcucuacagauuccauuccccuuuucauuguacaaaugcuuuucacacaaaaaaaaugauaauagucaaaaguauuuuaauuuuuuacagcucauuccuugagucuuaacuuuaacuugacuacugcucuuaccugcauguacugugugcucuuaccuaaggcugucuuuguuuggcuagagccuaaaacuguggccaacacagcgaccguauucucauagccucaggugcucaagaggaaggguagccuggugaggacccaucugcagaggcagaaagaaaaggggccuggacacacugcucauucagcuuguccuugccuuaucuagcaugcagccccgggcucagccuuaggaccauagacagcacagucuaaguuguaaauaaagaugugcaauggccuuugucaguuuuauaaguuacacaagugaagagguaaucaaagauauuuaaagauuucuggaauguuuaauaguuuauuaaaugccuguguuaauugugacucauuugagccuuaauggagaaagauuggagaccucuaggacaacuacucuguacuuagaaauaauuuaucagcuguuucuuucagaccggaaaauguguuugcuuauauucaaaugugauagauaaauuugcuauagugaagagauaggucauccucaguccuaauuuuuugguuuuauuuccugggaaagggucucacuguguggcccugaguggccuggaacucacagaggauucauuugccuuugccucucuagugccuugauuaaaggaggggccacuaggcccagcagcugcuuuuguugacaaauuuaagccaguuugggacuagagagcugucucagcacuuaagaacucuuucugcucuuucugaagacccaggguucgguucccacaccuacauggcgguucacaacagucuguaacuaguucugggaaaucaauguccucuucuguccuccuugguaguaggcauacauguggcgguucacggaauacauucaggcaauuauucacaucuucuuagaaaagaaaagaaaagaaaaguaaggcagcucaagguaauaagucagagaagacaggaguggcauggacugugcugggaaaacacuucuggugugguggugcugcuuaauuguccugaaucaagugaacuggaguacaugaaagucacuuguauuuuuaacauacucuguucuaagggggaaagcuaacuuggacgaucuuggugugucauauuguaauggaaugucucaaguuucuuuuguuaaaauuaggagaaauauguuaaaugagcuguuucucagcagugcauccagaagaagggguuguauguagcauggcaugcguucugcaugaaguaaugcacucacacagucugaaacuuaugaaacaucuuucuugacuggaaauagauuuuagaaaaagccauauuaauuuuacacuguuagguauaauuacauuuugauugaaguuuucugagcuaagauaauauuuucauagguuguugugaauagcuuagugguguuaguaaguugguaauugauuuaaauuuaaauauucuaaaaugcacugaaguaauuugguagugugaaaaggaauccuuucacugauuucuuggagaagaaauagaauugcaauguuacaguugaauguuuaaauaagccuuaugauuacacaaugaaaacauccuaacuuacuguuuuuuuuuuuuuaauuucagugcugaacaguaaacucauuuuucagaguuaaaaaauuauuuaaaaaaacaagauggggacuccugguucuggaaggaaaagaacgccgguaaaagaucgauuuucugcagaagaugaagcuuugaguaacaucgccagagaggugugugcugagguguacaaaugaugcucaugggugcugggaggcagacaugggcuugucagcuagcuguggggcguuugcuaggaacaugccugcuguucacaucauacgacuguccuaguaagauguacuuagacuuguaucccuucugauuugauuuucugagaauucaucugaaauucauuuuucacuaguuaugugcuuuguguaugcuuagaauuuuggaggucugagaacugcacuauagcucacuaagcuuuguagcucucagaacugcuggguaaauguugacagaaauugcccuuaagggauuuacaauccuagauugcuuuuuugaaacauuguaguagauauuugucugucugucugucuaucauccaucugucuguccauccauccauccauuguuguuuuugagagagggucucaggaagcccaggcuggccuugagcucccuauacagccaaggaugccuucugauccuccuaucucaccuccugucggugggauuacaagccuguguaacccuauguggcuuaugcgaugcuggagcugaaucccagggcuuggugcaucaacugugaagcuagauccugggcaagcucagcagcaacuacgcgggauccugggcagggcugggacuuucauaucgaauccuucagauacuaacagcuucuagggaguuuuuguuucaguuuguugauaacuuaggggaaaggaggggcaauaggagggaagauucgaugcuuuucgaaucucaaucgaaucucugcagcaucuccuguguauggauguuuaggagagcucucagcugggaugccuuucugaggcucuaccuguguuucagauucugaguguagcugcagauuugcacuuagcuuuugagugauaaauaauaacauuuuaauugugauuuuaucuauaggaauuaucagcauaggcaaauccauagaaguugauggauugugacaccagagcuaggagcauuagggagggacugcucagguuacaugggcuucuucguugggaugauaauggauuauacuaaaaacacugcauuauauacucugcaagggugaacuuuuagcauaucuaucugucuaucuauugagagaacuuuuucugucaggaaagauggcagugauauaucccuuugcaauuuuaauuuaaacuuuuuuguuguugguauuuaaaagcuucuuccucauguggccuagccuggccucggaaucccuauguagacuuugaacuucugauucuccugacuuuaugcuguccccacucucaucguaaacagaguuguaucaccacacccuuuuaagaaggauuuuuuaucgugugucuauguguauagacauggaggccagggguggauauggagggucuucuuuaauugcuuuuuauauuugaguguguguguguguguguguguguguguguguguguguacucgugccacagcgugcugguggaggucaggugacagcuuucagaagucauuucuuuccuucucccauggguuccaggcucacacugccaucaccaggcuugcccaucagagcuuuugcccucugcaccccgucgcucuugugccauauguucuugagacaggcucucucucuggagcuggagcuggcaguuuagcuggucaggcgguuggcaagcccaggcuccucaugccucugcacuuacucagugcugggauuauaggcaugcacagcuuuuuaauaugaauucugugugauugaacuccggucuucaugcuugguuugcaagcauuuuaguguagaagucaaauuuuguggaauaguauuugaagcaacauuaacuaaaacugaguaggacaguguugaaauaaagaaaaguuaucuaaaaacuuuauacaauuacuuuauaguagaaaccagauauuuuuagcuaaaaaagauauuuuaaaaaaugaaaaaaguccuuuauagugaccuuaaguauuuauacaagacacauacuuuuagauagaaauuaaaauuaccagaguguuucacaauuggagguggacguggggaggguucaguggucacugcccuugucucacaagccugacaggugcaggucccugagacuauagagccaaauguggucacacacaucuguaauccucucauuauugcggugagauggaaggaggcaguaggagaauugccugggagcuugagggccaccuagccugaaguacauaauagggcagaaugagagacccugcuucaacaaggcuaaaagcagaaccucucuugugguuugaauaugcuuagcccagggaguggcacuacuaggaggugugaccuuguuggaggaagugugucacuguagggguaggcuuugagacccuucucuuaaccacauaggagccaguauucugcuagcagcuuucagaugaagauguagaacucucagcucuucccuguaccaugacugccugguuacugccaugcucccaccuugaugauaauggacugaaccucugaaccuguaagccagcuccaauuaaauguuguccuuauaagaguugccuuggucauggugucuguucacagcaguaaaacccuaacuaagacaacuuucaaaauuguccacugaacccuacacaugugccuuagaaaacacacacacacacacacacacacacacacuuuaaaaaaauuuuuggagcauguacuuuaaaaaaaaacaauuaaggaguaaucugagaaguugaaaccuuuagaaaggaugcagauagccuuuuuuuucuauagauauguuuauuaucauuuuuugaggaucucagauaugcauuuaauagauuuugcucaucucuauccuucauuacacccaacuacccccacccaaucucccucccaaguucaugucauuuuucuuuuucuuuuuuuuuuucuuaaauacuccacuaaguccaguuagggcugccugugaguacaugggugugggugcaucugcuggaacaugggcagucuacaggggucacacccuuggauaaacugauucucucuuucccaggagcugucaguugccaguagcuuuuuagguagggauggggccucaugagaaccuccccguccaugcugaaauguugacuggcuugaucuuguguaagucuugcguaggcagccacaacugcugugaguuccugaguggcaaggacccuaucaugucuagaagacacgguuuuagagcugucuuccucuggcucuuaacagucuuauuuucuuuuaggcaaucuaaauucuuuuuaguggcugaguaauaaguccauuguguguauauucuuuuuguuccuaaguucaucuguugacuagacuuuauuggauggccauuuauugccuaaggagguaauagccauuuagacaucuaggagaaccagaaguuuguggcucuugauuauagauuaacagccugaggaaaagguauggagaugcgguuugggcuuagguaaaaagacauauucuagcagugcuuuuuggaguggauccuuaugagcugggcagagcugaugggaauacugcugcucugaguaauugauuuauuuuuaguucacaguaaauagaagauuagaaaaacuuuuggcaaguacaaaagguuucuuaaaauguggauuaccagagcuggagagauggcucaguggcuaggaacacuggcugcucuuccagagguccugaguucaguucccagcaaccacagguggcucacaaccaucuguaaugggauccaauguccucuuuugcugugccugaaggcagugacaguguacucauauauauaaacuaaucuuuuaaaaaauguggauuaucauagucugcaggaauuaugaguacuaacuccagcuuucaccuaagggcauaguuacuuuuuaaaacaaauaugaacuucgguuuuuuguuuuuauuugcuuuuugauacagggucucucuauauaacucuggcuguucuggaacuuacucuguaggccaggcuggccucaaacuaacagauccaccugccucuaccucugccucccuacugcugcgauuaaaggcaucugguaccaccuagcuuguguuuuauuuaauuuuuuuugaaguauaauuuucucucucccuuccuuccuuccuuuuaaaucuauuuuugagacuugaucuccuuuuguguugugcugacuggcugggagcucacuguguagacaugguuaaccacacccgguaaagugaacuuuuaauauucagucagcacacauuaauuaaagaucuauuauguauggacacugcuacauuuagaggguguauauaguucuaccauagagcucagauucaaaaggggaaauaggcacugaaggccacauaauggauucuuccucaaaguucagauacuuagcaguuccuuuuugucuugaaaacugguuaucugugucugcuauagucacugggauucuuagaaucaaggaaauauguaauguguguauuuauaacuguuaagugcuuugagagaacaguaaacaguuucauuaaagagugugccacaagggacaugcuugagggccuugggaaggcuuccuuggaggaaguggccuuucaccugagguuuguaggaugagggcuauuccucaagggagagggaguugucagagaacuuuuuguaagcuugugaguuugaagggggggugcauagaccccaaggacuaacagcggcagcuaagguuuguucagcuuugacuguuauacacugucucagugcuuuaacgaacagcccuaggcucuuuaaugcauuaccacuucaucaguucuguguauaagcagcagguaaccuugccaaguccauaaugcuuggaagggugaggugagagcuggaauccccauaguuccugaccucuuagagguguggaugcuaucaucgagggccucuaguuacuucaggugauaucugagacaggagaagaaagaggaauuaaccaacucaagcuaguaguuugcagauaggggcuaguuuuguucucugggauguuuggcaaugucuguggacaugugugccugccacagugaagggcggcaauggggaaggugcccgggcaaugugggcagaggcugaggauguugcuaaacuugcagugcacagcaaaagcaugcuuagcagggaugcggcugagagcccugaugauagacucucaugcauuauguuuuggagcauuagucuguacuaagaacaguggggaaauagugaagguuuuguguaggaguggaaugaucagaaggauggcuuauuaugggcuggagaugguaucagagaagaggcaucagugguuucacggaggugagucaggagccacaggggugggguggguggaauggggagggaaguaguuggugcuuugaguggcuauggauagguggcggagacaggacccgggagaauacaucuggauagaugguagggagagucagaauuggggagggggaaggcaugguugcguguuggcaugugcuguauuucagguggcugugagacagccacauggaaacuucacagggaggcuugagaacacagacugcaagcucauaggugagagguggccuuagcagacucucaauccuuguaucuaguuggcacauugggguaauugaacucagugugaucaccaucaucuagggcgaggggaaggugacuucucuuuaacugaguuguaaggaguuccaggucaaguuagaguuuuaucuuugacaccuuuuuuuuugcuuuauguauuugauuuauauuauucuguacaaguugaguuugucagagaaaauaauuccaugaguuaggguucuuccucuuuguaauuuuaguguucucaguguugauucacaaaauucauaaauuauuaugaaauagcaauuucuuauuuuacuuaggagaagucaaugucuuuccauuucuacacaguuaaaaacaaucaaauguccuccuuucugauuacugacuuuacuagcacgucgucugaaagagcuggucuaaguuguaccuuuacccagaauucuuucaggugucuuacaguaugcauugagccagucuguuucucccuuauccucagcagaggagaaaagggagagagagauggagcugaagcacucuuuuugucaccaggcuacccacugcugcuugucacuuccugccugcuuguuacucccuucuggaagaccaguguugcucucagaacuucacugucccuugauuuguugcugucuggaaucaaaggagcaugauuaugcuaaaggguucauuuugucuaggugugacagauccuucaagcccagcuguugcugguauggcccccgcccagccccccagcacgucuauaguacucagagccuccuuuggguagauugcaucauugcagacccuacguuuugcuuuucuugggcuauuuauuaguuuguaaucagaucucaguaauuaaucuucuuaaccuuugauuuccuuuuuuauuugguaagauuguuuuugcugucaaaggucucugcguaaaaaagaagauagaguuuuugacaauuaugaaaagaagaguuacauuuucuagauuuuauuguuucaguuuuaucuaauacauauuaaugccuauguucagaaaauuuuaaauauuuguuccuaaguaccaaagcuuuuuuuguuguuguuguuuuuucgagccaaagcuuuuuuuuuuuuuuuuuuuuuuuaaauuguuaaacacuauacauuucaaggucuaauuaagaaaaaggacaccucacauuuuggauugaagugaaguugcuaggaacauggaguaauaacucuuauuuguuaauuuggaaaccauggcaacacaauaaauauuaugccucuuaauuuguucuucaguguucuuuuggcccgagugccauggaagaauaaacaaaauuaacaguaaaugcugagcacgcacuaccugaguuagucauuuuucuugaugguuucacucuuuuuuuuuuuuuuuuagacacaauaugacuauagagcccugucugaccucaaauuuaugauccuccuaacucaagcucccaagugcugguauuauagguuccugccuucacauaccuagugagugagaaaagauuuacugcagcucaguagccccaaacucauagugccuugugccucaguucccagauuuuguauuuugaaucccaagugucugcagguacaagggugugaaacagguagugggauguggagaaaugaacugccgggcuaguagcucauggccuauuauaugaauauaucacacuguguacauugggggaguuggaauugacuuugaacucuuugggaccacaauuagauuaggccuccagggcaguuucccuagucaccacgggaagugucuggggucuggaggaggggagagcuggggagaaaguugcuguuugcaucucuggagaugaagagagccuggagcaagcuguggcugagggaagggagaauggcaaaguguggagacuugugggagcugaggaggugggcucagggacugugcuguggagggaggcuaggaaaagggaaagagccuuaugggccuucaccacuucaucuucugaguugagggacagugauagaagcuaaaaacaagaagagagaccuuaaaguaaagauucuauguuuaauuagggauuuauugagucugaaguucuugugggacaggacccauuucuaauagcccauuagaucagcugggugggagaggagccugucguggacauaaagauuugcugacuuaucaacugaagguaguaucacccaggagagaagauagaaugcagagacagaagauuaagccuggaaacuccaguucuguuaaaacuuuaaggaucuacaaaagaaauguguguccacacaggauucagaagagggauauuagaaagcacagggaagaccagaaggugcuagugcuacaggacaccggcaguuuucaggaggaaugagggguuagugauuucagcugccgagagaagugagauaagaacuuaggaauuccacuggguuugguaguuagaggucauuagugaccucugacugaguaguuucaguucagugauuuggccagaagccagacuguagucauuugaaccaagugugaagugaggagggagcuaugugagaacugggcugccaagagagacuguagaucugugcugggugcggauuccuuacucaauuuuuuaagaugggacagaacuuguucccaauuuugaugagccaauagaagaagaagcuaagauaggaaagaaagacaggguagcugggacagggucccggcuggugagucuuaauggcaguuuggagggauguguuugagggugaugggcuuggggcauucugaccucaaacaggaaggacagcucuucagugggacuugagaugaaggaaaaaggacagcauagagccugggacgucugacuugggcaggaagauguggagggaaugccuccuucaggucacaagcuguauuuucuacuucaagcucaucuuuagacacauuugaaagauuccuucuguggugggaaaagcauuggagcaaguggagaaauaccucauguaggaaggagaagaaaugugauauugcagaacuuucuccauugacaguggauaucauuuccauuguauuucuuagaaaugcucuccuugcuguuuauuuaaaacagucuguauuaguaugacaguuuucaguggugccuacuuuguuucugaaggccucugugguucauagaguauauauguccuaaaaacaaaacaaaagcaccuauuugugguucaguagguucucuucauaacuugauggaccuaccccaacuuauagaauguauuuaugucuugguuaacucuauugccucugaaguguuagguaccagauucagacuaucgugaaguaagcauaccuuuguuucauaccagaaaaguagucucaagugagaugugauauucggauuuuaucaaaguaaacagugaacacugcccagcugaugaagcagccccuccuuccuugucuauccagugagcagaguucuaagaggcuugaaggccucaggugggccucugauuggagugcugcaggaaccuacagcaaauuuaaccuggucauugugccugcuaaacugaagcaguuacagaaucugaauuuaaaaugcagaaagcuuguggauguuuuuggguauuggacaccacaaggucuaucaagacugucuauguuuuaacuuugagaaguuuuacugugcuuguuccuggggacuuccguagggugaccuaauagcauauagcgggaagucucaaagaagggagaaagugcaguuagaauuaggaagcuuuguagugcucuaggugaaagugguaagagcuguugggaagaggagggaucugcuggaaggaaucgaggauggauuuaggagguugggagguccugaggcuugagugggauggugugggcucccuuguuggagacuagcgaggccaggcugcccacuagacaaggguagaguuguuuucacucacucugcucugcugcuagcucauccauuagguguuaagagauggaggcuuugauuauagcugagcagucagagugugugguacuggaucugaauccucauugguugagagcugaaacuaugaucaaagaugagcagaaagguagggcagagaaaaaggagguuaucuacaucuggugugcaggagggaguggccaaagaaccaauggaacagccagggcagcuccacagaaaagagacuuggagcucauuugaaaaccaugcgaagcaaagcucuguggucugucugaggagauuggcucagacugcauguauagacagguuguaguagagugggugagagucuuaggaugugggucuuggcuccaguguuugcaggugaggugauguucuugacaagguauuuguccucuguacccagagauugauuuuguggauuagaagcaaucaggcauccagucuugcuaaugagucaguguacaaauggcaacaggcagagcagugagaucuccauuugcccacuaucugcaaaguguggcuuuuuuuuuuuuuuuuuuugaggugggaucuugcuauauugucuuugcuagacucauauuccuaggcucaagauucucuggccuuagccuccagaucagcugggacuauaguuauaaccgacugugccaggugaaaguuuggguuuugauuacgaggaaguuauucugauaauauuguuuaauuuuagguaagguuauccguuagcagacuuacuccaguuugaguuggauucugauguauuuucauaagcugauuccucaggcuguaucccuggaucaucauguuucaaggauuacuuaggguuuacuuaguaaacucaaguaauugguccaagaaaugcuauauauucugugccccucuuugagauuccugauguucguuguuacuaauauucugacuuaaaaagaaguucaacccaauauuuccuaacccuucuaggucauaaaauuuccguucuucuguuuauacauuaaacuuugugaacuggaauuuugcauauuuuuaguauuucucucucucucucucucucucucucucuguuuguauguguguguuuguguguauuugagauagguucucauauagcccaggcuggccccuauguagauaaggauggcacacuccugccauagccuccuagguaccaggauuacagauguugccuccacaccuuguaacuuggguuuuuuuuuuucuaaauucacuuuuauuuauuaagaaagcuuaccuuaugauauaauccaguaggcuggcgagccgucucaguggcuaagagcauugaguacucuuucagaggaucuggguuugauucccagaacccacgugcugacauacaacugucugcaacuccgggcccaggcaaucucacaccuucuucugcuccuggucacugcaugugcacggugcucaggcauacauacaggcaaagcacccaugcacauaaaauaaagauaaagauuaaaaaaagaauauaacucagugaccaacacaugugccauuuuaggauauugcauucuuuuaaaaucugcuuacugugauguacaguuaucaucuuuuaucaaauugcaaagcauuucaucagccccuggagaacucgcuucuuaauuagcagucacucucuauuucauccuucccuggcaaccaguagucuaguuucugucuauauagauuugcuuauucuugguauuuuauagacauagaaucucgugucacuuuuccuaucugucuuuucucacucagcaaaauguuuucaaggcuuaucuauguugcagccuuuucuaguccauguuuguuuuaaugacugaguaguauuccaguaguggaucccccacauuuguuuaucuacucaccagcugcuggaauguugguuaucucugcauuuugacuguucugagcagaacuguugugaauauuugugggaacacugccuucaucucccuuagguucacaucuuuugguaaaugcugggcuuuauggcaacucuguauuuaacuucuggagaaacugcuacacuuucccagagcagcuguauaccauuguacacugccagcaguuguguaggguuugaucuugccacauucuugccagcucuaauuacuuuccuuaaaauauaauuuguuuuguuaaaaccauucuaguagcugugacugguggcucaguggaugugaggucuuuuccaucuuuuuuccccucugcuuucucauuaaccuuuuuuuuuuuuuuuggagucuuaaaauaugugacacaguuuuggucagguucuuuccauuaacaagcacugaguaaaagcaaacaacaauaaugacucaaagcuuccauauacguagaaacguguguccacacgacauuguuuccuccugaagguuuuuccauacucaucuuuuaugagauacucuuuucacugacuagguaccaaguguuagggaugguacuuggccugccccugagcucccugggcacaguugauggccuucccagcucuugggccuucuuggucucucucuaguuucuuucuggaggcacucagagcuaugaguuuuccucuuaggacugccuucauugugucccauaaguuuggguauguuguggcuucauuuucauuaaacucuaaaaagucuuuaauuucuuucuuuauuucauccuugaucaaggaaucauuaaguagaguguuguucaguuuccacgugaauguuggcuuucuauuauuuauguuguuauugaaguucagccuuagucugugguggucugauaggaugcaugggacgauuucaauauuuuuguaucuguugaggccuguuuugugaccaauuauauggucaguuuuggaggagguaccaugugacacugagaagaagguauauccuuuuguuuuaggauaaaauguucuguagauaucaauuaaauccauuuguuucauaacuucuguuagugucccuaugucucuguuuaguuucuauuuccaggaucuguccauuggcgagagugggguguugaagucucccacuauuauugugugaggugcaaugugugcuuugagcuuuacuaaaguuucuuuaaugaauguggcugcccuuguauuugcagcauagauauucagaauugagaguucaucuuaguagauuuuaccuuugaugacuaugaaguaccccuccuugucuuuuuugauaacuuuggguuggaagucaauuuuauucgauauuagaauggcuacuccagcuuguuccuucggaccauuugcuuggaaaauuguuuuccagccuuucacucugagguagugucuguccuuuuucccugagguggguuuccuguaagcagcaaaauguuggguccuguuuguauagccagccuauuagucuaugucuuuuuauuggggaauugagaccauugguguuaagagaaauuaaagaaaauuguugcuuccuguuauuuuuguuguuaaaguugggauucuguucuugugguugucuucuuuuagguuuguugaaggauuacuuucuugcuuuuucuaggguguaguuuccauccuuguguugguguuuucccuuuauuauccuuugaaaagcucgauucguggaaagauauugugugaguuugguuuuauauggaauacuuugguuucuccaucuaugguaauugagaguuuugcuggguauaguagccugggcuggcauuuguguuaucuuaaggucugcauaauaucuguccaggauccucucgcuuucauagucucuggagagaagucugguauaauucuaauaggccugccuuuauauguuacuugaccuuuuucccuuacugcuuuuaauauucucucuuuauuuagugcauuuguuguucugauuauuauguguugggaggaauuucuuuucugguccagucuauuuggaguucuguaggcuucuuguauguucaugggcaucucuuucuuuaguuuugggaaguuuucuucuauaauuuuguugaagauauuugcuggcccuuuaaguugaaaaucuucauccucaucuacuccuauuaucuguagguuuggucuucucauuguguccuggauuuccuggauguuuugaguuaggaucuuuuugcauuuuguauuuucuuugauuguugugcugauguucucuauggaaucuucugcaccugagauucucucuuccaucucuuguauuuuguugcugaugcuugcaucuaugguucaagauuucuuuccuaggguuucuaucuccaguguugucucacuuuggguuuucuuuauuguuucuacuucccuuuuugggucuuggaugguuuuguucaaguccaucaccuguuugguuguguuuuccuguauuucuuuaaggacuucuaccucuuuagcaguguucuccuguauuucuuuaagugaguuauuaaaguccuucuugauguccucuaccagcauuaugcgauaugauuuuaaaucugagucuugcuuuuccggugucuuggaguauccaggacuggcugaggugggagugcuggguucugaugauggugaguggucuugguuucuguuaguaagauucuuacguuugccuuucgcccaucugguaauuucuggaguuaguuguuauuguugucucugguuggagcuuuuuccuccagugauucuguuagagucugucagcagaccugggagacuaggucucuccugagucucaguggucagaguacucucugcaggcaagcucuccucuugcagggauggugcacagauaucuggcguucagaucugccuccuggcugaagaugaaggccugaaacagggccugucccagaagcuguguagcuucuguagccugcacucucaccugugcaaacuagucucucagggaucuaggacccaagacccaagauggcucccccaccugccgccuucuuggaaugucacucacaagguggcacauagucagagaagcagcugcugcugcugcucccccucccccucccccuccccacugcugggccagagaagcuucuuaacaggcagucuugcuggggaccucaccagugaugagagcugcacugcuuucagcuuccuagaagaacagcagcgagucgugucuucagcacacgcccaagcgugagcucugugaggcugguagguaggcgaagcugcccggauguagccuggauggcucgggauagcugcauucagugacaggucugggcucucuucuucuuuuuugcuguuauuugcagcauugccuggacaaacauguuuaaugaacagcucccucaagaggagcgucacucagagauuucaacacacuucaacugugacaccggcuggagaaaggcagccacuacacugcaucugagaacuguaguuccccucaguucacagggaccauaucaauacccuaguauuguaaacauucuggaagggcaggcacaaaggcuuguaguucuacaagcugguggcaggauucagucugugcgucaagugugugguucuacuggcauugccaccuugugagugacauuccauccugugaacaaaggcauguuaacacuugacuuagaccaggaauuuggcacaaaugcucaauaugaagguuguagcucauuuucuuagugugaaugcugccuuacuaagcaagaacuuugucccucuucuggcugcagggaccaaaaauuaguuguuugauacaaggugucuaaguuagaagguaugacagcuuuaaaaaaaacaaagagacaaagacagguuucucuguguagcccuggcugcccuggaacuccuuuuguagaccagauuggccucaaacucagaaaucugccugucucugcuuuccauugcugggagcuuuuuugagggaacaccuuuaaauuuaacagaauuagcagcaacaauuaaggcagcaaaugcaguucgugccgaugcacuugucauugcauuuuauauaaaagucuaggacacugaugcuagucacuuaauccuugccggucucagaugcucacuggagaugucgauggugauagcugcgcaugcucagccucacucuaucuuaagucccagacauauucaaaggauccccuugcccagcucagcugccuacuucauaagcuuaaacauuuguuuucuacauuuuauuuuauaugucugagugcuuugcuugcauaugucugauacaccaugugugugucuggugcccacggaagucagaagagggcauuagauggccuggaacuagaguuacagaugguuguuagccgucguguggaugcuaggaacugaaucccagguccucugcaagaacagcaaagugcuccuaaucacugagcucucucuagggccauaguucacagaauuuuaaguguuuuuuuuuuuuuuccuacuacauuugcagaccagcuggcaguagggcuggacuggccugcaucugcauguccauuaauacugauacugguugggucuccuuucuuguuuucguuuagggcacuuucaugauguuuuuuuucugguaccaaauccacuuguguguguguguguguguguguguguguguguguguguguauguguguguguguguguguguguguguguguguauguguguguguguguguauguguguguguguguguguguauguguguguguguguauguguguauguguguguguguguaugcaugaauguauguauguauguauguauguaugaucgcucuauguugccuaguaugcuguaggaccugaacugcugugguccuucucccucagccugcuaaguaacugaaacuaacugagauuacaaguucauccuacaacacuuaguguggguuguuauuguucgagacagucucuacuuaggcuaaguuagcuugaaacuggauguguagcccagacuggcuucaaguuuuacagcucuucugccucagccuccuuagugcugggauuacaggugcacaguacgguuuuaguuuguuacguccuucaucagccuucaugugccucauauuucaaagcacaaccaccagcaucuccggagugcacaggaggcuucucaccugaauuccaggcccacaauuuuacauguuaguguuaggaaugggagucauuuuagacuaaaaucauaaaugauuuaggcuuccaaauauuauuauuucaugugugaucauagucuauaugaucacuuuucaacuuagcuaaaucuuuuuuggugaaauaugcaugauguugaguuuaccaugguagccauuuugagugugcauuccugcacacauuauguacauuuuguacauuucuauuuuguaccugucaccucaauccuucugcagaaccucacugucuuuuagcccggaaacugucccuguuaaacacuggagucuucacuccccuuccuucuagcacuuagcaaccacccuucauucugucucuacgaaucccaucuuagguguuuuacguaaguauagcgagagaauagucauccaucuggauuuaccuugcuucauuuagagucuuuauaagauucaucuguguggucauaucaaaauguccuucccuccuaaagacggagcaauaucuagucauagggcuuaauguaauuugcuuauccauccauuuggguuguugucaccuugugguuuuugggacugugacacuguaaacauugguguauaacugucuguuugggucuuugcuguuaaguguuuuguauuuuaucuuucaguggaguuauuuguaucaaauggucuuucugcauuuaguuuuaauuuaguuugaauucaguuguguugcguuuacuuugugugagagagaugguuaguaaaguaaaucugcaugcgcuucccuguggguugcacccugggugaacacccugcuguuacucgccgcacuccugagugcucacuucaguguggcaauugcagagcacaggcuuugucugcugcuuuggacucggccuuggcuucucagucuuagagcaguguauaggaagaaaaucaagucagguaguuuuaaagccuguuucucuguguuaaacguguggcuuaaacacuguccccacagagcuagaugaaguaacaaaaggaagacugugugagucucucugagugcaugguuuuuccuuuggucguuuaucuauaauuuaggguguuaagucucauuuugguguagaugguacagaauuggcaacagauccuggagggaaagaauugguauuuuugaacugaauuucuaacagagacuacaaguagaaagcuaaaguacguagaaugaaaauucuuacucauugccauggcuauaauauaaaaaguauuugaaaaguuuauugcuuuguagauuuaaaugcauuugcuaucuacuaagauguaacuaagccucgaagucuuuuucuaugacguaaaacucuuaugagaaacaauugccagaauggggguaaauaggaguuagcuguuagcugugcccugcucgcccaaacuaacagggcagagguuggucaucucacacugugcauucuuagcuaauugcuuaugggauggacuuuuuaggcacugacugagucuguucuuauggaugggcauaaauacaacauagagggaagcaucuccuguagcucagauuagacuaaggauguggccaaggacacggggaucaccauaaagcagagaucagagagaucugaaugauccauguagcacaucaaacuguuuaugaauuuccuugauauucuggcuuuagucugaaauauucauuuuuuuuuaaagcaaauguugaggcauuaaaguuguggggugccaagaggcaugugauucuaaaagguuuuauguguguggguguuuugccagcauguaucucuugucuucuacuuguaugccuaguacucagaugccagaagaggacauugcguuuccuggaacugcaguuacagagaguugugagccaccauguggguguuaaguaagaacugaacucagaucccuggcagcccuggaacucaugcuguaggcuaggcuggcuccaacucacagagaccugccugcuucuagcuuugguuucaauucuuacagauugcuuuuaacauagugugugugugugugugugugugugugugugugugugugugauaacuugauaauuuucuccuucugccauguaccugcugggccauauucccauaccuccucacccacaaaagacaaggucucuuuucauagcccuggcuggccuggaacucacucuuuauuauaggggcucccacagcagagcaaaguaugacucuacuaauguuaauuaggccuauguguagagcacggucagggaaucaguugcaagagcagagucgcugccacccacagccuuacucuauggagaaggaugaguucuguggaggugcuuagauggagucucucugucagguaaccuuccacaguguggaagugccuccugaggcuacacagccauaugcaguuaggucggagucacagcagaaagagggagggguuaagaugugaggagccuuguuucugcuuucaccucuucccuccuguccuuggcgucccuccacuucuuacuuaaauauaggcaacgggaaccaauagaggguuuuaaacaccugaguggugucagagacauuguugucaauuuuauggucuuguagaggauggauuauagggcagauucuagagagaugauuugaagaugauuguaguccaagcaggagacagcuggguuuuccuguugugacuccauuuacauuaaguaugaggacagcagauuacuagagauuagcaguugcuuggaucuaguaggguacaacagggaguaauuauucauguauguggguuuucucguugagguucuugaguuaauaguacuaaaacccaccaaauuauauauucuucaaaauguugaguuagucugcauccaugcugcccugaacacaccugguccacuuuaaaaauggugcauuaccuuugaugcuuaaauuauauauuaguuuaagagggacggggacagaugguggcaacagggaggcggagacccuggaaugagcagaguucgagacgucagcgguaacgaguuuaaauauuggcaauauugaaaaucaaauaacagugguuucucaaguucuuuggaugauugaguugcuaagaaaagaaagaaaggaacagagcgagcuuuggggauguaaguggugagcugagcaucaaacaugcucaaggcgagcggcugaagacaaugguccugacaccaagacuugagaccagagagaggggaauggauggaaguugacugaagucaggcaagcuuguuaaaaugauauuuucuuuuuccaauaucuuuggaagacauguccauuguuccuguccucacgucuagucuguaaguacuuuuccuuccuuccuuccguaaaacugagauuuauguuacuuuucaggcagaagcaaggcuagcagcaaagcgggccgccagggcagaagcaagagacauccgcaugcgggaacuggaacgacagcagagagagguaacggaagccgccuuagcuggcguguaugugcugccugugugcaguguauuggggagagggaaggaaaugaugaaggcgagaucucacagucucagaucuccauuuccagggcaggagcacagagagcuucugugagacacaaggcguuacagugagauagugacagggaaauccccauucggacagacuuuuccucaaggugcagucuccucccccgaacguagcucugagucuugcccuccuaggugagcaacugcuuuuucuuuuuagauaaagcaguucagaaugaacacaaagagaggcgggggcauugcagagcauauaugcaaaggauggguuguugaaagcacgggggcccaggguggcaaaaguaaugccccuuuauucuucacuccauaauuccaauucucugccgucacaauaaucaacuuaguaagucugcucuggacauuuuccuggguuuucuuacuuauaauauaaacaccggucugccugcauugcuacuacguucaccgucaauucuauuuccacagaauggggggagacacccccauaauggaucuuugcgcuaaauggggaaguuuuggaauggaagauuuuacaugagaugugugcagguccaagcauaaacauugcagugcaccucgaucuccccagcuagcuagcugaauccucaugcuuaccauuuugaagcauguuugauaagguagggaaaugguccccaaacuauaaaaucgguaggacaccccaccucaaaagaauaaaacaaccaaugccucuaucuggagucagaaaggacuggcuuaucagugccuuggcuugauguguggaauuauaauggguuucauuauguucuguaguuuacagauuuauauuaugcuuuugucuucaaacaauuggaagaaaguaaaauggguaaaugucaguugaucuaacauagcauacuuguuaaccuuucucucugacguugacuugagugugaaaacacucacaaauguuucacuauuguacuuacaaagggagaagcaccuguggaguaguagaaagcaauuuauuuugauguuauugguagauuuucuauugauaaguuaaaaaagaaauuuauauauuuguguucuauguugauguaauuuucucccuuagauacagcuucaaauacuggaugcaguuguugguuuggaaugcaauguuccaauauauugucuuuauacucuuaagacuacaugaaguuauaaauagaagagacaguuauuaauagaaauucgaucuaugcagagaaccacguguguguuuuuuuuuuacugaacauacuagcuuauuaauauuuuauauuuucaaaguauagcuuugagucaccuacuauuguugucuagggcaaaugugugugaguaagacuuuuuuggagaaugcagugaauugaaaaccacucagcucauaaaacuuuuguguuuauagccuucucaucaucauuccuuugaccggaaauggggagagauucacaaguggcugguaggccaggauugccugcccugcaugcugugauaacugcugaacuaaucuaacauggaagcaaaacguugacuaaugguuugagaaguaggugguguguucugugugggccuaaaggucgcagaguagcuguucuaucuguagggaucagaugggugcuggaguccagcauuuucauuuguggucaguagccucacuuugaccucaugaaagccccagaugaagaaagguuggguaaaugaaugcaugcuuucuuugaauggguuugcuuuucaucccucaaucccugcuuccuccuuucauucuccaucuuuaaaaauuaacuccacaggcucuccaugggagaugacccucggucuuagcucgugucuucugaauuguguucuuauuucaucucuuagcucuuugccaagcccucuacucccauugcagacuuuuagcuacaccagugaauaccaugaacugguaggauacuaguuggcaaccgugaacuuuuuucaaguuccgauuucaaugcaggauuauuaauuugauaugugacuaggcuuggugugguauaugaagcccaauaauauuaugcaaauacuugaaagaguacuuuuuuguuuguuuguuuuucgagacaggguuucucuguguagcccuggcuguccuagaacucacuuuguagaccaggcuggccuugaacucagaaauccaccugcuucugccucccaagugcugggauuaaaggcgagcgccaccacgcccggcugaaagaguacuuuuaugggaacuguugauagguauauuagucaccagagaagcuucccagagagucugagaccaugucucagcuggugcucacaccucaccuucccauacaaguggcucguagagcagcguggugaggagucuccaggccuguaggggcuuggcuugcugggauguaaguggggagcauuagaacaggaagcucaggagugaaggaagcuacugugucucagcacggugcugcuaagggggcacuugucacuuuauguaugggcuuuuuuuuuuucaacuugaaacagucuagauguaccugggaagaaggaaucauaacuaaggaauuucauccaucagauuggccuauggccaugucuaugagguauuuucuuaauuacuaacugauguagaaagguccagcccacuguggguggugccaucccuaggcagauggguuuggcuguauaagagaaguagcugagcaagccagaggaggcaauacaguaagcaguguuccucaagggucucugcuucaguuccugccucuagguuccuacccugacugcccucacugaugaacuguaaccaguaagccaaauaaaacuuucucccccuaacuugguuuuggucaguauuuuaucaaucauagcaacaagaagcaaaccaggacaagagaggaacagguagagguuuagugaccaacacuggcagagucagggucagaaugugaagaggaagggaggccaccgcuggugcagaggugaagcagguaaggggagggcuguguccuccuggguuccaugcaguccuuuguagccagcuggcuguuucucaugauucugauuucaagucgucugcuucagucagcaaccuuuguguggcuggaagaguaaaugcuguuucuaggguuuccuaaucugcagcugaaggagcagcuccagugccaguagucauauuuguaggcagagaagacaggcuuguucuuggggcugugguuuucucuuacugaaaccauuucuccuuacauuaagugaacuuuuaaaaaguguguuuuaauuugauuaacccaauuugaauauaauaagauaaaguuccagagaguucugcuuugaaguuuuuauacuuuauuaguucuuaugagaaacucagucaucacagaaaauaucacugcagaaucuuuuucaaaucuguauuuuaccauuaccaacacuggcuuuucauucacgauuuaagauuuuagaauacuggagcagggaaucucugucccugagcuuuauuuccagccugcuuuuacuguuugagacaaagucuaaguuguccaggcagaagaagucuguuggucaugaccuuccucgugugggugcuuaauuugucauucaugagaguugccaguccccagccagggaggaaagaauucccaaaaguuuggacuagauaugucauuuaagucauuguuaugcuuggauugcucagcccuaauaaggcgacacaggauuaugacauugacuauuucucaugacuucucaaagaaggggaauacucugcuuuguauuuagaaccuuagaaggcaguuugcuguaaucuguuucauuguuacuggugcuguuacuucaggaagagccauuggguguuauuguaguacuguagaucugaccuggaugaugaagagggcugucccuccauggaagaaagguccugaguuuguuguuucuguguaacugaaccacaacagagugaauguuguauuuaugguucgguugugugccgagucugagggucgaaaugccggccccagcugugugcuucuauagauuccuccuuagccuucugggagaugacuuucuaucccaaagaugagggauguguucugcuuucauuuguuugcuuuagauacagggucuuaacuauguaauccuggcuggccuggaacccacuuuguagagcaggcucaucucagacucacagagaucugccugcuucugccuccuaaaugcugggauuaaaggaauggcuagauguguugucuaacagugcucguuuauggcuggugaaagagaaguuuagagauucagcuugaauaucagcuugguaucccaaaugacaccaaugggcauguaaaauuaauaucccuguuuaacacaaggguuuccaauuaguuuggaaucuguuaccacuuagcacuccgugcuacucacaugucuccaaaacuugugauucacuuacaaaaaguuuaaauuggugauucaugccuagagaucacaacccuguuggaaauggggucacaaaaucauguuaucuuuaaacagaauuuaggaccuguuuuaucaauuguuuacauagcgagugucaaaagaugauuuuuuuuuuuuaaaaaacuguacacaaaaacugagacugaaaugaaggaguaaacugcgacauauuauuugaauuacuauguauguugcaguggauagccagagauagcaagagauagccccaucuguuuuuaguggcauaaugaucuaguugauuacuguagggcacuguggcaucguuuaacuuuagaagacagcauugcuguugaaaggugagccuaccuagacugguuagauuuaguuuuuagucauagugcaaauuacuuuaacaauuuagacauuaaaauucugaaaaaaugagaaauuccccaugguugcagguaaucauauuuuggguacuugcuacuugauacccaugucaagcugugcugcuuuccugcugaugggcaagcauggaaauguuuagaauuacacauaauuuagucaguuucuuuguaagccguauaaggcaugacuuaacucugccaaccgugaagcaguuauguucuuucuucugacuggucuaucacauugacacacugggguauauuucccuaguucuuuuguuucccaguuagaauagcuagaggaguagggaaaacaaaacaaagaaacaaccagaaaguuuccucacagugagcaccagacuacacacuaagcauuuauaaagccuucuucuuagaauucaguucugacaaagcgaacguuucuucugcccuguaagccagcacuuacagugaagaagucaaccucugugccuucaguuuucuacuccugucacguguucuuaucuccuguguugagcucucagggccacaaguaaauaacaaguguuuggacauacucacaccugcugagauaaaaccgcugccugccaugcuugugucugcuuuccacccaaagcagccagccaugcuccccacucagcucuggaaccacauguccagaccugcuuauccucagaagauggugcugugcuuuugacuggcugcuuuuucuccuuugcugugacaaacaauuacuuguucagcgauuaauuauugguguacuuucuucuuucccaggaagauucagaaagggccagguacucucaccggucuggucaccgccguccuuaccugguuuguaguaacauacaagcuugcccauggugcagucccucauuggcuucauucacucacaaaccuguaauauguuugcuuuuauuuuuaucagggaguugaggauacauugucucuucggagccuuggcagucacaggguugguauucuaaguugcuuacacugaauagcaaagcuuuuaaccuugagcuuccuucagcauuagugauuaucuaagcaaucugacaauauccauuuauacuucugccuuuaacaauaagcgggaaaugcuggcaaggcucuuuaguggaaagagaugcuuucucucaaauuauugcuagaagugaaucaauucuaaaaucuuagcuauuuuuaucuuaacagaggucccuucucaauuucuacagaaauaucuuugauuuuuuaaaaaauaucacaaaaugguaagguugaguuuuauaaaauaacaucugcuuuguccuaauuuuuaguuuuuuuuucucuucucacaucuuaaacuggcaaucuauuaaaugagcaauagcuuuggggcuugccugauuauuuacauuuauaaugauaugaaacuauugauuugaaaauuuuucuugccauauguguaagaauuaugcuuugacauuuugauugacacuguguaaugugccagccuuuaguguagauugcuguaauugagugugguuugucaccuaaaguccugugugcugugcugcagcacggcuugucccuucuuagagaacugugccguaagacauguguuguauuuuauguuauuuaugguuuuuaucaguaaagucaucuuucauauuaaggaguguaucuguuccaauucuguucuucuuccuacuauauauaaaaauggacuaguuaagcuauuccaacauaccagguauuaacacauucauauuuguaaacacuucauuauacucuaauacauuguuuucuuuugucagauguaaucuauuguguuuuuagaauaacuuuacacacugguuuuaagucauaacugcucucuuuaguuacaaauuuuagaauuguuuuagaguauuuucaaguuuuuaaauaagauuauuagugacuuaaauguggcauuauaggugguuggaaagcuggcucagcaguuaaaaagugcuugcugccuuuguagaggaccuugguucaauucuuaucauccacaugacugcagcucacauuuauaacuccagaucuagggcaucuaaugccaucuucuggccucugcaggcaccagggauacacacuguacacauacauacacacagguaaaacacuuuacaauuuuuuauauguaugaauuuuuuuuuuucaaaaaaugaaugcauuuguuguauuuccuacuagagggaguuuuuccuuccucuuugaauuacuuuaaaaagauuccacugaaguccaccaaaguuucaaaguugagagucaggggcuauaaaguguuccccucuuuuuguaguuaguuucuuugcuuuuauaaugcucauagugugaacuuucacaccuuccuuauugagcugaguaaauuugcauauaaauuugggaaaguuggaucuuuaaguuagaccuaaguuagggaacuuuaagucaaaccuccaaaguaaagaaaucugcaguuaaacugguaaggaggaacuauucgccucgaguggguauaaagcuacaauuuuaauaauaauaauucucucuucucucuucucuucuucuccuccuccuucucuucuuccuccuccuccgucuccuccuuccccuucucucucucucucucucucucucucucucucucucucucucucucucucuuucuuucuuucuuucuuucaugguagcugcauguguuuccauggguagaggaagacucuuaguguuuuuaaaguuaaucuaugaggucuaaagauguaacuucagugguagaguucucgacuagcaugugagaggaccugggcccaagcuccaccacuggaucacuggcaggaggaacacugugccugaaccgaaaaguuguaagggaggcugcacucucuagauaugugugcgcauaugcaacauauuuuacauguauagauuucuacaaaauuaagucugaaugcucugauaagauaaauugcauuuauuuuaaacaguguuuuuuguuuuugaucccucuggggauggagcccacuuccaagugcuccuccacggaggcugagccccacccccagccuuugagcucauucucccuguuugguuuuaauuagaugauacuagaauuccaaccauuugcaguuucauguguuguuuugcuuuggggauuggguccaggguaucuggucggccacuuaguugucaguagcucuggacuauuggcugcagaugacuaccauucccacuaauuggaacaugucagacaacaugugaccuguguaaaaaauaaauacuauggucuaaaauggugaccuaaauauucuugugguuuaccauguaauuuaaagguuucauuguuucucuaccuguuuuuuuuuuuuaaaaagcuuaagaguuauauauuuuaaaagacucauaaugucuacacauuuauuugguuuugaaauguuagcaguaccuggauguggaucagguacacuuaaugguuuuaugcugcauuccugagacuuugaacuuuccauuuguccaguuucagaaaucacucuauugaaaggugccccugacagaaccuauauggguugaaaaugcuauagacauaaagacuaaagauaauaagaacaaaagaaaccugagacugacuucugacuugggggagggacuaguacgucagaaccuuagacugcgaaauagagcuguguaugccugcuuguuccugggagcagacugcuaauaacguggaguuaauaagccagguagaugcuuuacaacacuauaaaugauugauuauuguuuugugcacaaaauacaagaagacaauaguagaaaucucaaauuaggaaacagagugaucuugaauccuaggacaaccaccguuccucauggguggaguuuguacuguuuaguuacuguuuauuuaguuguauguuucuggcuuugaaauaauugugaacucaguuuuuaaauuauucuuuaaacuugucuuuuguuauuuuaauacuacacuguuuaauuucacugaagaguucaucgaaggauauuacuggaacacacuggagcagagccaguacgcccaagaggagagacaugaugguguguaauucugagauguguggccuuagauuuucaugcauauauuguugauuuucaguauucuggacauaguaacaacaggaauagccugguaagacacgacgagaguuucugcuuuguuuccuuguauaaacuuuaaaacaaguuucucuuuuacaucucucuuuagugauagaauguucagacagaagcaucuuaggggaggagaggguuuauguggcucguaucuccaggucacaguccaucagugagagaggucagggcaggaacucaagcagcagcuuggagcaaaaccguggaggagugcugcuugcugguuuguguacagacacaugcuuagcuggcuucuuuauaaacucaugcuagggauggugcugccugcccugggcggggcuucccucccacaucccucuccuuccaccucucccacccccuguguuccuacaaggccauugaucuaggcaguuuccaaucaagccuuuccugucagaugacuaugggcuaugucaaguuaacaaacuuuaggagaaauagauuauaauagcacacauagaaguguuuuauccaguccuuaauauucccaauuuuccuucuuuugauaauuuuuaagugacaucacuaccagcugccauuuaucagauaaggugugugugugugugugugugucugauuucucugcuauauauauucuguaaauuuuuuuuuguuguuguuuuuuguuuuuugagacaggguuucucuguauagcccuggcuguccuggagcucacuuuguagaccaggcuggccucgaacucagaaauccgccugccucgccucccaagugcugggauuaaaggcgugcgccaccacgccuggcuuauauucuguaauuuuuaaagcuagcugaaucccacguuauauuuugaaaaaagaaaaaauuggaauaaauacucuugcuccugcauguugaaauacccugucaucuacagagaccgugagaaggaaggcuuaccuuauugggguaggauaauuuauguguaagaacaugcacuuuaacuguauguuuuggucauggauuuuuuuuucccuaaagaaauauuuuaauaggaaaaauaaauaaauaaaacuuuuauagagaagggauuugauuuucagagaaaugucacauacaacauuuuuaguuaauuuauaucagugguaaaauuaagguuucugccauauauguucuaaaugacuaucuaaauaaaugcaaauagacagguuuuguuauauuugaacuaguauuuuaauaucauacuuaaguuagauuguauauuuuuaucuucuagacuauuuuaagcauuauaaaauugugaucuccaccagaaauauauuuuauuccuuuaccuagucuguuuauacagauuucuaguucucuguauguaucauugaaacaugucuuagaaaauuacauauaaaacuuauguaucuauguguauguauaauauauaugguuuguuuguuuuugagauaaaggcucacugaguggcuuaggcuggccuugaucuggguuuccuacagccucagccuacuuaguggguguugggauuacaggugcguaccuagucuuaugaaaugauauuaacucucacaggaugcauaacauccugugauuuuuuuuuucuccuguauuucacuuuuuuaaacugccaguuaaacucacuaaauggauuucaaaagggaauaaacuuaaauuaggaaaacauuacugugggucaagguuuugaauaauacuauguaaugcccuaacucuguaaauauggaaaagauauuuuuacaaaacaguguuuuuaaaugcuuugugauacauuuuuaucuuugaguaagcuuguuuaaaaacuugugagaaugcugaagaaccauuguaggagacuagauccacacagcuauguuccauccccuuauaaaggagccuacauggaaaugugcguuuucuggucuuguuaauuuucuaugauuuuugauucauaucuaauauuacuugcuugucuauugugcauaccacauuuuguucuggccaagcuucucauucuguugagcauuuucucgaagaaauaagauuuuaggguguaugucucuagguaggcucaaggaagugcugcugcucugauuccaggauuauucuuuugcaagcuagauagauuagguagugcuccuccaugcuuggcugucugucaaucgauggcaaacaggguggcagccacagagaugaggaggagagcaucucugaccucacaaugguucuccuuuacucuuaagccucccuugggcuguucuguucugucauagucuaagauugagucgucuuaccauuacuacuucagaauuuuguuauuuaaaagggaaauagagacugagguguaucucggucauaaaagugcuugcacagcaugcacagagcucaaguuaaggcccuagugacgccaggggugggguuggggguggggagcacaggccuuuggaugguuaggaugccaucugucucaaacuccagagaaguuagggcuauggguacacauaacugcuggcauaaaacaaaguuuuaauuauacagacaguucagcaacaaugucuacugaaaaaguaaagguuauauccaaauauaagagcuuuuuuauugaauaaucuuuugcuuuugaaguaggacugcuuugguuuuaauaaugacaagguugcuuuuucucuuauguucccgacuggugauacaacaaacuuuccuucuucucugaacugaaguaugauaccaucaaggacagaccaucaagaguuucgucauuaguauguagcgcauggcuuuguguuaagugugaggguucacuuucuaaacaucaguuguugcuaaucaucgauuaugacuaacuuucaugguuuuguuaugauuuuuuuguuuuuguuuuguuuuguuaugaucuuuugggggaagauguauauaaacaaaaacaacaacaacaaaaaacccauuguuuuugaaauuguggcauagucuguuauuggaauaauagcuucucccagagacuucaggaucagggcugagagaaucucccagugguaaagugcuuuuuuuuuucuuucaucauugcaaggcuguagguuugcuucccaauaguacaaaccaaaccaaaccaaacuaaaaccgccucaaaaugauuggaauauuuaauguaagagucaggaucccugacuguuacuaaggucuguuguaguuccgucuguuuuugagagaagagcuggcaccccugugcuuacuugcugcacaggaagccugguuugcuuauuuuuuaacuucauguuuauuuauuuugccuguguaugugugucacauggcauauauguggaggucagaggacaacuuguugaagcugguucucugaacucaguucaccuagcaucaggcuugaccgcaagcaucuuuacucucugagccaucucuccagccccuuugacagugcuuucaugcacccugagcuguaacaauacagaccuguacuugauuuugugucauaagcuggcaaguuacuaaauacaacauccaguggugaugaguggcagcugaagaugaccaaacguuuuggcuugacauguugaauuagcuaaggaagucauuaacuggcuuguuuucuuugagccacuauuauguuggcagacuguccaaguuuauggacuaccuaguuugcacuuagaaugcucauagugaaguauaaagaacauucacaauaagaaaaugcguuucucaccuggaaggucuaucuuuacccuguaucucaugugaccucagccuggaucagcaguaugacauuuaucucaaugucacaaaagcaaacauuucuacccagaucggcacaaaggacucugaugucuucaccgaccugucaguauaguccugacccagacgggccauuugaccagaggcugagaguccugacuguucagucauguggacaggucgaauuacuuggugucugccuugacagaaucaacuucaaaccucaaaccaacuaggaaguugacaguggcugcagugaugauccagcagcguuagccacagaggccuuuuagaaacugcugccuuuuguaacagguuuauggguuucuuuacuuguaagauaaguaagcauauagcaucauuuuuaaguuguguauguuggaggugguaguuauguguuaucaaucuuugcaucucuggauguacuguuuacaugaauaccagcuacuccuuuuucuaaggaaaauuacauuguggugugacggguuaaaaguuuaagcaauuuaaaauauauaauucuaugaugugauacaaaguugaucuuauuagcaaaauucauacuuugguuugaucacauguagaaaucuuauaaaugauaguaauauaugauaugaauuuauauugagugagaucaaugaugauuuuucaaagaccauacacugaucuuggaaaaugugaacacuguaacugguggaaauaaaguauauagagugcuccuuccaaaaaagaaaagaaaaugcguuucuccuaucauugaggcucugacucuaugugaaguaguuuuccuaggacauccaguuacacuuugcuauuuuuaaggacuuacaguggcacagucuuacuacauagguugugauuauugucugcuggcugucuguuaguaacaggacuguccuuugucccccugggaaaagugaauauauauauguacacacacaucaucuuuucaaaguacuuuguguaagcuucagaaccuacauuuucggcauuucucuucuaaggagcguaugccaugaauguacuaacuugggcuaagacacugucugagggcuggagagccggcucaaggguuaagagugcuuacuguucuucagaggaccugagcucgguucucagcauccauguuggcucacaaccaucuguaacccaguuccugggauccaugcccucuuuggcgugugcacacauauggcauauacacacaaauaaaugcacauaaacuaaauccaaaagaagaaugcugucuugagcagugccuaugugaacuuuuaguuuaucuacugcauagcuuuugcuuuugauaagauggcuaaaggagguggacuuucaccacuuacagcuuucucagggcaaggaaguggggagagacucaagaaaggugcagugaagguccccacagacauccucugacucuguccuaauaggauuccuuuagcugcccagacaccagguuagacaguggugggcacaaggagaggucagagagagugaugugccugaggccgcacuccccagccuucccuucagugaguccacuacuaacaaacaagaaguagauugcaugugcacgacucuaucacaugugcuuuugcuguuauuuuaugaugaguuucauucuuaaaauuucacuaugugaucucuaaaauuaacuuucaauauuuauuuccagaaucauucuuacagucacacccaugggacgaagaagcgauccucuaguucuuauaaagauccacugguuaguucuauuucagaaguuugagcuaguugugguauuguggauagcaccaaauuacaaguagguuuccuucucagaguuuguuuuuaggaaccuggaauauacuuacugguagaaacagugaaguguguaguagacccuuucaccuaugugauuacacugcggaaggaaugggcuuuccauuucagucacuuaccaaacauuucuguagagaacaaacgcuacagaauuggggugcucggaacaccucuuucuccuuagugugcuguuggcagaaaugcagucuagcucccugccaguucugggaucccaugggagccuugggaggauguagcaggaagggaagagggagaaagaauguagcugaaaacagauuauagagaccuuggaguacaggggcaccggcaccuuuguggccagcugagcugaggugccugguuuaggagugucaaugauggcagaagacagggccaagagagugcgggugggguagaggcagugucagcaguagagaagggagguucuaggcagugagaagggagguucuaggcaguagagaagggagguucuaggcaguagagaagggagguucuaggaagugagaagggagguucuaggcagugagaagggagguucuaggcaguagagaagggagguucuaggcaguagagaagggagguucuaggcaguagagaagggagguucuaggaagugagaagggagguucuaggcaguagagaagggagguucuaggcaguagagaagggagguucuaggcaguagagaagggagguucuaggcagugagaagggagguucuaggcaguagagaagggagguucuaggcaguagagaagggagguucuaggcaguagagaagggagguucuaggcaguagagaagggagguucuaggaagugagaagggagguucuaggcaguagagaagggagguucuaggcagggaugccauacaugagcuuaacuucuaccuagaaggagauuugggaagggauuucucuaacccaauaauuuauaaaagugguaauuagacaguagccuuagguuuuucagaaucauucuuaaauauagagugagaguaacuccauuauuugcauuucauuuuuauuugaggguuuauugucuggucuuuaaaguaauaauaauuagcagagucuuuguuugaaguagcugcccuuuaaugcccaucuuuucuaagaaauuguaaaccauugcugcuuguucuuucuuugcugugagccguugcucuaaaggccuugcucuggagaagaaggaaccugcacaguaucagaucuugccuguguguucaaaguuugucuugguugugguuguaucaaaaacauguaaccuaagaaaacuguucaauuuugcuuuuugcagaguggccucuacuuugaccagagaaacuauagcagucuuagacauagcaaaccugccucuaccuacuauuuacggguuugucuaaagauuuuuguucucguguaucuuaauacaucucuaaccccccauuuugcauuuuuacuauuuguaacuaaucuauggaugguuuggauauaccaguuuugguaauugauucauauaauccuucuugaguaugucuucggagagaacuguuaaauugccaugcuuguaaugaaauuuucaaacacaaaaagauuuuguguagugaacaucacauucuuacuacuuaggucauauauuuauuuccuuagucacagcaauauuugccuguuaucuuaucuaucauucuguuuuuuguuuguuuugguuuuuuuaggcagaguaucacuauauauguagcucaggcucaaacucaagaguccucugccucagccucccaguaguuggcguuacggugggaucacuauggccagcuucuagcuaggcuuugauccauugcagaguaagccuuagacaucaguacacucacuacuagcuacacuuuuuaaaaauuuacaucugaaaauauaagcuacauauaggaugagacggauguuauuguuuguuagaauauuaauauaauauuagaaucuugguuuucuuuuuugucuguuuuauguuuuugcuuuuuuuuuuuuuuuaauuugauuuugagacauggugugucucuguaguuaaggcuggacauccuaccucagcuacccacaucaccacagucaguuagaaacuuuucuuuuuugacauuuaacuuuuuuuuuuuuuaauguuuuuucaagacagaguuucuugauguagcacuggcuguccuggaacucacucuguagagcaaggugaccuugaaucagagaucugccucucaagugcugggauuaaaggcugugcuaaaaccgccuggcauuuugugguaucuagcacauuaaaacuauugaggaaugggagcaaaucuaugugauagaauaacuuauucgcacaugcaaggcucuggauucaauuuugagcaccgaaaaugcuaucaacuuaaaaccuuacucuauacacaguuuuuucccccacuauucuuguuugucuagguuuaggggaaaagaaaugaaaauugugucuuaagggacaacagggaaagagauguaauuucuuuauaaaaagugcuuuuagugagugaacucagcuggugagugcagcuucucugguuaacuaguauucuguguccauguauguuuggaaagacaggcuuucagaucuguuugaaaaauguagugauagcaguaacugagggcucguuuacuugaguucuuuauaacauggccaugcccacugagagucucucaauaaagcauugacagugccucaggagcuacuggugacaguucugaggccaccauuugauacacucccagugccggggcccccuuuucuucaguauacuccuggguccuugucucccacccugccaauaauuuuauaauaccaaaagguuguagacauauugauuaacaacacuuagaagugauuuucuuucuuaccuuuaacaguuagcauucaaaaacuuuuuagugacuuuuuucuuauuuccuuuguuuuuacacuacuuuaguugcuugggccugacuaaugaguuauggaaucaaaaaucauaagcuuaaagucuucugcuugcaugauggggagugacuucuccugcugauuuuguuuuguuuuguucuguuuuguuuuguuuuugcuuauuccuguuguucugccucuuacagucuucuucccugugcagugagccgauggggacacccaagagucagagcagggucaguacucuccgaggacgcagugcugucacagauccacucgccuucuuuagguuuaauuagugcacuguuuucauaggccuccccuacuguaacuucuggucugcugaggaguaccagucugguuuguauuuccuccuuccagugugugcucugcaauagggccacuguuaggugcugaguuguguggccuuccugccauaugcccugcaguguacgcugcuuugugcuuuuuuuguguuuuggauauaaaacuuagggcaugaaaaauaauccuguuuuucgccaauguagaaguggaugacuuuugguagcuuauaguuaaaaucuguuuccuguaaggagauggacucaccuggguccugcuacacucucauacuuuucuuugguuaaggcuaugacccucagcuauggcagucaauaaucuauuaagcaagcugaauuaaaaguauaaccaauagcuuugugugacaugccaguugcuggugcuucuagccguuuguuuuguggccacuuccagacuggaaccccaggagugcuuauaccaguuugcuuccucauguuauaacgugaggguaaaagaaaauacugcaguguuuuuucuaaccaaguauauugaugaaguuauaaugaaacugguacagugaauuguguauguaagagaauauaacacuaucccuuacauauuuuugaauuaugaaguuccaaaauaauaaagauauuuucaaaccaacuccagugcuaagcagauaaguaauauuccuuuguccuuuaggcaucucuguaugauggcggauuauauaacccuuaugguucucgaacuguaagucuaaauggggaaggagggaggggaaggguacaggaugacccauucauucagccaguugugauaagggggcgacucgaaguuaugagguagcauaugaggggagccuauagagaaacucuuuggggcguuuccuccccauuuaaggaugggugugaggugggggugucagaccaaagaaaagcagcuauuuucaccgugggcaucaagaguugaguagggucacuguacucccagcagagaaacugagcuagccguuguuguaaauccuuucuucuuggaaacuuuauagccguccgaauacaguuacuacucauccagggcaaguuccuccagaagcaguccuguggugagcuaaugucugcaugcuuuagggauguuguaguugcucugcacucacacuuugggauggagugauguguuucaccaucuugugcauggauuaugugcuccuaaggccauacaaaucaaguacuaacaugugcuaccugacuguuccugcgugaacccaaguacuugcuugacugagucuggcacugaggccauugaaucgccuuaaaauuuuuguauugccauucaugaaaguuacuuugucuuucaaguacugauacuccuggugggugugcugcucuuucuggaacguuaaaguuuauuuuguaguuuaugggugaguaauguuaguaaauccagaguaacaugggacuuguccguucacaugcacacuuucagagguguuuuggacauguauguaugcuuuucauuuugaccacaaauggcuuccucuccaguauguguuauuccucuguuucuuaaaguauccugugucagugcauucagauuuauagcauccuuuuuuugacauuauuauucuuaacaauaaguuaugccccuuuucaauuaucacuuugagauaguuauauauuaucaaaucuuuuuaaugucagugugcuaucccacaaagguauagauauuauuuuaaaaaucauuuuaguauugauggucauuuagguggucagacauuaucuguguguacacaugaacugugcauucauauacagaggucagaggucagugucaggugucuuugucagauacuccccucuaccuuccuuguuuaaagagucucacugaaccuggagaucacuguuuuggcuagacuggcuggguagugagcccaagagccauuguccccagugcacacacuucuacccuggcuuugacauggaugcuaggaguccagauuaaggccaccaugcuugcagagcagacacuuugcccuuugaugaacacacauucucucuuugccucugucucuuucucuuccuuguacaugcacacaugugcacaaacagaguguuuguauacuuauacauguaucaggaaauaauaggaauuuaagagcauaugcauugcuuaaaaauauuuacuuuugauuuauguguauaaauguuuugccuacauaucucugugugcaccaugugcaugccugugcacuuggaagcuagaagaggauauuauauccucuggagcuguacucaaaggagacugagcuaccauguggcugugggaaucaaacccuggcccuugcaagaacagcaagugauccuaacugcugagccaacuuuccagcccuguacucccugagguguggucuuucuguguggcucuggauggucuuguagacuacacagccucaaacucagagguccacuggccucugccuccccagugcugggguuaaaagugugggccaccaugcucagagcauauguguuuuaauauugcuaucuaugcccauauauugacaaccaaaaagacuauacuaauuuacauuccuaaagcaaaugauuucuuuagguauauuguauuguuauccuuacagauuaucccaaauuggagaaauuauuaauuauuaauaaucauuaagauuacuuuauagcagguaaaauaugaguuuucugggcuuucuuuuauguuuauguuuguaguuauggccaugaguugcagcucucagagauaccauuccuguacauaauaaaaacuaacguguguguguguguguguguguguaugugugugcgugugugcuugcuuagggauaaaggcucuuucacaaaagauggacauuaccuuuuaacccacuguauacucaaauucuacuuggcaguuuucagaccuggugacauuuuuaauaugccaaacacaguagccuuccugcaaaagauuuuaauggcacacuuucaaaaacaaauuaguguagauccuuguucuugugagcuggcuagauucuauuucauuugcaauuuggguuuagaauuucuaccguagugaugccagaauggcaucuuaaugacaucagaauggagauaggcuacuuacuuguaccaaagaugaguucugccaaugcagugggaagaacacggcccuguaaaggggguaacaguaccagcacugcuagcugcauaggaaugagagccaggaaaugagucaccgccucagagcucugcugguaggaaccucugugacauauguuacuucauauuaaaacaucauuuuuuuccuuuccuaaauugaaaucuuaaguguauuuauugacuucucaaggaucacacagaucuucaagucuucccuagcuaguucugucugguuuacucacacucucaccaucguuaaacuuaaauaagagcuggcguuuaacacaauucgcagugcuuuggggaagcaucuugguucuuaaagauaguucauuaugcccuguagcagcuuaucuccuuaaugcugcaccacggcuccugccaauugcagugcuaauggacaguggccuccugaacuguucccauguguuuacagucugugagacccagagagaaacugaaucuguuuuacuuuuuguagcccaucgaugaugauaccgcaagcauugugucuucugaucgugccagucgugggcgaagggagaguguggugagcauggucugugugcaaacaaacauagcuuuuacaugacaacaguguaugauucugugaaauuugcugcaaaguaaaauaugcauuugacaaggagagcauuuuccuuucagcuucugugaacagcuugcuuuguaaaguggucuugagaaugagucauagauucacguguuuuauguacaaauccuuuauugaaaaacuuucauucuauuuuucguuuccuuaugcauaccuauuuaucuguuuauuuuccaaaacgagucucucaaaugagagucauacucguaccauuauaugguacuuauaacagaauccaggguguggccaccugcugcugccuguauguugagccagugccuguccauaucuuaagacugugaccuuuguuaucuguugauggcaagauuuuaaaacaucaguucagagguuuaccuaaccaaucacuguagaugcuguaauagcuucaugugucucaaaacagacagacagacagacagacaggcaggcagacagacagaauaacuggugaguggugacaggcacuugauagguguuaauggagugagugccuguuauacccggggcacuguguuaagugcuuggaguaacaugccaaaucaaggagaacagaucucugagcuugucuccuauuaaagacauagagauaaacuagcgaaggaggagcacagauggaagacagcucacagugugagcagaaggcaggugcaugugauggagcaccuuagggcggauaugugagagugaccguggaagagucuucagagacagugacagcucaugcaagaggcucagcuguuagaagagcaagagaagggacuuuccaggccagucuucauuauuuuguccaacaauuccugauguaaugacaugugaaaaaggaauuguggaaauugagcauugccaggguugauagcuauaaugaguuauaauauuguaaacuaugguagaggucugauaauagccuggaacacugcccuccccgguugaagguucccagggccuucagcgugcaagguuugcuugucaugaacucaggcagagaauggucucuguaccacagaauugcccuugacgcugcagaaggcuuguuuuaggaguugugacuucacuuagguaucucuucuuuuuugcuuuuugaaauaaguuaauuguaaaaguuuucucauuucacgauacuucaucaaacaucauauuaaaacaagcgcacacuuuccugguuuuagcuaguguucuucucccuuucugacuuuaaaguguuucauuuucucuaacugaaagguuucugcugcugauuacuuuagucgcuccaaucguaggggaagcguugucucugagguggaugaugccggcaucucagacuugacuagcgugaguguacugcauggguuguguuguugcaggcaugugacuaacagcuucuauaguaguuguguuguguuguuuuguuuuuucgagacgggguuucucuguaucgcccugguuguccuggaacucacucuguagaccaggcuggccucgaacucagaaauccuccugccucugccucccgagugcugggauuaaaggcaugugccaccacgcccagcucuauaguaguuauuuuuaaaguuaggaauugaauuaacuccuuagacauuuacuugugcauauaacaugaaauauaaguauuuuggaauguuuguuaaaaugugcuuaaaaauacuuuccucuuacccuguggcauccccccacagcuccuaagcauuuuuggugagucccaguauccaugcuuauuguguuugggauauuuuucacuauucuuuuuucugaauuauuccagagccaauccauuuacaccaugucauuuccuacacuugaucuuagccaaaaggccgagaagcgauccaugucauuuccuaauuaucuguguggcaugcaucccuaacagaccauucaucccuaaggaaaugcgugcuuuccuaacaccccucaugcccagcccauguuaagacgcuucuggcucacuuuugcccccuucuugguuuugauaaagcaauaaagugauaguuagacuuuaaaagcugaauaauaaaauguuucuuaguaaaaugccacugauuuucuguuuuaaaauggacucugguguugcucuauggcacccuuccuagugguucccagcugugggacugcauagaggcagagagaguauccauggcaacacuggguacauagcgguuagguacauugugaccugucuucugagcucaucucuccagggccccagccccagccccagcccccacucccggccggcaccacaccgacaagcccuguucugauugcccagcccuguggagggggugagagguggcaguuguucuggaaaugcaaagauuggguuuuguuagcacuucacauaugguaugaaguagcuauuccugaacuauuuuaauccuaaaaauaauuucaauuauuuuaauugcaguccuaauuauuccacauuccuaguucuuaaaucuggcuguacagcagucucaucuugcuguggauugaaccaaggauuuugcccacauaugaaguuucucaguuauucucugagauguuguccauuuuauuaaccugcuugguagccucuuuuucauuuuaagauuuuaauuuauuuuguguauguguguuggugugacauuggcauggagcacgugugugggucagaggacagcucacaggaguuguucuccuuucauguaguccuguggagugaacucaggucaugaugcucaguggugagugccuaccuggugagcgagcugugccagugguccacuggcuccugcuuuuccccuauaaauaugauuguauuuacucuauguaccugcucucuccauagcuucauuucugccaaucucacuauuuaugauaccugaauuagugguucuauccccauauauucaguucuuggcaauuugcuuuagugauuauguagaaaugaagagcuuuacaauuugucucuuccugacuauuuuaauuaaauaacucuuuaauauaagcaaaagauugucuaguacagggcuuucuaaguauucuuguuauuuuacagacugagggccauugcauucugcauuuucagugccuauaaaacacaguuacuucugccuuuugaugguguccucuaaacaagcagcucucucuaagagcaucugcuuccguucaccucacugaagcagaugaaaggggauucauaucgguccauucuucacuggccccaggucugccuuugaaagaugcuuuccagcugcugugugugggcacacuguacggaaaaggugccagccaguucugcaagacuacaggguucauauguuguaaccucuugucuuguucugugggucaggcuagaauaaaggaaaauaaaaagaguaaaaugugcugacuuauucauugcaucugcuuuugaaggcaacccuuugccaggauuauuucaggaaauuauuaaagucauuguuuacuucccuucuaugguuauggaaucagauccacuuuguguuuuuuuuauguuuuacauuuaaacaacuuuuagauaaccuuauuuuuagguugaguauucuuaguagaaaaacuuaaaaaaauccauuuuguucuaaaauauaaagguuguuaaauauuaacauguucuauaagcuggguugcaaucaguucaguuacacuaaaauaauauauaaaauuaacuuuuaacaguuauauauaaaguaugaaauacagguguauucuauguuuagauuuggguaccaucucuccaagagauaaaauuauuuccacaauugaaaaauaaauccuaaauuugaaacacuuuuuuucccaaaguauuucaaaugaaggacauuuauuagaaguuaauggguaauugugacucagugaauacauuuaacaaaccacacuguaagcauuuuauuuauuuuuauaccuugagcaugauuaaauuuuauugcauuuaaaacccaugucagaguuuggcagguccuuucagccuucacuguaaacacugcuugucauugcagcccccuuucauagacagcgugagccucggaagggagccugacagagucucuggcugagccacugcagccaagcauggcugcugugcuggcuuaacgauuccucagguuuggcugaugaucaguuuggguugcgacacugaguuugucagaauacagugagcacuauagucaguguuguggugcuccagugaugcagccucugcgugcacgauauuccacagugaugcagccucugagauguaggcuauuccacagugaugcucugguaaaaguagguaaguuugggggucauguuuauaagaaagguaauaugaagaaggauuucagauggacuagacuuuuaauuuugaauauuucuuuucucguuaaccuauuagcagaaaugaguuagaaaaauaaggcaguuuauaaagauacccuucuugacuuugagugauauuagccauuguucauugcuuuucaccagagcagauugagagggaauuucuucauguagagcagacacugguaauauugagaguccagcugucaucacuugcuuauuguaugacacuugauguuauuuuuaaauaaaucuaaauaaauuaaaaugauuuccuuuugaaaauaguacagcaagaaagggcccaaaaaaauacaacaucaagccccagcauuugcaucacugacagaguacuaucugaguaaaaggucuuugucaaacaugacaacuggguaauaaaaaacaaguuaaaaccuuucaaaugcgaggacaucggagucaagucauugaguaaaggcgaacagaaugcuguuuuagucaucagcuggagaaaguuuccaagucccuaccuagcugggcugagaagguugaccucauaguucagggcuagggauauuuuaguuuuguuuaaaguugauguuaccuuuucacugugguuaauaguauaugcaaacaaauguguaugcuguaguucaugaaacacauucagauccucugaguuuuuuucccuuagcuaaguuagaauuuuggaguaggucuauaaggaacuucccuuuugcagcaggucugggaggccagagacagguuagucugacaggcaugucacauguugaggugaccugccacugugaagcuauuaaaacaagaaagucuugugaggacagguggguguaguguuucugaguccuuacacacuagcugcugguaguagacacaaggcuugcaugacagcgaucagacaagcagaugaguguaauagugugggaaucagacauucuauuaaggaaagagaaguggggggaaaggagcuagagaauguggcugugacauugauguuaagauuuugagagacuuggguugauuguccuuuguagagcagggcuugguguggagaaaggccaauuuuucuacccuuguauucuuugaguuugcuguauaaaaagaaaaaguuuuaauaacccuuuugucauuaaauaguuuuaugcauuauucuguaucuuaauaauguuuacauuuuguguugacguuugcaguguucacaaugagguuuguauguaguuuucucuaauguauuuuaaauaccaugaaaaaaaucugucuaaacaaucuaaaauuuugaaucuaugcugcuugauuuuugcugaucuucuuuaggauguggacuaaaaguucuugaugcuuugucauagcuuuuauucuaguuuuaauguguuuacuuuggauccacacaucacugaacuuagaaugcgccauugaguuuguuccucuccccgcaaaacaagucaacaaugcugagcgucuucuugauuuuuaucucucucuuuuuuuuucuaguuggaugaaaaaucugacaaacaguaugcugaaaacuacacaagagugaguauaaaauucuugauggauggagcucucaaggucagccccgugcuuccugcgacuccuucacucuguucagcacaauuggcugacagagugguucuucccuucgucuauuuccuguccuugaccccucgaaauuccugcagccuuagaucaugugaaaguccuacauggagagaagagugcguuuauuucacuggacgucauccuaaagcucuuggcuauugcuuugguuugcagucucugaaaacugacauugcgaagccauuaaacacaaaaaccaaguguccaggaauggaccaacuaacucauacuuuugauuuuucuucuuauagcuaaaucgcuucuauaaggaaacuaggauagcuuccuuguggaggagugccucugcaguaaagguucuuuuuccuaaacauuuuuuguugguuguucuuuuguuuuguuuuuuugagacaggauuucucuguuaggaacuugcucuguugaccaggcuggccucaaauucaccgagaucagcccgccucugccucucaagugcugggauuagucauaugucaccaccauccagcuuuaaaacauauuuuuaggaaguuuuaggaaaauguuguguuaaauuuuauaaugcaaagcagaauuauaagucuaugugauuuuaauuuuuuucagccacacucuagagaaacaauccauuuaaauaauauucaacucaacagucaaccaauauauuucaauauagcaucaacauaaauccuuuguuuugugauauuugaguuagggucuuuguauguagccugggcugaccuugcccccaaccucagccuauugcuggccuuagaguguugcagcagccaaugacacuccaccaacaugacuggugcauuuuguccacaguuuuuucugcagaaagccuucaaagucuggugcacauuuucuacuuacaucucacuggaaucagccacauuucaagugcuuucacagggcucuccacaagucuucugguuuucugcuguuuauuagucaacaguguggcuuugggaagagcagucuaaaugcauagcaguguaugauguucuugcucuuagccaaaaauaguucaucuuucuuagcaaaggugagaugcuucagcagguuaggaaccaagacaggaaguacuaauaagacauuaguucugaaacggcuguuagccugacagcucucccguguuugagaccagcauggguugcacuuggucccuauugacugcauuauuagaauguucauccaaggcucuuuaucgcgccacugcucugccccuugcuucauguucacagcaaacauuugaagacacagcucacaagugccauuucuuuuuccuuuuucagccuucaucucgaaauucugccucggcuacaacgccucuaagugggaacucauccagacgggguaguggggacaccagcagcuuaauagacccagacaccucacugagugaacugcggguaagcagucugucugccuuugcaaagcagcuuugguuuuugguaguccauggagcuuuuaacauuucaugugacuuacgaggaacaaaguaggguuucuguccaguucaugggcaucagagcucagaaaccuggauguuucagagcugagaggaguggauuagauuauucuuucuucaguucucucuucugaagguuuggugccauugcaauggguucugcuagugccaaacaguuaugugaucuauaugaaaguuuucuuuuaagaaugaccuugccauguuuugaguggaaaauauuuggauuuacaaagagcagcagauuauggagaaggaauuuuuagccuuuugagccauugucauauuagauacuugaauacagguucucaguauuucauaguaauaaaaguauaauauuuggauaacagaaauacuugagcuaguaggaaguuuacuuaauccaucaguugagucuccauauuuauuaacccuuuuauuucaaagaugagaauguacuaaacgauuauuuuugaaugucuuauuugcugaaucuguuaucugaagaguggaucaagacuugugagaacaguuacauucauuugcucacucgcucacucucacucagucacucgcucccucgcucgcucacucagccacaguuuuugaacacuuggcagugggccuguagacggccaguuguaaccuggucuucaggagaucacugucuuuugaaaggacagacugaugugcgucaguugaagcagcuaauaguaagcaguggcaugaagagcaggguaauuaguuuagaaaggcaucguaaagaccaggaaaagagagcaaaggcuuuucagagaagcaagcgccaagcuaagacugaaggaagaauaaaagugaauaaagcauagaagguggaagagucucucuugaaugaguucagagaacuuuaaggucauugguacaggauacuugccagaggauaaggaagaaggauuugcuggugaaagaaagcaggaggagaguggggggagaggggugaggcaguauguagguggggguacaaaucacaacuccuguauugcauaggagagcaguaugauuugaauuacauucuuuuuaagauauuuauuuauuuauuuaauaauuaugagugugacacaccagaagagggcauagaugauugugagccaccaugugguugcuggggauugaacucaggaccucuggaggagcaguuggugcucucaaccacuuagccaucucuccagucccugguuugcauucuuaaaaauaacucuuaacucuagccacaguccugagggagaguaucacccagggcuugaccggggaggaugaaguggacagaugaugacuuucagggggagaaaauguaagauuggcccugaaguuacuuuguaauacuaagauuagggagggugggcaguaagucaagagaugggaauaucagauagcugccuuuuuuccuuccguuuucuuuuuuguaaaggugagguugcuuguauuucucugaguuggcaugagcagguggagccagcuaccuggaggcugugccuguggccaugccuuccgacugcccaguagcagaagagguugguuguguacuggggcaggugccugguuugugaaauugcaagacagcagagaacgaggaguucuagaacaguagcagggaggagaguugaccaggccaguggaguccuuugagcuguuacuacuggccaggcguauauguugaagacacagaguuugcaaaaggaaaaggcuugucuuuaggggcuuuauucucauaggacagaaggacacugagacaagcuauuccagccuuggacuuaggcagcuccuguauaguuuuuggcauuuguguaguuuuuuuuucccuugaaauaauagccucugagaaagaggugguuuuagguccuaguaccugacuucugaugggcuggcccccuagcaaagcgguuguugaaugaaucaaugaguacaagacuagcacaccuauccgaagggaaugagauaggcagggaaagcacagagcaagauguucuccaaccauccauucugugccacugcugcacucaagccccccuugacguuacaugaugugguuggacacaaaacauuauauuuuccuuuuaaaaauuggcccauuuaagaacuuuucuggaaaccuuuggagcagauguucuugucaccacuuagauguguccucaggacagaaucucucauugaaaaguguccucagugcacauaaccugccucucuuucucccaguuaaugugcuuaguaccuguguuauuuaaaagugaccgaguauguugaguaugaacuggauuauacuggauuaugguuuuugaaacuuaugcauaaagaguaaaauuugcuuccaauaaauuuacuauguaauuuauuaguugcaaaugaagcauuguacuaaaauauuuaugauuuauaaaauuuaaaaauguuagaauuaauauacaucuuaaaauauauauuuauauucuggcuucuguuuucuaaugccaucuuaaaaaaauucagugccaagaaaguacugauacuagacaauuucuccaguucugcugucaucagaagaauuugccucuugcggugguuugaaaguguugaauguuuguauuuuuauauuuaauuucucuaguuuuagaugaacuaaguugugucuucaugugauucuucugaguuuugagcuauauuugugcgaugguuccuuccuguguccugcaggacaucuaugaccugaaggaccagauucaugauguagaagggcgguacaugcagggccuuaaggaacugaagguacagggcuccugcugcagcccaugcaugcucuguugcagaaguguuggugaugguggucccacugcucauagcuuuacuaacaguguuuguccuucaagcaugugcuuaaccugccaagcacagucgagggaagcuugcaguccgcugauguuccaauguuacuguggguugggggaagguauucugagcagaggauaauguagcuuguacuuuuuuguuguuuugagacagggacucuauguagcccagucuggucuuaagcuuauggucauccuguuuuggccuggagccaacacacucagcuccuuacaauuuuuacuacuugucaaauauuuaguugucucuugggucuuagucauacaacaugagacaaacacuuacaaauauucuaaagauauuucuauuaaggacuggaccuugaaauucuucccagcacaaugaaaacauugccugauucugucaccaaguccauucugguuaaaguggaaggaggaagcauuguucugccccuuugagaagaaggggccugaagcaugcauacugauucuuuucuugccuguauguaaguuaagaaggaugacaugugcucaguaucuuaauggauuuggaucuggcaagaugucucaguggguaaaguagcuugccgccaggccugauguccugaguuugaucccugaaacacaugguagaagugaccugacaccugcaggcugcccucugcccuccaccuguguucugaaauuauuguacuggcaucuugugaauugagaauuuauugauaaaucugacuuguuaauuauaagcuucuagaguuuuguuuguaccggguggcugggugguguggcggcugaccgcaggguggacagugguuguauggagccggcguggcugcaaaaggaacuuggaagcucuggcccccgccagagaguugguggguagaguagcuggauggagcaugggaacuuggcaguucguauuuaauacuucuggaaacaacuagggggggugaggugggaguguaggggagggauaugcugaguuaccuuuuucuguguggcaugugcuaaguuaaaaauguuaagcgaucuaaucuuaaaaaaaauaauaauuuggaggccaaguuguauaacuuuuaucuauucccaacaaggaugucuauacuugccucuguaaaugugucagggagacauuugguuggaaauagcaucugauuaugcccacgcccuccauguuucaguauuaaguucaaacuggauaugaugaagaaacuaaagugguuuuuguuuguuuguuuguuuuuuaagucagacaccagcaaguaucuguaagagugaaugcaaggcauuccaaaagguaacuuagcacaugccacacagaaaaagguaacucagcauaucccuccccuacacucccaccucacccccccuaguuguuuccagaaguauuaaauacgaacugccaaguucccaugcuccauccagcuacucuacccaccaacucucuggcgggggccagagcuuccaaguuccuuuugcagccacgccggcuccauacaaccacuguccacccugcggucagccgccacaccacccagccacccgguacaagcaaaacucuagaagcuuauaauuaacaagucagauuuaucaauaaauucucaauucacaagaugccaguacaauaauuucagaaccaauugauaaugauaaaaccugcccaccuagauuagacaaauuaucccaauuagucuauccuuuacgauaucauaucuaccuguggcuauuuaaagccacacuguagauuucagaaauuuccucuugcaaguugagaggcacaggaccuucuuccuguccaccuccaucuuggcuucuucuuucuccugacaugcucucugucucugcaacucuuagcuccgccucccuuuccccuguccagucacaggccuccugcugcacuauuuaauauuauuaauauuuuauauuauuuuaauguaauuggacagggaaaauccugccacaaguaguuguuagguuugugaggcugcaugucuuaguuguucaucaguauaugcaggaaccccaaggaguuggcuguaaugccagugaaggacugaaccugccaggaagacugagggcaagcaggcaagcacaaagcgucuacuuucagugaccuuuauggaggcugccacuagaaggugugggccagacuuaagaugggucuuccaaccuuaaaugauccaaucaagaaaaacaaaccccuuacagguguacccagaugcuuggguuuuaguuaauuccagauguagucauguugauaaucaaaacagcccucauguguguguuuguguguuuguguguauacacauacauccucaugcuuauaaccccagcacuugggauguggagguaggaggaucaguaauuuaaggccagcauugucucaaauacaaacaaacugaggucaagggggagggagagaaaggagagaagagagagagaagagaggggaaaggaacacuuuuggaccagguucaguggcacacacuggaaaccccagguacugaaacaggaagaugacuugggccugugagcccaaaaccaaucugagcaacacagaacaccugucucaaauaacaaacaaacaaacaaacaacuuuggguaagcaagacagaaaaaacacugaugcuuauaaaaguuuagauuucagaaauuuccucuuggaaguugaaaggcacagcuggguacuucccuuaggcaaccagaagcuuugcaccauagcuguuucuagcuuccguaagcaaccagcgugccuaacaaaaucuucauuuagccagaccaaacccagcucugagaaaugaagacauaguugaggcuucacguccccgaaggcccagcccaaacuaggcagcuuucauucuuccagucucugaaaguucauauugcuuuuacuaggacuugagauuuugguggcaugcaguuaagaugacuccguuccuuagcaugugcugggaacuaccucagccuuuacauagguuuguuguguuuacuugaguaggaguugagauguugaggacaagagcaaagugucugucauugcauaaauugucugacauaaaugcuugcuucagucuuguguuuuaauuuuguuuaugauuuccuagucggaguaagucaucucuucaauuccagaaagaacuguugagcagacuaggagaaggaaucuuaucagcuacaaacugaucaguauguuaaguguccauuuuauacugugaacuaagacuaaaauaaugaagauacugaauucaaguacuaguagaggauuuggcaucaguuaugaaugcuuauuugaggaauaucuaggcauagucaaagcuuaaacauuuacacuguagcugcaaaaugugcuguauaccaaaaucaccuggaguugcuuaaaauauaaauugcuagucucuaccuccaguuugggaaucaguggaucugggagaggguugaaaauuuguguuuucauaaaacugacucgaaaugacuaucacuaugcuaguaagauuagaauauuuuuccaccuuggcacuuuaaagucuuucuuuaaauuauauuuuauuuauguuuauauacgugggugguuucccacagaggccaaaagacaucagcuuucuuagagcuggagauacagauaguugugagccgucuguaguaggugccacaaaucaaacuuggauccuuuggaagaagugcaagugcucuuaaccacugagccaucccuucagccccacuuuaaagucuguuguaugcuuuuuacaggaaguuauguugcacagaauuuaaauggacuugcauuguguauuuuguccaugugucuuaguucugagcuuccuuggauucuguuaaacauggaaucacacccuaaaaugaugagaauuuuuuuucucuuagccucuuggaugaaauuugguauuauaugaauagauaucauugaauugggaucuuccuauaguugaaauuuuaaaauaggcuuuuaguuaaauguuuucaaugcuauuuugaaucauaccuguauuuaguucugguuugugaagcaaugcuaguuagagcauuggguaucugaggaacugccaacuguuugcagaguaggcacuuaacuuacgucagcaguguaaggggcccagguuuaccacacccucccuaacccuucuuugaggagagaagggcuggcuagggauugaggugugugggggggucucuucuacugagcauuugcccucaguccuaugccuugguuauggguucuugcuaucuuaguaggugggacgcugggccacauuuugugguuuggugugcaaucccuagugaggagcgcugcugagcuuguacacuuuggagauccaucuuaaacccucuuugggcacugccuacucaugcagucaucauuuugaguuuugagccuguuguugacucuguaggucugggcugaagccaguuaucagaacugugaauugccauuugcugaguaaaguuuuuuuaauaaaggucuccuuuuucucuuuggcugauaguguuuuugauguaaguuuuaagaagucauuacccacccacagccauaaaggcuuacuucuguauuuccuuaguuuugauguuguuugcuuugcauuuaggggguuggcucaucuugagcuaaccuuugugaguguuguuggcauccgucuucguuuuuuaaacagugaguuguuccaguaccauucauucuuuccccuuuggauugugcggacaccguuguugaaaaacugguuauaaauguaagggcucucacugacuuauuuguuuacuacuucauuagguccucauacuucuaccucccucccaaccuuuauuccacccuaaucccuuccaaccccucaacacuuuguaggagagaaagaagcuugagggaggaggaggagggcauagaccucuuuagacuacuuccuguccaguaaggguguugacuuccuaggggcaaguccagucuucacugucagaauguccagcaguccugcaguagugaacagagccacaggaugaaccagcagccgggggggagggggggggcagcagcugccacagacccucugggguucugaauuuguauccucuccagaguccccagaauuaaacuauguugcugacaaaaaccgugccucuccuagagcucgagacaguuauagccaguggcuguggacaaacugaagcagcuccauagcccacaucugggguuaaaacacaaauauaguagucacagaacuggguuuuaaggaaaccagaauucucacacuucuggaguucuguagcuaucuuuggcuacauuguggguuguucuuucuucugcccuuuucagcccuuaacacuagauaaaggagaaaaaaagagaguugaaaggaaagaggaagacguuaucauuagacuauuuucugcugauuaagggucucaggauaucuacuuuuuuuccuuauuuuuuguucacaacuacuuaaaaaaccucaaauacagcaaccaaccaacaacccacacugccuuuuggggcccuagcauuuauauaccuucugaaaaguccccagaauuccaaaugucacaugauuguagaaaccauuugcagcuggcaaaaaucaugccccugcuagagcaggaggcaaaucauagucagcugcuauggacagucugaaguagucacauaucccauaccugggauuaaaaaguaaacauauucuuauuauauuccugugcuuuuaaaagaaaccaaaauuccagaauucucacuaccgaguccuaagccuuuuuuacugauuuugguuuguuagacauuuguauuauuauuauuuuuuuaaaaaaucucaaaaaauaguugcuuuucuaaaugaguuuuucuuuuuaucucuuaauaagucaaaggcaauugcaauuaucaaguuacuuauuguuuuaaaauaucuauacaauaucuuagguaaaagcuuugugaaauuucaggcacugugcaauagcucuucagugauuuuuguauuuauuuaacaaugacccaaaaauggauaauugcuaggaagaguguccaacccauuuagauuagcauuaugcacacugaggaaauacugaaaacagaaacccagaaguggcaaaauucagauuaguguguuguuguauagacagaggcugagcucucucaaacuacugcauuuugaacaccagacauuugccuguuaaaaacuacaagagaaacuuuugaaaauauuauuuguuguacauuuucuguuucuuaaaaacaaauguuuucugcacacuuuuucuucgcugcuugauguuguguucuugguaugcaaaagagaccacuucucagagaggcauuagugucgucucaucuguguuacaugugcacguuacugaacgaggagugccuagccugcuugcauuguguggaaugcuuccguguguaugccaggccacacugcugugugucucccaugggcagccaccaugucauagaugucaagcugauguuuuuuuguuauuuaggagucuuugucugaaguagaagagaaauacaagaaagccaugguguccaaugcacaacuagacaaugagaagaacaaucugaucuaccagguggacacccucaaggaugucauugaagagcaggaggagcagauggcagaguuuuauagagagaacgaagagaagucaaagguauccacucaucucguacaucacugucuuggggggaggggaggaaaaucaaagcccgcuguuuaaaggagauauggggcuggugggaagcugcagucagaacugaguggucugagaagucagccagugcccuauggauuuuuuuuuuucuucagagcugaggaccaaaacccagggccuuggcacuugcuaggcaagugcucuaccacugagcuaaauccccaaucccaccuaugaguuuuuuaaaaauaauuuuugaaggaaaaacuucuauacuuuuuuggguuuuuaaaaacuagauaaugaacuuuuuuuuuuuuugguuuuuugagacaggguuucucuguauagcccuggcuguccuggaacuuacucuguagaccaggcuggccucaaacucagaaauccaccuauuucugccucccaagugcugggauuaaagguguguaccaccacugcuuggcuaaauauuuauucuuuuaacugugaaaaugacauugaguugccccuugucuccauugugaacagaaugacacaacuuggaagcuucagugagauaggccuuuuuuuuuuuuuucuucugugagcuucuuaucacuucaagagacuccacuuuccaaauaaccaguuacuuagaagcagcaguuuaaagaugugagucagacauugacagguguuuucuugagaagucacagcugaagaauaaaggccacuggucaaagugacauaucugcccucagacagcagcagcagagacucuggguuguauuaaaaguuuauuggaccuggacauuuuaauguuaguuucuaaguagagaauaauuggauauuauugcuagaaauuaguuacugcuacauugccaauagagaaauaaaaagaaaaccguaggaaauugguguugaugaguuguuggaagcacaucugaauugcacauaauaaagggagguggcuaguuguauagcauuugauaaacucccauggucauggcguuauaauacuuuaauagaaaccagcucaucugacauuuaaaaaacauguuauuaagggauggcuugguggcuaagcacacuugcuguucuucaaggggacccagguuuaguuaccagcacccacaucaggucgcucacaacugcuuguaacaccaguuucacaggaucugacccaugcuucuggccucugcagguucuggcauacacaugauccauaugcauguauguagauauucacagagacacaucaaauaaaaacaagucuuuaaagugcauauggauuuuaaacauagaagaagacuguagagaaucuaaugagucucagcucccccuuguuaccauuaacccauaguuagcccagcccuggccuuuucuacucuguauuuagaacaaagucuaggcaucuaaucuuaauaauuaaucuggauagacugcauguucucccuuuaaaaaauauauuacaaaaacauuucagggacuagagaugguugagaaaauaaagcacuugucauaaaaacuuaaggacaagauuuuggauccucagugcccauguaaauaccagggcauggcagagacuggaugccuggaguaagcuagggagucaacacaaaccacugagcucuggguucaacaagagacucugccuuaauaugaaaggugagacuuaagccucagccacuacacuugaauaucugacacccacagacaugcaugcacacacaugcucauacaaaagaccaguucaugcuugaaaaauuaauaucaauuccuauauauuaaaauuuuaguaguuucaaagugccauaggcuuuuucauuuuuaugcuuagaaagcaaucagaagcuagccaugguugugcacauaauccuagcacuugagaagcugaggcaaaaggaugauggauuuauagccaagauuacacugagacccuuucucaaaacaaaacagaaacaagcugguaggguggcacacaucuuuaaucccaguauggaggaauuagagucaagaggauguucuuugagucugaggccagcauagugugguaguaaauucugggccaaccaggacuguccagugagacugcccugcaaucuuguaucaucccuaccccaccccagucaacccucucccagccacacccucccagaauccaggugagccccacaccuuggaauuaguugcuguguugaaacucuuagcuauugguucccuuuccaccucuccccaguacaguuuagauuugaggaaacuugauugccuguccuauaagcuugccuuucuuaaaugcuuuuuuuuuucauucccacagugucuuuugggggugguggugggggcggcgcaggguggucccuguccucuuuaguuccugugaacaggaugucagguauagagaugucauuaaauguaacuggagcccuuuuuuugcaagccugcuucagaaguggcaugguccuuuuuacagagcccagguagcuggcuguuuagagcguagauccaguuccaaggaaucugauacccccuccuggcuuucacgguuaccaggcaagaaauugaugcacagucauacaugcaagcaaacacccauacauacgaaaacaugaaaaaaaugauucaauucauauauaacuuccuaaaagcuaugauucaguggaguuuaguauauucacauaaaggugcaucugucacacucacaaagauauugacauucucucaaguagaaucugaaucuucuuuagucaucgucuuccugugucugauccucuggccccaaguaacuacugaucuucuuuguguuucuguauuuccucauucuagacucugauaucaacagaaucauaaaaggaaccauuuuaugauugucgucuuauacuuaguguaguaaucccgagucagccauguuguggcauucauauaagugcuucauuucuuucugugacauguuaacauuccaucuuuaggguagcuacaugcguugggggauccagcagcauuaauugauauuuggguuguuuuucccuuuggccuuucgugagaaaugcugacacgaacaccucuguaguuuuuguugggacauugcuucccuuugucugauugcuugggagugggauuguuggguagccuggcaacugcacagacccugagagagcagcggacuuugggaguagugucggcauuucagcugaggugcugcuggcuguucuuaaccagauccucucugcuguuugccaguguuugcccuuuccuggcuggccaucuagaggauggagcucugauuugcauuucucugauaaagcuacugguuuugaauaucuuuucauggacuuuugguuucuuuuuggaaauugcucauuuuucaguuuuuauuacuguuggaagacuaucuuucagauaaagguuacauaacagauaaaugacuuuagagcucucuucucgaagcuuuagauuucuuuuuauccuccuuauccuuuguggccuuucuaucuuuuaucauguccauacuuaggaucuuaauuuuuuauuaccuagaugaaacaauuugcauaguuuugaaagucaagauaagccgggcgucucaagauaagcugggcgugauggcucacgccuuuaaucccagcacucgggaggcagaggcaggcggauuucugaguuugaggccagccuggucuacaaagugaguuccaggacagccagggcuacacagagaaacccugucucgaaaaacaaaaacaaaaacaaaaacaaaaaagaaagucaagauaaagacuccuuugcuuguguaguuucaaaauaaggaguuauacauucacagugaccuaucauccuuuaugaagucuuuauaaauuuuguuccuuuugaugcucagauuuccccacuacuggcucuugugagcuccuuuucugcagauucccagguacuuuggcgaguuccaugcuuucugacagaugagcaugcucuggccuuaucuuuagcauccuuugucaaaggagagccuccauguucucccgcaggccuggggcugcucuugaugcucagucagccacuucauggcccuucacucagaauguguaugugggcucuugcuuguuugucugacaaaaugcacuauguugugaugguucauguucauaugcaugacuguagggauuauauccagucccugauggucuccaucuccucugcccuaauuuuuacugcuguacuccacgucacucagaaaagcaaggucacaguaacacugguguaguuauaggaagcagccacagugcuugacuuugccuuuaguuugggacaguaggcuaugcauagccaaaaugcuguuuuuuaaaaguuacuugaaauagauuuaaaacaaauuuuuuuauuauggcaaaaacauaccacaauaaaguuaccauuuuagccauuuuaaaggguguaguucagaagcauuuucuauacuguucuaugugaaaucuguauguuuuaauuuugcaaaaguaaauucuaaacaaauuaaguuacuagagacauuugggccuuucucuaguccaggcuaccauucugccuucaucaguacauguccugacucacaacacgcagccuggagcuccuucguucacaaggccugaugaacacuguccccaucugugccacauuuuaccccaucaaguauuuauuugccuagaugugggcuuuuuuuuaccuggagcuacacuuuaaguugaacucugacccguguaaagauagguagaucugaagucaaacaaaggacaugaauuuaaauuuuaucuuuuucauccugguuuuccucuuuuuuuucaggggaauucuuuuuauuuuauuucuauuuuuuuaaaaaugucuuucauuuuguuuuguguaugucugugcaccauauguaugccuggcgccugugugggucagaagaaggaauuagaucuucuggaacuacacuuagagauggcugugagccaccaugugggugcuugggaacaaaacucagguucucugcaagagcaacaaguuaguucucuucccugcugagcaaccucucuagcccuggggaagucuucuuacguuuagugaucggucuuuccuuuuauaagccaagaagauaugcuagccaauuuugauuaaaaagagagcugcaacauuugagauggauggaaacacguccguuugugcuccucccuuagagaacagcagcccucagugagugcugcucugcuugcagcacacaaagcuuggcugauuucucugcugcaguuacucccuugugcccauuccugguguuugcaguguuucuguccagaagucauccugcaaaccgugugugcugacucacagagcgacuguuucucuuccuuugagcauguguggugugggagcuguucccuucuuguuuccuggacuuuagccugguuuuccuuuuucucggugggguuuuguuguugucacuguuguuauuuuaggaguucuccagaugggaaaagcauaauaaaucuuugacucugaacauaaaggacgauuucuuggguagauuguuauucuuaucuuuacucugugguagcuuuugcuauucuaacaauuuuaacuauucucuugcuccacuugcccgucuuguuuuggauuuuggagcccucgaccucacagucacucauuuaaaaccucuccacucugcuuucuguuuuggugccuuucucccuuccucacgcaagauggagaauucauguuugacacuucucaugcaggucggccgucuagguagguaugauucuggaagucacaugggaccucuguguuaaauuacacaugcucagcuugugucugucccaugaccucgguaacgacagcagucacaccugaucuccugaccucuauguuaaauuacucauguucagcuuugugucuaucccaugaccucuaccaacugccuuuucuuaauaacaggaguuagaaaggcagaaacacaugugcagcgugcugcagcauaagauggaugaacucaaagaaggccuucggcagagggacgagcucaucgagguaugugcuucaacuguggaaaugcuccguuuugaaaaaggaguuggcuaggauggugguguguuuguuggaagacuguucaaguccuauaaagcaguguucucagcuuuccuaacgugacucuuucauuccuuauguggccuggugaccuccaaccaugaaauaauuucugaugcuacuucauaacuauaauuuugcuacuguuaugacuuguaauauuauuaucuguguuuucugguagucuuaggugaccugugaacagguuguuugaccacuaaagggaccaugacauacauguugagaacugcuguuaugaaguuuacuugugucaacuuggcucucucaaaauauuuugagagccggguguggugacacacgccuuuaaucccagcacucgggaggcagaggcaggcggauuucugaguucgaggccagcccggucuacagagugaguuccaggacagccaggacuauacagagaaacccugucucaaaaauuuuuugaaaauaacauauaaagucaagcauaaaaaaugaauguuuaacaacucuauaaaauucucuccuuuaauacuaggaguuuuggccaaugucuuuuauucguaagcacuuuuuccugaagauauccuaggaaguuggaaagggauauauuauauagaccauggauucucuggguccuagugcaugcucugcuauaggacgagauucuugagugagaauucuaaccuucacucagguggauacacuugagguagcugaagaaaaggaggaaguuguauagaucuuucuuuagacuccagggcuucagggcuucagcucuccgcuguggaggaauucagccacacugaggcagcaucccuuugcaauggaggguaggccgcagcacguggguaggcauucauccacugccgucccugcugugcucaaguguuuugguuuuaggaagaauuccaugugaagauaguaaggcuugauuuuugucauuugucaccaguuucuuggauaauaagcccagggugcuggaugcagauuuggaagccuuagucuuuguauguuuucaguuucuauuuuuuggaagucaguaucuauugaaacccgaguuucacauguaaugccuuuaggucucaagaacuaagaucugcauaaucaaguggagagugugggaguaggggcaguguugcuggucauugcaagacagucucucacagacgugccuacagacugaccugauaaaagacgauuauacgcaccugagacuucucccccaggggauucuaggccacguuagugcuaacuaggaggacaucauuacucaccagaagacuugauugagcacagcuaaguguuaaaaucauaucuuucuaaaaacuaauuuuuuauguuuuaugauauucuugauauuuuaguuuuugccaacagaaaucaaaaugaucaagcugaguuauaucugucuucuuuaguucugcuucaccacguaacauucaaagauacaguuuccucucugguaaaggauuauuuguucauaagcaaacacaaguuuccuucuguaauauaagcgggcucccuguuuggguagaagggcagucaucacaggaugaauauucgagagugugugcguaggagugaaggccggauggcugccaucgagcugugcuuggaacgguuauucugaugccuuuuuugacauuuguccugcccuccguucuuguggugcuggggaucaaacucagggccuguacacacacagcgcaugcuuggcugcauccugucuucccuugcugacugcugcaggccagccaggagacaguggcugucaccuuucccuuuccuguggauccuagacuuccccuccucccuguuagaauucccccaccuccuucuguuuuccuucuucuaacucccuugccuucuucuuucugcuuuuauuauuuuccaucccucuucuucaggagaaucagcgccuccagcagaaaguagacaccaugacaaaagagguguuugaccuccaagagacccugcucuggaaagauaaagcacuugggguaugagaggagguggggcuuuggagaagcucguuccugagggauagaccaagagaauuuaacucagacguggccaaaaagccacccuucuaccuguuuagucaguauggauaagcagaagacagagaauaacuucuuuaggaaacaugguagugugccuagagagaacuucucuuuccagacuccaugcuugcgaagcucacaaauggaaaccuuuaaaagaaguggucuucauuccccauauaauaaggauucuuaccccacagcaaccacaggcaucugaugcaaauuucguggguuguuagauaugcuuacauuagauaugcuuacauuauaaaauaugaauugaaaaagaagauggcguggagggagaauguuagcuuauagauuguuggugaauaaaauaggaagggauuacaauucaguuuaauuauggaaauggauaggaauguaaggucauagagcugccaaacugugauaccaccucuaauuauagcccugcaggcccaauagggccugguaaggaaaacuuccucauugcuguuuuguauagugcuauggguacacaccacgcaugcugcagaacagcaaaaauuagucacauaccuaguucuguaggguagacauuuaaagaacggaagauacuuuuauauaauuuuuuggagcuuaaguuaccaagucuccaaaauuccaucaaaaccuaaaaaaucuucccaaggaacauugcgauugugaauuacuuuauuuauaaauguuuuuccuugggaaagugaaaugauguguggggugggugcgcagaguagggagagugaggugauguggggugggugcgcagaguagggagagugaggugaugugggugggugcgcagaguagggcgagugaagugaugugagugggugcgcagaguagggagaguaaggugauaugugggugcacagaguauagggagagugaggugaugugugggugcgcagaguagggagagugaggugauguggggugggugcgcagaguagggcgagugaagugaugugagugggugcgcagaguagggagaguaaggugaugugagugggugcgcagaguagggagagugaggugauguggggugggugcacagaguagggagagugaggugauguggggugggugcgcagaguagggagagugaggugauguggggugggugcgcagaguagggagagugaggugaugugugggugcacagaguagagagaguaaggugaugugugggugcacagaguauagggagagugaggugauguggggugggugcgcagaguagggagagugaggugauguggggugggugcacagaguagggagagugaggugauguggggugggugcacagaguagggcgagugaggugaugugagugggugcacagaguagggagaguaaggugaugugugggugcgcauaguagggcgagugaagugaugugagugggugcgcagaguagggagaguaaggugaugugugggugcagagucuagggagagugaggugauguaggugggugcgcagaaggcaguugguagagaaaaaguucaaaaugcacacacuguucaggauggccaucucaugggucaggaggcccagggcuucucauuuguaugauuuucuuaguauuuuaaacugauuaucuuggaacagaagcugacuggcuagaguaaaacuacaugccccauaaaauagcucacugaaacagaccuuguuuuccuacuaaaaagacaugccaacacuggcugcagcagcacaugccuuugacccgagcacuuggaggaagaagcaggcagguggaucucaugaauucaaggcuagccuggucuauagagcaaguucuacaccagccaggcuacacaauaugaccucucucaaaaagaaaaaaagaagaaaagaaagaaauguacauguggaugguuaagauagacaucacuuugcuuuuaauugucugaggauuuauugaaauugucuauaagauauaguguaguuaacuuuuaauaaguaaacuugaguagcucaggguuacguaaagugcuuguugagcacgaucgugaugccuugguguucaucuccagaacccaccugaagguggaaggagagaagacuccaaagugcuccucugaccucuguugugugugugccaacucacaccacacacacacacacacacacacacacacacacacacugauaaaugcucuguugaaaaaguaaaucuuuuuauacugaggaaaguuaggauucauguucaaguguaagaaaugauaccaagauaucccuguguucccuuugcucacaaaugucacaucuugcagagcuguaguacagugucacagccaggccaugccuggugcagugaagaacauagagccaccuccauuuguccuuuuuauagacacccaucuaccacugcccuccaguccugagagccacucuguaauuuugccauuuuaagaauguuguauaaauagaaaccuaugguguguaacauuuuugggcauagauuuuuuuuuccauucagcauaacucagaaaguucauccaguuguaagagagauuuauccccaccauagcuuuucuuuacauugcgccuauuacaaauaaugauuugccauccuaaccauuggacacaucagugcacacugucccuguccucuccagcuuacagucuggacccagaaugccucaccccugccagccacugcuccacccuguccgaguuaacuccgcaggcuccucauugaggugcggucauagagcacuugccuguuuauggcuacuugauuucagcagcauaagauccuaagcuucaucagcaaggcacugcaguaugugugagaucuaaugaaucucagucucucucucucucucucucucucucucucucccucucccucucccucucccucucccucucccucucccucucccucucccucucccucucccucucucccucucccucucccucccuccuuccaucccuccccuuuauguguauguguguaugugaucuuacuauguaguucaggcugacuuucccauuuccuucucagugcuggggcuccaggcauccuucacccacacucagcaaauguucuuacuuuuuuaaacugaaugggauuucccucaucuuuguaucagauuuaucuguugaugaccccugggcagcagcguccaucucuaccugcuguggacauguagugcagacgucucuuugugcucuguuuucagugaugcugggucuaucccaaagccacuuaguaaugcuguuuaauguuuuugaggaccagccauucuguaguccacauuccccagagcagugagcaagggugcauggucuccauuucuucaccagcacuuggugcuuuucugucuggagcuguuacgucaucugcuuuuacucuuugcucuuuccagucccagggauagaacccaggcacgcacuccugacaggagaaugcccuacuaccgagcuuuuuuuuuuuuuuugagacagagucuguguggaccaggcugaaugcacacguccagcuuccuuuuuauuugcuucagcucccagagcaccgcucaucucuagcuucauuuccaagacuacaaucuaaugacuuagucaggaagcagccuucucucccuccuuucucuggugauaccaguccucucagcacaggccugcacgucucacagguucucaccuagacucgaguagugcacauaaaaggccucugagcucuuggcaaacccaaccacagauaauucucauuuucaauaacugcaguuauuuaacugguugcauaguauacagccugcucuacaucucuguuaggcucuuuguugcuaaaauuaaauguuagaucuuugacaaagaauuauuuagaucucugcaaagaugaacucuguacuuugaucucuuggcagaggcaauugcugccugcaggcccagggcggugguuaugcggucaggcaauacagagaaucucagaucuaggauaaauaaauacauuugacccaauuauaagguauuucaguagcuuucaaguuuuguggugaagugaacaaauauacaggauauauuuuauuuuccuaacuguaauuaugggaagaggaaauuuuaaaaucuaaaaguaaaacaaaacccaguaccauaauuuuggaaggagguacaaaagccacguacugguguuuguuggaauucuugagauuggucuauuccugagguuuuguaugcagugggguuauugagaagcacuuuguuaaagugacccccuccucggcuacaugucaugauuacagcacaacugcaugcugugcuuuuguaacacacaucuaaccuguggugagugacugcugugccuacaacacccagcuaacccacaggguucagacaggaaguguccugggcuuguucuaaggugucauuuguuguuaagggcauugacaacagcagcaaauguuuaaggcuucagaaucuagagucucacaucacuuuacagauaacugcagauagagcagaugugugacuuuccaccauuuuggggaagaaguuagagacugacgguacagugugaaaaguaaggaagggcuugucuaaggggcauuuccccagcaucaugugggaugagcgugaaagaagagaaugcagccucucuaggcugugcuguaaagccacacgacagggcuuuagagccagagggaacugcauucgucuucucccuugcuggcuacuuugggcagggagaugaguggugcagggcagagggcgagcaucuccaugaggucaucuauccacugcuacagucagugcuaugcaguacugguacucacagguagcaccaugagggcuuuguauaaaucacccagucagggccaggcauguugauggacacaugccuguuuucccacuguggguauacauuggaggcccaggacuacauagcaaguucaaguccagccuaggcaacaugagagcuucuguuaagcaacaagaaccaccaggaaacacuuuuuagucaccaaauaaccaagcaguugaccacuuuugaccuggugaugagauaaaacauuaaaugcaugaaaaauaugcaguagaagaaccagugcucccgccaggcugcugugcucccugcuuucucauccuggguguuagaguguggguccagagccacccaccuuuuccaaacucuguaacuugccaaguacaagcaauccuccaaggcuagcaugucucugaggugggugcugcuguuaggccuuccguuugucagauagcuguguuggaugacuauuucagggccccaaggcuagauuugaaaccccugaccucuuacucagcugggcuaguguucacuuuguguuuauuuuguuauuuuuuucucauuuucucauuguaucagaaaaacaaacgaauuauacucguguauaauuaacauaagcagguuguggagauucaggugaugucugaguacuuugcucuaacacuggggaacaagcagccaguauuuaaaauaauuuauccagacucgcuuuucuucccaaacuaauuucaucuuaaaacauuaagcauauucuuaacaaaacuacucuuguuuaacaugaaaugaaauguguguuuuuuguuguuugccaaaugaaaacauacugaggaaguaaggcaggaaauuuuuguguguaaagauggucuucaugugacaagcaugucuugccaaguuccugcaugagccugcuucuguuuaaacucuccccagcugugcacgcgggcuguccccacugccuggucaccgcccccaggcuucuaaccuccugcuguaggccuuccugcuuaucggaucagucaccuuucucuugcucuuuuucuaugcuguucuugcccuugcuacccugccuaaaaccaggcccuagagaaacagaaagaacacauugccugccucaggaaugagcgagaugugcucagagaggagcuggcugaccugcggcagacagugacgacagcagagguaugucagccugggccuucugccccuccuccugccuuacuucuuuucugaccauaaacaacagccuagauaugaugauugagccguuuccuccacagagguauaucacauaacuaauuucucauuagcuuuuacccauggcaaacauuguuacagagaugccauaauagaacuuaguuucuguguggauuaucauuuguaauacuaaguuuuuccuucuccacagaaacauggcuuaguuauaaucccagacagcacucccaauggugauguccaucaugagccugugguuggagccauuacugcugugucucaggaagcugcucaggucuuggagucagcaggagaagggccacuaggugagacacuacuugcuauuuaggcuuggauuggugucgggcuuccagcuggggucaggguaggugcagagaaggaaucugggugcauugcccuuaggcauucuugauucugggaaaccagcaguggagucuucaugaggggagcacugcagcuuuauacaccucuccuuuuacuuaaaauagacuuugugcagaguccagugugcccauccugcaggcagcucagggcugguggacuucccagcauaugcuuagccucuuccuggcccacauggauuuagagucuaagcuuauccuaggacuuugccaccacuuuucauaacgagagauugaugauggaacagaccguacugagugaagugugacuuccagagcagggcucgagaguaacccuggagagugggaugacagcuucucuccaggaagccacaaagggguccagcucaaauguugcccuauaauaaaucuuacacuaggggaagaaaaacagcacaaauagauacggugucaucaguuuacauguaauuuuuuucuccuuuaccugggugagcagaggagagacccugcaggcauguucaccucugauauuuaacacgaugaugucauuuguaagcccacacuuagaaaccacucaaguucaaaccaaaccaaaccaaaaaccucuuaagucaguuuacuguuuuguuguuguucccauuuaugccguucauagccugauacuguagagaacugaagaccacaaugggcuggcccuugugggucccuccaccuuugggaacuggaacucacccagccagccuuauucauuauggguuuaucggccagcugugaaccgcugcuuuaacugaacuagcgguguugccuccgcauguggggucuguucccgcccaaggagcagcugcccugggcaucuccccaggcuggagcccaugcucuguaugcuugauccccuugugugccucaguaaguuagccguggguuuaaacuucacuucaagccacucugaguuuucugauccauaaagcuuuguuucgccuugagggcuagagugccucacccaccugcucccacuuagccauuagcccacugguaccuuacuccacacuccugggucccacucuugagucacaguguggcagacaugguaauuccauaacugagaaccuagggaguuuguuuuucaugucugaacucccgcuuauaaguuguggcugccuuacccaaagcuuucaccaaguguuaucaauuuccaucucuccuucauucccaggcugucuugcuaaaacaaauggaggaagggaacccuaacccgaugauuaaaagacgcuccacaaauucacacccccaaauuaaaaaaaaaaagagugggagacucuaaagacaacugggaaaagcuuguacauuuuugcagcagcagcagcagcagcaacaacaacagcaacaccugguuuccucuguaccccaguuugucucuaggcagagaaagucagugcucugggaacagauacuuuauuugauaguaugaauaaaaguauucuuucuauugcagugaaagccuuuguaucuuuuccuguucagauuguaaauaguguaauuuauuagauguuggcaccuuuacaaguucaguuuacagccuuccuucccacuuguuccagaugugaggcuacgaaagcuugcuggagaaaaggacgagcucuugucacagguaagauggcuacucauccugucacagguaagacagcuacucauccugucacagguaagacagcuacucauccugucacagguaagacagcuacucauccugucacagguuagacagcuacucauccugucacagguaagacagcuacucauccugucacagguuagacagcuacucauccugucacagguaagacggcuacucauuugaaucuauuaguuuaucucagauaggcgauacagugcuaauaaauuagaauguucauuagaaguuagaaauagcuggauguaguagugguacaugucuuuacucucagcacucagaaggcagaggcuggugggucucuguguguucaaggguagccuggucuacauagugaguuccaggacauagagaaacccugucuugaaaacaaacacaaaaaacugaaagaaaaauuuagaaauauauuucuaacuuugguacucaagugacauuuaaaggaagaaaagcuaauuuauguuuugugucucaaaaaagaauguauaggauacauacaaagcuugcugccccacccuuccaccuucagccugaccaucuccacccucuuuuagcugucccucaguaugagucacugacuggaugaugcuguuccuuaaaggaccaucuguugacauugcucuguggaagacaaaccucugccacacaugugcaacuuccuguuccuguagccucuuaaaggccagucuguuuccauuugcaggacuuugaauguuggcuacacaggaagccacccuaauucaaucuagcuuuucuuuuuugugugccauaagccuauuuucuugugcuuaucacaaaguuagcuuguguuuugaacaguaguuuaagcccacucaggguuuuuuucugacacauaccaggguaccaucuugagccucugacuuaacccauccuggacuauagagacuucuucacuccugaagugccagcccuucaggccuagagagacugucugugcuguggaugggugcuucugucuucccaccuuccucuuuccuucacucuuuuguuaguauguauuccaguaguuuccugagaaagaccaggugugcuauuaaaaaaaauucccauaaccucaaaggcauaugaaagugucauuuuccuuaaguguuuuccuaggccuauuucuucauuguccugucuuugaguauaguuguucaaaauugugaaggcauaggccuaugagauggcucagcaaguuaagugcauguugugcaagccauaccugaguucagucccuaaaauucacauaagauagaaggugagaguugacuucacaaagauguuuucuguccuuuguguguguguauacacauuuugagauuugaucucucauaggucauguuucugccuuccccuucuuuccuuuucucuuucucucuaguaucuugaaauuucacaguuaauguguucagaaguuuucaagcaucauaauagcccuuguagauucuagaaacucguaguucugaguugaaaaacuugagugguuuuacucuucuccugacucggauccagucaguaagggaauggcgagugauacucugugguuugauaaaucacgcguggcgugugggaaaucuaggugagcagauugcuguggguucaucugaaauauccaggcccuggacggccuuaguaggaagaggucaaauagaauuuagaagcuguauuauaucugaaaaguuuuugugaacacauuuauuauguguuucucuagcuguauucaacuguaugauacagccauguagucaagaaagaguuagacuucaccagggcaaaggauguaguggauauauaagaccaugauggucauguugaaccuagaaguuaagcuggaugaccaguguugaggggaccucuaaguagagauuagguauaguugaaagaagauagaucaaugacuggaagugaauauggcugaggauguuagggcuaggguuuuagagagaaugaauugggagaugagcauucauaggauguggaacuaaauaaucuagggaguauggcuaucuaaugaagucaguuauauggccaaaggaaaaagagguagauggcaggauccuugaagggcacguguucagaaauugagguaccuuauggaagcaugccacuacucuggauguacacugaaaugccaaagacuuaagauagggguauuuugggagugcaagucaggagcuaacaugacaggcacagcaccucaguauaaauaugagguaauuagauauucguuugaaccgaugagauuaagaacagagacuucagggaguaagucuaggcuaguucagcaacagcaaggaaagccugagagcacuauugcauuucuaggcugagguaggaggcugugaagacauaaguagcagcacuuaguggggcuacaggaauggcaggacucugugagaguacccaggugcaagguguacucugggacaaggcugugacaggagcaucggcugguagcaggcugaugcuuccagaugcauuggagaaguuuguggggugaaguuaggcauggccagggccuuugggggacaagugcugaagaggagggaugccucuuuguaggugugauagaaaugaugggauaauaaccaaguucucucgaagcaaucccauggugcagagggcagaggugccuaggagguaugcaguccucgagucugaaaucagcacuugcccuucccauugggcaguggcaaaacuaguguuuagccuccucuugaucccuggcagcagaguugaggucacuggggaaaccagccacuauggauauauauuuuuguauguuuaaagguaucuaaaaaacuaaaaaaguccuaacugcccaugaaaaauuucacuuuaaugagacuaggacaaaacuacucaaaagauguacuuuugugcaaacacacacaaguaauaaagaauagaagucuuuauuaggacaccuaguuucugaggcucauuuucuguuuauaucaaaugccuaggaccauuugucucauaggcaaaauagugcucaagugguuuguaugcuuugcuaauuaaaguaagacggaucugcuuuguuuaugauauggccacuagacuucaucuaagagaauugggguuaggagauggucuuauagcacuuggugugcagcauauggccuggauuugaauuccaaguuguagccaucauagcauguucaguaaucccagggaaguggacacagaagguuugcuggagcuugguggcuagccagccuagcuaaauugauuagcuccagguuuagugagagauccuaaucucaaaauaacauguacaacaauugagaaagacaucugauguagaccucucgccuccguguaugcaaacauacauacauccacacaugcaaacucaagacacuuaucuuccaucccggccugguaauacagaucuaaaauccuaacuacuugggaggcugaggaaagagaaucccaaguucagggucuuccugggcugcagagugaaugcaaagccagccggagcaacuuagugagagccuauuucaaaguaaaacagggcuauggcuacaacuccauguuaguuuuugcuuagcaugccugaggcccugggcuucacccuauuaucaccaaagaaagagauaaagaaacagacagacacagaucucucuggugacuuuuacuuccauuccagauuagaaaacugaagcuccaguuagaggaagaacggcagaaguguuccaggaaugauggcauguccggggaccuggcaggacugcagaacggcucagacuugcaguucaucgagaugcagaguagguaccaggggacaggccagacugcugggaugcagcauguaucccuggaauagaguuggauaugggcugcuggaccgcaggggaguuguucuagucaucuaggagcuaaauaugucccagggauggcuugggccagucacugcuugcauaugaucucugcccuucugugugggacuuccacuuaagcuuuugcuuuagaauucaucuuggaaagcuaaagauuuaagauccgcuuauauaaauguugagcuguuucucaaauuuccuaguuuuuaacaaaaauucaucauuacaugagauuaaaaacaaagcuacaaaauaauauaguuuguuuacccaaguuaugcuuccuuuuccuuucuauauuuaacuccauaucauugauuugagacaggucuuuuuacauaguccuaacuggccuaaaaucacuauguagaucagguuggacuagaauucagaaaucugccugccuuuaccucucaagugcugggauuaaagguguuugccaccauguuuggcccauauuuuuauaugcauugaaguuuuaccugcugugugucugugcgagggugccagauccuuucggauuggaguaacagacaauugugagcugccaccuggguguugggacuugaaccaggguccucuggaagagcaucucuccagcccacucuuaagugucuccuauaaucacacuaaaucccauaguagaguuguccuagcauccauuuuuauuauaguuacccuauugauagugauacguaacuuacaauaggggccuuuaguuuucuaauuuguaguggcuuuucugauaauggacuuuaaaacuguggcuaagaauuggacuuaggccgaaugaaggaaucuaauaguuugaaacuuauuaguaauaacuacuguggcuaguaucacuuccucuuucagaccucaggucccucauucuccuuaaugaguaguuugcguagugggacaggaaugugacagaauguaggaaggcuaguuaugaagcuggaugcugagccugaccagugcaguggaugcuggcagucccagacggcacaaguagguuugggaagauugcuaaagcagcaaauucaaaagaaaccaaguugaaauggaacaugcuagcguuuauaauugcuuccucaaaccaaguagcuguuauuggugggcuuugcaggugaaaguuaaaugaccugagacacugccuggaagccaggacuggcugcugaagaggaaaugaguagcugcuggcucuaaacugcagcuuggccuguagaaugaguagaguuucaaaaccauacucacaugaaaugaauagaguuguacacaggaaggaaucaguguuugagagugauaaagaagcuguacauuuugaugaguuauuggagauaugaauguaaaaacagaacuauaacuuccauuguagcgcucaugauggaguguucccugucucucuguacucccagagguagccuuggugauagcuacuuuaucuguuuuuuuuagauagucuaauuguacagccaggcuggccucaaacucaugguccucuuguuuuggccucccagugcugggauuugagauuauagguaggugcuaucucuugugguuccuguugcuuuaaggucauagcaacugcccaacagcaaaacugcuugcacugaacaccgcauggcaggccuacuauuguucauguggaaauagagggcaguucuugggauguuugaauuauuucuuuugguggguuagauaugauuuauguuccauagacuuugcaacuauauaauuauggagaugagugcaucuuauugaggcuggugaagacuugagucagaguguguaggagagcagaaacacugcccgggagcugcaagguauagggcugcuuuuaaagaggcaaggagcccagaggcugcagggggcauuguuacccugugagcuuucuuucucaaaggucuguuuacaagagcagugguuuucagucuuccuaaugcugcaauauuaauacaguuccucauguugugguaacuccucaacuguaaaauuauuucauugcuauuucuuaacuguaacuuuguuccuguuaugaauuguaauguaaauaucugauaugcagaauaucugaugugaccuccccaaaggggucagaugcauagguugagaacugcuggucuagaggaaaagucggacuuugcuucugacucuuggucuucagaauacugcagagcacaaguauaggagcuucuuguaguacauagcauccagacccugaacugcauguccucuguaugcuucuucacagcuucaucucuggagacaaguauaauucauuauuaucuucuguuuuaggagaugccaauagacaaauuagugaauacaaauucaagcuuucgaaagcagaacaagacauagcuaccuuggaacaaaguguaaguaguuuugugauguaccaaaugguuuaaaugccacuaaaugugaccaaaugccucucagccgcuuacauccaaguggcuagaccuuugaguuucuguggguggccuagguagcuagaucuuuucaaaagcucuguguuauaguugaaaaacccagagaacaccuggugggguaauccagcuuugcauuugcucuaaagacaaaggacugagccagcaagaugguauagcacagacauuuggcugcuaaaucuaaaaggccuggguuugaucccuaagacacacauggcaggagacaacugguucccauaugacucuucuuauccuguccuaguuaggcuuuguauugcuguguugaaacaccaugaccaaaugcaacuugugagugaaggguggguucauacagcucggcaucaaaaguagugaaggcagaaacucaagcagggaaggaaccuggaggcaggaacuaaugcagaugccauggaggcguggugcuuacuggcuuccuccuuaaggcuuucacagucugcuuucuuagaccuuaggaccaccagcccagggauggcaacacccaaucggcugggcccucccucaucaaucauuaguuaaaaaaauauacuacagacuugcccacaguccagucuuauggaagcacuuucuuaauugaaguucccuccucuucaaguugacacaaaacaagcauagaccucuugugugcucacaguaaauauauguauugauuuaaaaaacaaaacaaaaaaaaaaaaccacaguacuuugcagcugucauuguuuuuuguagauauuucuauagagcauuuaaaaauagcuccuguuaagaaaaagaaaauuguuucauauacauuuuauaagcugaaagauuuaacaugggaaaucggcccuagagugaaugacugcaacuguccuucuccucgggauccguggcugcccagugacacugcacuuccaucuuggcugcugggcagugguggcaaacucuaaaggccugugugcugcauuuacagaucagccggcuugaggggcaggugcugagguacaaaacugcugcugagaaugcagagaaaauugaagaugagcugaaagcagaaaggaggaagcuacagcgagagguacugugcuaacaugcuucuuggagaacacauugcuaaagacaaacacuguggaaauauuucacuauuuaagaaaucugacuuuugucaaguacaguggugcaucccuuuaauuucagcagucaggaugcagaagagcgggccuaucucuguuaguuuaagggcaguuuggucuacauaauaaguuccaggccagccauggcuacauaaugagauccuuguuucaaguaaccaaaccccagaagaccugguaaacacugcgcggggccgcuuacccuuccugugggccuugcgccugcacaguggcugccacugacuuuguaaaguagcaaauaaaaauguauuuuuagguuuugcuucagaugacaucagguuuugcagcuuuuacacauuguguauuguggucuaaauaauuuucagcaccauugcuuaggccucuagcuagcuagaggaagguggcagcuguuuggggacuccauacauggccaucacuauuaguugacccccguuucccagaaguggaaaggguugcugggcuuucuucugaccacauaaagugacugugcccuuugucuccagcuacggacggcacaggacaagauagaggagauggagaugaccaacagccaccuggcuaagcggcuagagaagaugaaagccaacaggacagcccuucuagcccagcaguaggaggcggcccuucuaccugggugcugcugaggaccuugccgggagaugcugacucuuuuguacauugacacaagccccuucaaguacuguuuugagucuugucauuaaacagccaccuuuguauuuuauaauuuaugagaaugaagcagguuuaaucguuaauggauuuggauuuuguuuguaguucacuucuacagugagaacuagucugugcugucuuuauuuucaacauucuagaaucacguuuucucaccaucuucuuccugccgccucgcugacagaggcacuggguggccuugcuguggguucuggaggauggccauucugagcacugagacacuugcuggagaccucaaaaacccaagugccuucuccaaagugugaugcaggcuucagagaccaauggccaagguuccuccucuucuuaccagaguguuuacauuucagugaggauguguucagcaguggggagucuguuucacucaaauuuauguuuggaggaaaaaccuuuuuuuuuuuuugaggguaagauauuuaaauuauauaaaaguuuuagaaaacaauauggggaguguauauuaaacuuugcuacauggggcagagcaaguccaagccuguacuccaaagacuaggcuccucagucuucacacccacugugcuguuccgugcguuuucaucugcugcuuaccugugaaugaagccucagacaagcucaagggaggagggagggacagugcaggcaggcagggaauccgccugaaucuaccuacuaaaacacaccuuucugccauccacgauuggcugagggcagucgauguuaaagaagccuuuaggacaagucauggcuaccauguacagucuugcucuucuuuucucaagaugagauacucugggauacagaacuuucuucuaguuuuuugagagaaaggaucgauguagcccggcuggccuccaccucacaaucauccucauugggccucuuugagugcugggauuccaggcagguacuuucauaccugguuccagaauauaaaguccuuaagaacuuucaucuuuaaagagcccaguucaagauaccccugccccugcuguaaccacuuuauaggguuugugauucucauuugucagaaucaaggugguuucaugggaaugauuacuauagcucaaaguguuuacagaaacuauauugaggaaaaaaucuaaugaaucaaagccucuuaauaaaucuagccuuggaacuagauaauaaaauuaacucaaaagugaaugauaauugucccuuuuuuagagucacuagcccuucacuuuaaggauauggaaacuacauccugagcugagaagauccugugcaucuucuaauagaagcaacaauuguaugggcaggaaugcagaucucuuaucguuucucagcuacaaucuggucauccagcucuucacaccuagaaggcaccucuuccuuuccacugacgucacucagccugaauuccuccugggcuccugaaccuucccucugaggagccccugcuuggcccuagcccuuguuuuagucuauucaauugaaauggcucuauuucuucauuaagauaaauuguuuucuuuuaaccuucuucauugcauccuguggucuguauucuacuuuaaaauucugggcauuuguccuugggcugacuguuguauuucugcugaggaaggcugauauuaagguagcuuguuugggcacugaauaaugaauauuuuuauuacugguuuuagagaaaaagcccuggcuaacuccaguggacuagauuugaccacccaccccagcaagucaccacaguuugauagcgaaggaaaagaaucauuucauauggccauguugggaggaagagacaaaaaggucccagaaauccaaacuaauuuuccaaguuuuaaugguucaaaagaaguaacaaaggggacagcugagguagauauuacugacgaagcaauucaucuuggacgggccagugaucugacagguaauuaaaguucagguccuaugaaaggcucuggagaagugguugcugacaucucuugauaguuuccauggcauacuuaguuccccucuccaaguguagccucaccacuguuggaagugugucauucugagggguaagcuguccuaggaguguuaucuacgaguagcuuugguccuuugucauaaagauaguucucaccacuucuguacuccucaauuccaaaguuucucugaaacagaaugacucaggaggguaaaaaagauauccagagaagggcaaaguaguugcugaggccgcugacuuuuuuuugcuuccccaggaucuuccaaacaagaaccccuagaaacauguuuacagccaugaagugggcuaacuuaccucuuaccaguucaaagaucgggcaagggugguuuaaguuuugucccuaguaauuaauuaguuuugauuacugguagugagg

SEQ ID NO: 5346 - RNA, 13894 nt, Mus musculus
uggaacugggagaacaagaaccaugaaggugacagagcacaguggacugacucugacuccgccaccugcugggcaggggaggaacuccuuccuucucugcuuuaacuuucccuuuuaacuuuccuguccuguccucccucccucccuccuucccuccuuuuuccuucuucauuuuaccuuuuguuuugagacagcaucucaacuaucacagccuguacucugauucacuauguaacuauaaccaagaaugccaguggacccucaucuuccccucuccaccccucccccagggcugggauuacagguaugcaccaaccaucucauuuaguuuauguacuguuagagagcaaacccagagcuuccugcaugcuaggagagcccuccacccgcugagcucuauccccaagccuaccuuauuuauuuaucuaauuaaauuaugugaugggucauaauaauuacagccaacauuucuccacugcccacuuuaugagagaaggccuucuaagagcuuugcauauaucaacuaauuuaaggcucacgggugucauccuggguacauagaugaggagacagacaauagggggcuaaguaaacagcggguuccuuccaggcggugccugcauucucugcacaacccaccuggagacugcagcaaccuccuggagauguuggaaggauuaaccuauagugcacaucaagcuauaagaacagggcaaccauuaagucaggaguuucugcccuccuuccuucccucccuccuucccucccucccucuguccuucccuucuucccuccccucccuccuucccuccucccucccucccucccucccucccucccucccucccucccucccucuuucccucucucuuuccuucccucccucccuuccucucucucgcccucccuccuccaguuucucauccucaucuccuguauacacgccgcccugucgugaugacaugaaggggaccgcuggcuucauaugauuuuggugguaaauuaagacaucaaaagugaucucaaacauuugaaauaauuuuuucuucugguagcauguuuacaaugcugaccuugaccuucaagauaagacaacggcaagaaaacauucauucauucauucauccauuccuucauucauuuuugguuuuauucuggguuccccaugucucacagccuucaggagcugauggcagaguggaaaggaagggacugcuccacagaucacaauuggaaggcgucaacuuaggucacugacccaguuugcagauggacguagauguagaguguggccuccaccaucuuccaggacuuuuagaauugucugcuucaugauggucugugccccaggguucuaaagaucacaacuaguccuaacugugggauuuauggcuaauggcugucaacugccuuccccaggagucauccccugcgugauugcugcauuuucauaaggaguugugcccacugggcuuguccacucuccagcuuggcccucaucucuagaaagcucugggugugcuaguaaggguugcacagggcacaacuccuucugagaguuagaaggggaggggagaggcagagggagugagcagguggguagacaggguaaauagauggaggcugaugcuaauuccauguugccugcuggaaucucuggucugcucagcuuuggucagagguccacacaaaagcagaggggcccagcugacauugcugaugagggagagagucugugaagaaggagacaggacaggaagaaaagaccucaucaccuugggcuccaccucuagcagcugggaccuugacaucacugaagguucuagacccuggaugagcagugacugaccagggaguuggaauccuugguuucccagccacaucugagccuaacuaccuguuggcaugcguccuagcauugagcccucuugcugccagcccaucacagacuguuugccuuggcagcugcccccuccuccuccuccuuaacuccucaggacagggacauuccuagccuguucccuguggcagcugaugccuuuugauagcagcaguggccccuucaccagccugugggacaaguggacugagccaccagacagacgaacugauaagguugaagcagguucaaaaaccccagucaaucucauaauugagaacggcgggcauuggaaccagcuccuggccaggcuguaccuguccuggaacacauaaccacgacacccacggagaggagcaugacaaccagucauuagcauaaaaaccuaguucuccaugcuaaugaggugucuaguaaggccccgaguguuuagccaaugagcuuuccuuccuaggcaucccuuccugcaaaagguauuuaaucuuugguucacucugaguaagacaugcauucauaucaaccaugaauaaagcaguuuggacaaacaaacucuuucaucgaggaccacugcacgagaggccuucauuguaaagaaccaugccuaaaucucccagagaaggccucucuuccacucuuggcacucacuaggaaccacccuguccugggcucagccauccccuuccugccuggccuauaggggaaggaccuuggacuaccuuucucaccuccucaugguccccagcuuccucuggguacacaggagauugaggaccacagcaucugucccagucccccgcugguucucacccagggaaacacagcugggacccccuaucuuggacugcauucuaccuuuccuuagcagcaaauuuccugcacgccaguggcaaagcggacacucagcccaauaccagccuuugaccuaaggcacccacaucuccuuuucuagaagaggacaugguugccuucccugccccauacacacaucuuucuaaagcaucuggcucugucuauuuuuagggaaacaaucucugaggacauuucaucccuaaaaaaguucucuaagaaaaguucaaagauggacuguuguuuagagaucaaugaaaaggagauggaauucaaauauuaagaagaaagcccuugccuucagguaaagcugacauuugcauaauaacgagagugacuagccagauggaauucauucugaccagaaucucaaauccuggugaagggagacucaccagaauugaugauaggaguauaugcuaaucaggagucuguggcuguccaucacauucacagaucuugagaugaggaaguagacuuccuaaacuggaagagacaucaccugacauuaaacuuaauuugguuuguuuucccaucagcccgcgacagaugugcaauugugggagucuuugcaggagguaggggagagcaccucccuuuuguaagaacuguuugacugcuguuggcaugauuguuacuguguuagaaacaacaggcaggaggggaggggaauucaagagccuuaucuggaucauuauuggugaauaaugggagcaucuuccaagaagaggaaaauacagaguccuaguaaaugcuuccagugccuugaugaccaggcagcguuagugcccgagagaugggaccagggacugggaggaugccuugacuugaaaauugaguuuccugaaagagauaagguuauguuagccugacccagacuugaaugugaauucucuuauuuugagguaacaaaagcaguucuucgggaagauggagggaugaggagagaggguggaaaaaucucacuguggccugugaucuccucgcugguacugagccagccuucuauagucucccuccccacucugaaggugggauuguggcucacuucacacacguuucccucagggucccuugucacacggcaaagguuuuccagacgaaaccaggcucuuuuaguugacccugaguugaucaugaggugauuuugugagugaccugggccuaauuggaacugcccuucaaaagagggcauggguuucuuuaagggcagccaccaaagaacaggggugguagaugugcccucaggauaaugucuaggguugcaagaacuuacucuuuuuuauuuuauuuuuuuaaauuucucugcaaauauaaagaagaaaaaggcaggaaaugcaaggucucagcauucagccaaguuuuccugaaaauggaagaauucaauacacagagaaaaggagaggagggggaaggggagggaggagagagagaaacagacacagaagggagagggagggggagagggagagggaaagaggaggcugggagagagagagcauaaagcacacagagacaaauuccucaaggagguaaagggacccaaagcauuguugcuugaaugggaggcaggggcgggguggguaugugaugaucugccuuucucucccagaacuggccagucugagcuaucacugcggauuggagaauccagacaaugggagggaggcugaucugguucugucguaggagcuccuuuauggcagauuuccaagccccacuagacuuccaguccgcuggagugugcaggggaccccauccccccaaugcugucuucagagggagaagaacccagaagcuggccauccuaaccgucuaagugagaguuacauccauccacaaggggccucuuuggccugcccgucgucugccaguagugaucucccagauuccucaguagagcagagagagacgugugucagcauuaauacaggaauaaagucagugugcagaagggcaggaagcccccuuacaccagggcuguaagggacggacaugucugagaaaagugggagaugcgcaaacgagagagaagggagcuguguaggggcucauagaggcuccagagcgucugagccuuggccugucagaguucucuagucuacggccauucuccagagugcccuucucuucagccuuaaaccaucgauguccagugucccuggcccaucucuuuguuccaagauuuaugcauccugagaucucucaggugcccucuggacucacaucugcaccuguaacagaggcccucuuuuauuuuauuuuuuuaauuacuuuuauuuacauugaagaagcaaguuaacuggagucuuccaguuccaaagaaauauuuuuuguuaacuaucccaaaacaccugguggcagcuucuucuggugcuaagcucuggaugagucuaggccaauauuuugacucuagccuugugagggguggucagaaacugugucugggcucccagccacugaaaccuugagggaaugcauagcuacuuaaagcuacuugagucuguggcaaauuuguuacauaacaauagaaaacgacuuuaguuuauucuuuaaaaagcuaauuggaggagcuaugggguuagccagagugcaguccagcuugcuuaaaacccugggguugacucucagcaccacauaaacuuggcauggccguacuuccucaucaugccagcacuugggagguggaggcaggaggauggaaaauucaacauuaaggcagaggcuauaacucaguucccagaguacuggcuuagucuguaugugagagaaaccuuugaagauucccaucucaagaaacaaauaaaacaaaacaauauaaaacaaaacaaaacuccuaauugcagcaaugccuguguaaguuucucggcugaggagggcagagaguggcugaggcuggcucucucauccacauuuucauagcuaacucugugugaaucucugcuccuaucuguucgggaugucuucauccugcugggugccugguacccaguguggucucagucauguuucucugucuuuucaacagcacaggggaaauaaugugagucucacaggcaacacuuccgaggccaagguuugcagcccccuccucugccccacccugccuccagacccacagccauuuuuauccugauacacucugacugcuauggcuaugucucaguucaguucaauuagaagcaacauguauugaacaucugcuacauuucagauuuccuaucggagcaggggcaggaaguagggguauuguuaauggugauggaacggagcccagaaauugaagucaaggucauguggccccguguucaucuccaaguuuguaugaaaaguggccaucuucuguacuugcugugacagagggcagggugucaaguguuuaacagauuguauuugcuggauguaugaccuuagggacagauccuguuugggauucaucugaaagaaaacauaagauugauaaucauacugaguaagcagggcuucgggauggcucaguauauaaagcacaugccauagaugcacagggacccgagauuaaucccuucacccacauucaaaagcagagcucaguggcacacagcugaauccccaugcaggagagacagguagaagccuaggacuugcuggcuagcagccuauccuacuugauguauuccagggugagauucugucucaagaaacaggcuggaugauuaaaggauggacacugagguugaccuaaggccuccauaccacuacacacauauacauacacauacacauacacauacacauacacauacacauacacauacacaugugcccauaugcccauccuuagccacacacaugggcauacccacaaguuaaacauaucagugauauggauaaaaggguuuugagaauuacaugagcaaaaauacaucuaaaaucugcuauauauuaaacucucaauguaagaguuuuacauaugucacuauuauauauuuauacuguuauaaugcacuauauguguugguauuauaaucauaugauguuacuauuauuuguugguuugauauguggagucauauauagcucagguuguccucaaacuagcuacauagcugaggauaauuugaauuucugaucuccugccuccaccucccaagugcugagaugacagguauacauguccacaucuugcaauauauuacuuuaauaauaaauguucuauguuacgaugauaguauuaucuaccaugcauguuucuauuguagccugacuuacuagggggaacgaauuagauauucccuauacgaaaagccaccuuuaaucccagcacuugagaggcagaggcagagagacagaggcagaggcagaggcagaggcagaggcagaggcagaggcagaggcagaggcagaggcagaaagagagggagaaagagaggcagagaggcaaagagaggcagagaggcaaagagaggcagagaggcagaggcagagaggcagagaggcagagaggcagagaggcagagaggcagagaggcagagaggcagaggcagagaggcagagagacagaggcagagaggcagaggcagagaggcagaggcagagaggcagaggcagagaggcagaggcagagaggcagaggcagagaggcagaggcagagaggcagaggcagagaggcagaggcagaggcagaggcagaggcagaggcagaggcagaggcagaggcagaggcagaggcagaggcaggcggauuucugaguucaaggccagccuggucuacagagugaguuccaggacagccaagggcuacacagagaaacccugucucgaaaaaccaaaaaagaaaaaaaaaaaaaaacaucaacaacaacaaaaaaagccguuuaaaucaagccucgacaauggcagugucuuugacaaggaagaccacagguagaaggccauuggucaagggcguggugguaggaaggcgaugaugacgugggugagcaggggcuucuguggucauccuagcgcaugcuccuucucucucucuucacucugauucuugcagaucggaugugggcagacuuucccaggggagucgaguggcauggguguuggaugccucauacaggauguauuuuuuuuucucucugacugcaaguagaaugugauccuuggugcuuagggaaauacuaagaguagguggcuggcucuuguuuucagagcagagagcgaggucuuccuauccaggagcuuuuggaucaggacaagugacaguggccucuugggggacuguccuagagauuaacugugucuauuguucugggggagagguacagccccagggagauguugguggccugagcugccuuucucccauuugagagcauugugcuaugugucauuucugauuaaacuguuauucgcagcuaacaaagucaugauaaccagccagagaccacuggagugcucucccuugcccaacagcaagcuggcaccaaacuacuuguucaugcagccauugucucucugugguuccaaccauuauuaauaaugaugaucauggucauuaggcccaggaagaaaauaaugaugagacagcucuaauuagacauuauaacgacaacacauucuuaucaucguguugucuaguauuaauuauagucauuagaaucacuguaacaauacaaacuuccgcuugaguuuaucuucugugugaucaaagcauuuaaagacaugaucuuguuaguccucaugacauucugucaaagggagagcugcucucugaucucaucucuguguuugggguuggagguuggaggggagacaauguaacguugaacuacuaagagcauaacaaaacacaacaaacaguggguaaacacacacacacacacacacacacacacacacacacacacacacacacugcacauaacauuguguuugauguggcacaaggucuagaaugaugacuccagaaaguucaaauuucuuuuuuuuuucuuggcuacauuccagcucugugaaauugagaaaaaauuucccccuuuucucugaacauaaugauuaagugugcuuucuuuucuuguguguguguguguguguguguguguguguguguguguguguguguguguguaaggcagaguucaaccuuagcuguuguuccuugggccucauccacuuguuuuuuguugaggcagggucucucacuggccuauaacucaccaagugggcuaggcuggccaggcaacaagccccagggaucugccugccucugccucugccucucugccucucugccucucugccucucugccucucugccucucugccucucugccucucugccucucugccucucugccucucugccucucugccucugccucucuuugccucuuugccucucugccucucuuugccucucugccucucuuucugccucucuuugccucugccucugccucugccucugccucugccucugccucugccucugccucugccucugccucugccucugccucugccucugccucugccucugccucugccucugccucugcaguacugggauugcaagcacaugcggcuacugauuuaaaaaucaagcuauguccugacccuuaugggggcagcugacugggcucugagccugaguagggcucauuuuuuccauugcaguuaagaacaguuccaucuuccugcuucaccaucuccuuucaaugaaaagcaacagcuuagugcuuccuguggucaggucuugggcugagaaucuugagaagaaccaggaaaauguugacuccagcuucaucuguguugaaugagucaguugagugaacaaaaaaguaaaaggagauuuuuaaaaaauauguacuuugcaacagcaauuuguauaugauuuaccgcuaagggagcagcuguuuauuaauguguacauuaguagggccuucgagccaccugcagucagaucuggccugcuguuugccuccaucacuuacugcccacaagcucugucuccccaucucccucaccuccuuguagcucugggcaagaaccaaagaggcagauugucauggaggcagucuugggaugaaagcuuggccauucucagugcccuucaugguugggcuuuggcuuucugcccuauacuucacugucauugggacucuuugaagaaauugccuguuucuuccaggugccauauauggccucuugagaccggguccugaagauaugccucugagcaaucuagaagaccuuuggauaucccagaaccugcuauuuauguaccuugggccccaauuugcaucuacgagugaccuacucaucacaguaagccauuccaucccauuauuaaaaucuuccuuauggguggagcauuaguuaguaggcauuuggucuuuuaaaguaggggcugggaguguugcucauuggauagagaggcugccugucaugcaacgaguuuuggcuuuuauccccagcaucucauaguuaggaacaguggugguggaugccuguaaguaaguccagccuuugggaggcuaaggcaggaugaccagaaguuuaaggcuguuauggccuucauggagaaccaacccccaaaagguacaguugugaaggccucauguauagacuuucaccuggccucuaaugcuggaagcuucauuuauucuugucuaggccaucagccuuuguaguguucuuauagcuuauagaaggaccuuuccagaucucuguaccauuguugugcaucugcuucuccuccagcagcauccugaagugucauaugcaagagauagaguagccugggucuuccuggaccagcagcaaucagauuaaaaguacuccuguccuugugagaauuuguccuuccuaaugccaggcucuuaagguuggagcagcuaguaugccauguugacuucuauaggucacagacaaacguucugcaaaguaggguagugcugagaugagcguuuaagggaugcagaagucugguacuuaguaggaccacauuucugcucugaucaggucucuuacucucugucuagagggucucagcucuuagauaccacucagagguaaaaaauggagaagucugaaggaccaaagucagguacagccuagucuccaccuguccuuguguguuugugaaugugcacaucuggggcaucgaggucaaugucaccugucuccuucaguugcuucucuaguuuauuuuuuuugaggaaagguuuaagcuugaggcucauugauuggcaggguuuuuuggccagugaucuucagagauucuccuguuuuuaccucccugugcugggauucuagggauguguccucaccuggcuuuguggguucugggggucugauuucaaggccuuguucuuuuguggcaaguccucgccuuucacucaucuuugugcuagacucaguccuaccgcaugcugguguucccgcuucuccuucagguaugugauacucuuguccugucucuggucuccuucuauggacuuggcagaggaauugaggggagguacacacucacugggcuaaagcaccaugacaagacuguaauuccaggcuagcaaacacuucacaagcuccuaugcugccaacuuuguguauuggaaacaucuugagcaaaaugucagggaaagcaucucacggagcccugcugaccaaaagccggagauguuggggcugccaucugccuguggccucuccuagguaauuauaccagucucucaaggcccagaacaagggggaugucgacacacuuuccuuccucuaggagggcaaugccucuuuccucugcucaucuggagaaacccauccuuaugguuuucaggugugagagagguaccaggaggggacacagcaguaucuggugagauaaaaaaguggagacuuaguuguagagaauaagggagagaggcuugguguucuaaagggcaugcaugauaauuuuggcaauccuuaauuaaaccauagacuagaaaauuccacuaauaccgcuguccaaguuucugacugcagacauucauucuuuguuuuuuuuaucauaauugaagucauuuucuuucuuugauuacuaauuuguaucaagaaaaguaauuguaucugcuaguuuuuagaaagaaaauaucuucaaaauuuguuaacagcagaguguuuauauaccccuugccugccucugucuauucuuuuuggagguaggugggaggguaaagcucuuaagaaugugauuuucauuuggcaagagaagugccauuaugucaugccucaucagaauuaguuuucaacgaggagacuccuccaagucuccucuucuggacuugggcucuaugggauuauggugguucaucuuuauugccuauuugaccugauuugcaaucaucuaggagaagcaccucaggucugucugcgaugggguuuacagcagguuuaguugaagggggagcaucuacuuugagcguggguggccgcauuacucagcuugagguuguagagugaacaaagagaaaaaguugaguugagcacccauguucuccuucuucugcuccugauggucaccugcuuccugacaccgugugccagucgcuugugcuccuuccuccagggcuguggccagcuugaccuucauucugccccugcuauguuggauaaaaccuuuaaaaugaauccuguguuucuuaaggugcucucgucagauaucagucauaaugauagcaaacgaacagcacuggucucuuugacaccaggcagcaucaguggacuuugggagggagaagaguaaacaaacaaacacacaaacaagccucacaacuuucucuuacuuagggauuuuuauaggaaaaguauagugaccaacauccugaugucccuacggaacugaaacgcuguacagguacccuuguaugguucaacaaaagacuauagacagugaaggcuccauuguugucuauuuuuauccuucccauaguaaguuuagaaaauagcauuuuuuaaggagaccugguccuauguaugccagugagcccuugaacucucuauguagcuaaggaugaacuugaacucuuaaucuuccugccuccaccucucaagauaugggauuauaggcaugugucauuauacccaauguuauaaguuaauuugguuaaacaauuauuaguucuuugagaauuuuagacaacauguuuugaucuuauucauacaccugcaacuccuucuggauucaucccucuuuccuauguaugcaacucuguauucuuaaaaauaagcaagugaacaaagaaacaaacagaaaagcgucaaguccaauuucugugguccauauauucuuggagauaugaucauccacuggagcauaguugacucacuagggguuaaacucuuagaaagcacugauucuccauccacagagacuaucaauugcugauagcuccuuagcuagggguccaccuuccuuucuugucucccuuagucaugucuaccucccucauucuuguugaguuuuggccaagcuugugccuguacaggucuugugaaugcugucauauguacugcugcccugcugugcccagaaggcaucauuuuccugaagucauccaccuuguucuuacacuauucuugcccacucuucugcaaugaucuccaagcacugggggaagggagugcuucauuuagggcuggucacuccacauucucacacuguuugaaucuuagccuguugugggucuuaucaucuacugcacagacaagauucucugaugagaucugggagaugcaaaaauaugagggggauuuguaggguagacaugaaaaacauugugaaggauucuaaauuaauauuuaaauaauuugacauuugaagaaacuguuacaaauggaaauuuuuuuuaucaguaguaagaagauggauaccugccuauacuuucuuggauccaguggacuuccagggucauggacacuucauuuacaaaacaaguacagaauuauacgcagugagacaaauggccuaccucuagaaaugggugcaacucugaaucuucagaaccaaagacaagucucuugcuguuccuucuggcugccucagacacaggcauugcuucagcuggcuucauguaggguucuauuguuaugucuaggugucuccaucacugaagugacuuagcuaacuaggaaauaaacaagagagagcaaccug

SEQ ID NO: 5347 - RNA, 1737 nt, Mus musculus
uucuuccgagucuggcaggcagcuuagcccuacguggagugggaguggcgucaaaauucaaaggaacugccgcaguuggaggcguuguaccaccugcuucgagacgguuggcggccuggaguggccuugaccucaccccaagucuaacccggguggcagccgcucugccgaagggaccuuggaggacagaacuacaccggugaaacggaaaagccacgcguuuauccuucgugcacucuggggacgccgcuggucugcagagagccacgcuguccggugcucccuauccaaugccugcuugggcgcccagccagguccaaccuccaacccagccccacccaucccacuaccagacuuuggggacaauuauacugucaguauccucagaagucauucugcuucacagaggaggcagcaggucaaaagccaccaauuggccuuuauuuauuuuacggcaagauugauuuauuuugugcugggauuugaauucaggaccuuugggagagcagucagugcucuuacccgcugagccaucuuaccagccccacaccaaagucuuugaccuucccgaagcaaucaguaagaaacuuccaucaacucugaccagacagaauuucagaauuacugcaaacagggcuagugagaugacucacuggauaagggugcuugccaugaaaaugaggcgaacucaguucaaucccugaaacgcauguagagauggaagggagaauacacuccacagagcuguccucugaucaccauaugugcaccguggcaugcaggucaacacacacaucaugcacacaugcaguaguaaugauaguaagugaauaaaagccguuuggguaagaacaucacauaagguuugccauagauagaagguagggaauagaaugacauaugguaaaagcuugucacagaaucugguuaaggacugugccucugggcuacauuucaagccuguggucuuaauuugguucucuuuacaucuaugugcucagguacacacgugcaugcagaggcugaaggccuuagguguuauccucaggagcaccauuuauucccuuugagauagggccucuuacugaucuggagcucaggaaucaggcuagacuggcugagcacaagucuaggagaucuuucuguuucugccuuccagcucagaaauuauaagcaugggccagccacauuuaacaucaucuuuauguggcuaugggaaucaaucuggagucccugggcuugcaaagccaacgcuuuguugagccaucuccauagccacaguauuagcuuuuuaaggucauuagaugaaugcuuucuucaaaaugauuucuaguauguauuuuugaucuuacguguuagcuuucaucacaauaacaagagaauucagaucagugguucucaaccugugaguggagacgccauugacaaaccuauagcuacaaaaauauuuacauuaugacguauaacuaggaaauuaugaauuagcagugaagauaauuuuaugguuggaggagcccuacaaccugaggaacuguaucaaaaggcugcagaacggggaagggugagaaccucugauuuagauaaucaacuuuugucagagaaaaauuuugguugaugguuugaagguucuagcccauaacuggacucuccauugcuuugggcccaugguaaggcuggaggcuauuuuggaagugccuagcagagcaaaagcacucaccucauggccaggaaaugaaa

SEQ ID NO: 5348 - RNA, 8917 nt, Mus musculus
uccuuucuuugguuuuauuuauauuuauuuguuuauuuguuuguuguuuucuuauuugugugggguaggggcaaaggcgugcuauaguaccaccacggaggucagaagacagcuugcgggaguuguuccuuuccuucuaccuugugggugguggggcuugaacucaggucauuuggcuccauagcaaacuccuucacccacugagccccucucaaagguccccacacugccauuuuugagaaguguagugaguuuuacucguucugcauguugaagacacuuauaaaucccaccccguuuuccuaccagguuauuaucauuuuauggcuguaaacgauauccuugcuuccaggagcgcauucuccaugcaagcugguuuucugacucgaucucccuuagccaaccuuagcccuuuuguuugucuguuugauguguuuugucauuuagacagcgucucauguagcacagguuggccuccagcuugcacuguagcugagcugaaguucuggccauccugcugggaccucucaaguguggcauuacaaacacgcaccaccacacccaguuaauucugauagcgggcaucagcuuaggacuuggcgcgugcuugucacgugccucuaccuacuguaugguagauucaucuucagguccagcuccuuuccugauccauccugacaggagcagcaugaagccgggccaugggaaagccaucaguagaaaccccuucuuauuuacuuagagagaugagauugguaggaacugggaaauccguuguaaaaaaguuggggggaaucaauguguuuggaggcauaagagaucugggagcucugacccauugcauccuagggaagcccggaggaugagaaguucugagagacacugggccccuccccacagcuccgcuccaccuccaacucuucuuaaggcucugaguaagacauggucagggaaguguucaccguccugguccgcauggccacugaggaagaaagugacagccuuuuaugaauuaggagcaaacauaacugugaacaccacuggauaucaaaguucugugcaagugaaaaagugggggccucgggguauacuucagugguauagcauuuaccuggcaugcacaaagcccuggguuuaauccccagggcuguguuaauaagggauuauuaaugaaugcauaggccugcaccuuagguuggggucucacuggagagagucccagggaugcugcugucagagcuggucccuaacauagcaacauucccacauggcugugguggcuugggaaguguggggggcuggcugcucaggguggagaguguuucugaggcagaaucaaggggccaggaggaagauggagaggggcccagugcagagaacccuguggagcccuucagggugguagcuagaccaccuacgugacacuggucaucugugagguggcaggcugcuugacgcugaggucacaugggguaggagauaaggcuccauuuucagggagagagacaacagcucccucuggguucuaagccagugagggaacuugcuugggccugagcagacagccauugguggccucugggaaacucucuuccugucucugaugccucuugugcccuguggccugccuaacugaggugucugccaucucuuacagggagagguuguggaguauguggacgacuuguuggagacggaagagucugccuaguccacaggggcuaaggaaccucucuuccgaguuccucuuucuucaagugccuggguuguugauaccucacagccuuuucuucuuaaaguaagaaggaagccaccaucucucccuaccaaggucaagccugacuuccccuuguucacacucaguauucacgcuugucuucaugguuacacgucuucaugccugucuuucccuucacacauguguucccgucaucuagucuguccuccucaaagucacguucgucuccccucugaucccaugugucucccccauguucagaaagacagucuucuguggucugcuuucucaucccugaagaaaaaucaguauuauuuuuuaaguaagaaaaacacuaaaagaugauaaauauauuuggagaauuucuuuggucucuccguccuuccagacguuccucuccuuuaugccacuuguuaaggacaaaagguggcagaagauaaaggcugaggucggggccucagggucaccuucacuugguucacuuggccugaccugagcuccaucuugcucacaacaacugaagguggccucugcucaguuccuuggaguccucagaauacaccagggguuacaaugucauuuaaugugaacaguacccgguuauaagucucaggguuagaaaugauacaggccagggguggauuuagcuuucuuuauucuccuaaggacugugggguuccuguuccaccuuaggcauuugacugacagcaguggucccauguggagucaccaaaggaaaagcugcuucuguuaguuccuggucugggagcugcaacagaauacuugacacaagcgacuucggaaggguuugucugacucucaguaagagggcggacuccaucaugaaaugaugucagcgggaagucacaguggagacaugagaucauggagguggggggucacaguggggucaggaggucacaguuggggagggaggucacggugggggcaggagaucacgguggugguggguggugggaguucacacuggugggaugucacagugggggugggaggucacggagaugggagguuggugagaaguggugcaggguggguuugggaggggacgucaugguggcaggagucacagcagcuuaaguucaugauggagggaggucauggcugcuggagcaucuaucuguaggcaggaaguagaacgcuggcgauaggcucacuucucucuauuccaucugggauccagccccuagacaggccuagcugcauuuaccgugggcuuucccaccucagguaaggaaaccuaggaaccccgucucaggccuggagucucaagucuugggugauucuggauguuggccuuugauguuaaccacccgcccuguccucacagcuuggagucugcaggaagagggaugcucauguguuuguaggaaccgcgguguccuagguguaggaugcuguaguggcuauuccugguugucaccuugacuauauguggaaugaacugcaauccagaauuggaaggcucaccagugacccuuaucuggaggcugggagauagaaguuucugaucuggaucuugguauggagaucuugaggcauaguggcuacagauuccagaagauuaagacagggagaucucugaguucaaggucaucugggauuaaaggugugguggaacacaccuuuaaucugggcuacaccuucugcuggagaccauauaaggacaauggaagaagggagucucgcucuugcuccuucaccugcuugccaaguacaaacagcaaccgguacaguguacaaggcucuggguuugaucccagcgccaugucaagcagacgugcacacccguuaucccaacacucaagagguggaggcaggaggaucagaaacucaaggucauccugagcuauauaaagaguucaaggccagucuuggguauauggaacucuguuuccccccacacacauacuauaaauaaaacguaaacauauugaauaaauaaaauaaaaaaugggucagagccauauaugucuaaccucaucaaugggagcuggggacagggagauuccccaagacuugcuggccagcuagacuaaaaaaauagaggacuccagauuuggggagagacucugccuuaaaacaaaacaaaacaaaaagguggaaugagguaggggugguucagugggcaaaugugcucgcucaccuucaagccaugaggauaugaguucaaaucccccgagccuacauaaaacccagguggguaucauaagccugugauguuccagugcuccuacaaagggagagacagacaggagacuccccagaagcucaaagaccagcaagucucauguauuguuguaggaaaauaaugagacaugaaaggcagggaccauggcccaaggaugucaugucauucuggguccugcuguguuccaacuccuucacucaguaaacuucacugaggucaaccaguuguccugaaaucuacaaguugguguuacucacccugcugaauaaauggcuggguuuuauuucuaaacuguacuuuaaaacacaauacacaagaucagaugacaaaaccuuucuguaaauguuaugugaaacagaucaguuguccuggauccagguagagauauucaaagauguugggugaagucuugggcaggaaugaagagguuagguuugcuacuauuggcauuuacugauggaccacgauggaaagauugcugauggacauguucucugcucuuccuuuugucuuuuuuuuuuuuuaaaggcagggucucuguagcucugguuggaacucuguaguccaggcuggccuuaaacuccgagauccaccuguuucugacucccuacagccuacauaccccaagguggucuuaaacuuagcaaguagcugaggcugaccuuaaacuucucuccagagccucuuaaccuccaccccuuccuugugugcugagguuaugucauuagacaccugggccagcucuacaucguuuaugcaugugugugugucauguguauacugcucacagaagccaaagagggcaucagauccuuuggaacuggaguuagagguggucgugagcguccauguagguccugggaauugaaccuggguccucuggaagagcagucagugcucuuaaccacugaguucccugauuauggguuaagcaguagggacugggugagaggaugguuuacuaugcagaaaaagcuacaacacuggccauggguugcucgaagaaggaauccagaccuugaaucucuaagguaggauaagaagaccuaccacaaguaucugaaaaauacuugauuuuuuuuuuuaagagacagggucuugcuauguugcccaggcuagucuauaauucauaaucuccuaaauugcugggauuacagauauucauccucaugucuggcucacagaggcaucuuugaaggaaugaaagaguaaauuguucuggcauggggaaggaggaaaagucugaaguagcucacacccaaacugcucuccaaagcagcuucaugaccacucagaacagaagaccuauuucccgaagcacagcccccaaacacaagggggcgcuggcccucugccaagcgaugaggaacgaauggcuugucccaaguccucugaaaagacaccauuguugagugcacacacacacacacacacacacacacacacacacacacacagagucacaggcacacucacacaugcacauacacacacacacagagucauaggcgcacacacacaugcacacaggcauacacacacacacacacacacacacacacacacacacagagacacguccccauugugucaguuucuuaagagugcccaggagaccacugcugcugggagauucuacagaaaaagcagagaggugauuuuucacugaaauuaaaucuuauugcaaagaagauucacaacgucacggguuacuuuauucuaugucuguuauguuucaaaccugggacaaauggcugagaugccuguuuaacauaucaaagcagaccuggcugccuggcuucucccugcaccuguuacaggguccuccuggcuggcagacccacccucuaccuugaacucuccaggacagggagcugggcugcucuucccuaugugguccaaccauuuugguuaacugcccucugcaucuuugggcuuccuggaugcugcaccugguuuuccucucgcugcucuuccuuccccucacuccucuccucacauggcucuguucauauccacucuggacucucccagauaucccugcuucuagcuauucuuuuccacauaaucuacaauaaaccuccuccaccauaccgagggagcagucauguucuuuuucuuuuuucauuuaguguccaauuugcuuuuaauuaauuaaauaauaauaauaauaaggugaggagauggcucagcaagucagauucuugcuguuaaaccugaugucuugaguucuaccccuuggguccacaugguggaaagaaggaaguggcugccacaggugguccccugacuuccacccauaugcugugguguacauacacacgugguacacacacagguacaaagaaggugucucuaaaggcugugagcagcaucagucaggaugaauauaaauguaaauauugagaaggcaucucagcaccagaguaauuuaauuaaacaauaaaaguucacucucauggccccgaggguuuuuauuuugauuuuguguuuugaggcaggauuuuacuauguagcccuggcuuuucuggaacucacccuguagaaggcuggccucgaauucauguaucugccugucucugccuccccaaugcugggauuaaagguguguaccacuauaucuggcuuauccuauaaauauaucuuaugauuuauuuauucauuuuauguauuugaguacaccaucacuguuuucagacacaccagaagagggcacuggauccuauuacagaugguugugagccaccaugugguugcugggaauugaacucaugaccucuggaagagaagucagugcucuuaaccgcugagccaucucuccagcccuuauccuauauucuuaaguaugucguaaagugaagucgcaucgucaugagggacaggagauuaaccaugauugaacugacacuauccagaguaggagacacugguccucauucuagcugccuggaagccagucuucugcuagcagccuucagaugaagauggagaacucucggcuccuccugcaccaugccugccuggaugcuaccauguucccaccuuggugauaguggacugaaccuccgagccuguaagccaggcccaauuaaauguuguucuuacaagaguugccuuggucacggugucuguucacagcaguaaaacccuaacuaagacacucauacacaauuuuuuuuucaaacgguagguagcacaugaggaaugucgcccuaacuuguccucugguccccaugcacacaggucuccauccacgaacaaauauacaugcauacacagagaagcacagaagaccagguaacuaacacccuggcuuacuuagccuggaggauaugcugcuggcaucucugacccuccuucucucccccccccccagaaccccacccucagcuucaggagccaccuuguguacacuucugcagugcugcuggagagguggucaggagcugauguccagaagcacccagcgcuccaggguucuccugccgccaccacccuccauccuugucacguuuuuggaaaaccuaugccuagguucucuuugcccuccuuacacagccuuuaaaaauagucauuaaaaaaaaaaagacaugcagacaugccagaaauaaccaguggcucaaugaaccucugaacaaauauggucaguacagagauggccuggaacagauauuugcuugguaacagcuauucacucagugcccuacagagggagugucuuguggcuauggcugaucagaccagaggaauuaaaaagaaaggcuagagagagccagacaugguggaaccccggaacgugagaggggcaggcuggggugucugcaguucaaggacuuccucagcugccuaaugaguucgaggccaguuugcgcagcaggagagauuaucccccaaacaaacaaaagcccuugggaaacaugacaaacaagacuacuacuucacuuaaacacgauggucuucucucagaagcuguaucugucuucaggucaucaucuucgggauauaguucaucacuguucagacccgguaugucucacaacuguuuguacaaucaacuuauacaccaugcauucacuacagcuacuccaaauuaaaaaggccagaguaggagaagcugcaguguuuggccaggacuauuucagaacacauuuccgggaagcugauucucaucucacaacaguaaaaauguaugcuggcaaaaaugucaaucuagauuucauacauaccuuuuaaaagagucagguuuuaaucaaguuauuuucugugacgaguucucucggaugcuuugggcaccccuucaucuaaugaaaagaaacacauuuuaagcaucacacaccacuuccuauugcucuaauacuucaauuaggaaacuaagcuguaucucccuuaccuugguaucuuuuugcaacugcuuugaugauguuaagaaugaugacgccauggucccugugaaaggguucaugugcauauaauccgaugucacuuaggugucaccaguaccuuccaaacagcacaaaaggccuugcauauuuuucugcaaaccccgcuguguaagaacccacccaaacugggacugaggaaccagaacgcacgcagccuucagccaagcugcccagucccaaucuccccagggccuaggcuccaauccugaaaucucuuuugcugcugcgcacuucucccagguaguuuacaccgguacccuaagcucaagugcggagggcugcuccgcagaaccggagcaucuaaauuuacucuguaaccccacauuuugcuuggucaccaggucgccuaaaagaguaaccuacagcgcaaagagaacccucagcuuuccgcgcaggucccuuuauaguuuagggugcagucagagcgaggcuguccuuccuuccuucuguuacggauugcacccgagagcacgugggggcgcggccguuccugaagcaccgcguggaaaagcugugggucuuuuc

SEQ ID NO: 5349 - RNA, 16266 nt, Mus musculus
cggcgaggaggucugccggacggggcgggccacggcccgcuuccccgccucccuuccuaggccugccgcgucgcgcguccucagcucggggcucugguucgugggccacgcgcgauggggccccgcagcccuacggccgcguugcuggugcugcugugugucgggugcgcgccgacccccgggcgcgggcaguacgagcgcuacagcuuccgcagcuucccgcgggacgagcugaugccgcucgagucggccuaccgccacgcgcucgaccaguacagcggcgagcacugggccgagagcgugggcuaccuggaggugagccugcggcugcaccgucugcugcgcgacagcgaggccuucugccaccgcaacugcagcgcggccacgccagcacccgcgcccgccggcccggccagccacgccgaacuacgccucuucggcagcgugcugcgccgcgcgcagugccucaagcgcugcaagcagggccugcccgccuuccgccagucgcagcccagccgcucagugcuggcggacuuucagcagcgcgagcccuacaaguuucugcaguucgccuacuucaagguaagggcacucgccccaccccgaaccccgcccugccaaaccccgcccacucuaccgagccgcucucugucgagcccaggucgccgcccccgagccccgcccacagaaccccuuccggcugauccggucuagccgaccccagcucccaaaccacuucugcccuaucccaauccccccagcaagccugcaguccaguugagccucgcccacccaggccccgccaaucacaucuccuguccuguguccaggaccaucccccucugcacaaucacccucccucaaaauuuguccuaccgaacaggguccaaucuugccccacccucccuugugagcgcucaccagcagcaucccauauugggccucccuugggccacuucucuaggucuagccccaccaagcccaaggcucagcccugccacucaaccucgagcaucauuccuuuauccuuugauuuuuuuuuucucauuuauauuuuuaugugcgugcgugcugugugaaaucugugugccugugucuguguguauaccaugucauacguguguggaugccuauggaggccagaagagggcagcagaucccuuggagcugaaauuagaggugauugugagccacccaguguaaccugaguacagggaacagagagaacuuuggguccucugcaagggcaggacgugcccuuauccacugagcuauggcuccaguccccuucacccagguucugccacagagcucugcuaaagcucuccaaaucccgcccuuccuccuucaucuugagcauaaaaauuauuuucucucacucucucuuuuuuuccucauguaaccugggcuggcuucagaacugcuauauaguggaggcugauggugaauucuuuauccuccugccugcauaccuccugcaugcuccaccccucccagcuccugugaaaauuguuugcagccugugcugagguagcaaauaugccacagggccccagcagaguacuuggaacuggaaggagggcuuuguaaaugcggccugcucuuugaggggcaaacuccucugcucagggaagugugugcagaucccagguucaucucugcucccucucucugucucugucucccucugucaucuagaauuuaagacagaucauuuacugccucuucucuuuggcugcuuaaauucugccugugauugcuugcuaaaaauagccacaaauugcagcucccugcccucuaaguccuugcucugggagguuugaauucccaguugcuggacagaagggugucagcuuguugggccuucacggggcugaggcagagagagaacucucaaaacccaauuucuacuuuuucugguuaagaaaaaaaaauuuuuuuuuugcuuuuauuaauuuaaucaaugugugugcacaagugggcacacagugugcacgagugaaggucagaggacaguuuguggagucuguugucuccuagcacgugggcuccaggcgucgaucuuagucauccggcuugguggcaagcaccuuuaugcacugagccaucuugcuggcccuccucuuccucagugcucuuccucggugccuagaucaagucucaggucauuggcugccugcaaagccuucccuucucuccaacugccagcucagguuuuccucacaaguccaaccagccagaggccaccuccugccauucuccgggcaucagccuugacaccugcccucuccagccuccccgccuugccacaugaaagccaccauugaauccagaugacuuggcucaaguuuaggggcauucagggacagauugacgccucucuuaauaccuuauucucaagaauuugauguggcuuacaugcuugucucucugucugucugucugucugucugucugucugucugucucuguuucucauucugugugugugugguguguguguguguguaucucucucuuuaaaccuagucaccaucccugucuuagagugcuccuucaggaaggcugacaggggccuuggaugccugagugguugaggcccuucugacugccagauugugccaggauucugucaaaauguggggccucaggcugccguccucucggggagccuggugcaucacaccugucugccugcguugguuacuucucuccuuacugugacccagugcccagagcuaacuuaaggaaggaagaaggugggcuggugagcuggcucagugguuaagagcgccgacugcucuuccaaaaguccugaguucaaaucccagcaaccacaugguggcucacaaccauccauaacgaaaucugaugcucucuucuggagugucugaagacagcuacaguguacuuacauauaauaaauaaaaagauuuaaaaaaaaaaaggaaggaagaaggcucacaguuugcagguaccguuggucaucaagggcaggucaaggcagccggagcaggggguggcuggccacauuguaccccagccccacauucccagucaggaagcagagagagauggaugcugguucuuaguugaauuucucuuuguuaagcagucugggaagccagugggcagauaaucccgacugaaacuuuagauaguuccuuucagguaugcugagugacucguguccugggugguucugcaucuagaccccaucaagucgggaauggggauuuauuaucacacugcuuuguaagguccccccacccccagcaugccuguccuguuugagaucgucuguguuccugcuauuucuagucagguggccagcacuaaacccagggucauggccccugaagcuccuacagcagcaauaugggugaacugacugucaccagccugcuuccuggaaacagugcccacugauagacgaugcuccacaaauaucugcgggggagaugagucagagggaccagagucccugagaauggaggcagaggguucugagagaguucugcaagcauuaauguguuggccaagguuccgccagaaaagauaacaugaggaagauuuauuaagacaguuguuuauagaagcgugcagggguacacacgggaucuucuaaucccuagcacuagggccacucagggguacccagcccuuggccagaaggagcaggggaguaaguugggaggagugaccacauggagcaggccaucuugacaggauccgagaccuucaguuugggaacagucaggggucgccguaggaagaaagucagaagaugaaacagaccacagccuccuuuuagcuccccacugggcuccucauggcuaaccucugagccagccagagggccugggguuugcuggaaacgccacccuccuggggcuuagauggugcaggcaguggaagguaggcaggaaaggcacucagggcuggcccaggucuugagaggccuugaaaagucauugcucucguaacuggaaaugucaucuaaguaaagagggaaccgaagggcucccugaggaggcuggugcccuagcucagcugguagaguaauugccuggcaugcagcaggcuuugggccccaucaguguaugagacuggcucuauucacgcaugccugugaucccaacacuuggggagauaaaggcaggagggucagaaguucaaggucauuaucagccuugaggcuagcccaagcuacguaggaguggguuaagaaaggaaggaaggaaggaaggaaggaaggaaggaaggaaaggagggagggaaggaagggagagagggagagacauugcugaaaugaaauuccaguuacaaagcucagugucugacuggaaacugugcacuuaggccaaugaccucccgaaggccaucgcugcggcucacaccuaucuccugaagcauccagaugacgagaugaugaagagaaacauggaguauuauaagagcuugccuggagccgaggaccacauuaaagacuuggaaaccaagucguacgagguacaccacucuggcuuuaccccgaaguuggugugggacucugggagcaacuuuuuuuuuuaauuauauucuacuuugugugugugugugugugugugugugugugugugacauaccccuuguguggcagccagaggagaauuuguaguucuccuuugugaccgugugggucugggggauuggauucacguugucauacuugguggcaggugcucucacccacugagcuauccuccuggccagugugcugacaucuaaagaauguugugauauuuucagugauauuugcugaauuaugacaauaggaaaugggggaaacaaaauuuccaugaaggaaagucagcaaauugggcauggugacuuuugccuguaaucucagcucuugggaggcccgaggcauugaugaucaccucagguucaaagccaggcugggccacaugcaccgccaagcccuuuuagcuaacuuuugaugaacuauauacaauucagcgaucugugacaacuucaugugucaugugauacaaggagcauggugaggaauuauguuaucacccagccugagugacacauuuccuccugucccucugcagugaggccaccgacaccccgggccccugacucagggagucacuuuuucccugaucugaauuugauuuuauugucaaauacuugcucuauuuggaguugaacugaagaggacauguggucauuugggcugggggguguagcucagugguagaggguuugcauacccgcacagcgcccuggguucauuccccagcacuguauaaaacugggcaugauggugcauacccgagaguccagcacacagcaguucaagguucagcuggcaagagggcuuagaggguugauggguuuuccugccuaaccugaggagugucuugaguauguaggagggaucugucuccucuaagacaucaucugagcucuacaagucuacacgugcggcucaugccuguguacacacacaagugcucacgcgcgugcgcgcacacacacacacacacacacaagaauguaaaaguaaaaguuuagaaaggaggucaagcucaucuuuagcuacacagagaauuugaggucagcuugggcuauccugagacucuguuuuuuuuuuuuuuuuuuuuuuaaaugugucuguugugaacauuguaggcaaauccagauccacacgcagccgcgcuugguuugcggcuaguuaagggucauccaggagcgaggaagcacggccugggcagagucgcgcuucuuuuggggagacaaguaugucucggguuugccaggagggggcgucaccgcaucuucuugcucugcagagccuguuuguccgugcggugcgggccuacaacggggagaacuggagaacguccauuuccgacauggagcucgcgcuucccgacuuccucaaggccuucuacgagugccuggcugccugcgaggggucgcgggagaucaaggacuucaaggacuucuaccuguccauagcagguuggugauaggcggggccuaugcgcccaaggcaucuaaggacacccccccccccuuuuuuuuuuuaaagaaaggaaagaaacuuuuuucuuguugacaggaucucacuguguagaccaggcuggccugccuggguagaccaggcuggucucaaacucauagaaaucucccugccccugccugcugggugcugggauuaaaggcaugggccacacccaguuuagauuuggguuugauaugguggacuucuugugccuugaggucuugcuuacuuuuuuucuuuauugguaucugaauggaauauuuccucucucuuguuuccuaucccugaugguuuaaaaucuacugaaucuuucguuucuagcauuccugccucuccagcucgucuguguccuugucucucauccaucuugcugccuuucugccaacuuucuuucucucuggccuuuuucuugagacaggguuucucuguguagcccuggcuguuauggacucacucuguagaccaggcuggcccuggacucagagauccgccugccucugccuccugaggcuugggaccaccccucugcuugguuacuuucucaucaacacccugauuuacuuucucugcccuguucacucacuggcucgccucuucaguugcuggucauuuuuaggaagagaugucugaaugcuugguucagcauuuuaacuguccuguuagcucggaaucagaaguugggagucagagucucuugggggcuucucgcccagccuugcuuuccccuguucucugugucaugcucucugucacuccacuugagguucuucucagagagcgcccugcaucugaggacccaguaugcauuauuacacgcagaggagaaagcaaacugccugcuuuauuguguacgacgcuggucuuuucuccaaacuuuaaacaaaauucuacaguuuuuuuuaaaaaagauuuauuuauuuuguauaugugaauacacuguugcugucuucagaucccauuacagaugguugugagccaccaugugguugcugggaauugaacucaggaccucaggaagagcagucagugcucuuaaucacugagccaucucuccagcucccaaccccguuguaaagaaaggccccuggcugccacuaccaucagaacagcacgccacuggugccaccaacagugcuucuaagacacuuaagccaauugcuguguaaauaguugucauuugggcugagcaugguggagcucaccuuucaucucagcaguuggauccugugacuccaggacaaucagagccacauaaugagaccuuuucuccaacagcaacaacaaaacaagauuuccuuccucgguuucugacaguuacauugggaggguccgguuuuggccggaacaacuagaaguggcuuuagagugucccacgaagacaugugugauagcugcuauucucuuaucggaggugcuauucauuuuauuuuauguuuuuauggcaaugcuggcgauugaaccuagggccucacguacgcuucauaaauguuucaucacaguuaaggcuccgucccugcuuggcgcuguuaauuuguaagcauuuaguuaaaggguuuucugcuucugcugcgucaggguucauuuaucaccucacgaguuagauguuaacagcggaacccugaggacaucauggucccugcgugcgugccucaguuccagcaucauccuagagaagucuugcugauaucaugucuuuuuuucuauaagucacuuguacauaaauaccccccagauuuuacauuaucuucugguuuucguuuuccccauuucguaucuccaaauucacaauaggacuuauguuacuugggcuugggggcguagcuccauggauaaagugccuaccggguccuggguucaguuuccagcucugcacugucuggucaugugguguauccuguuaucccagcccuugggaucacaagguagcgucaggaggaugaggaggucgugucauccucggcuacacaggaguucaaagccagccugagcuacaggagacgauggcucaacuuuguuuucuaccaacuugacaauuaaauuuguuguuauuuuuguggugcugaggaucaaacccagggccuaauguaugucaggcaagcccucucccauugagcuagaccccucaccuucaguuuaaauuguuugaaaaaaugacaguauguauggcaucuuagcaguguaagauugcuauucauaugaauucguauuaauauucuuuggucauuaaaacauuuuaaauuauauuuuuauuuauuuuguguguauauggugguggugguggggugggucagugcuguggcucacuuguggccggaggacaacuuguggauguugguucucuuugucuacgauguggguucugaguguugauucaugcuacagaagacccuuccugugcacuguaugcuugcugaagaugccggugaucaggccacaugccuggugcuuauagaagccaaaagaacgugauggauccccugaaacuggaguuacaguugugugccacucuguggugugggauaugagccugggaccucuagaagaacaguugguguucaccagggagcuaucccugcagccaugagcucuuuauuuuauuuuauuuuauuuauuuauuuuuaaaaaagauuuauuuauuuauuauaucuaaguacacuguagcugucuucagucacuccagaagagggcgcuagaucucguuacggggaugguugugagccaccaugucguugcugggauuugaacucuggaccuucagaagagcagucaggugcucuuacccacugagccaucucaccagcuuuuuauuuuaaaugucacauuuccccccuuuacuuccauguguguggaaggcaggacuagacugagggauugaggagggacacagagagacagacagaccgacugacuguucuaagaauuuauaucuguuuuucagaucacuauguggaaguucuggaguguaagauucguugugaggagacccucaccccagucauaggaggcuaucccguggagaaauuuguggcgaccauguaccacuauuuacaguuugcguauuacaaguguaaguaacccugugcagaauaucccugcuuagcuguggcggcugagaaggccaccaaggucacacacgugcuacgcacgaagaggccgucuggcucccugauucaagcagagacccugagcccugagcccggcugccaaccuugaacucuggguuuugccugcuguucucugggagauuuuucgcuuuccaggguuagagauaaauaguguagguaaaaauuagccccuucccuagccauacaggcugugugcagaagagccuuaaacuugucauuauagaaaacagccgcuagguggcacaauugaauaaucuuccacccggucaguccugccagaguuuuguuaaauaaggaagggucucugcuuuuguagauuagaaguggcucuggaaaguaccaggauaaauaccuugucucacuuuuucuuugccugacuccccugccccccaagacaaaugccacccugcagaacccccauguuguggugauguaagguguccaguucuaaacagggaggcuggagcagaaaacccguucgcaggggauggcagaacaaggucaccuuugacucuuccaguccugagggccuaucgugauuuaucuuguugguuucuguaguguggagucuuuuauuuauguuauuuguuuguuuauguauuuagaaacucggucucauguagccaagccucaaacuuacuauauagcuaaggaugaccuuaauuauugaucccccugccuccuccucccaaaugcugggacugugucagcacuuacuauuuuauuauuaacauauauuauuuauauuguuuguguauauauauauauauauauguauauauguauauauauuuuuuuguuuuuucgagacaggguuucucuguauagcccuggcuguccuggaccucacuuuguagaccaggcuggccucgaacucagaaauccgccugccucugccucccaagugcugggauuaaaggcgugcgccaccacgcccggcuuguuuauauauuuuaaauuaguuauuauuaacacacacauauuaaguuaugguuuaugaagaacuagggauugaacccagggcuccauguguauuaagcaagcacucuaccaacugagccacauccccagccuuuguuucugucuuccaaguuugauucaguuagaggagggccugcccucucugggaauugugguccuagccagaugggacccaggaacugcagccuuuagcaggaagccuguggcuaaggagccucuguccuccucaggcccaguguggcccaggccuugagucccaucaccucuggugacgcgcccugagugucugaagccagcagaaugaacacagccugagggugauccgugcucucuacuguccgucaggcgguccugggaccuaggcugugcccugcccacuuucugaggucuuugacuggagaaaggucaagcuucuagcuuccauggggagugacagccgagagcugcagggcguggcucucaccugccuggccucuucucucugguuucagugaaugaucugaagaaugcagccccgugugccgucagcuaccugcucuuugaccagagugacagggucaugcaacagaaccugguguacuaucaguaccaccgggacaaguggggccucucggaugagcacuuccagcccagacccgugagugucccgcacuggguccugcucacucacucgucccucuucccacacuggguccugcucacuggucccccuucccgcacuggguccuacucacucacuugucccucuucccacucuggguccugcucacagguuccccuucccgcacuggguccugcucacuggucccucuuccucaccugcaggaggccgguuucacccuucagagagaaucagcucugaaaugaaggaacuccacuguuucugguuacuguuggucccccugccccucccugacucuguagcccugacugacccagaagucacugcguauacuaggcuggccuugaacucagagagauacccccccaccuugcuucugccucuugcaugcuggguucacaggaauauaccaucacacacugcuuaauguuuuucuuauauuuugacuuauuugccgugugucuguacgugggccugcacgugcagcagccugcagugggggcagaggacgacgugugagaaucagcucucuccuaccaugcgggucccaggcauugaacucaaguggucaggcuugguagcaagcaccuucaugcaaggagccauucuccaggcccgugaggcuuuuuaacuccuuguuugaguccauguauuuuuccccuuucccuuucuuccuuuugcucugaccucgcucgcucuggcccugcucucuccagcuccguuuguuccggcccauaggguuuuuuauuuguuucucauuacggaugguugugagccaccaugugguugcugggauuugaacucaugaucucuggaagagcagucagugcucuuaaccacugagccaucucuccagcuccgggucuguguauuuacuuaugcauuuauuguuacaaaaauagggcuggacuucacaugcuggcuuuguaacuuacuuuguguccccagccccccuuuucauggcauuagaagccaggagcugcuuacaagcuaugacaagcgcuccaucaccgagguaccuucagcccuuggucucuagagauaggguuuugcuaucuagcucaggcuggucucaaaguuguaauccuccugccuuccaagggcugggguuauagacuuuuaugaaugaaauaucacuuaauuccuucgauagauagauaaauuugaggcuuuauaccuacagucagggcuaauuauaugcgacuuugaaaaccucuuugccgcuguuagguguuggcagugcacgacuguaacucuagcaaugucgaugcagaggcgaggggauuauuauuagguucggggcuagccugggcuacaaagcaauacccugucccaauaaagcagaaacaaauauauauuuuuucuauucaggauuuuuguaugcuguccuagguuuucauaaauaagucuuccauaucucaauuccuugcuaaagcacacaugcacacauuuccucaguugcuguguugguuuuuuuguuuguuuguuuaugcuguguuggggaugggucugaggguuucgggcacgccaagcaagcaugguaccaacugagcuuuagcccagaaaacucccuuccccuuacccccucaagggccaugcuagcauuuauauaucauagaauacuccuuccuaucugcauacuucaguggcuguuggguauguacacacucacacagucuuucuuagugugugcucauuaacccuuucaugccuugaaugaaauccaguacccugugcugcuugcuguuggcacucacaugagaagucuggucacccgacaguucucucugugucuggacaggaagcaguucaguucuuuaaugugacgacgcuccagaaggaacuguacgacuucgcucaggaacaccuaauggaugacgaugagguaagcucucgcgcucugcacagugugcccgagagaaaacaugacucgggucucugcuagagucacuucaaggcuggguacccccuccaaugggaaacagaaggggcccucgaggacacagcugcuguugggguuuuaauggacgccaguguucugguguggaaaagcacagagcuggaagcccaggcuagaccgaugcuucuccugugggggaaauguguuuggaguaugcaucagauugugugugugugugugugugugugugugugugagagagagacagagagagagagagagagagaacgggauggacugggggcgcuugucccaggacagcccuguggagucagucucugcuuccccccuuuuuguggguuucagggauugaauucaggccaccagacuuacagggcaaccacuuuacccacugaccccuccaccauguuuuuacaguggagucucuuacagaaccuggaguuuauuuauuuggcuagacugacugcagugagcucucaggagccuccuuucucuguccucuuccucaggguugaggugacaggcgugugcuacuaugcuuuggugcugugcgcgcgcgcgcgcgcacacacacacacacacacacacacacacacacguccucaggcuugagggccagacacuuucccauggacccgucuccccagcucuccccacccccuucuuuggagauaaggucuuggcauguagcccagguuagccuuaucugcccucuuuccugccccaacucuaaagcaauagaaugcuaggugugucucaccauguccuuucuuugguuuuauuuauauuuauuuguuuauuuguuuguuguuuucuuauuugugugggguaggggcaaaggcgugcuauaguaccaccacggaggucagaagacagcuugcgggaguuguuccuuuccuucuaccuugugggugguggggcuugaacucaggucauuuggcuccauagcaaacuccuucacccacugagccccucucaaagguccccacacugccauuuuugagaaguguagugaguuuuacucguucugcauguugaagacacuuauaaaucccaccccguuuuccuaccagguuauuaucauuuuauggcuguaaacgauauccuugcuuccaggagcgcauucuccaugcaagcugguuuucugacucgaucucccuuagccaaccuuagcccuuuuguuugucuguuugauguguuuugucauuuagacagcgucucauguagcacagguuggccuccagcuugcacuguagcugagcugaaguucuggccauccugcugggaccucucaaguguggcauuacaaacacgcaccaccacacccaguuaauucugauagcgggcaucagcuuaggacuuggcgcgugcuugucacgugccucuaccuacuguaugguagauucaucuucagguccagcuccuuuccugauccauccugacaggagcagcaugaagccgggccaugggaaagccaucaguagaaaccccuucuuauuuacuuagagagaugagauugguaggaacugggaaauccguuguaaaaaaguuggggggaaucaauguguuuggaggcauaagagaucugggagcucugacccauugcauccuagggaagcccggaggaugagaaguucugagagacacugggccccuccccacagcuccgcuccaccuccaacucuucuuaaggcucugaguaagacauggucagggaaguguucaccguccugguccgcauggccacugaggaagaaagugacagccuuuuaugaauuaggagcaaacauaacugugaacaccacuggauaucaaaguucugugcaagugaaaaagugggggccucgggguauacuucagugguauagcauuuaccuggcaugcacaaagcccuggguuuaauccccagggcuguguuaauaagggauuauuaaugaaugcauaggccugcaccuuagguuggggucucacuggagagagucccagggaugcugcugucagagcuggucccuaacauagcaacauucccacauggcugugguggcuugggaaguguggggggcuggcugcucaggguggagaguguuucugaggcagaaucaaggggccaggaggaagauggagaggggcccagugcagagaacccuguggagcccuucagggugguagcuagaccaccuacgugacacuggucaucugugagguggcaggcugcuugacgcugaggucacaugggguaggagauaaggcuccauuuucagggagagagacaacagcucccucuggguucuaagccagugagggaacuugcuugggccugagcagacagccauugguggccucugggaaacucucuuccugucucugaugccucuugugcccuguggccugccuaacugaggugucugccaucucuuacagggagagguuguggaguauguggacgacuuguuggagacggaagagucugccuaguccacaggggcuaaggaaccucucuuccgaguuccucuuucuucaagugccuggguuguugauaccucacagccuuuucuucuuaaaguaagaaggaagccaccaucucucccuaccaaggucaagccugacuuccccuuguucacacucaguauucacgcuugucuucaugguuacacgucuucaugccugucuuucccuucacacauguguucccgucaucuagucuguccuccucaaagucacguucgucuccccucugaucccaugugucucccccauguucagaaagacagucuucuguggucugcuuucucaucccugaagaaaaaucaguauuauuuuuuaaguaagaaaaacacuaaaagaugauaaauauauuuggagaauuucuuuggucucuccguccuuccagacguuccucuccuuuaugccacuuguuaaggacaaaagguggcagaagauaaaggcugaggucggggccucagggucaccuucacuugguucacuuggccugaccugagcuccaucuugcucacaacaacugaagguggccucugcucaguuccuuggaguccucagaauacaccagggguuacaaugucauuuaaugugaacaguacccgguuauaagucucaggguuagaaaugauacaggccagggguggauuuagcuuucuuuauucuccuaaggacugugggguuccuguuccaccuuaggcauuugacugacagcaguggucccauguggagucaccaaaggaaaagcugcuucuguuaguuccuggucugggagcugcaacagaauacuugacacaagcgacuucggaaggguuugucugacucucaguaagagggcggacuccaucaugaaaugaugucagcgggaagucacaguggagacaugagaucauggagguggggggucacaguggggucaggaggucacaguuggggagggaggucacggugggggcaggagaucacgguggugguggguggugggaguucacacuggugggaugucacagugggggugggaggucacggagaugggagguuggugagaaguggugcaggg

SEQ ID NO: 5350 - RNA, 73823 nt, Mus musculus
gggcggggcggagcugggggcggguccuggcauaggguccucaacaacccccggaggugcagcggcuggccagagcgcccacugccuaacggagagaccccaucguggcgcgaucaugcuccgggucccccuguguacgccgcucccgcuccuggcacugcugcaacugcugggcgcugcgcacggcaucuauguaagucuccggugccaccgcgcggggacgcuccgccgcugggaagcgggcagaggccgaggaaagccgcggcucugcaaagucgggauccggguuacccucgaucacccgcucagagcaggcaggccgccgaggcgcaggcaguggucgggccucccguaggaggcgggccggacgggcggggcgcgcguccuuccugguugcuggcgcgcguggguuccgcugcggcggucccgugugcacggaccugcuucccgguuugugcagcgcggucgggggcuagcugaggugcgccugagucuuuccagcuucgguuucuggggagagggguccaggcugcgcggggcugcuagagggcuccgcgggcaguggcguggggcgcgauccuugcggaguucgggcuucauggaacgcuccggaaggagaaaaaauggggucaggaguggcuccugcaguggggucacaggaauauucgcuuucagagacuucucccuuuucaaacauacuguucauguuucucgcuagccaccugcuggcugcuuuuaguuugaggugugcaucgccuuguuuguuggaagccuuuuucuucuuuuaggguuuggcggugcgggaggagggugggaagaggccaagugcuacaggcgaggucuggguggcagggcaguggcugaggcgcgugggacacgcaccuggggaggucugcaccgaaccugcgaaggggacagggcgugguggaacggggcuccuacucauuugcacuuugagcgagucaccuuggggcccuccagauggacugagucggguaaguucaaguacuugguaguagacuuugaaccuuguagacuuguaaaaauuacacucuuggaaauggcacacguuuaucuaaaaccagaguugaaacuuguuuaaguuucuggaaaacaguugcugaaaaugcuuucgauuaaggagaacgaaaauuuagugccggcugcuccgucagagcuugaggucuugagaaccagugggcagaggcuccaacagguaggggaaaggaacccauauaucuggagugucaggaugggcaggaagagauaaggauuuauggaggugucaccagucugauguaagucaccaggcaagaaauugaggugcccugugagagccgaacccugagacgcugcuuugugaucuccgcgggaauucuuaauuauguagcuaucccucuugagcaguuagauuagagccaagaaauuccagccaacuggcuuucaguuauuuuuguuuguuugcaucugcaacguuaacucucaaacuucagaccuagauuaaaaauuaaagccgggugguggugguacacaccuuuaaucccagcacucgggaggcagaggcaggcagauuucugaguucgaggccagccuggucuacagagugaguuccaggacagcuagggcuacacagagaaacccugucucuaaaaacaaaacagaacaaaacaaaaaaaaauaaaaugugugugugggguuguuuaguuuuggggggggaguugguuuuguuuuuuuuuccuuuuucaagacaggguuucucuuuguagcccugguuguccuggaacucacucuguagagcaggcuggccuggaagucagagauucuccugccuccaccuccuccuccucucccuccuccuucuguuguuguuguuguuagauuuauuuauuuuucuaugugacuauacuguagcuaucuucagacacaccagaagaggacauugggucccauuacagaugguugugagccaccaugugggugcugggaauuaaacucaggaccucugaaagaacaguccauauuuuuagcugauaagccaucucuccaguccccuccugccaaaccgauugcacauuaacaagcaauacacuuguaugaagauaugucucuccguuuugggcuagagcuguaauuacuuuaagagaagucuauucuuuugaguuugguuuuuuuuuuguuuuuuuuuuaaaagauuuauuuauuuauuauauguaaguacacuguagcugucuucagacacuccagaagagggagucagaucucauuaaggaugguugugagccaccaugugguugcugggauuugaacuccggaccuucggaagagcagucgggugcucuuacccacugagccaucucaccagccccuuuuguuuuuaaugagaaguucucaugaacccuggcuggccucaaacuugguauguaaucaaacauagccuuggacuuuugacgauucugccuuuaccuccugggggcugggaggaccugggugcaccaccaugcccuguuucuguggugcugagaguggaacccgggcuuuguucaugcuagguccucuacaaauugagcuacauccccaggcccagaaaucagaaucuuacguugccguuugcaaucugcagucaacucagauuuuguuguuuuuggaaaacuguauuauccacgcacuggaagugugaaagugagguuuuacuguuacauguuuacauguaaugacauuugcaacggugcuuugcuguuguuacgaaaacaguuuugacucaugagagacuuuccccagacgauaugcuaacaucugaucacuuagaauaauaacuuuccuauuauuaaaaaaaaagaaagaaagaaaacagacuggggacgggggccacucgagaagcagaagcgggagucucagccggggcuacacagagaaacccugucucaaaaaaaagggaggggggagaaugagaaugaaugaaugaaugaaugaaugaauauuagaauaugguucaugcccguuguggggaaucuuuaaccguaugaaacacuguuaagccaacaguaggaacugaggcuggagaugcgguuugguugguagaaugccugcuggugugcaugaaacccucacauaaaccaacugcaugguagagcaugccuguaauccccgcaccuguuggguggaggcaggaggauuggaaguucaggguauccuugaccacacugugaauucaagggcagcuuggacuacgugagaccugacccaaaaggucauguaucacgucgugagugccgugagugcggugcguuuuaacagcagagccuggcggcucacugguguuugaguggcuuggauuugaggcagguuggagcuguggccgcgguccgugggcuuugguugagugggaaugagaaugcucugcugaucuaucuaucccauaaagcugacaccaguuccugguugcaggcggagcugacccggaagucucucacuggccacuguccuuucucaggaagucacuugccccccagaguccacuggcacugagccuuggggggggacucuucaggagcugagagaaugacgcucuucaggcaguugucgcugggcuccaaggcugcccuggcugcagccacggucuuccuguccaugauccucucccgcuccuuucuggcugagacccuugagcuccaggccuggcgcuggcuguuccgccugcagcugauccuguuuguaaacucgaucaugcucauuggcuccucguacaucuggcggagcaccgugagcaaccucagccauuccccugccguggaaucuaccuguuuccagauuuggaagcuggcugucauggcguuucuggcccuggcacauuccagcuucuucaccaugcucuucuugguggccgaggaacccuacauguuuuccuuaacagccuacuccugccugggugccuacaucaucauggucuucuuccuuuguaucuugaaugccauggagcaggccuaccaguucuuagccuggcgcagcgguaggguggugggcagccuggacaagacaaggcaccuggugcucaggccugcgcuggcaguggccgugacggcggugcucaguaccauuggccuucugaaugcugcccagcccccaguggugaaaaccguggaggugcccauccaucagcugcccgccuccauggacaaccucaagauugugcuccuuucugacauucacuuggggcccacagugggcaggaccaagauggagauguuugugaggauggugaacaggcuagaaccagacaucacagugaucgugggcgaccucuccgacucggaagccucuguccugcggacggcaguggcuccuuugggccagcuccauucccgccuuggcaccuacuucgucacggguaaucacgaguacuauacaucggacgucagcaacugguucacacugcuggaauccuugcacguccggccccuacauaaugagaauguaaagauuucugcccccggggacccggacagugcggggagagauagagaaugggucugcuuagccggcguggaugacauagaagcagacauccuucacuacucugggcauggcauggaccuugacaaggcucuggagggcugcagcccagacgaugccaccaucuuacuggcucaucagccucuggcugccaagagagcccuccaggcucggccagauauaaacuugauccuuucuggacacacucacgcagggcagaucuuccccuggaaugucggagccuaucuccugaacccuuucuuugcugggcucuaccaagugggcaaggcgacguuuguguauguuagcccagguacagccuacuaugggauacccaugagguuggggagcagggcagaaaucacagagcucauccuguggcggccuucauaaaccugccccgaaggcccuaccuugccuugcccugcccuggccugaccuuccuccaucuccugcuccgucccagccuugccagcacgacuuuggccacagucugcugggaacagcguuugcaguggggaugccuggcaaguccgggcaggcuuaacucuucagauaaucaauugcuuuuugacgauacacccgugggucugcuuggccauggaagugcgaacaugcauuuguuuuccagcugcugcagagaggggguccuuuugcagggugugggguggcuggaaaugguacuucuugaccaaacgcagggagaggcaggaacgcuugucuccuguggguuuagcccguuagggcuugggugggcucugggauuauuugauuagagauagcugguuugggcaugggccauguugagagaggcaucaccucucugcuugccugaggagaguaucacuuuccucuuugucaaucaaggucaccuuuaucgagggcaucggcaagccccauugaaacauggggaccuuucugucugcaccaugaggggugcugauuacugugcuggguggcugggccaggguggcuugagaugaaaucauggggacugugguaggggaugacugccaucccuuaauggcagcucugagucccuguucuguguagucuuugugugagaucauuuaggagaggcuccuucuguguuugggggugaggaaggacacugggugugaugagauaccucuuuaaaaaaaggcagugacaaauacuucccuagauggcccuccacuccagguuccaacucagugugcgagggggagcugccuccuccuaaaaguucacucuacagccugaugguuuagcaucuuuagagguuacagugaacaugggguucuaugugcagauaaacaagacccuagagccccacguucccuucaaaauaguucacuuguuugaggaaggcuucaguucacucauagcuagaugaggggaggccucuaagagagucgcucauugcaggaggucaucuguuaaguucugacuaguucauugauuggcaccuccuacccaucacaccagccagguuugggccugagauuuuagagagaagcugagguuucuugucuacccauaggaaaccugaagcugccacggguaugacccagcucugccccugcagguugccccagaccccagcuauggaaagacaggacugaccgucuuaccugcguggggggguucuaacugaucuaccuuggccucugcccacagaagcauagggucauucauaggacuucagacccacaaggaaaacaaaaggagcuaucuugugcagugccagaagauuuguuggucuagccuuugccaggggcaagagagacuuugcccuucacauagcagagagcuagcuagcccuaagaaggcucuacugagauguguuuaagaacaucuagucagccgggcgugguggcgcacgccuuuaaucccagcacucgggaggcagaggcaggcggauuucugaguucgaggccagccuggucuacaaagugagcuccaggacagccagggcuauacagagaaacccugucucgaaaaaccaaaaaaacccaaaaaaaaaaaaaaaaaaaaaaaaaaaagaacaucuaguuagcugaggguccucugccuggagggggggcuuccugcugcuugugagagagaguagaagccuggcagugacaagacccccuagauucuuagcuuccaucaucccagaaauggcuguacuucuuggaucuaccucaaggcugcuuugcugagagaaugcugaaagcuuguaccuacagugaacacacaguauaaugcuaaugugcuaaucagugaaccaagaccugcuaaggaacauugccaagcacaagugccaagaaucaauccaguggguugccaauggguggcgugcugcccuccagcauagcccagauguccauaugacacuaagagccaccuuccuggugagugccugaguuucuuacacguacucugcuucuguaaaugggcauucuucacuucacccuuuugaauuuuuggugugaugaggucuggugugcaggaggcugcugacccauucuugucucccagcagguaggguauugacaggggaccaucugaucccuaaaucaagcaagcaagcaagcauaccuguaauucccagcacucaguguuuagagacaggaaaauuaggaguucaaagcuaguagugaguuugaggccauccugggcuacauaagauccugucuggggagugggaggaggaagagaaauaaagagcuuugccuugauacugugaugggcucauucgccucucaccccagacaggaguuccgagcacuaggagagauuuuguaaagaccaugaccuguuguugggauucuaggagaggccaccacuccauaccuuucaguaccuugcucccccagacuccucugagcacagccuacuccugccaccccuccaaccucauccuuucuccauguucuccauuucugcuguuucagcccuuuugggaucacggcuguccuuucuguucuccucagcuuuggaauucaucagacugagccgucuggaucuuucucuucagggcauuagacccauccugggucucauuuugauacugucaccuugugaucugugugcacacaucgccuauuuuggcuuucagguuguuuuguuguuguuuguuuguuuguuuguuuguuuuugaggcaggguccugcuuuguauaccagauggccuucaacucgaggcuauccuccugccucugccuccccaagagcuggaugccagcaugugucacccccaccuggcuccuucauccucucugaacacaaugggguuggguuaccucucggugagagauaaacuugccuugcaagucugagucccuggguucaaucucaggacaucacagaaaggaaaaacagcgggacagugaggugucucaacaggcggccucacaagccucacuucaguuccaucucuggaacucaugguggaaggagagaaccaaccccacagaacuguuccccgaccucccgcacggaugcggugccaugugggcccacauuuacacacaacgcagauacgguaauagaaagaaaauaauugcaacgagaugagacugccuguucuucugaaggucuguauccuaauagaagggaagugaugauucuguguucucaucagguccugucuccuugaucuguuucuucaccuucuucaugccuuccgggcucucaagcauguuagcacaugcgcaguguucaugacauuuccuucucugucccccauugacuccguccuaaggaggccagcugcucuggaauucaaacucuucugcccucgugcugccaugcccgcccucugacggucacuuuuauuucugugguuccaguuuuucuaugccccauuucccuucugaauucuguuguugggguguagcuaaagggcugacacuuguguugccaauuauccguuuugcuuacucuccugugguuuucuucugcuccccauuccauccaucucuguucuguuuguucucuuguuuuguguuguuuggagacagggucucaggguguagcccuggaauucacugcauagaccaggcuggccuacgaggccaggagagcugucugacucuccaugcccaguucuuucucuaauuucuugaggaagugccacuuuauaguucuauguuugaggcaaagucugaaaagguucaguauacugugcgggcuacuucucuuuaagucuguaguguuccucucacucaugagugcguguguguguguguguguguguguguguguguguguguguguguguuuaguacuaauauggaggucagaggacagguccucuucuuccugugggucucugggaucaaacucacauucugccaagcgccuuuacuuagcuauuauuauuauuauuauuauuauuauuauuauuagucacguguuggucugugugucugcaugugggccugugcccaugaaugcagaugccgagggagcuggaggaugggggcagcgauggcaggagguugugagugccugacgcugagccaccaaacucacuguugcuccaucuccugcuuccuauuuuuguuuuuaaaacgauaccucugucuuuuucccccacagaaggacaggauuaagcuaaucacuggugaggagagcgcaggaggguuaggguccagacacaagugcccgucgcucuugguguccuccauucugcuguccccucccuccccguggcaguguccucucuuuagccagguguuucagaugugaaggaaaaaaaguuuuugacgcaagacacauaaaacaagcaagaugaguaaguauaggugugugguagagcagguauccacagaucuguccuggggccauuuucgccgagaacuucaguugcuucacuccaccagccuguuggaaggacauccugaccacagcagccucuggacucccggccaucugaagucacucuuggcuugggccuuaagugugcagagcccuuccucccccucuuuccauagcccugggucucuggugaaacagcugaguuuuuccacccuggggcugaggugccccuuucaggaacuccgcgggccccuggggugaguuggcagggcucguggggugugacuagauacccacuggauuggaacuucccagcuuccucccagaaaaccuggagacaaggccuugcuugaccauuuaauuuauaaugacccuuaaccugugaugucaccaagcugcuuugacucaaguccaggaaugugcacgggggaugcagauuuguuuuuagcaccgaggacuagaacucuucggggagauguucgggguacccagagacacuuguacuguguugugguuaguguucuauuuuauuuuuuuuaagaugcuuauaacugaagauaucacacuggucgguacuagaccccugaugaguacuugaucugagggugucgugggcguacugccuuuuuuuuuuuuuuuuaaaccuccaguauuauuauaugcauuguguguguaguggggguggggacuccaggggaccugaacauccauuauggcugugcuugcaauuuguguuuuguuuuguguuccuguggcuaugcacuuuguaaaaacacugaugccacuacacccugcaagugugaaauaaagauuucucucuucaugaucacaauucgguguccauucuucagaagggacugggcaaacuugagggauuuuuucuuuuaacuacuaggagcuaguuucuugucuuuccuuuucuucuuuugcauucuuccuuccucccuccccucccucccucccucccucccuuucuauacucuucucucuucuccacuccucucccuuuucccuuccuucccuucugcuuccucuucucuuaaagaaauuauuuacacauauguguguaccuguguguuuaugugugccgugugugugcaguguccauagaggccagcagagggcaucagguccucuagagcuggcguucuagguggcugugagcugccuaacaugggugauaggaacugacgggggggggggggagccucuggaugagcggugaacguucuuuuuaccccuaagcaccuuucugacccucaucccuuccucccaccuccccuccuccugccucccauuuucuaauaaccucauauguaucaauggugcuguggcuggacauuuagguuggaucugcuugggcccuucaguguugagaguggauucuccccguucagcuuggcagugaaggugagaaaugaccaucuguccguuaguccccaccucugcugcuguccuuacugagaaccccccccucccggagcaaauagcacaaugcuguucaugcauugggugagcaggaaggucuacugauguccagugacgucauguauuauggcuaccacaaaacagcugacaaagggaacuuaaggagugaaggguuuaucuagucugacuuacucaaaaguauuacauuuguuaguauguguaugugugucugugcaugugcacaugcaugcaugugugugcaugcuacagaguacauguggcgcucacagggcaacuuuccccaagucaguccuuuccaccaugcaagucuuggggaaugaagcucagguugccaggcuugguggucagugucuuuacccugugugccgucucaccaccggcccucuuggcucacaguugaaggggguacaguccauccuggcuggggagggaguguggugagguacggucaugcugccugaguaaucagaaagccgagagggaacaggaaguagaaauggucuauaaaaccucaaaccugcccucagugagggucccuccagcaagagucggucugccuuccaaauguuccucagccuuccaaaacagagccguugccuguggacuggguguuuggacucugugccuaugaguggcauuucacauucaaaccuguaacauauguccuaacaguuguggucucaugugaccuggagcugggcagugacuguagcuccugaggugagagauggugaguacuacuuccugccugcccacaacagacugcuuuugugucagacagacauuuuuguuugaaaagauuucuacauggucaacaaagcaagugcuggaaagccaugcuuccguuuccuauauaacccacgccuguguuguagcugcucuuagagccaugcugcuauaaauaacccaguguuguccaccguggcgcuuccguuagcaggcgcccgcaggugagucagauggggugcgauagagaugaccuuaagccuugauggaggagaaccucguagcuauucuuccaggaggaguguggucuccuccggguuuuucuuaaggaagagacggagaguagaagguucuggaacuuucacugcacccauaaaagaaaguccucauacguggugaggguugugcuggcuguuaguuuggccccgcuuugcauucaagccaaggaaguaauguuaggacacacucucacuucugggauccacugugugagggacuugggccuucggggagagggauggccugacacaguucguagcaugaguguuggcuuaagcuguacuaacaauacagguaguuaauccuugugcaagcgaucacaccguaggguccuuccuucaggggcuagucaccccucccuuuaagcagugugucaggaaacugacucaaagcugggccuugggaaaaagcuccucagcuuucgauguuuacaauggucccccucgauaaugccaggaugucgcugucagcgaugagggcccagugucauggcagugucuuguccucauucaucuacugagaacucuaugugcuguggggcuucuaaaguuaccaaagcauuucuauuuauuuauuuacuuauuuauuuaucauauuuacacuguagcugucuucagacucuccagaagagggagucagaucucauuacgguugguugugggccaccaugugguugcugggauuugaacucaggacccguggaagagcagucaguggucuuaaccucugagccaucucugcagccccaccuuaugcauuucugacugaaaguacguccucugggccuccugaagcauauauggucuauauagucugacaguggguugccccuucccugaaccgaccacuccauugcucccucggucauaggcagcccugguuucuucucucccuuccugcaaacuagugucauguguguguccaagaaaccaucccaugagcuuagguauuagagcugacaucaagguaagaguuggugagucaggacagauaccccaugccccuguccucucccaggacaccauguccuuugcccccucuagauucauuccuaggguaccaccaagguuaaaccuucgaccuugcuuuccugguaggagaugagggucucuguagacaccgucacagaaguucaugccacucagagacugccccauguagccugaaccugucaguuccucucuucagaacuuccaaaccugcuaaacaagccagccagccucgcagucuguccaguucacaguaaaccgagagagccaagucacguggcaacuccugccugaggagaguguucagcaggucgugcacuugcugggagagccugaagacccgaguucugucccagaacccacggaaaggaggaaagagaaccgacuccacauuguccucugaucucuacgugugcacauguacaauaccacgcaagcacgcugcacuaguguguggacgcacacacucguauauauacucacacacacuuauaccuacauucacacacuuguacacacucaugcucaccuauaggugugcacacucguauacacacacuaaaguuuuagaaaugaaacaugccaaaucguccccuuuaagcuggaccucgucucucucuggcauaggugagggguguggcaugcauuuugggguauccuugcucacccauuacacacuaacuguaaggucugguugcuaaucagcaucucuaaccuccagaugccgccccacgcccaugugugggugucuguuacauuccucacugcccugacaagaaacuuaaggguucgcuuuuggauuguggugugggggugcgauccaucaugauggggaaggcacaaugguaggaaugugggacagacagcuggucaccuuggguccagaguggaaagacagaaaugagugcugaugcucggccugguuucucucuucauccacggcccccaacccaugcauaguaacacccacagucagagggggucaccauuuaaaauucccugggaacuuccucacagauaccuuuguuuuagucaguguuuguucuguugcuguaaagagacgccaugagcaaggcaacuuauaaaaaagcacuuaauuguggggcuugcuuagaguuuagaguccgcgaucacggaagggagcaggaccacaggcagguagacccggugccagggcaguagcugagagucacaucggauccacaagcucaagucagagagggggaauuaggaaugacuugggcuuuagaagccucgaagcgcacccccagugacacaccuccuccaacaaggccacaccucccaauccuugcuagacagcucuaccgucuggggaccgagcauucaguuauaggaggccauggguaccauucucaaccuccacacuuagccccuguucuuggagacagucaaggucuuaggccauuacugguaccacuugccuucauguagguuccuccggaaacagaaccuacagcaaggguuugggggccgguggcucgagaauccaaaugagcacaggaagcaggagcauggggaggccugugaauaucuacaccucauuugcuagcccaaacuguggcgaucagccagucugucugcuauuuaggacgauacuucucuaaguccucguuaacugcacccugcaguccuagguccggacgccucugucuucagccccguggagcuugugaccaguuccucuagaccagggaguuuuuccagaacccuucccgcucugcucaacgucagccucauugguaaagcagcagggguggggucugacuacagcuauggcccuaagucguaaucgauucgaccuuagggauaccaagaggaagcagagaauuagaccugagauaggggcuuucuucacagauuucugauggauccguggaggugccaacucccuagguggauaccagaccucgugugaacucucgcacuuguugugagauguuccagaaucgcugcgggcuaggaugcugacgaauccuggcauuguuuucugaaagcgucaaggugcacguggcagcuccuugaugcugggcugagaggcagguggcuucugguaccccggguuugguggguaccuguugccgguugcuaccugucuuuguccacuagggggcaguguuccacgcugccuaacagcucugauaggaacuccaaacuggguuccuugaaacuuuaugacauuucagccaguguacuggcugaaggucauauauaaguaacuccacacuauguaccaggcauuuuggaaguaauacuguacugugugcgcugcgcuguccucuguccccaugaaaaggugcuugauuuacuugccccagaccccguucaguucaauucacaaacuggguugugcccugcagcauugagccaggcgugguggcgcacgccuuuaaucccagcacucauuugggaggcagaggcaggcggauuucugaguucaaggccagccuggucuacagagugagcuccaggaccgccagggcuauacagagaaauucugucucggaaccccccucccccaaauaauaaugauaauaauaauaauaauagcguuugaacauuacuuuucuccaguucccuggugguuccgaaugagaugcacuugcccaggucacccugggacucagagcagcagcuaggauggggauccauggaucuguugcugcugcgugcguuugagacagggucucauguagcacaggcuggccucaaucuguauguagccaaggaucacccuggauuucugauccucuuuccuccacuucucugacacuacaucccccacaccugauccauugguuucugcacugccuuuuauagucccggggauccgagggacacugcuguugagcugauuggaguaccccugucuccaugccucacacacagcucaguggauauagucccagcuccugagcguccauaggcuccagguuuagggaguagagccaaaguaggagauagccuccuccacaucaccuuggcugggcugacuuguuuauaaguuauuguguaacuuaagucuacucguuguguaacuuaaucgaaaagcacccgcccccaccccccagcuccacuucugaccuaaagguucacguucucacggggucccuuacuugcccugcagaaugucacccagaggacauuuaagcucgacuacagccgggaccgcuuccucaaggauggacagccauuccgauacaucucgggaagcauucauuacuuccggauaccccgcuucuacugggaggaccggcugcugaagaugaagauggcugggcugaaugcuauccagauguaaggaaggaugcuugcccaagacccaccccuuucccccuacacacacacccaccccuacacaaguaggagagagcucugugugcagcccugcggggcuggcucuuuaggaguuugacuggccuuucuaaagagagcgaagcacuucucccuugaacuuuguccucagaaaccauaaagcugaaaucagcuugaagaggcaaagguaggaggaggccagagaguggaucagaagguacagaggucugcggccaagccugacaggcugaguucaauccuggagaccuacaugguagcagagaacaggguaucgucugaucuacauguguacacgcacauguuugugugcacaaacaauacaccaauaaagaugaaggcagguuuuauauauauagcucaugaaacuuacauuucugccaaggucacgucuuugguccgagguccaucgaggagccaaacgugagggguauggaguguggcugcuuuugguauggaggaagugagccugugcuuagguauuuggaacccagcuugucuuacuggguuaauuuuuuuuuuuugaacccaggcuauagguucacaucaacaggcacauguccccgucuccucugauucugugagaugacuaauugggggggaaaacuggggcagcugaucacucuggauuuugcagagccggugugaaucgcugauaacaucuuaaaagauaaagguugagaaagccuuaguggguuugguagauaccuaggggauccccccacuucuguuucuacggccccuggcagaguggaucuggguucgcucacaguuguuagcacgcugaguuccagugggcuauggcugagccuggaucuacggggggggggggggggggggaggaugcuuguggggcucauccuuaaggcuuucuugccgagggucacagugcacuguguauccgcaccagaggucggggagccaguuccguuugggucguucuauuuccuggccugguauucugacaaaagucuuuugucuucuuguaggguagagauuucuucugugguuuugcuuucaguguugagagccaaauucaggcuuuugcaugugaugggcaaggacuuuaccacaggcucuguaggucucuagacugggugagaguuuuguuuuguuuuguuuucuuguuauagaaguacauauagacauaacauauaacauauauaugucuauguaucauuugcuugcaaugcccucagaggccagaagagggaggcauauccccuggaacuguaguuucaggcaguucugaguggccaugugcuuaggaaccaggccuagauucucugaaagagcaguaagggcucauaaccacugagccagcucuggcucgcucucgcucucucucucucucucucucucucucucucucucucucgcucucgcucucgcucucucucucgcucucucucgcucucucucgcucucucucccccucccucccucucccccucccuccuucccucucucucucucucucccucucucccucccuccuucucucucucucucucucucucacacacacacacacacacacacacacacacacacugccccuuuuaaagaagauaggaucucucucuauguagcucaagcuaaucuagaacucacaauccugccucggccucuugagugcuaagauuauauuaacagguaagcaccaugccuggauuauucuuacuuuuauuaaaguguuuguuuuugagacgggguuucucuguguaccccggcuguccuggaacucucuguguagaccaggcuggucuugaacucggagauccacccgccugugcuuccugggugcugggauuaaagguaaaugcugugugccagccauuucuuuguuuauuuauuuuuuaaguagagucucauguagcccaggcuacccucaaaccuauugugaccccaugcuggccauuuaacccuuacccuucugccucuacuuccaagcgccacuguguucugcucaaccuuuauuuuuauuuauuuaaauuuauuuuuuauuuuuuauuuuuuuuuucuguggcaggguuucucuguguagcccuggcuguccuggaacucacucuguagaccagucugaccucgaacucagaaauccaccugccucugccucccgagugcugggauuaaaggcaugcgccaccacugcuggguuuaaccuuuauuuuuuaaauacguaccucauauuacuuuaacacgauaauuagaauucgugcauuuauuuuucuuguuaaagcuuucggugugcuugacgauauauuuuuuuuuuucugucacaguuucuauagauuguuuucaucaaggccugguuugggguuccauguuagaagggguguugggcacgcucaaggcuguguucgauucucaguguuucaaacgagccagguauaaacugaagccaaaggagaguuugaugcagagaggcguacagaagugaccaagaagcugucugaaauaaauccgccuuggcagacaaagcugacaacuaucauucauguccucagagcaguucuguggaugaaggccaucaccuguaauccuaccagaccacaaacaaaacuaaacaaacaaaaaaaccacugguucaucucuguucacgccaucuucccgucagucaggaagcaagagagagaaugaacaagguccugaguggcccugcuggaucaucuccagcgugucauagagagggcaugccucggccuccugauucaugccaggcucugugacucccaucccaguauucgcccgaccuggcuggcugugcuuagcuuccaggaucggaggcaaucugccacuucagugucauauugcaaaaacuggauauuaguuccuagaaaucccacuccuucuguaagggcuuucuuuauuacaccucguuuuuuaccucucucucucucucaccccccaccgugugugugugugugugugugugugcuguguguguauggaagacagggcacaggacaacguguagaaguagcucucugcuuacacuaugcugguucugggauugagcuucugggucaggcuuggcgcccccuuacccaccagugccuuagcacugccccguguuccacucuuagacccgaggugucaaaugcucacagagccugggcccccuucucuucccucccguucagcugccaccugggaggguuucagccgugugugucuucacagguacgugcccuggaacuuccaugaaccccaaccaggacaauaugaguuuucuggggaccgugauguggagcauuucauccagcuggcucaugagcugggacuccuggugauccugaggccugggcccuacaucugugcagagugggacauggugagcuuccaguugcaggguccugccugccuggugggugugaguaagggcaggagaggccgacgggauggggguggggcucugggcaaaguggauuaaagcgaucuaagacucaagagucuagagcaagugguacugugacccgccaguguuuauuccuucagcgaggugccaggcagcgaggagcaggcgggaggcagaacaaggggacuuccucauggcuuccucugucacagacauggagugcacucugcuuugucucccucauggauuaguuauaaaauuaagagaagcugugcgcauaaaaagagcucuagggcuuggagagauggcucagugguuaagagcacugacugcucuuccagagguccugaguucaauucccagcaaccacaugguggcucacaaccaucuguaauggaaucagaugcccucuucuggugugucugaagagagugaaagucuacagugugcucauagguaugaaauaaauaacaaaauugagcggggggggggauguagccccgugguagggcccuugcuagcaugucauuuccaacgcugcaaaagcaaacagcaaguaaaacuauaaggagagaaggaaagaaaaggagggagagaaagcaaguggcuggagagaugacucagcaguuaugagcacugccugcucuuccaacggaccuggguuccagucacagcaccuggaugguggcucacaaccucuguaacuccagcuuuaggggggaguccagcgcccucuucuggcugcugagggcacugcaugcacacagugcauacacauauacaagcaaaacacccacauacaaaaaguaaauaaauaaauauuuaaagagaaagaaaguggggagggguuuuacugaguguggugaugucuguaauccaagcauuugagaggcacaggcaggaggaucaaaacucugaggccagcaggugcccuagaggauguguggggguggguuggggggaguccaguuuuagacuuagcucaaaacaaaguggggauggugucuugauucucagaacauguuuaauagagagguccuaauuuuucuauauuguaguuucccagaagccugggucauuuuccccugucuuuucccucccugcugacagcgaucucuccuaaagugacaaacaaauuggcuguuguuuucucucucaaaggggggcuuaccugcuuggcuacuagagaaacaaucuaucguucuccggucuucugacccaggugaguuaccguugccccuuaaaagacuuacgagagacuagacacuugauaucaaaagaaccaggcauuugaagggggacuucuguauaaauaccccugaguaggguggaagucucauuucacuggacagcgaguauguaggagacacagcuuccuuugcaggcuugaacagaucucacugauaagcgggccgcuuuuugaguuugcaaccugguuggcgguuaaccaacuggguucagcacuuguauuuucuuccuacacacuuaguauauuacgcagccagcgagucaaaauggcaggguuguuucugggaugaugucacuaguuuucuugguagcugugugucuucugguuuuuuuuuuuuuuuuuuuuuuuuuuuugcauuuucagagugauuugucagugacagcuuuucgucuucucuuuucagaacaugagacauuauuuuagcuguaagaccuuaaacagucauucaguugcaucucuguuuucacaaaugugugcgugcguucgugcauuugugugagugugcccgugugugcucauguguuugugugugcaugugugaguguguguugugugccuguguguuugagugugugcacaugaguguguguacaugagugugugcaugugucugccugcaugugggccugccugcaugugggccugcacucuuaccuuauuacugcuguuuucacauguguugucuccugaaucuuccuaaccauuaaaaaaaaaaaaaacuuauuuauuuuugugugcaugugucugccugcaugugggccugccugcaugugggccugcacucuuaccuuauuacugcuguuuucacauguguugucuccugaaucuuccuaaccauuaaaaaaaaaaaaacuuauuuauuuuuaugugcauuggauguuuugcuugcuugaaugucuguaugagugugacagguccccuggaacuggaguugcagacaguuguaagcugccaugugggugcugggaauugaacccagguccucuggaagagcagccagugcuccuaaccccugagccauaucuccugauaacuguaugaagcaccuguuuuugucagucuccuuugagguuguaaacaaaugguuuauuagauguuacuuuggugugggagacacacaccuguaaucuucacacuuggaaaguggaggcaggaggaucaagguuucaaggucuuucucagcuacagaucaagggugauucuagccuuccaccuuuaaguuauuuguuuuguuuuggagauaagguuucucuguguagcccuggauguucugggacucucuauuuagaucaggcuagccaugaccucaaagaucuccugccucugccgcccccccgcccccggcacugggagcauacuccugccucugccccccccuccagcacggggagcacacacaccuccaugccuuguuaaugacuauaaugcaugucacuuacaucacaugcaugcuugcuugaugcccacagaauucagaagaggguguuggaugcccuggaacuggaguuaaacacaguuaugaggcaccaugugggugcugggaauuccacuuuacacuuuauauugcuguagguaaugcugacguucugauccuccugccuccacaagugcggggauuacaggugugugcuuucacgccuagcgcuggggaucaaacaccagggccuggugcacgcuagguaggcacgcuaccaacugagccacauccuuuacccagcuaacuuaauuuagaaggaaaaaaggcccugcuguguuugggaggaggacgcaguauucagcaccucucugugccuaucccacagggccuggcugccucugcuucuaacucuaagccccauagcaggguaaguugccaggaguacgcagaugucaggacaacuagcuuaaagaacuguguucagcagacuguggcugccucguuuuagaagauaacugagggcaguguauccugggacaggcuguggcggagucuccuggcuuuaaaaggaugaggcugccuagcucagcugacuugaauuugagcccuggaacccacugugggacuugugcucauguacucccauauacacuugcacacacacacacacacacacacacacacacacuaaccauaugacaagcuaguugacaaaggcuugcgacaguugccacaccauccuguuuugcagacuaccuuguagcuguggauaaauggcuggcaguccuucugcccaagaugaagccccugcucuaccagaacggaggaccgaucauaaccgugcagguaccuggagcugagcuguguguggaaggagggagagacgggggugcaaccguccaucagcguuauguaaaugacaacugacaccuggcugcaguacugaaaaugacacuuuucuuguaacugacucuggggaaaggguuagccugucuucuuucucuucucuucccccggcccccugucuaucugucucuugucucucuguccuucucugucucuauuccucuuccugucucugucucucuguccuucucugucucuauuccucuuccugucucugucucucuguccuucucugucucugucucugucucucucucucucucucugucucucucugucucucucugucucucucucucucucucucucucucucucucucucucucucucuccccuucaguuugcgucucauguaucucaggcugauagcgaacuccguaccugaggauaacuuggagcuuuugcuccuucugucuuaccucuacagugucgacaugacaggcugcaccacacaccugucguauguggugcugaggaucagaccuaagaccuugagcacacagucagucuaccagccgagcuacacccacagcccaggacccuugcccagaauuacguacauuuuauguucuuagcuaccacugaacccaaaaaauuccaggacaggauuugaacuagaaaaacaaucaacuuuacuuuuuuuuuuuuuuuuugguuuugguuuuugagacaggguuucucuguguagcccuggcuguccuggaacucacucuguagaccaggcuggccucgaacucagaaauccgccugccucugccuccugaguacugcaacuuuacuuuuuuuaauuguuuuauuuaaaaaaauuuaagcugggcagugguggugcacaccuuuaauccuagcacuugggaggcagauuucugaguucgaggccagccuggucuacagagugaguuccaggacagccagggcuacacagagaaacccugucucaaaaaaccaaaccaaaccaaacaaaauaaaacauuuaaauugcuuauuuuauuuuaugagaacaaguguuuugucagcguguaugugcgugcaccacaugugugccuggggccuauggaggucagcagaggucauuggucccccuggaacugguaugaugaauauugucaguugccaugugggugcugagaacugaaucuagguccucugcaagagcaacaagugcucucaaccacugagacaucucucuugucaucauuuuuuuaaauuuuauauguauguuuguguguguguguuugucuaagcuuaugugugccauguggcuucaggaaauggcagaguucugaagguauuagaucugcuggaacaagcuacaagguguuugggagccaucuugugguugcugcaaguagaucccggguccucuggaaaaggagccaguacucuugaccacugaaccaucucuccagccccacccuauuuauguuguuaauuguguauggacuugugugucugguugucuguacaugugaguacaguugcaggugaaggccagaagagggggcugguuccccuggagcuggaguugucggcugcccuacgugggugcugggaauugaacccagguccucuggaagagcagcugguguucuugaccacugugccaucucucuggcuccucgugcugccacauggcagcugacagccaucuuugguuccagggggucugaugcccucuucugucuucccuggguacugcacacacauugugcacauacacacaugcaggccaaacacccauauacauaaaauaagaagaagaaaguccaaaaagguaagugacuuagccagcaaugccuggcuggcaggcaggggaguuucaagcacacacuucgucugcugacaccagaguggcucguccuuguacagcaagcuugggcugugacuggcagaaagacuucgggcaucucugaaguggccagagcaagugacgaacugggaccgugcugguuccucucacacuugcugcugcacucuuuccccguauguuccgggcccugcaaagacacgugguuguaggugcaccccagggugcaaaauguguacuugacuuugaacaacuuucagugucuguaaaaugcuucuguggaacgugacgcccgguugagugagcaccagcagagcauauuuuuauggaaaggagcaaaguugugugagcuggcugggcccugagauaucaaauggaguguguuuuucucugaggacugugguucagaguccugauggagugggggcguggccauuggguauaggugaggugaggugaugaaccggcugagugggucagggauucucgcuuugaggggacaggugacugcucauugaggaauguagcuccugaccccugagugccccuuaucucucauucaaguagagcguguacaagaggccacagcuuccugugugaagccagugacucugaaagucaagcaagucuuugcucugcacagcuggaucaucucuguguauccaugugcacaugccuacacguaugugugugcacgugcacguguguccaugaagcuugucuguggaggccagaggaggauaccuguucaaucacugauuacccaauucccucgagauggggucaucccugaaccugcauuuauuaugauugacugauaaaaaucucugguuuggcuuuugagacaggaucuuagguagcccaggcuggccgagaacucccaauccuucccucuuuugccucccaagugcuggaauuuuaagugugccuccauguccuauauuugaucacagguuuguuuguuuguuuguuuguuuguuuccagagcugaggaccgaacccagggccuugcacuugcuaggcaagcucucuaccacugagcuaaauccccaaccccucaucacaguuuuuauaaaguuuucuuuagccaaagauacugaaaagucgugagcuaaagugugaccccugggaugcggucaggacugaaagcaagcaucaggcaagucggucucuccuaagcccaggucaaaggaaggagacccacgggccggucaaugguucaguaggugagaaaacacugcccaggcacgaggacuagaguucuaacccucagggcccaugugaaaagccaggaaugucuacaugcagaugugaccucagcacugggguagggcaaugggacaggaggguucaccugccuccaggguccaccuccuuccgggauuaaaagcgugcaccaacacugccaggcuaaaucaaaagaacuuuuuuaaaccaagaaauacaagaccuucuauuuuaacccugcagaagacagcaaaccugcacacccugaggauguuucuucuccuguccaucuugggcacugcuccuaccgggugacucugcucucugccuggucucccuccucuccagucacucaaaccucaggagccagaagcgaaguucgccguauuuugaguguuuucuggaaggcguuuuugucucuguuuuucucuucccuuuugcaguuuaggugaugugaccuguuuccuguguggcauugccaccucauuucccugucaaaggccuugucacaugcguacaguuuggacaucgucuacaguucuuuguacauaauuggaugucucucuccuugucuuucuguuuguuuguugcuuuaaggcauaguuacccugcguagcccagacuggccucagacccugucugugcuccuccugccuuccugguacuagaauuauugaguguggcccaccaggucccaccagccucuaauucaaagcguaucugagguugaccuugaacuccugauucucccaccuuugccucccaaguucugagcuggcagaugcgcuccugugccugguguaugcaagguugggaauccauacugggccuuuuguaugcuacuuaagcaagcacucuaccaacggagcuacuucccaaaucccaccccacuaacuuuuuaaagacagggucucacugaaccuagggcuugcagagugacuagacuggcggcugaucagcgagucccugguccacccgucuccuccucucagcgccaugguuaccgacaaugugccaccaugggugcugggaugccaacucgggucuucacccacuugaucuuaaucaagaggcugagacccaauuccagucauggccccagccccugcgugucgacuaagcuaagcuagccuugggcuuucagugggccaccugcuccugccucuugagggcuggaguggcagccguaccccaccacacacagcugugacaguugcuuuugucugucucuucagccagcucuagaggcagugaggucuucacccagagcuugaccuuggcccuucucaugggagcccagggaccuugaggaggagagguugugucuguaaccagggugaagaggguugguugugucuccaccccagccugaggacaccaaggcucuucucccuuugcucuuccagaucagggacaccaaacuugccccagauacgcaaaugauuauuuucaggagagauaaagcaagccggggcacagaggaugggugggucucacgugaaguguuaaucucgguuuuuaaccuaaaaaugaaguaaaacuagugagucaugcugcuucaggccugucaacccagcucccagaaggcugugcugcuucaggccugucaaccuagcucccagaaggcugacacaggagggcugccaugcguucagggccagccugggcuagugaguucuaugcugagcuauagugugaaagcacugucucaaaccaacagcaacagcaaauaaaguugacagcacccuuuuguuucuggggcggggcggggaggggucacucucuggacugaguguucccagguuccuugggucuuuuucagaaaccggaagaaccccaugcaggcugucaugacaggaggugugcggaagcagagccuuagcaaagagugugugucuauaaccagugcugccagagaagagcggccucuugacuuagggcugugguucccagccugugggucgaacaacccugucucaggguucgccuaagaccauaggaaaacaaacacagauauuuacacugccauucaugguaggagcgaaacuacacaguuaggaaguagcaacgaaauaguuuuauggcucaaggucaccacaacaugaggaacuuuauuaaagggucgaagcaucagggagguugagaaccccugaguuagaguaaagcucuuuagugccuggguucucugucucagccaggguuacgauugcugugauaaaaacgaggaccaaaggaacuugggggaaggaaaggggucauuuagcuuaugcuucaacauuguagagucaggacaggaacuccggcauggcagggaccuggaagcaggagcugauggugcagaggcuauggacaggaugcugcuugauggcuugcucagccuccuuacuaauagaacccaggaccaccagcucagcgauggcuccacccaccuaggcugggcccucccccaucaaucacuaauuaagaaaaugcccugcaagcuggccugcaaucugacuuuauggagguauuuucucaauugaggcucccucuucucugaugacuauagccaacacagccuccuuuuugggaaggguagccaaagcuggguggcuaguuacuaaggggugaacuaugaguguuggugggccucuggguguuuuccuuugugugugugugugcauugcacacauguggcagucagaggacaaggcuugggauuggguucauuccguacuccaggcuagcuugcucaggagccccugggagagucuccugucucugcuggucucucccguauucccacccccauucugccacaggagcauggagauaauagaugugcgcuagccaccacauccaucuuuuuauauguguuccggcgucgagcuuggggugucggucuugugcagcuugcuccuuuucccgacaagucaucucccccuguuuugauugguagauuugagauaugcaaacguuucucugauguauaugucuuuucccacauugcuguuaacccuguguacauccaauuaugcguaggcauaagauuucagauaagggauucucucaagagggcacaguuggcuuuauugugcaugcacgccagaccaguucagacuggaucugggguauguuuccagagauugguaagguuguguuggcaucugcugaucucugguccuccuuucuaaacacacagguugagaaugaguacggguccuacuuugccugcgauuacgacuaccuacgcuuccuggugcaccgcuuccgcuaccaucuggguaaugacgucauucucuucaccaccgacggagcaagugaaaaaaugcugaagugugggacccugcaggaccuguacgccacaguggauuuuggaacaggucgguguguguagguagcaucuagaaaacagcuauugcagauagagugaggugucucagaguuuccucuaucaggugggcuagcgagcuuugcgugacuguaacaaaauaccugagggagucaacuccuaaagagggaaggcucugcuuuagcccacaguugcggcuucaauccgccaucuguuuguccuguaauagagagaaccuuucugggagcauauaaugaaaugagacccuuuuaccucauggccugagacccucaaagagggagagaugagacugccacccucucuuucagggacaugugcccagugaccuaaagucuacugagcucuguccaccccaccccgcucuguuugagacaggauuuuuuuuguaguuuaggcuggcugcuuauucauggucuagccaaggauggccugaagcucuggguccccuuacuuccaucucccaagggccggaguucuagaugugugcuacccccauccucggcuucuuuguacuauucuuccacuuaacaagagucaaggggucggcaagauggcucagugacugagggugauugccaccgaaucugaugaccugagagugauuccugggacccacagagugggaggagagaggugacaacuacagauuguccucugaccaccaagagcauugcgugacaugugcacaggcacacaaguacacaugaguguacacacguguguguacacaugcauguauacauacacacaaaauuaccaaauaaaaauguaaugaaaaaaacagauucagccgacagauuagagcauagagcauaccugcaaucccagaaauuaggauacaaguggggggaggaccucugaguucaaggccagcuuggucaguggagaaaguacagaacagccagggcugugcggggggggggggggggggggggcgggguucgaaauaggguuucucuguguagcccuggcuguccuggaacucacuuuguagaccaggcuggccucgaacucagaaaucugccugccucugccucccaagugcugggauuaaaggcgugcgccaccacgcccagccagaauaaccgucuugaaaacaacaaaaacaacgaggacagauucagauggagauuaaugaguuuuacaacagggggcugggaagauggcucagugguuaagaccucuaguugcucucaaaaaggacgaggguucaauucccaguacccacaugggaguucauacauacacacacacacacacacacacacacacacacgcaaaacaccuuuuaaaacagaauuuaaaacaggcuggagguaugccuugguggguaagaggacuggcugcucuuucagaggacccagguucaauucccagaacccacaaucaccuagaacugcacuuccaggugauauaaagccuucuccugaccuccacacauagauacacaaacauacacauagaauauauauauguauauauauauauauauauauauauguauauauauauagagagagagagaguuuucaagacaggguuucucuguguagcccuggcuguccuggaacucacuuuguagaccaggcugaccucgaacucagaaauccgccugccucugccucccgagugcugggauuaaaggcgucgugcgccaccaugcccggcuuuaaaauaauuuuuuaagugaauguucaaugugagucuugacaguaguagcaaguuccaggcuaaggcuaugugagacccucacuuaaaaauuuuuuuuuccagggcauaguggugcauaauuauaaccccaguacuguagauacacgaaggcaggaggauugcuuugacuuagaggccagcuggaacucuaauauacuacuuaauacauucuagacuaggaagacuacguacuaauacccuauuuugaaagauucacaaacaagggagcuggagagauggcucagagguuaagagcaucugcugcucuugcagaggaccugaguucaggccccagcacccacauggaggcucauagccauuuggaauucuagucugucuuagugagggucuuacuacugugaacagacaccaugaccaaggcaaaccuuauaaggacaacauuuaauugaggcuggcuuacagguuuagagguucaguccauuaucaucgaggcaagaacauggcagcauccaggcagccauggugcaggaagagcugagaguucuccaucuucaucugaaggcugcuaaguggaagacugauguccagacagcuaggaugagggucuuaaacccacacccacagugacacaccuaccccaacagggccacaccuucuaaugaugccacuccuuggacugagcauauacauauacaguuucgucacacagucccacagaaucugacacccucuuucggccuuggcaggcacuggaugcguguaguacacagacgcauccucuggcauacgcauguacacauaauaaguuuuaugaagaggaugcacacagaaauaggagggagggaggagagagggagggagagagguucagaacagcaguuugaauggcugaggcauacagauuauccuccaaugguggccauucaccagaggacacaguuagaguggccuugucucccugugccuguuaguuagcugguagguaucuguggcugucccgugugggcagugcuguggagugacaggggaggucucuagaacagacugguccuggaggggaacagguaguucagccucuggcuguaggcagacauggggucagggggacagcuuagaaggcagagcuaugagcuccucaggccugcauucgaacaaagccaugggggccugcucagggagaccgcuguguggggugguccccguacguugcucacacgggccacccuagggcaauucauagcuauuccuugggccuuugggccuugaaacuccuguggaucaaggaaagguuuaugauauacaugccuagaaauuacgaagggaaaaggagagagugugggggaaggcaggggacuaucuugcuccauuuaagcuguuauuauuacuauuguugcugacuacagggcuguagacuacagggcuguaauguaggcuggccugagucuguguguacaggggacugagcccagggccuugcgcaugcuaccagcugagcuaaaucuccaacccaguuuggguuauuauagcaaaugacugagcugggcauagugguacaugucuauacucucagcacucugaagacugaggcaggaggauaacugaguuugaggucagucuggguugcauggugaauuccaugccagucagagcugcauggugagacccugucucgggaaaaucuaaaagacauaaacaaaaauugccugccccgcucaccguuccaagugcuccaaagcccaagaucaggguccccucaaguucagggcugaguuugggucucuccuucaacucaguuuccugaugaguccuuauguggcagaaagggguaagggcauaaaaugccauuauaaggcauuaaaugccauuaauucauaacaggggaauaggagggccuggcuaagucacuuccugaaaacacaucuuuaagacaaaguuuuuucauguauuucuuuuuacuggaggagggugcucaagagccaggcacggagcauguguagaggucaggggauaacggauggcagucauuuucccuguuguaccaugccaguccuggggauugaacucagguuaucagccuugguggcaagcgccuuuucccucugagcccucuugccggcccuccacuucucagacauuccuauuugggauuauaguccaacuuuugaauucccuaccagugaccuuagcaggcugguuagcuccuuaugcccgugacggacucuucuucucuuucuugaaauuuccaggcaacaauaucacacaagcuuuccugguccagaggaaguuugaaccuaaaggaccuuugguaagaacuggggguguggggaagagacugagcuuguacacagcucuucccagaggaggaggcaggcugcagaagagaauggguccaucuuuggugguuuauuuuuuauuuuuggcucugggaucagcagcugaugggacuggggcagaagggaacguagcccuuccugacuccugagugacagcuggauuggugcuccaguuuggagacuaaagcucuucacgcgagugaaggagaugcagagaaccaggacuggccaggacuggcuucggcucucuugguuuuuuugguuuuuuguuuuguuuuuuuccuuuucucuccucucuccccacuggaucucagguagcccagaggcucagaacucaguguguaauggaggcugaccuuaaacuccugagacuccugcuuccgaugauucucagccucugggacuaagugugcacugccacacccagcuuuacgugguaacucgcacccagaugcuuucugcacccgaaggaaggcuggugcucuaacugagcuaccucuccagggagcaaaggccaguugcucugaccugaggagccuagacauggcugggacaggaucugguucacauguguauucuuuaagguuuauuuuauuacuacuauuaugguggugaugauggugaugauggugaugguggugaugaugaugucuguguacaaugcacaugugugggugcucucugagaccaaaauggcauguaggauccccuggagcugccugauguggggugcuaagaacggaaauccaguucucuggaagaacagcagauacuuuuuugggggggggcguugcuggggggagguucaagacaggauuucuuuguguguaucccuggcuguuauagaacucgaucuguagaccaggcuggucuugaacucgcagagaucuuccugucuuuaccucaagugcugggauaaaagguguggucaccacaugcucagcggauggcuuuuaaccuccaagcagcuucuguagcugagagacuuguuucuuaacucugcaagcuucugcacccugcccccaccccccacccccuuaccccuccccgcucuugaugcucugguugaaauauggaauuaauucugcugggccugggagggccugacuguuccuggagcagagcagccaggaagcggcaagguugcaguuuugauaagcagcucugcugagccugcuggcuugcugggagaagaggccagggcugccuggaccucugucaggccugcauucgcagcucuucccuccagguugcugcaacaagccuuguuugcaaaaaaaaaaaaaaaaaaaaaagaggcucugcuggaggucugcacugcagagccugcucaggcagguggagccauuuccuggaaccucuccagguucccuuucucuauucugacuuugaacugauguugcuucuggccagcaggucucaagaucaguauucacacaaaaagggugaauugugcguaauggauaaauguggggcuagauguuugcuguuguuguuguuaauggguuaggguuaggggguuagggguaggguuacagagagcccaccagaucuuaccagagauaaccacuuagacacaguuuauacccaguugaaagucuuuguucuagcuagcugggacuacacucaggucuuggugaccucaguguagcccugaggauuuagaccaaggggcuuuuaaaggaaaaaacaaaacaaaacaaaacaaaucuguucucucucuuagcagcuucaggggaggauugcucaagcaagcagauuaacagaagccaggaaaguuuagcugggcaucugagccucagggccuagaauagaauuggaugcuuuuccacuggauucuucaucaaaaggauuaaauacugauuaaacccaaaacagccucaucaaaaauacaagaugggccaggcaaggguacacgccuuuaaccccagcacuugggaggcagagguaggcagaucucugugaguucgaggcuagccuggucucuagagcaagauccaggucuauagagugcuguacccucugcacugucuugcucugucacacggguauugaauacagggcuuacaucugguaggcaauuucucuaccacugagauacauccccagcccuuggguuuuguguuucguuuccaauacagucuugcuagguagccuccaguuucagauuaacuaugcagucuagacugacuuugaacuccgaauuauucugccucagcuuccucagugcuuagauaacaguuaugugccaccaugucugaccagagcugcuaauuaugaagacaccaccuugccugacuaaauguuuugguauuggagggaaggggcagggagugugggacauucccagcugacaaaacugacaaagguaaaacuuuaggaaccaguugucccaaaauacccacggagaaucgggugugagauacccaagucccuccuguaagaugaugcgguuccuauagauuuaaguugcacauccuguccuuggcauaauucuucucuagguugcuuguuccagacccaguauagaugcuauacugagagucauaguaauuuaucauucagguaauaaugacagggguggaggaguuuauacauguucaguacugaugcaaaguuuuucucaaaaaauacauuuucuuuuagaauauauggucucauguagcccaggcuggccuccaacucaccacauagcuaaagaguaccuugagccgggcgugguggcucacaccuuuaaucccagcacucgggaggcagaggcaggcggauuucugaguucgaggccagccuggucuacaaagugaguuccaggacagccggggcuauacagagaaacccugucucgaaaaaccaaaaaaaaaaagaguaccuugaauugauaauccuccugccucuaccaccugaguccugggauuacaggugggcaccgcccacgccuaguuaucacagggcuggagauggaacccagggcuucaaucacucugggcaagcauucuaccaguugaaccaugccccagauauuucugauuguuaauagguugggucuacaaugcagaacccauggauuuggaggguugacuguaguuguaguauguaagaugaaaugucacuauugguggacacucagagacccaguauagauacuguuguaauuggagguccucaugggacccucccuacauuacagggacaccucagcaucaacucaagguuguaagugucuccugagcaccaccccuuuucccuuucagaucaauucugaguucuauacuggcuggcuagaccacugggguaaaccccauuccacggugaaaacuaaaacacuggcuaccucccucuauaaccugcuugcccguggggccaacgugaacuugugaguacccaggacugggagagggagcccuguggcuguggcucacagugaaguauguguguucucuuauuucucuguagguacauguuuauaggugggaccaauuuugccuauuggaaugguaagauccguuucacauccauugguaaaagcuuauccuguuuccaguguaugauuugggggaugguguaucuacuggccaauuuuuauuuucuguuuccauuugucuucuaaauuuucuaauguacaagaaucacucaucuaaagccaggugugguggugcaugccuuuaaucccaacacuugggaggcagaggcaggcggauuucugaguucgaggccagcccggucuacagagugaguuccaggacaaacagggcuacacagagaaaccccguaucgaaaaaaacaaaacaaaacaaaaacaacaaaaaucacccaucuagucauuugagugugaaaccuuaagggccguagucugaucauuuaagggucuuauuuuuaagccagucugccuggcagucuaguguggcgggguauguguuuacauacuccgcuuuggucuuucuguaugugcguucaugcauuuugcaggggcauguauacauguguaucugugggugugcacacauguggaggccagggacagccuccagugucgucgguccuuggacaccagccaccuuuuucuuuuucuuuuuuuaaaacaagaucucucacagaccuggaucuuaccaaguagacugagcuggccacugagccaagggagccaucugucuccaccuccccugaucugccugccugccugucugacucucauuauuacauguauuuacuuacguguaugugggggucaaagaacaacccgaaggaacugauccucuuccccccgcgcugugggugcuggggauugagcucagauggucgggccuggcagggcagagcuuuaccacugagccaucgcuccacucccguuuuaauugucuuuuuuuuuuuuaaagauuuauuuauuauuacguaaguacgcuguagcugucuucagaaacuccauaagaggugaucagaucucauuacggaugguuuugagccaccaugugguugcugggauuuaaaccuucugaagagcagucagugcucuuaacugcugagccaucucuccagccccugguugucuuuuuuaaaaaaaaauaucauaaaauugacaguguuaaauaaguauucuaaacacuuucaaaguugaacaguccuuacccccuacuucuggaacauugucccacccuccagaaagaagcugcacacuccacacugacuccccucuccuccucacggccccuggaggucacuaagcucuuccaugcugccaggggcucuccugcucuggauauugcuuauaaacagagccauauaaugucgaggugauuaauuacaaguaaucugaugucuuugauuuagccuaauauguucaaggcucauccauguucuuuuguguauuaaugcuuuauuuuugucacuaaauacuauucuaggguuggggguaugguucaggugcuagggugcuugucucgcaugcacaaggcccuggguuugagccccaugcacagccuccacauggugggugguaugcguuucuaaugccagcacuuggaaggaagaggugaaugguaguuuucagguggcacaagugggugagaggccacucgugacagucuuucaaaaaauaaagaaagcgaaggcugagucagaugugguggugguaaccgguaaucccagcauuugggagguagagacagaguuacuacagguuugaggcuagccugaucuacauaaggguuacauagggagauucugucucaaaacaaaaaguaaauaaauaaauaauagaaucuuuuuuuuuaaggauuuauuuauuuacuuuauguaugugaguacacuguagcugucuucagacacaccagaugagggcaucagaucccguuacagaugguugugagccaccaugugguugcugggaauugaacucaggaccucuagaagagcagucacaugccuuaaguagggacucucccccguggugcugauaacuugcugugcaaacacaucgaccugaguuugagcccuggagcccaccaaaaaaaaaaaaaaaaggcugggugucagcacucaggaggcagagagcuuugagaccagccuggccugcagagcaagucucaggacagcuaaggccccacagagaaacccugucucaaaaacaagacgaacaaacaaaacaaaggaaagaagaaaagaaaagccaagccgggcguggugaggugaacuucuguaacccucgugcuagaaaggggagacaggcagguuucuggggcuugcuagucauuugguguagcuguagcugaauuagaagcuccaagcuggugagauacccugucuccuaaaccgaauugagagccaaugagaugguccaguggcuaaaaguucuugcugcccagccugaagaccugauuuugauccucagaaccuacgugauagaaggaaaggaaauggcuccugaaacugaccuucccaugagucccggggcacauaugugaacaaaauuaauuaacucaguuuuuucauccauucaaaccaagaugguaggcagaaguucuggcuuuuauaugcauaugcacgcacacaugugccuccaugugcaggcguacucauacgugcaugcauguacucacacacacaauaagaacuagaaaaguuacacuuguuuuuccugaacgccacacacugauccucccccacccccucgccaggcuuaggcugaggacccagggucggccagcacaggcuggucugccuguaaggagugugacgcuuacagaugagucaagugagaagccacucuggaguuaaaccacacagaaggugaacuccuuaggugaggaugugguuuuuaaucucgcuguaucucaugggaaggaacguauuugaaccugugcguccgcccaggcaggcagaccugggggaaagcugccucugaggacuagggaguagaggauguuaauacagcagucuguuggcugaaggucugggucuucuaaggugagauucugugcggagcagcaaugaggaaguuagcgcugaccugaugcccacucguugauaugucagcccucugacagcugguccucagcccgucacuugugaacuuaccgccaagcacugacgaucuguuauguuuggagccucauuuacuuacaaauuagagccgucagagaacagcuucguucucgagugugcguggcagagggcugcugaguuagaaggggaagaaaaccuugcaggcucacgguuagcugcaguagugucgcuaucucaagggcugcaggugucacccucuagguacagugccaacuuagccugcacaaggucccaguacugccaaaccagguuuggugauacauagcugugaccccagauacacacccauagucccugauauacaccugugaccccagauacacaccugugauucuagcaccugagagagacaccugggaucccagauacacaccugugaucccagaaacaccugugacccucugacauacaccugggaccccagauacacaccugggaccccagauacacaccugggaccccagauacacgccugugaucauagcaccugagagagacaccugugagcccagauacacaccugugaucccagcaccugagagacacaccugugauccugacaucugagagauaagaggcagaagaccagaaguccguuaucggccuuggaugcauagcuuguuugaagcuauccugggccucgucugaaagaaagaagaaaagggacgaaagaccaccccugcccccagcccacccccaaucccucacaggaaccagcuuccagggcaggacuccucaugugucucucaugcauggguaaauuuccaaaggacuggccaaaagggaaccuaacccuguaaguauccacuuugacaagcuuagaaguuucuggucuagacucugcaccaugaacaauaauugcaagggauuuuuuuuuuuuuuuuuuuuuuuuuuggugcuuuuaugugcccagccuugagucugcucauuggucuugucacaggucacauucugggaaguuguauugauuaugcuucccauugcugugagaaaaaccuaacaaaaccaaaccugaggaaguggucaggagcucgaagccguuggccgagucaucucugcagucaggaaagggccagagaugagugcuggcugggacucgacugguuuugucuuuacugugggacaccagcccaugggaugguagcuucuucccuaucuagguagagccucuccuaggugcgucuaagucaauaauaucaauaauauuauugacugucgagucaauaauaucagccaucacagaaaauguuccuuggguauguucucaggggcagcaccggucccacaaaaacaacaggguguagaagacaaggugauguaacugugaaugagaugggggguugggggacaugugauguaacugugagagagaugucggggugauuuaacucugugagaaagucgguggugauguaacucugugggcgacuucggccuauccuaaggaaaccuuagagucuugggggcaggggggggcagggaaaagugguucuacguccccagacugauuggcuguuagagaaaggcuuucccuggagggauguaaacggagaaaaagcagaucagagcacuggcugcucuuccagaggacccagguucgauucccagcacccacaucugcagcccuagucccaggggaucugauacacucuuccagccucuguggaucacacacggcgugcagacauauaugccugugaaacacguaugcacauaacaugcaaaaugagagugaccuugaacuucuaaucuuccugcuccaccucccagaugcucaguuacaggcaugggccagcacauccggggucugcugugcugggcaagugcuugaccagcuguagaaaugcuauccccccucuuaccauuuggggcuuuaaugugccuuccacuucuccucaccccaacguugagccccugagcaaugaccucaagugacugacuggugaccuuuucugucuuccaggugccaacacgcccuaugagccacagcccaccagcuaugacuacgacgccccacugagcgaggcuggggaccucacuaagaaguauuuugcucuucgagaagucauucagaugguggguccuucgaacucucagagagcugggcugcuggggggccugcugugaacuccucauggcucuguggauggaucccuugcuaacggaggugaaggagggaggcacagguuuuggguacggugugccuggggaagaccccaugaguuuaucagcaaaggcucuaggcucugcacccuucaucugugaggcugggauuaggguuccuaaccaugcgauagggagagcaaaggacaugugugagccauccggcguggucucugacacugugggcagcaaguagaagccagaagauacgucccugugguggcucgaauguauagggaggaaaauugauagccaccagugugcagagcaucuguggucugugcagagggagaugcugugcuccaccuggggcagucgacugcuguuuccucuagcuggcucgggaacgucucuguucugccagcagccagccuuugaagcaccuaaagcucucaggugggguuuccugucucuguggugaauugaaaaaaaaaaaaaaaagcaaacccacaauuuuuuugcucagucaccugguuuugaaguuuucugccaauaagugguaaaaguuaggugucguguaaugucaguguaagcauguguuaagauuuguguucagaaauauuuucauauuuugggggggaggggggcuuauguuuugagacagggucucucuguguagaugagauuccuacuuugaacucacagagaucugccugccucugucucccgagagcugugcaccaccaccuggcauguuauggaaaaagagcaugauauaaaccuaguguggugcaugccugcaacccagauacugagcaagaggaucgaucaggagucaagucauccucaauuauaugauggcucgaggccucagcuacauagaugaaagcagagaggggaggaggggggaagaaagagaaauauauauuuucauuuaaauuuccuuucucuuuuuuauuaauaguuuuuuauuuauuauuuaagauuugccucgagccaggcaugguggcgcacaccuuuaaucccagcacuugggaggcagaggcagguggauuucugaguucgaggccagccuggucuacagagugaguuccaggacagccagggcuacacagagaaacccugucucgaaaaaaccaaaaaaaaaaaaaaaaaaagauuugccucuguguguguguguggauacccaagggucccaaaaaggucauugaauccccuggagcuggaguuagcaggcaguugugagcuguccaauguugugaauucaaguggaguuuccugaaggagcaagaagcccccuuaaccuguaucugaauggagccuccagcccaauacauuguaacucuugauacacugagucugguuucuguuuugcaccuguguaugucucugauuguaauuguaacuuuuuuuuuaagauuuuuauuuauuauauguaaguacacuguagcuaucuucagacacaucagaagagggcaucagaucucauuaaggaugguugugagccaccaugugguuguugggauuugaacucaggaccuuuggaagagcagucagugagugcucuuaagcacugaaguaucucuccaacccguaauuguaaauuuuguuguuguuguuguuuuauuguuguuguuuuucgaggguuucucuguuuagcucuggcuuuucuggaacucacuuuguagaccaggcuggccucgaacucagaaauccgccugccucugccucccgagugcugggauuaaagucgugugccaccacgcccagcuuauaauuguaauucuugauacacagagacugguuucuguuuugcacguguguauguuuguguuuguaaguguagcaugucuuccucagccucuccccacccuaguuuugaggcagagucucucacugccccuggaguucacuggcaagcagcgccccccgccccccuacucuccaaugccuagcuuuuuguggguccggggguuagaacucagcuccuuugcucgaguggcuggcacuucagcaccugagccccaugcagagaucaauuucggcuauuauuauuauuauuauuguuauuucuucuuuaugcuccccguucucuuauuuuucuucucuguauuacugucucuucgccuuguuugaggaugcuuuuguuuucuuguuucaccaucuucugguuaggaaguuuguuuuucucuguguuucugguuucuuaccuauucaagcauguuaucucuuuccuuagaagaacaaacaaggcucccaaggcuacuguguaugggaagugagcugucacagcagccaacgcccugugggagccucccugauaccccccugcccugagcuagccauugccucaacuccuguuaccacauagucauggaacuuguuuugaacuugaaauaacuaaauucauacaaacacaaaauggauucauacaguugguaagucuggcccucaggaagcuccgccccucaguauuaguuuauuaaucacguagagccccuggauagagagugcuugccgggcacacguggagcccuggauuugaucuccagagcugugaaggguguggugaugcaguccuaacauucaggaggaggaagagcaagagauucagagucauccuuggcuacauaguaaauuugaaaaauguacuaaggggcuggugagauggcucugcaggugaaggccuuuccuugacuucaguccucaguacccaggaaaccuaagcuggccaugauaacaaacacaaguaaucccacguggaagguggagcccagagggucaggaguucaggguuauccucagcaaccuugagaauuuacuacuugggcuccugcuuuaauuaauuacuuaauugguaccauaaaaaacagguaugugucguguacugcuuuacgcuagcugguuuuagcugcuugguaaccuccugcugaagguaaaaccucuacaaagacuucaggcauugaugagagagcagagagcauuguguugguagccagggcugggacauugucaggacuuagacagggagaggaaggugcccugcuucuagaguguauuggacggagcccagccaugaagucuagggagaagccaaguauagaacugcugcauccaucucccgggccagacugagacucgcuuaagugaggaugcaugggagguuugggcagaacagcugaaggauaaugcaggcugcaggaacugaccaggcaaagaaccccagugaagcaggaagaccagucggggacugguggggacugguggugacuggugguggcugugguguguguauacacaucaccagucagacucagaccacaauaugaaaguggaaagccacacacccuggcucacacuuaaaaucucagcacuuggggaacugaggcgggacuguuaccaugaguuugagaucaaucuggacuacgauguaguaaguucuaggcccaccagagcuagcuagcuacacggugaaauccugucucagggguggagggauggagggaacaggcaagaggggaggggagggaagagagaaugcagauacuugugacuuucuggggcaagugugagggaaaagggcaagagucagaugccucagccagcuggcgggaggcucagcaagucaaguguuugucaccaaggcugaggauccacguucaggccccagccaggauccacauggugcagagagaaaaauggcuccugagaguuguccucugaccuucauaugcaagcagucuguguguguguauaauaauaauaaugccaauaacauaaaccccauaauaacuagaaucaaaugucucuuacuguuuggccugacaaacuccucugugguacagaucguguguguguguguguguguguguguguguguguguagauggguggcauauaugugugcgugcuguggugcucaugugaaggucagagauaucuccaugacugucaucagcagaggguggcuaagauucccuguggagcauaagggagaaaggacagagagucuguguaucaucuacccagcaggccaacuaagggggaccaucaucacggugaaugcauggagcuggccggauagaucagcaggugaaggcguucgccgacaggccugacgaccugagcucagucuccuguccucacacaauagaaggagagaauugacugccagaguuguccucugaucuccacacauacacaccuacccuacccucguaauaugcguuugugugugcauuauuuuguuuuucaagccaggguuucucgguagaccagacuggccuugaacucagagauccaccugccuccuccuccuccggcgugcaccacccccaccuggcuuagaauggcuuguuuuaaaaagucuccgugggauggucuacuuccccccuagggaucacuccugggguugcgggugcucagcaagcacucuacacugagcaacgucucuggcucuuauuucuccuggaacuugcagauacguagauaacuuauuuuuaaaguacuggaauauuugcuugcaugaagggaaaugucuaaagacaagggacccgaguaaacucuccugacccuucccuucuccagagacuggaguggaaagucucuuccagugagacaacgucaggguacccaaauggagauggguguugucccccccugccuuggacuaucgagagagucucuucccagcaggcugcaugagccuuuacucacugguaaaggucacgugugagucuucaaggcuugacaagacuugacauuugcauuucucuaagauuucucuuugguguggguaauacuaaaguagacaagguuaacacuuugaccauaaaacuccagggcagaguguaguaucccccauccccccuaucccaccccacccccacccccccgcccugaagagacagucaugccucuacuuuuaugagcucuugauuaaauuggugaccuuuuuuuguuuuuugggauuuuuugagacaggguuucucuguguagcccuggcuguccuggaacucacucuguagaccaggcuggccucgaacucagaaauccuccugccucugccucccaagugcugggauuaaaggugugcgccaccacugccuggcuuggugaccuauuuuaacaguucuaucuuaaccccccacugugugugugugugucagagaaagagagagagaauguuuaugaguauaagaguguguguaagccgggcagugguggcgcacgccuuuaaacccagcacuugggaggcagaggcagguggauuucuggauuucugaguucaaggccagccuggacuacagaguaaguuccaggacagccagagcuacauagagaaacccugucucaaaaaacaaacaaacaaacaaauaaauaguguguguauacguguguguguguguguguguguguauauauauauacauauauauauaggcgaggagguguauguguguuaguguuuuaaugcugugaacagacaccaugaccaaggcaagucuuauaaaggacauuuaauuaggacuggcuaacagguucagagguucaguccguuaucaccaagguaggaacauggcagcauccaggcagguaugguacaggcagaucugagaguucucagucuucaucugaaggcugcugacaaaagacugacuuccaggcaguuaggaugaggguccuaaagcccacgcccacagugacacacuuacuccaacaaggccacacccacugcaacaaggccacacccacuaauggugccacucagcugguccugugcucgccugacaagcacuaagcuuagguucaguucccagcuagucauuaacccagcaggacuaugaggagagcccuucaaccuuaucucucaguuucccccuuuuauguuuaacgcuggcccuaaaauggaccagaccacccagagagcuaugcugaguggaacgcagccccuggucccccugagcaugcucaccacuguccuccacgggagacaugaguguacaccuggggacuggcugacucagggaacuuauuugcccuaggugugugugccuacauguacacacguguaagguguacaaguccacgugcacuccugugagcuuguccgagcaugcacguguaaaggacagagaccaacuucugcuaucuuccccugccucugucugguuuauuuuugagauagggauccucacugaacucggagcuugcuguaucagcuaggccggcugcugcaagcccuggggauccacccauuucugaaucccccugguccugggguuucaugggaguccugaggauagaaaaucaagcccucacaccuccguagugggcacccuacccacucugacguccccccagcccagccauaggccuuugacucaucucugggcaaagucccucaugcugucuccuggcuguguagugaugcgggaacccuuacuacaugacuuaauacaagguuaauacagccugccgcggcuuuucucacuccgugagcaaggacuguuucuagcuacagcaucaccacacaaaauucuuucuaagcagaaucuuuagauggaugaaugaacacaagaccugaacucuuuuuuuuuuuuuaaagauuuauuuauuuauuauauguaaguacacuguagcugucuucagacacaccagaagagggcaucagaucucacuacgggugguugugagccaccaugugguugcugggauuugaacuucggaccuucggaagagcagucaggugcucuuacccacugagccaucucaccagcccaagaccugaacucuuauuaaugauuaauuucuaucucuuuccucugauguucugguauucaaagagucgcuaugauaugauuuuuggaucuaauuuaagagcagagauaucaaaauuccuguggcuuugagaaacucauauaaaaugggguggguggggcugucaagauaauaagaguucaggccauucucuuugaaugggaaagggcagcugucugcuggguaugcaucuuugaaugcaaugacaggcgguuuugauggucagacuagaagcugugucucagacauagauuaugucagagaaaugaagaguaggagguaaaauguuuguggauauuugcuuauuuucugaaacauuaauuacucagauagaauguuaugauuuugcuaagcaguaaacuaguaccaauaaaaaguuauuaaacagaaucaggcaugguggcacacaauuuuuuaucucagcacuugagagggagaagcagguggaucucugaguucgaggccagccuggucuacagaguaaauucugggacaacugggacuacacaaagaaacccuguccugaaaaaagaaaagaaaaagaaaaagaaaaaaaaaagggguuaacauuuuuuucugucuaagggauuaacauuuuguucucuccucuuccccacuguguuuuauaguuuaaagaagucccagaaggcccuaucccuccgucuacacccaaauuugcauauggaaaaguugcucugagaaagguaagacaggauucaggguugguaguguggcucaguggguagagugcuuaccugguaugaccgggucuauccucagcaccauauaaaccaggcaugcuggcacacaccuguaaucccggcagucaggaggaucagaaguucaaagccauccuuaacuacauagugaguuaggagcuagccugggcuacauaaaacccugucucgaaaagagauaaaaagucagauccucacggagaugggcagacacggugaaugggggugucaucggucggcuggaggcuugcucucuucccugaguuuguuuucugagggccggguggaagaguuggcauuucuaggggagauggaagagaggaugcuugugcaagcuggcaggaugcagggcguggugcucgugggccgcuccguucauuuuaguucgguucuugguuuugaaaggcagugcuuuggacagcccuggaaugacauccuaugucauaauucucgccagucaggcucucucccgucauuugccccuuuauuauuauuuuuuucuuuauuacauuuauuucuuggcuugggagacaugcauucuguggggcugagauggaggccagugaacagcaugaagaagugaauauuucuucuuacugugcaucuggggacugggacucagggcaucaggaauggugacaagcacccgcugaacccucuugacagucccauccaccccccuuuuuuaaugaguuccuccaagccacaggaauuuugauaccucuguucuuaaauuagauccaaaaagcauaucauagugauuuuuuuggauaccggaacaucagaggaaaaagauagaaauuaaucauuuaauaugaguucagguaauuuuauucuggggaggaaaggagagaguuacuuaaugguuuacaaaauugguuuguuuugacucuuugggucuccgguuuuccccuagcuucacccuuuacuccuacgugcauucauucaccagaaaaaaagagaagaaaacaugaauagccacuuauuucuuaagaaucuucaaguucuaaaauagcagcauaagcuuuuaucuuuaaggcaaacaccaaacaccauagcauaguuuuccauuuguaaccuugagcuucugcuuggcuggcccagcugccguaauaguuuccauuguagugucagauccugugccacauucuacaaagaacguggucucugauaggaaucucuucuuagauuaaucacgcuugaaucucacuuggaagggggcacauguucaucucuguagcgacuuaagaaaaauggucgcuugguucugaaacagccaagagucuuuucacgugauauaaauagcugcaaauguuuaaaacaacaacaguaccaaaauugaaaaacaugaagaaguacagcuuagcgcuaugaaggaaaucagcaaauuggcaugguagcucaugccgauaauacuaacugugggggcuaaagcaggaggauugcugucaaauucaaaagcagccuuuacuccauggugaguccgaggcuagccuggacuuuagagaaagauucugucuccagaagaaagguguggggaaaagcagaggugguuguuaaucccagcacucuggaguggaggcuggaggcugagacguucagggucaucuugaccaccuagagaguucuagccugggcuacaggagacacucgcugucuaauaaacucgacacagagagcugggagggagggaaucggcacacagcuuuuuuccauuuauguaagacauaguauauaauaaaguuuuauuuaaaauuguauguguuugugugugcacucgcacacuuguggggcagacaggguaacuuucaggagccgugacacaggcucagaacaccugccacauaagcuugaaagacaguggagcaaccgugacccaagccugugacaggguucuggcagaucuaaucuuagagugauuugccucuaccuacuaucuuugcuucaaagcucuuccucacuugaaaacaugugaugcuucgcagaggccuccugucucacgugcuguccguuuugaggccuuucuuagauagagagcucugagcugucuuucugaaugggugcacuugaaacuccccuuaagacuucuaucauuuacauuuuuaucaagaguuaggagcagggccuggagagauggcucagcaguuaagaacacugauugcucugguuuuuuuuuaaguuuuguuauacuuuguuugagacaggguuucucuauacaguacugugcauccuggaucuugauauguagaccaggcuagccucaaagucacagacuguacgccugccuuccaagugcugagauuaaaguugugugccaccaugccuggcuucgacugaucuucagaggaugcagguuagauuccuagcaaccacauagcggcucacaagcauccgugacuccaguuccagguucugacgcccucuucuucccuccuugggcacuguacgcacauggugcacagacuuacgugcaaacacccgaacacguaaaauagagaacagguuuaggacgugguuggccuuuaaucccagcacuuggaggucaaggcagguggaucucugugaguucaaggccaguuuggucuacauagcaagucccaggccagccaggacuacacaguaagacccugucuccaaauaaaauaaaacaaaauaaaaaguuacaagcaaggccuggggcuagccgcucggugguacagaacuuacuuacccaguuuguguggaaccccgggcucauagccgggcaggguggugcaugccucuaauuccaacacuugagaggcugaagcaggucaguuuuugugaauucgagacuuguggguguauagagugaguuccaggauggcuagggcugucacguagagaaacccugccuuggaaggaaggaaggaaggaaggaaggaaggaaggaaggaaggaaggaaggaaggaagaaaaugaaagaaaggaaggaaggaaggagaaaaaagaaaagaaaagaaaccgacccuggguucaauccccaauccugcagaaaacaguaagaaauaaaagcagguaggugcuagguuuuagcugaguuagcagagagccugccuggcaugcagaaagcccuggguuugaaccccaacaguaaguacauagggugugugugguugaaugcucagguaacccuagcacuuggaagaucagaagagcaaggucacauagcaagcuggaggccugcuugggacacaugagaacaugucucagaaagaaagggagagagggagaaagggaggaagggugagagagaggcagcaagagagacagagagagagaaagagacgggggugggggugggagaaaacagggaguggguaagaucaaaggggaucgggaagcaaauggaacuuggacaguugagacuucucucaaugucuuuguuaagucagacuaauguaaccucccucccaccugccacucuggggacaggacacugagucugguucugcuucuuugcaguucaagacaguggcugaagcucuggguauccugugucccaaugggccagugaaaagccucuauccccugacauucacucagguaaaacagguaggucugucuccccggggagcgcucuguccuucuguuccuggcaacacaggugugucuuacugcuuccugggcgucguuauuuaaugguggcugggaguagggcucaguuggugaggugcuugucugucaugagcaaaggcccggguucaaaccccaacaccucauaaaccaggcauggugacagccuggagaauuagcagguuggaggcucaguaacucaagcucauucucagauacaugguauucgaggccaaccugggcuacaugagauccugucuccaaaaaagaaaaauaaagucaguugucaguuuaauuuuuccuucuuagaaguucugcuuugggaagaacauuguugugcucuguguuugugugugugcuucauuuccuggcgcuuuacuuucuugucucgcuagaaguuucucguucgaagcuuuuucaggauuuuacccaguucauccaguucaucagcuagcagcugcuuuuccugcccgguccauccgcuucaucagcuagcagcugcuuuuccugcuuugaguguguauguugcggacugcuuguccccagaaaacagggcugagaucccaagcgugacaaaggaaccaagagacccuuggcaucccggugacaccgucccauaccacacggggacccaagaggacauaucuccucugccguguccacacaaaaggcauucugcugacucuagugugggaaggcuagucucggaacaaucuggacucuucagaaacuauugcugccagccggcuguggaggccacaaguaugauuccugcgugggggaggccaaggcgagagacuagagaacuggaggccagccugggcuacauaguaagcuccaaccuggccuguggaacagggcagccuugucucagaaaaacaaacaugagaaaaaucccacacaaaaauuccagugagaucacgaacuggagacgagacuugaaaagaguuuaaguggcuggagagauggcgcaauaguuaagagcgcuggcugcuuuucugaagaaccuggguucaguucccuucacccacgggggcagcucacgauugccugucacucuaguaccgggcuauccaaaacuucuggccgcuguggacaccugcauucauguguacacaccuaaacauguacacacacacauacacaugccucacacacgugccuagcauggcaugaagcccugagcuuaauccccaaaauuacaaccagacaugguuauaugacgccucaucacuugggaggugguugagggcagccugggcuaccugagucccugucuuaaaaaucaauaaauauuacuccugauuugguggcagaacccaccuaccccccaacucucucucucucucuuuccucuuugcuuuaaaaagaguuucagguugagucauguuuuguacucuagagcagauuuagcccaagaaccuggaaaauguuuuacugagcagaacucaguguuugucuuguguucagggcuuuuccuggcuuaaaaaaaauuuuuauguguaugagugcuuugccugcuuguguguauguguacugugcaugccugguuccuacagaagccuaaagaacuucagcugcccugaaacuggaguuacagaugguucugagcucagggccucugcaagagcagcaagggcucuuaauggcggagucaucucuccagaccccuuuaaagaaacuauuguuaucuuuauuuauuuauuuugcugaugugugugugugugugugugugugugugugugugugugugcgcgcgcgugcgccauccugugugucccagggaaugaacucaggucauaaggcuuuguggcaagcaccuuuacccacugagcccucucaccagcucuugauuuuguuuaccagggaccccugaccuguaggcaugauuucccugggucccucugggcaguaacuuaacucuuguuuucccaguguggcagagugcuccuucauguuugacuaguucugccaagaccuaacaagucagccugaguuuggcuguggguggaggaagcguuucguucccuagagcuuucagaacguugcuuucagccggaucaagggcagccacgcucucagcagccgaacggugagggugaugcugauuucucauguucuuuucucaccaguauuuuggguaugugcuguaccgaacaacgcuuccucaagauugcaguaacccgaaacccauuuucucuucacccuucaaugguguccgugaucgggcuuacgucucuguggacgggguaagcauucucuuugaccuccacaucuaagccuugacagagggguggagggucuucuacacuuaauaacuugacagccaguguccccgggcaguauggcuugcuugcugcuauggcccacaugcugcagggucagggcuguucugacacgcacacucuagaaaacccugggucucaugaguccaaggccaacgcuacccagacugagcuuagcauguucacccaggccgccucugcucuuuagggauagcauccaugucagcuugguacauguuacuauacaaaaggugcugaacuuagugucucccccuaaaugaaacauuagagucucaaggguugcucaugacaguuguaacuaaaguauaccaagggcuucacuucauaguaaaaugcagauguguuuuuaaacacccuguccaauaucuggugugaggacacacgccuguaaucccagcugucagaagguugaggcaagagaauuguuaagauucaggccaaccugccugcaugaugaaauccaggcuuuaucaaaacaacaaauaaaggaagaccugagagccagagcccaugagauggcucagcacagugcuugccaggagcccugugguugaguuugaucccugggacugacgugguaccaagcagagcugacuccugcaagcuaaccuccgacacccacucaugugccucggcccuugggugcacacacaguaaacugaaucacucaaaagguagcuguggccauuugcucuucauugggacaguugugggaaaagcucacaagaagauuuuccucaccaagcacauuguuucagaaaaguguuagccuuggagguuuggucuuugaaacaggauuucaugcagcccagguuggccucagacauguuugguauccagggccagccuugaacuccuggucugcuuaacucugccucccaagugcuaggauuacaggugugugcagccacacucagaguagcuuaaaucaaaaauauguccauucuaggcugggaagauagcuugccuugcaagcuuaagagccugagaucacaucagcagccccucuauagagaacaaagaaacaaggggcuggagagauagcucacuggcuaagggcauuggcuguucuuccagaggacuugagcucaacuucaccaccuacguggcagcucacagcugucugaaacucuaguccuagaagauccugacacuccuggacucugagcaccaggcacagacauaguacacagucauacaugcaggugaaacacucacacguaaaauacauaaaagaauaagacgaaaaaauccacgugugacugcgugcagcuguaaucucagugcuggggaggcggggacaggaggagccuuugggagccuggccagccagccgagccuccuccgaaaguuccaagagggccagagaucuuaugucagaaaggaagauggcccauuucugaggaaugacaaccaauccugucccaguggucucuacacacgcacacaugcguacuuucaccugaacacacacacauacaauaagggaggagggcuuucuuuuauaaccagcagauuucauuuuaguagguacaagccccugagaggugacacugugccuaccauuacccagccuuuuuuaguuguguccugguggcuuacggugaguguagccagucuaaaaaauaaccuuuuaaaacauuaaaaauagggguggggggaggguaugggaggcuuuugggauaacauuggaaauguaaaugaagaaaauaccuaauaaauaaaaaaauggaucucagaaaaaaaaguaauaaaauauaaagucacaaauaaaauaaaaauuaaaaaaaacguuaaaaauaggguuggggauugagcucuguaacagagcccugguucuggccucaacuuggggugggugugguggugugaaugaaggaaugaauaaaugaauaaaugguuagcaaugucuuguugagaaaauaccuguuguuucccucacuauguuacauaaucucuguggcugagguacccuagcaguugaggugagcugaccccaccucucucugauuuuaucuguccccugauuuuaucuguacucucuacguguuucaaggcuguuuccaugcaccuaacugugccaaguggagagcugugaggagaugcagugauccuucucacagggacgcuagaaugucuugucuguccugcuccuuuaaaauagaaguguggggccacaccuguaagcugggcacgugggaugugaggcaggagaauuagaaguuccagggaggcccucaugguagaaggaaagaacugacuuccucaaguuguccucaccaugguauacgcgcgcgcgcacacacauacacacacacacacacacacacacacacacacacacacacacucuuaacaauguaauauagccaggcaguaguggcgcacaccuuugaucccaacacuugggaggcagaggcaggcagauuucugaguucaaggccagccuggucuacaaagugaguuccaggacagccaggcuacacagagaaacccuaucucaaaaaacaaaacaaaacaacaaugauauauauauagagagauauagauauacuaauaauguuauauauauacauauauguguguguguauacacacacacacacacacacacacacacauacguauauaucaagcaguaaaaugccugagccaagcauguugguccauacuaguaaucuuagcauuuauaagguggaaucaggaagguuucaaguucaaggcaauccugggcuguaucacaggcccuuguuccuagaaaggagucucagucaucacaacacauucccagcagaggaguggccccugagcuguguccagccauccuccucauuugggaagacagggauugugggaacuuguccugagcacauccagccuaucccuguacaccuggugacacuucggggcaggaaaggggacagaugagcugugcacacagcuccuuuucucugaucucacccuccauccccucggcuuuaacucacaggucccccaaggaauccuugaucgaaaccucaugacagcucugaacauacgggggaaggcuggagccacgcuggacauccugguggagaacauggggcgugugaacuauggcagauucaucaaugacuucaagguaggacacuuggaggagggacgggccugggccugaaacacucacgcaucugacucugcuuccauuuauacagaaaaaaaaucuuuacuuucuaugucuaccaaggaaugcaguuuauuuuccuuauguagaccaggcaggcuggccucgaacucagagauccaccugccucuuguguuccaggugcugggauuaaaagcaugcaccaccauauuagaucuacacauuaacuaacuuuuuaaaucuguuuauucuccuuguuguuguugaaggcagucucaaguagccuaggcuagccuugaacucaccaugacuuugaauuuucgauccuugagccuccaccccccaggugcuaggaucaccaaugucugccaccauccuguuuacgcagugcuggacguugaguccagagccucuuguauccugacagccgagucacauucuccaguccuuaaguacugacaguuguauaugcuauaaauauuauauaacauauuauauauaucaauaacuauauugauacuuaaguauaauaguuaagacuggggguggauguauauguauguauguauguauguauguguguauguauguauucauucugaccagugaccacagaccagcugucacacaucacagccgcucccuuuuuuuuuuuuguuuuguuuuuucgagacaggguuucucuguauagcccuggcuguccuggaacucacuuuguagaccaggcuggccucgaacucagaaauccaccugccucugccuccggagugcugggauuaaaggcgugcgccaccaccgcccggccagccgcucccuuucaaggccugcacacuucgcugagccugaggagugaagcccccugcuuuguuuuguagccuagaagaugacuuucucugaagggcucuuuuccuccccugcccacgagaaccuugagcuuggcaaacaggacacuucccugugcuuaagcucagucguccuguggggagaaacggaagccacgccacccagcucguccggggcucucccuccucgguaccugaggcauguggugggcucugcugugcaggcuuggaccgguggcugcaacaaagcuguguuauagaaagccccuuggcugccguccugccgccgccaguuacuuagucucuguccagucccagugugguauucuaaccaguauuucuagaucauuaagaaagcuuacauuguuaaucuggguuucuguuuaguuuaacguguuuaagaaagaaaaaaaaaaaaaaaaacaacucauagcccaggcugggcagagacucacuguguagacaggcagggauguccuugaacuccuaagcuuccugccucgaccuuccaagugcugggcuuacaggcauguuccacugcacccaggucauguggugcuggggcacaaacgagggcacuaggcgaguccuacugagcugacuccccagccuggaaacuuuuuguuuuuugagacaggucuuacuuuguagccaaggcugguuuagaacucacaacaaugcagauucugcguuuacagggccaaccuccacacccaguucaagaaacauuuguuuugguucuguagcguucccaaggugcuucccuggagagagagcacuaggcacugccaagcaucagaucgugaucccguuucuguuuuuuguaacauguaugucuguguauucauauguaaguauguguguguuuguguauguacgggcaugcauguguguccgagcacauaugcacaugccugccaugaguauaaagggccaggguugacaacugacuucucccucaagcgaucuccaccuucuaucgaggcagggucccaagugagccuggagcucucauagccaacuugcccugggggauucccuguuccuccucuuguguacugggaucacaggccgggcugucaugccuacccagcauugauguaggagcuggggauccaagcucuaggucucacucuuacguagcaagcccuucacccacugauccguuuccccagccccuuccugauccucuuaugggcagcagcaaagccauugugacacacugcuuacacuugccuccguguaaauguauuuccgcacccuuguguucuggcuucggucacugaccuuccuggcugacugugguuggucacauugacucccagggugaguaggauccugugguguggucccugcguccgggcacuucauacuggccggaucaguaaacaguugagacuugguaucagagagugccuuuuaaaaauccaggacucgcugagugggaaagcuccuuacauagaaaguaaagaauuggugaggcuugggcgcacacacacacacacauacacacacacacacacacacacacacacacacacacacaccuacaccuguaauccccgccccuguaaggucugggcuacacaacaaguuccuucucucagcgaacaaauaaaaaagccauagugagaagugagcugaguugccagaggcaaccugcaguccaaugcuggaagcaggaagauuuuagagcucaaggcuagccuuggcuacagagugaguuccaaaaucguguggaacacacggauccuucucucgauaacaacagaaagaaguuagauacaucacgguccuaaguuucugugugaugacugcagucagggcugccucagccccuagccccugcaggucaaauagggagaacuucucaaccaauccugggguccauugucaucucaucccuuacagccuuugcucaaucccacagacuuccacacacaugguccucacagcuggccagacgcucggccacucuggaucaaggcuugcuccuugguuggugugaggggcagaggccaccccgcaccccccuccaucugcauaggauaaauaucccuagaucucucuacucacuccuucuccccuuccuuguuagucuuuguuuucucuucuucauucuagcaaauucugaaaucagugggguucaagcuagagcgcucccucagaggcacccacuuccuguagcccagacacuagggugacuuuguggugauuuguggugaagcuggcgcauagggccguguaccucguuccaaagaguugccguugugggaguugguagggucaggcagauccagagacagacgggacacugaaaggcagggagagccacccauguggcuacucuaggaggagaaguaaguggacccuguaucaccccaucuuacuccaccccaccccaguccgcccucaggaucccgacaugggguucagguuuaaauggacggcuagagagagacacucuagcaguccuaguaaagaugugucccagcuccagucucugcaaccagugcucugaggaggucagcacucagugccagcucucccugagacaagcucucaggcuggcucuggaugauaccaggcuuugucuggccuuucuuuuuccuagcaugagauuucuagggaaauuccauuuccuuagguuccauugacucaacagucugccagccaaagugggggagggugggcauaaguaucucuuuagauuucuucauucugggcuggaaggguggcuagggguuuagcacacuuguagaagauccaagcuuagaugcaaagacccacauggagcagcucauaacugccuguaacuccagcuccagggcaucucaugccaaaaggugcucucuuggcaugguacccacauacauggacacacacacaccacauauacacaugcucacacacacacacccccacacaccccacacaagaucuuaugccacaaauaaaaauaauuuuuuuaaacuuaaauaaaaccaggcguggugacacaugccuuuagucccagcacucgggaggcagaggcagguggauuucugaguuggaggccagccuggucuacacagagaaacccugucucgaaaauccaaaaaaaaaaaaaaaaaaaaaacccuuaaauaaagagccaggugguagcagcacacuccuuaaaucucagcacuugggaggcaaaggcgggcggauuuuucuguuggcuugagaccaguguagucuauagaaugaauaccagaacaaccagagcuacacagagaaauucugucuugaaaaaaaacaaaacagacagacggaaggaauaucuucauuccugccaagacaguagauuggacugagccuccagccggaccugugucaccugcuguccacacagcagagucucauuuccugcugcgucucccaggaggucagugacucccaugagucccugcuucaccuguggcucauggcucuguguuuccuuuuuccaggguuugauuuccaacaugacuaucaacuccacuguccucaccaacuggacggucuucccacugaacacugaggccaugguacgcaaccaucucuggggccgggaggccagugaugagggucaccuugacggacggucgaccuccaauucuucggaccucauacuccccaccuuuuacgugggcaacuucuccauccccucgggcaucccagaccugccacaggacaccuucauccaguuuccugggugguccaagguaugcaucuucaugaauagccuucggguucaagccucaagcauucgguucucaguaccgagaaggaaucagaaggcugcugcuaguaagaugcugugugauguggggaggguuuccuacuggcucacucgugcaggaacaagacuguggcagaucuucagggacccaguguccagcuuggagguguccuucucugccccguuuuccuugacaacuuuucuucagugaauggcagcucacuuggcuuccuccaggaagaacuagaaccuauuuguucauuuuuauuacauuuacuuguguguguguguguguguucaaauguggguuuucauguaccugccaaggcaaacguggaggucagagccaugagaaucagccuucuuccuccaccauguguguggguccuggggaucgaacucgggucauugagcuuguuagcaagcacccucagccauggagucacccccccccccauccccagggcuucuuuauaugcugcuuaugaagggaacaguuuuuugucugcauaggauuucauguagcccaggcuagccuugaguuugcuaaguagccggaaaugaccuugaacuucuggugcucccgacucugcuccagguacacaccaucaggcccgacgagaaauggggcaaccgggcuauaagggcagaggaagaggagaggggagagagagagcuggggugugagcagucuucuuacacgccuggcacacaccuggcggcagaugaugauguaagcuguugcuagguuacuguuggguggaacuguagucuucugguucucagagcucugagaugagugcuaacugcccaccuugggagagaggggcgccaccgggugcccccugcuuguucgugacugauuaacucuaagcaaaccucauacuguaaauggaccauagcaauuucauucuuauaguaguuccaggcugcccugggcugcaagaaaggcugucucaaaacaaaacaaaaccgaacaaaaaugcuagacccguugguccauuugacgcucguccgucccuucccgccccccggaagugaccaucuuuggccucuuggcugauucgucaugugccgaccacagugaggccucugcugugcauugcccaccaccauguucuccacgucuaagcucugccuuccugggaagccugguccuccucugcccugucccugggaccucauccucucugccugccgccaguuggaacuccuguuuccuggacuuccugucagguuccguccucacuuccuacccaguggucucuagaaggaaggcuccguucugccuucuuccccaaaaccaaccccucuucucacuuucucugccggugguucaccagccuuucucucucagcaggggcucucgggccugagaacagaugcaucccugggucuucccccgcagcuagcaggggacuuucugccuccuaggucaccuuugguuuucccccugcugacaagaaggugaagggugcuguggccaucagaggcagcuggcucuucuuugucugugugggcucccaagccaggccuuucucccaguucucaugccaugggauguccucuuguuacuccaguuuagcacaaaaucucgggcuuuggucacccagccuauuagacuuggccacccaagguauugugacaaucacaaagacaaaagagaccggaguguggcuugauagaguguguccauguauguauauauguauguauguauauauccauguauauauauccauguauguaugaauccauguauauauccauguauguaugcauguauguauguauauaauccauguauauauguaugaauccauguauauauccauguauguagguauguauccauguauguuugcuauacuugggcucaguccucagcaccacauaaaacugggugaagugguacugagcagcagcagaagguggggagggggauccuagauucaaguugucuucagccacauagcaaguucaagggcagcccgggcuccaggagaccuuggguugaccucuggccuguuuguaugaacacugcaggagccauccacccuguuucuguuuugcuugcuuggcuuuauuuuacuugguuuauuauuacugucauuguguggaugacguguguguguguguguguguguaugagcgugacacggaaaucucaggugacgugugcaugaguguggucauaaaaaucucaagacagcugacaugugugagaaagaugagacuuuacaacgcgggagagccucgggaaccuccagccagucaggcauggcggcucgccccagcaccuaggaggccgcacagacagagacagaauccugaggguuccuggacagucagugagacagcuucagguccaguggggacagucugccuccaaaaggagggugaagaguacuggagagggcuggggcuggggcucagaggugaagagccccugcucuggaggaccaggguucuagucccaagaaaucuggugcccucuucuaaaccucugugggcaucaggcacgaauaagaugcacagacuuggauccaggcaaaauauacccaugaaauucaguaaugauaaggcagcagagggagguacucaaagccaacuucuggucuccauauacguacaacaaaugcaacaaacaagcaaacgccucccgacacgcccuccaugaacacagauaagucaccccuuccugggccucacccugugcugagcaacacuucagcugaugguuugggagaagaggaaagauuugaccacgugacacugaggccugagcaguucucagacuagguuaugcucgcugacccuugucuuccuccuccucagagccccuucccuccccacagggcuuucuuuucuuuuguuaccaaggaacuaacuugaucucgugagugaaaucacuaauacauucaguccaugagauaaaagcaccacuuuugauugcucugguuuuucuugggucggauguggcuuucugguuaagcaagugugcuugggggauuucaggggucaggcgugccugcucaguccauacaggucagugccugucugcacugugcaccgacugacuguagacucucagggaggcacguucgccagggcuuuggugacggucagaacguugggucaugcgugccacguccagcuaugcugggacaaaagcguguuuucugcuuaucuccaucuaagagaaaugaguguggaugacuauuucauuaaacuaucacaccaagcugugcgugguguaaucccagcacucaggaaguagaggcaggcagaugucugugaguucaaagccagccuggucuguacggugagucuaagacagccagggccgcacaaagaaacccugucuccaaaaaugcacaugagguagaggaagaugcaggagaaguucaagguucauucuccagauguguauccaggucugucuggaacccgugaaauucuuagcgucauaaaagaauguggggcuggagagauggcucagcaguuaagagcacuuucugcucuugcagagggccuaacuuugauucccagcaccuaccuggugucucacagcugucucugaccugccuggcuccugaguguacaugauaugcaugaacacacacacacauuuuuguucagguuuacuuauuugguuuugugaggcagggucucacuaugaauccuuggcuggcuuggcuggguuacagggcaugugccaccccacccagccaaauaaauauuuuuaaaugauuuaugauaagguuaaggagcuagcucauugguaaaaguguuuccuacaugugacaucuggguguaaauuuaagcguagcacagcuguaaaaagcuacaaacgguggugguggugguggugguggugguguuugcuuguagucuuagccuuggagaagcagggagaggcagaauccuggagugugcuggccgguuagccuguccuaacuagcaagcccuagguaccagugagcaguccugucucaaagcacagggugaaaaccccugaugucacucccaaugaguacuggcagacuaugacucugcugcuuaucguaccggggugugacuggguguuaacuggcuuuaagcuggaaacugagaagcccaugggugucugucauccuacaagccacucccacagcguggggcaggggucagugcauucccuuugccugguuugcaauggugcuaacccuacacagucauucuuuacgucuaacucauaguuuucacucacaaacccugugaacccagaaacuaggugauugggcuucucccagcaagugcaauaacuccaggugaaguggguucacuauaauuuuuaguacacagaguuuauuuuacuguguauguguaugugagaaacagacagacagacagacugaaugaaugaaugacacacuaugauggcucauauguuugugugcaugugcccucaucacagggauucguuucugaucuuuuaugcucucuuucacuucuuggcucucaggugagucauuuugcucaaccuuucaugccuuuuuaaauuucacguguaugagugucugucugcuuauagguauaugugugcacaccaccugcaugcaggacccacagaggccagaagagggcaucagaucccuuggaguuacaggcaguugugagcuaccgugugggugcugggaacaaagcauagauccgcucuaagaacagagguacucuuaacugcugaggcacauuccagcccuguccucuucauauuggaagguuagagacagggcccuggcuauucuuuuuuuuuuuucuuuuuaaccuucauuuuuuuugguuuuuuuuuuuguuuguuuguuuguuuucgagacaggguuucucuguguagcccuggcuguccuggaacucacucuguagaccaagcuggccucgaacucagaaauccaccugucucugccucuccagugcugagauuaaauaaagauguagaugcuacauuuguauuucuucaucuuuuaaaguuugaugcaagcuuguguguguguguguguauguauuagagagaaagagagggugggagguacuuuugcaaccugccuauggauuugaaagcuuccagaccucuucuuucucugagcugaaugccuuggguauuuguuaggaaauagaaaguuauccuagaaugcuuccuaaaauacaggagaccacagagcugcuucauuuauuacacuaagaccuggguaaaugggauucacaccaucugcagauagccaugggguugggagaggaggaaaaguuaauucccuuugcuuauuucgggggcucugcuuauagaccacuucaggugcuccuugacauuuuaccuuauagaaucaagcuuucaaccucacagcacaauguagacaagucaugagugggagcauuugaaccuugaggacagaccuccacguuucccgauuugagcccuccgagcacccauauuuccuuuaguauagucuauuaccucguugucuuuguguuuuuuaaacagggccucacuaugcugcccuggcugucccagaacuuguucaggagaccaggcugaucuugaacuuaaaaaucuaccugccucugccucccguaugcugggacuaaagggaugugcuaccaugaucaaccuauauucacguuuaaggggcaucugaauaucuuaaaacaguauugagggguggauaugguggcgcaagcuuuuaaucccagcgcuuggacggcagaggcagggagaguucugcuuucugggccagccuggucuguugagacccuaucucaaacaaaguaaaagacaguauugaaaguuuaacucuagggucuggagagauggcucagcaguuaggugcacugguugcucuuccagaggacccagguucaauucccagcaaccacguggcagcucaccacuauaacucuaguuccagaagaucugaugcccucacacagacagacaggcaaaacaccaaugugcaugaaguaaaaauaaauuuaaaaaagaaauaaagcuucacuguaaauucuaggaagauuggcuuuguccggguaaguuaaggcagacacacacucacugagaaguaggucaggcccuaacaggaacuuccgcuuugccgucaccucuguguuaauagcagaagguagaagugugggcuggggucaugauggucagagauagucgacuucugccauggacuguagaaguugggacugccaugggacacccccaagccccugcagucaccucauuaguauauccuuuugguuuaccaagaauaauguaccaagaauaauuucagcauauauuuuucuguuuggucuuuaguggcaggguuucacacuguagccuagacuagccaaaugugcuaagcaagaguccuuuacuaagcuauacucucaacucuuucagcauaaauuuuacuuauuuuuaaaauuauuuaguuacuuaguucaguuuuuccaaggcagcguuucucuuuguaacacgauagccagggcuauguagagaaacccuguuucaauaaauaaauaauaagcagguuaguaaaaauaaaaauaaagaaagccuuuaaaacuucuagcuggaagccuaguguggugguccacacuuauuaccguagcacuacagacucagaggcuggggagucacuacaaauucaaggucagcaugucuauauagcaaguuccaagccagcuggggcuacuagcaaaaccaaagaagaacuaaaaccuuacccuaaggccaaugagguacuuuaaccccagcacuuggggaggcagaggcagguagguugauugaucucugaggccagccuggucuacagagcaaguuccaggacagccagggcuauacagaaaccuugucuugguggaaauaauacauacaaacaaaaacaauuaaaaaguuuuuuaaaauguuguugacagcacuguuauuaagaacacaaagcuagaaacaccugaguacccauuuucaguagugaaggagugaguagccauccgcauauuuuucuagggaaugcagugucguggcagcacgcacaggccccgcuuuaaucccuaacacugaagaaaaggcgggagcagggaacaauguauuagucaggcaugcuggcacaugccuguagccccagcguacaagaguccaaaguagagggauuaugaauuugagguuauccuggacuaacauauaaaaaaaagaaaaaaguccccaaagcuaauugguauauccguaccauugaaugucauauguuuaaaacaauaaugcauauauacacuuauuugugcauguaugugugugaguguaugugguaugugcauguacaugugugcuaugcuccuguguacaggggaggaggucagagaaaucaaaguguccugcccuggcucuccaccuuacccccuugagacagacucucuuucugaaccuggagcugggcuggagaccaguaagcucccgugguccucugucucagucucccacaacacuggcauugcaggcaugggaaagacggcaccuagcucauuuaugugguugcuggggacuugaacguguguccucaugcuugcccggcauggcucuuacccacugggccaucuucccagccuauuuauguacacuggcacauagguaaaaauuagucaaaacuaauucagggcaacugaaaucaggagcuggucuuaagaccgugaaaacaggauucuggcagagauggggcugauaaagcccaggugaaacuauuaugguuuaugccuuucaggacggagagagauaacagaucccgaguaaaaacaagaguuaaaguaguucugagaaccucgaaacugccacccuuuucuaaaugacuuaguccaacagacaggcaguucugagucgcugaccuccuucugugagcacugaacgccuagagcuuuuguuucagugguaaguggugcccacacugaaccaggaguacagcccaucugcaccccacuccuugcaccaggcacuaggcugaccaccaaaaugugcugugccccccuagcacauaauucauaaucaucuccuaccauagccucccaagggcuaaaauuacagcacccaccccauucacccuugcuuccaucuugggcugcuuuggggaccguucucaaacuacauggacucuguguugccaucgacccugggagggggaaaauuaaauggagaccugccugaguucagacagcuagcagcaggcaagaauaagaugggaaaccaggaaagaaauccagguggacuggaauaaagccaagggaaguuuuauuaucccugcagucucggcacuucagaggcagaggcaggaggauuaucuggacuagauaguucaggcuagucugcuguacagaaagacugugcaaauauuaauuguuuauuuuaaaaugagcaggaggggccgggcaugguggccagcauucgggaggcagaggcagauggauuucugaguucgaggccagccuggucuacagagugaguuccaggacagccagagcuacacagagaaacccugucucgaaaaaccaaaaaaaacaaaaaaacaaaaaaaaugagcaggagggaccaccacgaggaccacucucuuuccuuccuucucuccuuucuuguccccucugcccuugcccucuagaacuucccuccucuuccagaucuucuguuuaccucuggcaugugugaccccacaccacccccagcacccccagcagacuauuccaucuguucuguagccccucgaacccugagugcgucuuuuccagaagcagugucccugcucacaggagucauccccacagcuugcaagacugaaaaucuugucuuccaagccauucuccccacaucccucggaggaaagcuacaagaaccacacacccaacaauaauguagacacucuccuguguaggccucugcucccauccccgucucgucccaccgcuguggcuuacgcccacuauauugcccaggcugccuucagacucagacugauccuccuaccguagccucucgcaugcugagguuguagcaccugcggcacacgcccucacauucuucccgggguuguuugggaaacaguucuuagacuauguucaggcuuuaugcacgucaggcgacauggcugagcucugccucuguggggcagagagcaaggaagacucuccugcugaagggugugggcagccauagcagagaggguugggguacagacaggcaguuccugggagccaggguggaucucagaaugugcugagguguggcccaagacuggucuguagcuucugaaucugaggcuccaaaauucguuucuucugcagcaggaauugguauuuggaagaagcucuaccaccuaacaugggauacugggaugcuggacucuauggggcaucuguugccucucugauacuaguguuccucagcugacaaccucucucucucucucccucucucucucucucuuccucucucucccucucucucucucucucucucucucucucuagggucaaguauggaucaauggcuuuaaccucggccgauacuggcccacaaugggcccacaaaagaccuuguucgugccaaggaacauccugaccacuucagccccaaacaacaucacaguguuggagcuagaguuugcacccugcagcgaggggaccccagagcuguguacaguagaguuuguugacacuccggucauuuccugaccugacuugaccaucgguggccauuuuccaagccagucuggucaagacucauggcugaaccucugagacugagccuuggggagcacagcucuacucugguuacacggaucaccuuuguugugcuagaauggaagcuacauuucuggaauguguguacccugcuggugacuuugcagccccgccuugccugaccucccacccuaguggccaccgggaaggcugaagggaguggacaccacaggaagacacagguuggagcaaaacuugaauaauguccuuuauccugauuugaaauaaucacgucaucuuucugcugaauaaaauugguuugcaaguuguggggguccugucauuaauauaucaggcagguauuaaacuccagggucugacuuaaaucucaacuagaccugagugggcugccugaagcuacuucaccagcuugagguacaaaguggguagaagagagagcugguuugggugagaagagggcuuuguuuuugauccugcuuugacuauuucugaaucucugugauaucugcuuggugagagaucuccaguuauaaaccaucuaaaagauuaauaguugcucaaaguagguaguauggucucucuauacaauugaauagaauucucucucucucucucucucucucucucucucucucucucucucuccucucucucucuguguguguguguguguucauguucauguauguaugaaguugcauguauaugcauguauguaugcaggucagaggcccaucuugggugucauuucucaggaaugucuuaguaucuaggcacauacaggauguauaaaauguaauucugcuuauguuugagacccugucucca

SEQ ID NO: 5351 - RNA, 1343 nt, Mus musculus
cuuuuuuuuuaauuaaauuucuuuaauuuuuaagcccagaccucagaaaagucguccccuguguccauagucgguuuucuguagcucucagcuuaagagcacuaagaggugaugguucccccucagcaaagugugugagcuggucuuuuuaccucaggggcuggggcagccuaccucagaugggucuguuaggguuugaaugcagaaaagagaaaggagggaaggaauuguucuguuugucaggugauaaucucccaucuccaccuccacucgagaucgccguggguuccccacacucugcucucugugcuugguucuaagcgucucuuuccucccuccucagguggagaagauccggcaggugaaggcgaagucucuguuccugcagguggagaagcugcggcagagucucagcaagcuggagagcaccaucagcgccgugcagcagguccuggaagagggccgcgcccuggacauccugcuggcccgagaccggaugcuggcccaggugcaggagcucaagaccauccgaggccuccugcagccccaagaagaugaccgcauuauguucacgcccccugaccaggcccuguaccucgcccucaagucuauuggcuuugucagcagcggggccuucgccccgcucacgaaggcuacaggagauggcaucaagcgugcccuucaggggaagguggccucuuucacugucaugggcuacgaccacgauggugagccccgccauucgggaggugaccugaugucaguugugguccucggccccgacggaaaccuguuuggugcagaagugagcgaccagcagaaugguacuuacauagugagcuacaggccccagcuugagggugagcacuuggugucggugacauuguacaaucagcauauagagaacagccccuucaaggucguggucaagucgggccgcagcuacgugggcaucgggcuccccgggcugagcuucggcagugaaggugacggggagggcaagcucugcaggcccuggggcgugaguguugauaaggaggguuucaucauaguggcugaccgaagcaauaacagaauccagguguuuaagcccugugguuccuuccaccacaaguuugguacccuugggucucguccugggcaguuugaccgaccggcugggguggcuugugacgccucccgcaggaucauaguggccgacaaagacaaucaucgcauucagaucuucaccuucgagggccaguuccuucuuaaguuuggugagaaaggcaccaagaacgggcaguuuaacuacccgugggauguagcagugaauucugagggcaagauccucguuucagaca

SEQ ID NO: 5352 - RNA, 907 nt, Mus musculus
uccaucugugccucacgcuugcuuuuuauaccuauggguaggaucaucuacucuaaaaaacggguuccucugacagucagggcggacucuccaucucgucccuccgugucucaaagaaauccuugcggcuuuuuugacacacuucauguaauauuaaugaacacaccaagccuucuguccgaguuaauuuuuuaugaacaauaugccugauaaagcuucccgauguacuggggcuggugccguaagauggaggccccggacugcagggcacgauugaggguuuucuuagguuagcugaggugaggcucccagagugcacauuguuggcuugggagagauggcuggaaaaugaugcacacguggcggagagaccacugaccuccgccccucucccugcgcccucgggagggaccucucaggccuucagguguggggaguaaguccaggaaauccgugcaagcucagagcuacuuuacagcugaccgucauucccaguauuccacacaaacgcagccacgccggugacccuguuguuaaagaguauuccuuaauagucugauacucacuggaggugccacuucggagacaaagagacucagccuuugccagcaacucucaguuacacacccucgggugccagccagcacgagcccuacaggccucuuggaaguugcugugugugagguaggaggugaugucccuuccaaugucucaagguuuugcuugcucuugcagcugagcaucgagcaggcccagacuguggcagaacagguggagaugaaggcgaaggugguccagucugaggucaaggccgucacagcucgccacaagaaggcccuggaggaucgggagugugagcuguuguggaagguaaaugggcucacagcuuccccagucagcucccucg

SEQ ID NO: 5353 - RNA, 2347 nt, Mus musculus
uuucagggaacauuguggcaggaagacggaaguagugcuggagaggagacuggagagaaacacugggccugucccugugaugcacuucugccagcaaggccacgccucccagucccugaagugucacucccugaagaugaagcauucaaauaugagucgaugagagccauucuuguucacgucgccauaguuauggagguuggacccagcacucaagacuguuauaaagaauuuuugcuuugguuuuuguuguuguugguuuguguuguuuuuguuuucuggggggcgugggguagagacaaggugcacccaagccuacccucaaugacucaguggcugagcugugucaucaccagaccuuugaaaagguuuuggccaucauucuagcucucucuuggugucucugucucucuuucauguccccucuccaagacugccuuucccccuccccgucaaucaaucuguugcagaagauauguugcauggugugaucuuuccgguaaaccuugccuguaaucugccaagguacucccauggcauaaauccuaacaguaguaguguuugcuuuugaaacagggucucuauuccugaugcccuugaacuugcuauguagaccagacuagccucaaacucacaaauccaccugucucugccucucagcacaccagaaggcagagaaugacagaucucugaguucaaggccagcuuggucuacagaguucuuccagggcuaagcagagaaacucugucucaaccaaacaaaaaacaaaaauuugcaaaauuugagugacauugaaauaugugagauuggccgggcgugguggcgcucgccuuuaaucccagcacugggaggcagagucaggcggauuucugaggccagcccggucuacaaagugagcuccaggacagccagagcuauaaagagaaacccugucucgaaaaaccaaaaaaagaaaaaaaagaaaaaaaaaaaaaagaaauaugugagauugaagccauucuggacaguauagcaaauuccaggccagccaggguuucauaaugagaccugucucaaaggggaaggggagagaauaagaaguaaauuaugaagaugggugagaggagcugaagguaugcagaggauggugcucgauucccagaauccacacgguggcucgaaaccagguagcuccaggucaauagagcugaugcccucuucuggccuccgggggcgcauaaccugcugguaaaauacuccccauguaaaguagaguuucaugcuauuuuucuuucugggcuuagcaguguuccaaggggccugaaaugggguggccuguaauagccccaaggucccagggcccucaguauuugugucccucaccccuuguggaguaaagguugagcaauggcccaggauaggugccuuaguuaauggucagacuggauccuagaagccaacaggccuggccuaaaguaaacacaaaguaaacacgcccugacacaaagcugggaggcgggcgcagaggcucggccaggugcgagugggcugucacggaaggaggcagugaaguucauuagccuccucauuuggggcaaagcgaauccguguggugacacacaauugucuuggaggauuuaaggggauuugccugagugucccggugggccccuagccuccuccuaauccaguccacauuucagacuacuuaggaacgcauuaaaugucaaagccggcguuuaggaaaauaucuacauuucguaugcaacgcccgggucaaaagaaaagccaaaccgacgaaccuuccagcuuuuggcgcaagaggcacucugugugguccccagugugaauggggagggccgcgcuccccucccaggaaugcaguccuuucucuaggggaaaaugcuaaugcuuuguuucugccuuggcucccccaggcgcgggggcgcccccgcacgauugucaccgccacauuagcaugugagcagccccuauccccacccacacccacacccccccccccccagcucagcccugauuggggacuucugggacccgggcaauggccagcugccaacagucuuaccacaguccauaucuccgcugagaccucaggaagcuaacaggcaacccugcagguggggaguuuucacuccauacgcguugauccuuuaauauacgagaaaaaacuuuauuguagcugucccaccaaggaaaucaaaaucauuggaacagcuguggucccgcugcgaucuguguccuuaucaccaggguauccugcccacgaugugacucuucacacgaccuccaagcuauucccagcggggacagccgggaagggguacggccagcccgcgggaucccucu

SEQ ID NO: 5354 - RNA, 5659 nt, Mus musculus
aucuggguuuuuaguuuuuuuaauuuagguuuuggauaaggaacagaaagguaaaucaaaccaagccuuuaggguuuaaauauucuaaaugacaauuguuuuaagucacaauuauuaagcucuuacuucauguguaagcaaugcauuuccucauagccuucugccaacggaggggcucugguuucuauaaauccacaucgcugcugcaggcucucuguuaccgucguaagcauuuagcaucagugacaagcacaggaucugagcuuuugucuccguaucuuuuugucucgguccauuugggagcacgaagccuguugggaugcacagaauuaucugguuuguuaacagaucuggaaaucauugggggguggggggagggaagaaccaauuucucaaugucauuuccaugcugaugcuugucugggacucauauagaaguuauaguacuuccaugacacgugggcaggugcuacuauguauagcauaagaauauuuuuuacccuacauauuagcaacuuuaagacuugagcucaugucuggugggguagcucagcagagaaaagcacccguugccaaagccugugacccgagugugacucugauggcggaagggaaaaggcaacaggaguuucucucugaccccagcaugcgcgcccgcaccaacacacgcacaaaauaaucguaaaucauugaaaaugugagucugggucuggagacauagcuuagcaacugguuaagagcccuggcuacaaaaccgugaaggcagaguuuggauuccagcacccucagaacaaggcacgccuuuggcccaguacuggggugaggggagaacagagagggucuggagccuguuggcugccagcccagcugagaaacaccacaagcugucguuucagagagaaacccugccucaagggaacaaggcagagagugacagggacaccugacgacuucuacacacaggcccgcacaccacacaacauacacagacccacauaacauaacacacguaggaccacacaccacacacaggcccacagaccacauaugggaucacacagcauauaccauacaacacacacaguccuacacaccacacacggaaccacacaccaacacaccacauaucacacacuacacuugggcccauacaccacauaccacacagaggcucaaacaccacacauauauuaaauauuaagauaugacauuuauuauaacaauaauaauauauacuguugauuaacaacgucaccgucuaacagcagaagcaggccaucucaacacugauagaauauuaguauauuaguguauuucuuauggagcaaaggucagaaaccacacaaacggccucugcauacggggccaagcuuuuaaguuuuaaccuuuugaauauacauuuuaaguuuuccaaauaaaaagcacuguagaaguuucucugagaaucugaugcaaauaauuuuuuaaagauuuaauugcccuccacugcagagagucggcucucucuuuuccugguagcuucgaugacccuuccuuugcacacggaguccuaccaaagcugacucugcugcuucaugcugcuggucaggguuagcacccauugcagagaggaaauaucacaugaacguaaagcucuuuggcaaacauaucuauucaugauuugauguguaucauagcuuuaaugauaaaaucuuauguugugaccggagaaaacucaguggcuaggaguaucugaucuugcagagaaccugggauccaucuccagcacucacaccaggcagcaaccaccugcaacuccagcuccaggagagcugaugcccuuucuggccuccaaaggcacaugcucucaaaugcacauagccacacacacacacacacacacacacacacacacacacacacacacacacacacagaggaauuaaauauagcucuaaauguuuauaaucagaaguauaaaaguauucuugggaaagcaguaaucuaauaaaaugaguuuuuagaagaauaaggucucacuggguaaaccugggugguauagcacuagguagaccaggcuggcaucaaacucacaaaggcuuuccugucucugucuccuaagugcugggaugaaagacauaugcuaccacauaugcucacaaaaguuuauguugcucugacuaaagacaagaucugucuuuguagcccuggcugucuuugaacuuauuguauagaccaggcugacaucaaacucucagagauccaccugcuucugccuccuaaguauugggauuaaaggggugaucuaucacaucuggaucauaaaaggauuuuuaaugaauaccauuuucagguauuuugacuuuaugucuauaacuauauauugaguuacuugaaucucagaaaacuuauucuugucaaccuucauauaucaagaaaaauguuacaaggcaauuauaaaaagauucuuuguauuacuuuuccaaauguacuuaaaaucauacaucuugauuagcauaaaacauuuuuuuaugucuugcuuucuauugcccuugaauacuaagggaaaaauguaaaauuuaauuucuuuuuagagucuguuuuagaagaaaauccuuacagaaauuuauguagcaaauaaaaauuuuuguuacuuaaccaacuuuuaucgcaugccuuaaugaauacugcuuuacguaaacacugggugugcuuugaagucuuuaguuucgauguuuauugucccucuagaggacuuccuugagaagaucagauaucccuuaauggugugcgcagaacacuucaauguucugugaagcacauucaaugugcucaauauuucauuuuaauagauuuuaggaaguuuaagcguacggaaguuuauauggcaagaaagcauagcucuaucacaucuaggaaacgauaagcccaaauuaucucuaugacaaagaaaagcuaagcuccuccacguuucaggcuuugugguaaauccugucccuggguuuuaaacuggccuaccuggggcuggagaaacggcucagcggguaaaggugcuugcugucaagcccaggccuuccaaaaaguuguccucugaccucugaauggcaacacugcaugccugaauacacacaagauaaauacauagguuuugggcuaggugugauggugcacgcuuuuaaucccagcacuugggaggcagaggcagguagaucucagugaauuugaggauagccuggccuacauagugaguucuggaccagccaguaaaacccuguuuuaauuuuuuaaguguucuuaaucaauauuuauagaagacuuaaguggugugcuggcugguuuugugugucaacuugacacaagcuacuuuccuagagaaaggagccuccccugaggaaaugccuccacgagauccagcuauaaagcauuuucucaauuagugaucaaggguaugggggggggugcccauugugggugguacuaucccugggcugguaguccuggguucuauaagagagcaggcugagcaagccaggggaagcaagccaguaaguaacaucccuccguggccucugcaccagcuccugcuuccugaccugcuugaguuccaguccugaccucguuuggugaugagcagcaguguggaaguguaagacgaauaaacccuuuccuccccuacuugcuucuugggcaugguguuugugcaggaauagaaaccaugacuaagacagcgggaucaggaucaguuagccauccuuuuaaccccugcauugcauuuaggcuuggguaagguaaggaccguaagccauuucucuaggagauggugugaggagaaagaggacuaaaguuuaaaauuguuuauaagcuuacaugggcagacauacacacaaaaaugcuucaauaaacacgcuaauaauugcaauguuaagcugagagaggacggggaucaccuuaaguuuaagaccagccugggcucuggaaugcaaccuuaucuuaaacaaacaaacaaacaaacaaacaaacaaaaucucuguauguaauagagucagaaacagacuaacaugcaaaauaacaugcaagaagaacuauacaugucuuaaacaugaaggcacuuaaaugugaaggcacgaggcagcauccuccuugggggccucaugaacucaguacguuccaugcuuaugcagauuacagcagagaugacuccaaaaauauacucagacugaaaugcagguagauaagucugggaaccuuaauccacaguguggguagacuagcuggaaucaggcagcuguggguucagagagagacccugccacaauaaagcggagagcagcugggccgagagagaugacucggggguuaagagcacuggcugcuccuacagagacccagguucaagccucggcacccguguggugauucucaacugccugaaacuccagcuucaaagauucuucugaccaccaugggagcugaacucaaguccuuuggaagagcagccaacauugguucacuuuuccagucugaucguuuauggggcacugucagccagaggccagcagacuuuucuguguggcagcuuauuugguccuuuccugugagaaggcaggaaaggccaccggcccucagucucccuugucuuucucaacagucccuguacucugaguacggagggguauacaucucuccuuaggauuucacauaaccccucuggcacccacuccugccucagcuggcucucccucccagccugggcucagcucaguaagccagaaaacaucuugcagacuuuaucuuuguaguacugggcauugcguccagggccucguaugugccugguaaauucucuggcuccaagcuucacucaaaauccauauagucaaccuuugaagauacccucaauagcagucuauaggcccauaaucccagcuacccaggaagccgaggcaggagcguugggucagucuggguuacagaaucaauuuaaggacggccuaagaacuuagugcgagccugccucaaaauaaaaagcaaaaagucguauacagcuuggcgguggaacacuugcuaagugcggauaaggcccuggguucaaucccaaaaacugaaaaaaaugagauuuuuucccccaaauccuccaugaauaauauaaagagaaacaauagcauugcaucaguuuugaggaacaaauauuccguucucagaguagcucgcauuuuagcauuagagcaguaaagacaggguagccgaggaugacccugaacuggugagucuacaguuucccccucccaugugauggaaagcaacaacccaacaccacuguagcgggcuggggaucgaacccagggccucacgcacaucaggcaagcgcuuugcccauggaggccugcaggaugucauugacaucuggcagcccacgagucucuuaccuacaggcauggcugcguuccccgcuauugcuuugggagacugcucuccauugaugcuucacccucuagguccucuuccucucugcucccacaucuuccuuccuuccuguauguggcgaugaugucagccgucuuagccaggcauugcuuuaaccagaggaaccgaguggguucuaagucacucccuggcugguggcaugugucuggggaucucagugagcuuggugcugggucaagugagucuuuggggagug

SEQ ID NO: 5355 - RNA, 69219 nt, Mus musculus
ccccuuuugugcuccucgcggcugggcgggcgggggaaugucauugccgcuccgagccgccgcuccucuggcgcccucgucccgucggcucucgccgccaccgccgccuccucagccgcacgggggacacggauggcuaguggggcgcaggggccuuuuggguugagaccgcgacggucgcggccacuguugaggcggagacuucggaucgcugccgccuccaccacccccagugucccggccucgcggugcugagggcgggagcgcgcccagcucuuccuccgccuccgccuccuccuccuccucguugucgucgccgucgcccuccuccuccuccucugggucuccgcccagcaccccucgcuccaggcggcggcgguggccgcggaggacgagcgagacccgccgccggggcacaacauggcggagcccucggccccggagagcaagcacaagucgucccucaacucguccccguggagcggccucauggcucuggggaacagccgccacgggcaccaugggcccggaacccagagcgcguccagggcggcggcgccgaagccggggccccccgcggggcuguccgggggcuugucgcagccggccggguggcagucguugcucuccuucaccauccucuuccuggccuggcuggccggcuucagcucgcgccucuucgccgucauccgcuucgagagcaucauccacgaguucgacccguggugagugugcccgcccuucccccgcaggcagcccgcgguccccguuugucuggagccccucggaucccacccggucucccgcgggccgggccgggcgcgcccccugcccgcuuggcgaaguuugccugggagcggagccuggguccucggccgccggggugggccggcuccgcgcggcgccucuucgccgccgcgccccggcuugcuccgggggcccccuuccccacgcccucuccgccgcagcuuugcgccuuguugcauuuuauuucauuucucuccuuccugccaucggagcagccccgggauugccuucuggcugcugguggugacuggaaccccuuguccgcucagccucgcaguuucaugcuuucuuuccgggagaguggaguguuagaauguagggggggaaaauauuaucccgaaagcgagcgcagugguagcgccucguguuuuuccagcaccagguauuuuccggagugucucuuuccccccuaaggcccuuaagugcucucagcucgccacacuauuugcacaguuguauugcguugcuuuuuagagcgagaucguuuuucuguuagcugaacucucacccucguuguugcuacaauauccgacuggguugcaugaguucuuuuauuggugucugcuggaaggucuguggagaagagagcaagccguaccacagugcugagagucuagauuguggugccgaaguugcacgcucugcauggcacucacugguuuuagggacuuaacuucgaacacugaguuaccuacacgggaagauugcuuuucacuuucuuccuccuggcccaaccugaguuaaguuuuuuguuuuuuguuuuuuguuuuuuguuuuuuuuuucccccagagagagauugagagcgagcgccagcgcgccucuuuaaacuaguuuauucuucaggcugcccuaucaaccuugaacuaaucuuacuuguaauuagacauaauuaaacgguaggguauuugucuuaccauuugaaaugcacagagaaucuucuuaagaguuaguacauauauagguuauaaaugaguuuuuuggggggggcuuauguguuaaguaucagauuuaaguuguacuuuaagaaaaauauuuaugcugcaauaucuauugaacaccagaggggccuacucaaggaaaaccuguuuagagaagcagugagcuacagugauggccugcugugagguguuuucguccuauuuuaagagguuuccauuuuuuucuaacauuagauuugcuuuauaaaugaccauuauguuauuuggaaccagaggagaaaaucauguugguggagauuacauacgaaccuacgaauauuugugaagucuuaacuaacuagauagaguauucuuugaaacaaucaauuagauuaaaacugagauugacuagaaaugaaagccgcagaauuuacugaacaacaugaaaagagaaaguugugucuuuucagaugaagauagcacgggguggaacaaaaacuggaaauauuuccaggguaauuguacagauacuuccaugaaguaacauuuuuuacaaauggaaggcugggaacuguuaggagugcacucagaagcugaaauuaauaauuacagauaaaugcacaaauaaaugacaaggcgauuuuaaaguuucuuuuugucauuuuccccuaguaaagcugcacuugaggcggcuuagauuagauggcuuuaggaauugaagagcauaacuuuuuuuauucaugaaaaucuauuuuguuucuauucugcuguguauggaaacaguucuuugacuugagucugcuccacuuacauuuuaauucacauugcugaucugcaaguguccacagcuaaggccuaccuacuuaacuaagcucucccaucuaccagcgguaguguuaaauguuuguuuauuuuugaugaaauguuaugcuuggaauguuagagcauucuaauuagcagauagguguaguaaaggaauuuucccugccugcaccccaucgugcaucgggacuugucugugugaaucucauggaaugccuaacucaagagaccuaaugagagaaaucaaguucaaacaaaaagaauacugugcucacuuuagguuuucuuuucauagcuguuacuaauaggcaugccauucauucuuccaucucauaaucauucuugaaaauuuuuuacaagggagguuguauagcuugccugucauuacuuuugacuuuuaaaacaguuuucuccaaagcuaauaacagcagucucucacacuaguuuggaaguggcucagauuacagcgcaguaaugacaggaaccuuuaguaauauuuaaauguucucucugccuguuucuacaaaccaauucuggccugccccauaccuccuucagucccucuucccccuuccauuucuguauccuuuuugugaaaggcuguugauggugaguugcuucuguaaauuuuaucuugaauugugagacuucagauagcugccaaaggugaguugucaccaaguuacaccuguuuuuaacuuuuucccugaaguuauaaaucuuaccagcugcuguaagagguaggcuaugagguuauugacuuaacuaccuuuuauuuagaucauuuggcaacguuugggguuaugaucucaccuuuugugccagugaguuucucccuccucagcugaguuggugagauuccgggcagcaguggaaguuauucuguagguaccagacauuugguugaccaacuaguuuaacgagcaugugucuaacgcauccuuuuaucugacacuguauguaguccuugcauaguuuugcugugauugugaaugcauguauguuccauuaaccagaccuuuccugcuagcucugacagguugugguagcucucccuguuagcacuacuuugagauauccuuguucuuguagaaccgcuuuuuaggggcuccucucuggagagaauuugggaauuuagaauuuaaaguuuuagguuuuagcugaaacuauguauaaauagguuaauuagugcaaacaguuucaaaggagugauaagccuugaaaguaagcuguuaggaguugggggcugcuuccugucuuuugaggucucccauguuuuucuucacuuuacaaaugacaaaaaaacaaacuguugaccucauaucugaagaagacagaaugguuagcaaaagcaagcaguguagaacagaaaguuucccggaucuuuuaaagccuccgugacugggaucauuagcagcagcaggccggcagcacuuccaggugggauacaccaccacuguuuucauuguaaucuacacucucuggcccggagcuucugggauccucgaguuagaaguacauguaauaggaagugcuugaguggcugcaucugaugauggcuuugaauccgugcccacuugcagucacuguucuccucugguagucaucauggcuuuccugaagcaugagauagauccugaagcagcuaggaucugucuuuuaagcccuuggaaucuuugcuuuuucuugaggguuuucuuugcuuuaggaccagacuaagcaggauuccaugcuuaaagacauacguggcuugcaugaagacaguugguugucuaccaagcauuagaaacuaaagguuuccuucucuggcucugaaccuauggauguggaaaugucuuagcagccugucuguaccuugaccuccagucuucaugcucucaaaaguguugcauguauagaaaaaauauaagauagccuuuguuguacugucuuaauauucaccaguccaccuguguucucagaaguaauuaauaccaaggccgauguuuucuacagugaaaucauagacaccacagcacugcagcugcuuugaguuaaaagccucugcauuucaguagaucugccuucugcuaagugauugugcuauaaguuuucaacauacgggaaaguugaauuuuagagugaacauucacaucacuacugccuauguucucugauugaugguuuguuuuguuuuguuuuguuuuuugcuuuuuuuguuuuuuguuuuuuuuuuuuuuuuguuuuuuugagacaggguuucucuguauagcccuggcuguccuggaacucacuuuguagaccaggcuggccuugaacucagaaauccgccugccucugccucccaagugcugggauuaaaggcgugcgccaccacgcccggcuuaauguauuuuucuuaacucuucaaugucucuggcugugcuuacacccuucuucuagacucugaaaucuaaagagacuacuggugcguuguccagugauaaaggaugcuaccuugcuuccucuacuccaugauaagggacaacuuuauuucuggacugcauuugguuucuguaaaagcugaacccagcauauacaaauaacuguuuuuguaucuucacuuggagugcaggccaggaucagauuccaucccuuucagguuuuggucaguaauuuuaccugaguacacuguaagccauguuuguuaaaugacuuggcucuguugucuagagagaaaaaucugaagugguugaguuuugguuuuauucuauuucacuuaugaagaacuuggaaagucuugauugucuuauuauucagccuguugucacuaccauguuucauccaaacaagagaggccuaaaaagcauauacaggaccugaaagcauguacacccaaaugaaaggggcacgauaggggccgcccugcugauucugaauauuacuugucagugugaaccagccuccucuuccuuccucccaggagcuugcuaugacgcccaagcuggcaggugggguuacaguguguccugcuucucacuccaccuucugcccugaguacuuaccugaaacuuagaaauggauagagaugguaguacgugggauaaagaaaagagcuccacgucuagugggaguaaguguagggagaguuccagaagcgucuguaacuggagcaaauuuguuuacugauguuguaggcuggccaaaguauugagccacuuuuuauaguuugugaguauuugaaaagugcuuccuuagucugagacauguaaacguuuuggaauauacuuuucaacauaaauuaguaaaugucuguuuauucacaucuguaccaauauucuauucaaauuuguaucauuuaaagauaagcaaaucugugaauugcaguaauuaaguuagccauaucaucuguaacccuuucuuuguggaacuuaauguuguaggaaacauuaacagaauuuccaagugauaagugcaaguucaacaguaucuuacuuuguaauauucaccuuucgcuugagggaagggguaaaaucuuuuguuucauagacaaacauuuuaguucaaugguuuccagaucugccugauuucaaaaucuguuuuuauguacccugccuguaaugcagguuuaaaagaaaaugugucucuugcucuuuuuuuuuuuuuuuuuuuuuuaauccuuucugaaacuguauugcucagcccuggcuauccuggaacucgcucuguagacuagggaggcuucaaacucagagaucgacugccucugcuuccugaaugcugggauuaaaggugcgcaccaccaauuuaauuuguuuugcuucuuagucauccguucuaagucuuuacucauuggcccaucaaaaaugcuuggucccagcccucucuaaugaaguuagcuugcuaguuggaugauagcuaguuauuugcuuguuuuaauguaggggaagaugaaaaguugauaaagguuuugcuuuuugguugaagaugaguaaugaauuuucagaagugggccuuuuacaaaguagcccauugagaagagaagaugauugaaucuaguuaaauauuuucacuaagguuugucuguaaaagguucauaauguugaguuuggagguacuaagccaucccagcauggggauuuugaguggacagcuaugcucuuagacucagaauucuagagguaaauagauuuuuaaaguacaugugaucccuuaucugguuuccuagacagagggccugagagcugcauaaacuacccacagggagcugaggccuccucagagugagguguuguuuuuggggggcuuuuuuaaaguuauaacuucagaauaugagaagacauucuuuguguauuaccacucauuuugaauugaggguguugaaaauaauacuucacacauagauguggaaacaggacuuuuguauaaaguuuaauuuggaguuggugauauaaaaaagcuguggguaugaauaccugucgcugccauaaauuaaguuauaaaacuauucuuuuuuuacugugugcucgucuuuaucaaaagaaauguucuuggauagaguagucaaauuuuagucauuauuaguaaaauucuaaaguaucaguugauaagcaaguuguauaaacuuauaacccuucccaguuauaauaguuuuucccccaguauguuuuuuuaaaagugaucucuagcaauccuuucaauuuaacaagacuuccaauauuauuuuuaacuuaagauaugcacagguuuuuguucucuccuuuucuugguaucuaacggugcaauugauaguguguacgugcacaccuguguacuaauguugaaggugagcuuuugucugcagcauuacaaaaauuaaaauguguaguaacucauuccuaaagugugcauuaugcacacauuacauuauuuuguuucaggucagauuugucuaaagaaaagcaugaggccaaauugaauggcaucguagaaaaggauugugcaaguuuauuuaugaaaauaaauuauuucaccaugugcaauccacagcaaaaacagugaauguagaauuaucaaagacaaagagcacuguuauagucucugaaaguaaaucucaagugcuuaaacaaaagagcagaaagugcagugcggaggcuuuucuuauaggugaaagggcuuucagccuuaggaaggauccagugcacagucaaaugaggaccucaucugaccauugugcucauagccauuuucaucuccugugacacugcuucuccagcccugucucccacauugugacggaaccuaaguaacgguccugaccgugucguagguggugagugagcuuucuguuugcuacgcugacagcuuaguuaaccugcuuaguuaaccuguuuuuaguaagccgagcuguaacguuaucccgcucuuuugcucaucuguuuugguuggaagagucagagcaucuggccagcaagaaaggcucagcaguccagcaccugagauauugccuguucucucuguagcagggcguaccuguaaaaaggaagggaaaagcuaacaagguaacaagugaucuuguaaagaauuuuucuaauauauauuuuauauguuuuaucugcauguaugcaugucuguguaucauuugccuacaaaaacccaguuacgauuuugcaaugccauguaaguauuggagauugaaccuugguccucuagaagagcagucagugcucuuagccacugagccaucucuccaggccuagauaacaaaugaucuuaaagccaacucuuuagauagagucauccuuuucucuagauaauccuugaaggauugaaucacucagaagacacagaggauauaggaagcaaagcauggggacaucauuugggagacaaaugauaauggaauaaaaacaguuacuguucaagaacugggcuuuggggaaggagcagccgugguguuggccaugcuagugcuagcuguuuugagagacugagaggugcaggggugaugaccaccccuaccuacacucacacugcacuccugccaccucauggcaugccugcgccaguucucucucccugggguuugcucacccaugucucuucuaccagggccagcccugguaugcugcccaggugauguucagggccagcuuacccgcucuuacgaccucggagucacucuccugacuggaucgagggggcagagggcaccccaccaccaccacuucacaguagaagaguggcagagccagcucucccuagcucugcccucagagccgucuccuccucucucccucgcuuccucuugaccugggccagcauuacugagcugaccaugugaggugcaaggccugcuuucccaagugaagugcaaaauagcuccccugagcacaugacccugugggcagcuuucucaacugcuggagauggugaggggcagagggugagcaucaccucugugccaccccacagcagacagucuccaauuccaccucucuucauaaugcuaaaacugcucuacuucuuucucucccauuugagcaccacauacauguggugccauguccuguuugggcccucccugccucccgcaggcuggccauguggcuggugggccccugggugacaucauccaugcugugggcguaguggcaagugggugucuaugacuccugccccucuggagggcagagggcaggucuuugucuguuuuccucuaccugugccaugcugccuggacuugacuucaauuuuuaugaguccuaggcauaggacagcuuuggccaucaagccaggaugcacaaggcacugccaucugcucugcccuugacugauaagaaaccaccaccaccaaggugucuucauugcuaauuacaaagugugugugugcacgcgcgugcgccuuuuguguuuucagacaggauuucacuaugcaguuuaggcuggacuagaacuugugagguagugcacaccagccuggaauucuccauccugccugcacugccccuuccuaacucuaaaccucccaagugccaggaccaugccuaacaguaauuacuugcuuuguuguuugggauaaggggugugugugcgcgcauaugcaugcucacauaugugagguuugucuuccuuggaucacccacugcccguaauccaggacuugucacuugaacccagaguuugcugauugagcuaaucuagccagccagcucagggacuccuccuugucuccacuucucagcaaagcaggauuacaaaguaggaugcuggggauccgagcaccaguccucaaacuuuacccauaauucuggaaagaggauguagacaucugagcugaaagaauuuaggaaaguccuaagaggguacuguuugauauguuggggguugacauaugacccuuucacaggagucaucuaagaccaucagaaaacacauuuaugacuccuaacaguagcaaaaugacagcugugaagaagcaacagaaauacuguuauggcuagggucaccacagcauggggagcuguauuaaagagucacagcauuaggagacugagagccacugcucuaguguuccugugguuacuaaguuguacccuuuuugguuuguuucccugauuguuuacuggcugugucaggcuucaggaauauugagaaagucauauucugaagaguuucucaaaaaucaucuucaaggauaaaguuaauucaaagaaugauaaaagaucauuggccuucauguaagaaccugaccuuuacugggcucugaaaauugggugucuguuagcaaacacuuuaugauaucaggaaagugacucuaguugggaaggcuuccuuuaauaauuagcacuuaagugaaacaaauagaaaacuugcaugcauuucucucuggugauuagaaugguuuggucugauuuggugguggucucugcuauguguuaguauaaacccucaugcuacuugaguggauaaugguuucuuuuguaaacagauaaugggccguugucaaacuuaauuuauugcugaagaaaaaaaaauuaaaucuagaacugccuuucuuaaaacucaguugaguuagccagcauuugaauuauaguccagauuuuaaaacuuaagccagcuauccuaugaaagauacuuaacauaugccaucauccuaaacuccaugcacggaacaauccaagugccuugaggguagacuccaccuggguaccggucaguguaaggauggaggcccucuuuagugcuccugagagagacuccucuugaaugaauuccgaacuggagauguucuccuaagugucuuaaguguugcgagccaugccagguagauucuuuucagaaaagccaccggaagguuagucaguauaggcucuaucacuaacauuauaggacauuauagaagguuagucaguauaggcucuaucacuaacauuauagaacauuauagaggguuagucaguauaggcucuaucacuaacauuauaggacauuauagaagguuagucaguauaggcucuaucacuaacauuauagaacauuauagaagguuagucaguauaggcucuaucacuaacauuauaggacagucuuuugcuaaacuuuacugaggacugcgcagcugaaugaacaggccggagccauuuguugaaguuuuacaucuauaggguaaaaauagacuagguuucugugguuacgaguuguuuuguuuuguuuucugaauuuguaaaacacagucauuuggauuuugacacucauaggccccuguaguaagugaugauuuaaugugaccacagaaagcagaaaaaguuccuuucagucaagaacaucauuuguauucucccugcaguauuuugcacaguauuaggggccuggugaauacucagugaauauugaaaaccuuuugucucuaacuauauaccgucuuauaaauuaacuucgucuuaaacuaugcgucuugguuuggugaaacagucauguauuaagucucuuggauguggcuguaaugucagaagagucagaugcacugaacgcugugacuccacccucacagguauauuuuaguccuaaggacgaggaaagcugcuggagaagagaugggacuaacugcagaagagagaugugagcaucacuggcggcugcuagcuuugaggguagauagcugacuggaugcagucagaagaacgucaagagaaaguguucuuuuaguuguaugcaguuuucuuacaagcacaaaucugaguuccuuuucauguuuuaacucauaaguuaaggaacauugagucagacaagaaaaagacuaguuaauaucuacaagcugccugaauuauaaaaauugcauuguuaauuuuugagauggugaauggaaaagaugccaucucaauaacagugaguuuacaaacuagaguugagggauaauaagagcugaaguuauugugccuuaacacuaguuaguuguacuaaauucacgcugacagugaguuuagguaggguuagauuacugcuccauccaucacucuugacugaacucagugacaugcaaauccagcagcacuucagaaagcauuggaacuuugaccuauuaaacuuagaaauuaaaggauacuaaauaaaaauacucauuagaacaaggcaauugcuguauugugaaagagucuuugcaguggaaauaacuuugugccuaauuauuaggugggucauuggauaguagcuuuuaguaaauuaguguuaaauaagccaaaauaggaagcccuuauccuuuuuuaaauuguuauuuaaagcuuaauagaaaugacuggucuguuaaguauuccugugaguccuugaacugaaaaccuagaauugaccucacaggauuuuuuuuuuuuuaacuuaacaaaacuaucugccuaaaaaacauccuuuguccaucaauguaguuuaaaaagagucuguuaguacauguucauagccccaaguuuagucccuggcacagcaaaaggacgacaacacagguaaaaccgaaucuugagugggauuuguucagcacauuaaccaacauuuuauauucacugacuuuuaaaaacuuaauacaccuguccauaggcccaagaucugguuuccacaacauguuuguucuagacuuuaaccaagagagacuuucauuuuaacaugcuacacagcugacauuugaaggagaggaacaggauggugaagccauguaagauaaugaaauggaucuaauuuuaacaugguuuaaaggccagucguaugcucagaguagaggaaaugagcuugaacaacugacuuuaaaaauccagcuauuuaugguuguuaaauugagacagucacuucauuaaaagggagacacccuuccccccuuuaagauaguaauuuugguugucaagugacugaacuuaaacaaucuaauauaaacaaccuugauacaaaagauuuuucuuuuaaaauaaaacuauuuugaauacuuaaaaaguauuuauaucauuuaaguuauguuaauuaggccuauugggccugaaucacagcauaaggcauugcuaauagguugggguauauuuaaaacguaaccugcacauuaguggaauguguguauucuguauaauugugaaacuuacuguugauauuggaaaccuacccagcggcugcagaauugagcaccaaauucauauuuaccuguuucuucucuagccuguuucucauauuuuuccuguugcaacuaggaaaacauuuugacuucauaaaugucuugauuauauguguauguguauauggcaggugugugcaccugagcguagguaucuagagucuaggagugggcgcucagguucucuggagcucaaguuacaguaguugugaguucuaggcuuuuuucuaucauagauaauguuaaugauaaaacuuuucugauauauacauguguaaguuugauagugguguacuugcacugacguaauauucagcuauuuauaaagaugccaucucaacaccuaguggacagcagccagcgguuuucaccauccugugggccggcgaggaaguugugccagccugcauuuugagagcguuaugguugucuccacaggcuguagcgggcuggggcgggaaugccucagaugccugggcauuggugacaugcuggaacucugaccaugcauuaaucaggauuuggcucuuuccuguauuacauaggcugccucacugcaugcuuccugggcuccaaaagagaaucccaagaugggagaagccuccugguugauaaaaggcaugaguggacagcaucauuuccaaucuaauuuauuguucaggugauauagacuuaccucagugucaagagagaacacugguauaugggugcagaauuauuuaggagcaucuuuagauauucuaccacauuauguuuauuauuuuaaucuccugugaauaucuuuggccacuuuggcuuuuuguuuguuuuuuauuugcuuauauuugaagcagugacuggcuauauaacucgggcugcuuccuccugccccagguucccaagugcuggaguaacagucauacaucacuguccuugucaaccuuagugcuugguccuaaccaguuuuuaaauuagcuucuuugucuuaaugauuuuggcagggggaggacggggagaggguugagacaagguuucucuuuauagcccuggcuguccuggaacucacuuuguaguccaggcugaccugccucugccucccaagugcugggaucaaaggcgugcaccaccacugcguggcuugucuuaaugauaugauaagagcuuucauauauacaucuuuauuuaauauauguauacaguuuacacuaaagguuaaacagguauuuuauuucagcuugugacuuacacaauccuaugguauuuauauuuuauuuccccaacuuuauagaugugcuuuaguuuguguguuaaaagaauguacucuugaagucagauagcuuccaaagaugacauuuuguuuuaaagaacagcauuugcaaaaguaugcagugagauguccaucagccaaucuguuauauccucucuugacagugauuaacugaucacucugugugacguuuguuagguguacaccgagaacagguaaugcuggagaaggugcggagagugacggcucccgagcagguacaucuagcuccaggugguuuccagugucgcucacuucccuaguucuuggcuuccccucuugaguuacucguuuggaucguucggucacuaucugcccagacuuugcacacuuguuuuccacagcgaggcuaguuacugucaguguucuuucugagugugcucucucuucucaggguaugaaggguuugccugagacucgggauuuucuugccuaccucuacuuccauacuuuauucuagaaaguaagguucuuaaguauuguggcuaaaauacuuugagcguguguauugagauguuuguccuauguucuuagaacgcuguagacaggucaguugaagcaugacugaguuaccugagaagugagcgugccacggagcaggacugaagugcagaacacaaaguugagggaagugaagccacuuuuuuucaggccugaacaaauaggaaaugauggaaauacacuugaagacacuucuccgcuuucaaaucaggcagauuuguguguauuuucaauuuauuucaauucuguuuguugacagcaccccaguaggccucgugcaaacaugccaccccauguuucuugaauuuaauccccgaaugcaguaccacacaccuuuaguccuuaauccuagcaguaggccagcaaucugugaguucaggcuagccugauugcaugguaaguuccaggccagucagaggcuuuaauaaggcuaaguaaagagccuuugucucagcagacaaacaaacaaacaaauaauaaauucggaugauggaaguagaaguuaaacaucagaaggguuuucaugcaguagacacacagcuucuucgggcucuuuuuugagugcaugguucaugcccugacauaaacagguggaaauuggaggaccacugagccagcuugccagcccucuaguuaguuuuucaaaaagucaaguauagccagguguaguggguccacacguaaucucugcacuuggaaggcugagguggaaguaucccaagauuaaggccaagcuggccucagaggaagagccuuucccaaaacagaacaaagagcauguccuugauagugcagagacccucucuuccgggggacugauggaaauggcagcaguuaaaaccuuaaugccuugcugugaagcuuugcuggguguugucagaucuucggaguuuauuguccaccucacugagggaaaagagugacagugacuuaaaggagugaccagacagcugcagacguuacucagcccuucacuuucucuugugcucaccacaagagaagccggugcuuugucucagcacacgcacgcucuucugcugaagaaggucugguauuauagaggcccaccugccaguggguggagguaagggagcguuaucccagggcuaagccgcagcuucgugugcaccgaugaguaccuucagcguaccgcagggccugucugcucucuuuaggucuuuuccuucagaguggacuuggagcucuuuuucaugcaucauugguuaguucucugcuguacugaagcacuacuauggauggauaccuuucuuugaauuuccauaucugaaguuauaaacuugauuguugagacagugccuuuaagaugucagcuggugcaaguagguuuaaauugccuuuggcuacagugaaauaaagcuggcuuucccacccucuguguacuuaggaagcuaucugugaagucugcuguccuugguuuuugauccugccacuagauggcagggauaauaaaagaugaaauacuaguguuagcgccugcuugauaggugcugcucucuagcucugcuaguacaauuuggggugcauaugaagucucucaacuagacaaccuaccuaacucuguaagaaccacuguaaaacaugaguggaguuaaugacaagguaaaggagaaagaauggaaagcuguuuuucaucuuugagguaaucauugguguuuuaaaacagaucuauuguuuuguuuuguuuuguuuuguuuuuuuugagaaagggugucucuauguagcccuggcuguccuggaacucacuuuguagaccaggcuggccucgaacucagaaauccgccugcuucugccucccgagugcugggauuaaaggcaugcgccaccaaccuccacccggcuaaaacagauuuauuauuauuauuauuauuauuauuauuauuauuauuauuguuguuguuguuguuugguugguugcaugauguguaugggaggguucacaugccacagugcauguaucaagguuaugggacaacuuuguagagucuguucucucuuuucgcauuuacaugugaguggauguagcauuuuggagcuggaacucagguugccaguuuuuuuuuuuguuuuuuuuuuuuuuguuuuuuuuuuuuuuugucgaaauugaugccaguugcugagugucucucagcugaccauccggguucugaccugccuuucugcaugcaccuuguugaauuugacuucuuuuuuuuuuucucuuguguuaggcuuccuuuagcaucuguaacuggucauccuuucaggguuccuauuugcuuuccuauugaauaccuguuuuaacaucaacauuuuaaaugguuacauaugcaaaauccuagaacaaucuguauaaaauguagaacuugagaguaucuauggaagucuugccaaguaaagagcuuguugauagccuugaagaacaggauaaugagaaacuaaagggcagcauaugaugaugugauguuauagaagacuuugccuuggcuggagcuuguagcuacagagugcccggcacucaugaacccuggguguaauccccagcagcacauaaaugaggugaaguuggcgcaugccuguaaucuagcucuugggaggaagagacagaaagaaguucaaggucauccuccgcuacauaguuugaggcuaaccuagguaggauauaugagauuuuugucucaauagaaaaagaagacuucuuggucuucuaugcaggcuuucaccagauaguccucgccggcauuagaauaaaccgacauauugacaaguacaggugacuucugugauguuucagucaagaguuaagucgucaugacucucagaccuaucaccccaagcaaaucucaguucugccaguagccuaagugaguuuaacuuggaagaggguuguuucccaguggauucccccaaaggagagcccagccccacaugcacucuaagccaaggaccuacacugaacucagcugggauugugacccacgaaagaauuugguagcaaggcacuaaccuaagcccgugcaacuugcuacacaaagguagagaacaaauagaaaugcccuucauagcccuuguuucuucucaucuugcuacugccuaacaucuaaucaaggaauaguucaugagucccucgucuguaccagacucuggauauaaucuugaagucagcaggauucuagucuaguagggaagauagacuuaaaccaagaaugacagaugcugugaaaggcgugcgcugugaugagaguguagaagauuucagucauguuccugucucacagacuugcccuugcuuucauuagcauuaugaaaugcuauguacgguuuuuuagccuucauacaugcuuuccuccuuuuagaacauuucuguuuuucugcuugguaauuagcucagguuuaagaaaaugccaauuguagaggccuucugugagcccuguugauagcuggguuugugagaguuagacugugccagugccagagcaccguguaagguaagcuccuaaggacagacaggaccuggcaaggaggcucuggaacuccugcacacugcuggugagagggccggccaaugguaacuccugugggaaacccuuaauguuuucugaauacaggcuuauagccuagaaguggagggagaaaguacuuacuaauuccuguccagagacaggaaauauaaucuuuaaggcucgguccuguaugagaaugcuuaauccaucaggcuaugcuaugucucauuguucucaacugggaacauccccacagcccaucaguaacaguaacuguggauagcagucguaagacaaauucgcuuagaagugaaagggggcacaccacugcugcaugggugaaucucagaaacacccuaacacuguuaugucacucuuacauaaggguagcaccauccucuuuaucaaaagaaagcggagaaugaacaaaugaguguauguggugaaagaagucacuguuuaaaaagggaguugacuggaaagguaugugugggaacuuucugggcuagcacuguuagcucauugcaugaaacaugaaaauagguauguaucagugcguaaaauuuuacuccauuuuuuuaaaauguguaguauguacuuguuuguguagguggguaugcauguucgcucagccauaguuccuuuguuccuuuauauauuuacucauuuauuuuuugacugucucacuggacugaagcacagugguugacuggucacaggucugggacccuuucuccaacucaguucugaaguuaucagcgcugacugagcaaucuucucagcccuuacuucagauuuccaaaaugaaaaaaaaaaaaaaaaccauauauaugauucagguguuguaacauucagguguagcuaucugugcuauuaauggucagauguuagcccugcagagucaggaagccagucugccucuguucucaguuaccauugugcacacaugcagccucauucaguaguuaugauggaaaguuacuugagaacuauaguuucuuaaaguuaauccauauuuuauggucacauuuucaggaaaaauacuugcacuauuguagaauuguaugcuuacuguuuaugugauaucuagcgucuuucugugccagaacucacaagacguguguuugcuagcguuagccugcucuggauauggauuugagauagugugaaugcuguuuguaagcaucuaaacaucugacuucugaauggauggggcuucauuuccuuuaagcaggugaaacuguguccauugccuucugggucucuucuugcuaugccaguguuuugugaggagcuagauauguguuuguguguguguguguguguguguguguguguguguguguguguguacacauuccucugauugcucauagauuuucuaauagggcuagcuaguuaugucuaagcgggauucuuuagguaagaaucuaggacucugaaauuauugauaaaaucucuuccauaaagacaguguuuuguauaaggauagguuccuucaguuuucauucuccagccuuugcugcuguguggggaaguuguuuuucucuuccaggacacuggaguaauacuacuagcugggaagagccgaggaaugaaaucuguaauggaggugagccacccuuaggguggggccauacuucguaguccaaggcgccauuuguguaauggaaauguuagaggcccaggagcuaccaaugggauggguuucugggaaaggcaaagcacggcgucuucacugaauguucugugcauggguaaguuccuguuacuaggaguaaauaagcuguagagauugagggagaagccuggcauaaaucagauguggcuuuuaaauuuaguaaaggacaagucaaagcaggaaacugagaaugaguuguuaaacuugaaugauuuauacauaucaaaaugcauguuuauguaucuuggaagauguugcuguaacuuacagcagaaacaacagacuuaacuuucuuuuuuuuguuuugguuugguuugguuugguuuuucgagacaggguuucucugaguagcccuggcuguccuggaacucacucuguaaaccaggcuggccucgaacucagaaauccgccugccucugccucccgagugcugggaucaaaggugugcgccaccacgcccggcagcagacuuaacuuucaacuugccuuucugccuuccguccuuucugucgugcuggcugccuuccuuccucccugagcuccuugccuuuuuccauccuccuuuugauuugauguucuaauuucuacuaaguuuucaaucauguauauuguauauuaggaagguaaaauggauuuuuggguuguuuuguuuuggaaaguaggaauuccugccaaucauuuuugcuauagagauguaugcacaagagagcaaacuuucugugugagaauggucuguguccuguccuucugcugcacucugcgccaaagccauugcuguucaggagugacacuuguaaggaagcagacacuuuuauuauuagcuguucucccaaaguaguucuuaauacuggguagcacgcuugucuuugguggaaggagaggcugagccuuguugagagaaagggagaauugcucuuaugcucgugcguauacaucccuuccuaagacaagaagaagaagagccuagcacagugggacagacuagacaucaguucacugaaacuaguucugucaagauugacagaaguugaccuuggguccagguagggcagagauggagacacacugcucuguuuuucuuuuaugggaguaacacuuggcuuguaagaaagcauuuauaaacuugauaaggccuuuaggagguagugauugucaccuaucaagcaggccugaucaagguuuguuaggggccaugguuacaguaacuguuaaagaguuuaaaucugaagcaacccagccauuuugcuggacucuucuguauugguuccaaaguaacuuaacaaaagguuccauguuacuccuuucuuucuuuugagccagggucucacuauguaauccuggcuguccuggaacucacccuguaauccaggcucgccuccaacucacagagaucugcagccucugccuccugagccuugaguuuaaaggcgugugcugccaccccaugucugguuucaaguucauucuuaaauuuucuuuuaaagauucauuuuaugcuuaugaguguuuagccuguguguguguguguguguguguguguguguguguguguguguguaccauaugcauggugcuaaagagaucagaagucauucuagaaccaaggucacaguugugaacuaucgugugggugcuagaaacugaaccugauccucuucuagagcaacaagugcuauuaacugcugaaacaucucuucagccccacaucuuaaaacaauuaagagaacuuuaucaguucuuaguuacauguuuauagaauacauaucuaaacaugaauaaccaguguuuuucaaauacucuuagcuuugaacccuuucauuaaaugagauuuguacaaguacccaaaauauaacagagaagugcagauuaaauggaggacaacauguucuguauuccaauucuuaggaacauagccaagggagagccuuuuggaacuccuaagcacuuuuaaaucuacuucaaaauaacagugcccagaaggggaugugagugaaguucugcagccuccaccgcugccaccgcugccacugcugccaccgccaccacugcugccaccacugcucagagucauccugggaucaaguugaagaaugugggugcuggggcuagagcugccaucucagccacuucauagcuguaugacuuuggccagguguuagacauuugugccuuaauccagucaucucauuccgagguuuuguuuguguuugugaaugugugccagaugagagaaugaaaaaaugccauauuuaguaccacaaguuagaagaauuguaaacagucuucagaccucauaaccacgcucccucucaggaacugugcccauagauugacuaccuggggagagacuccccaucagcuuacccugugggcgaguuauucccuuguuaaugauugauagaccagcucauuacaggcaauuccauccugggcaggugagcaagccaugaggcucaagccaguaagcauuguuccuuugugcucucugcuccacuuccugcccucagguuccugucuugacugcccuccaugauggguuauaguggggacauacaaucugaaauaagccucccuuccccaaacugcuuuugguucaaauguuuuaucacaacauuaccccagcauuugcaguagaaagcaagcuaggcaggcuugccuuuacuuacuaguuucuuuaaccucucucugaguaggugacuccuucauucuuaagugucguacagauggugugagauagaacuuuauccuugcuuagaggagucuguccuaucuucuaaauuuacucacauuuuguggaaccuuucccaucucuaaucugcuuuguguuuauuguauuuaagccccagaaaaaccauuuuguuuuucaauuuucuucguacaucaaaaaagcuugguauauaaauauacuugagaaauuuuaaaaaauaaaugauuuaucacuuuguagaagugaugcguagaaaagccuuguguagaggugugugcuauuuauucgaauguucugucagacaagacuuccugggagucuugucucuguaggagcuuguguuuccugauuuauuuauuuuuuuaauacaaacuauaguuaaccuaacuucucaacuuaaagcaaauuagaacucgagagaaggguucaaggcuuugccugguguuguguuggcccaugccggccuccaucuacuccauucauucucuuguacaacacuuucucuuuugcuuuuuggguuucuuugagacaggcucuccuuguguaggccauuuggccugggauuucacuucccagugcuccuccccugaguacugagaucacaagcugucacuccuggccuuucugguuucucauugcccgcacucaucccagcugccuccccgggccguuaccuuucuucucugcuccuacuugauuguuccugccgugugccuuggguuuggugcgcagaggcugcguuagacuugugcucuugccuuggguauaaaagcuuuguggacucaacuguuuagauguaagacaguguuucuuucucaucucccuuguauuggugugcuuuuucacugcuaaaugguugagguccuccccccagucauuuuuuugauugcuuccuucuuagugucacuuuauuuuagaguuuuuuaaaauuuauuuuuaugaaggcuguuucuaaauggcugcaguaucuucuguguuccucuaaaaaugugcuaaucuuggaucugagaaugugaugcagaagugaauagaacugaguaugguggccuacaccuucaaucccagcauuuggaaaacaggaaggcagaucucugaguuguuggccagccuggucuguagagcaaguuucagauuaaccagagccacauagcaacauacuguuucaacccacaaagaguaauuagaauacgaacuauuuacaggcccuugacaaucauuuuaauuaaauguuaugaaaaaauaauaauucucacaucucuccucaagaaacaggcaguauuugauugauugcauacauacauuuggauccucuuuuggaggagaaacguuuuagaacaaaagacagagcuggcccuugggaaaguggcuuuccuuuuaguauguuuguagcacaccuguggacuaagagcugcucugauuuacugcgguagcuaagaaauaggugaaaauuacuucccagcuuuucuggcucauauuuuacauauaccauauaaugcuaaaacaauggugggaucauagcucaguggaagagcauuucccuggcaugcuugagacugaauuccuucccuaguagauuaaguuuaggguaaagcacaaaaacuuacauuguuguucaauacuggggugccuagaggaguaaacugugcugccauuacuugacucuuguaagcaaagcgccaggagcaugaaguccuuccgagggucacccaggcacucucacgcacccgcucaugagugaagaacagagaauaaguuguguguuuggcaagguaagaaaggcaaugcuuaaaauugcucaaagaaggugauugauaaauacuuuuuuuaauaucugaugccagaaaaagacaggccugugguuaaucucaaugccacuuaaguuugcuuuggauuggauuuguagugcugcgacugaggauuugcaugagagaaaauagccaaacuauacuuagcaguaacaccccaaucugcagcacauuuguaguaagcuauaaauuuagauugugacaauuccuguuuaauauaaccaugagggaggcagacauuuaggauguaaucccuugaccgggagccaaaaguuucuuagaccuaaggaacuuuagugcuuuaauuaaugaacacuguuuaacagcaagaaaaacuuguauaaaaauuaacuguuacuguuugcuauaguuugugucaguccaaauguguauacauuuaagcuugaaauuguuucuccuggguuuuuguuuguuugguugguugguuguuuguuuguuuguuuguuguuuguuguuuuuugguuuuuuuuuuuuugaguucaugaagauuuuauuggaaaaauacuguuucuaaaacuagaaaccgaguaacguuuuuaguuuggaacuuaaugguuuuguuaaauauuuuacuuugacuaaaaccgguauucaccuguaauuuuuuuuucuuucuuuuuuuuuugguaauugaaaagauuggcaauuacagggaugcugaagagagagcaagaggggaguugugaguucuuauugacaguguucuuaagccuuucagaaucucugaguuaccucuuuauuuuuaaugccagaauauucauuauuuuccauauuuaaaauauaguauaaucuagugauaaguguuaauaagcauaugugggguuuuaauuuagauauaaagaauagcauuagagaugagauuaaaucuaagcaaaggugcucaagauucguaaguaaaaugguacgauuuguggagcagcauucaggaagaccuagguaaauggagaucagccacauucuugaagugaauauauccugguuauaaagauguuaauucuuaccaaauugauuggagauugaguggaauuugcugguuaucuuggguagaacugauaaacuugcuuuaaaauuaauaugaagaaucugaggcaggaagaauuagcuacauagggaguaucaggucagucagagguacacaguaagaccuucuauccagaaaaccaaacagaaaaaaaagaguuuaaaaauuccaagaggcaggccaaaaacugcuaguaaaauauucucucggauacaaagauugaaugcagagcaguagcgaugaucaguugagauguacuaaggguuuaauggguaaccugaaacuguuagucacgaagaagaaaaugagcaucucucugauccugcugcagcagagcguucuuuuucucacacucccucuuucccuugccccuguacuuuuugucuuuccuuugaaaaaacaaacaaacaaacaaaaaaaaaacaaaaagauaaauuuagguuuauguaaagaauuuguguuuaaaaaauaccaugggagaagagacuggagagagcgcccaguaguuagaguggguauugcucauguagaagaucuggcacaucaggugguucacagcugcuuuuaguuccaguuccugcagaccugacacacucuggccuccaugggcaccuaugugugcacgaugcacauaaacccacaugcacauaaauaagaagaaacuaaguauugaaaaaauaccaguggcuugguaagaagauggcucagagagcaaggacucuugcuguagagaugaacugcuuucagucucuggguuccacaugguggaaagagaggaugcuuguaggugguucucuuuugucaagcaccagcccuccucugaaaaauacuguaauuuaaaauacuacuggcagaauguaaagagaagccacaguaugagaguugauuuauaaaacugacaaaagaauagugcucaagacauaaaaagauuuauucaaaugcagacugauguaaugaccaagggcgcgagcuauuucucagagagcugccuccugccagcauuaaauguugacacuaaaccaagacccagcaagugcgcuuccauuucucuucagguuccagcccuugaccaaggaagucuucaguagacuccuaaugccuugcuuuccuucaggcugggacaucggaaguuacagcuaacaugucacuuuggagagacuaguguugugguuauguggcugacagaaugccuuuccugucauacccaugcagaacugcaguccugcaucaugggagcagagcaaacacuccaaagaaaguacauugugucccuuagaaaugugccaaggauguggagugcguuagccagguuagcaggauauauauaacagcagugccccaggugccgcaaggguggauaguguaagcacugugacaguggggaccccaggugccacaaggguggguaguguaagcacugugacaguggggaccccaggugccacaaggguggguaguguaagcacugugacaguggggaccccaggugccgcagggguggguaguguaagcacugugacaguggggaccccaggugccgcagggguggauaguguaagcacugugacaguggggaccccaggugccgcagggguggguaguguaagcacugugacaguggggaccccaggugccgcagggguggguaguguaagcacugugacaguggggaccgaggugccacagggguggguaguguaagcacugugacaguggggaccccaggugccgcagggguggauaguguaagcacugugacaguggggaccgagguaagacugcaggacugaagauccagaauggaaagaagggagcuugccugaugugagacugggguuccaccacuauggggagaaguagaugcacagacagagauaaaggcucugaggagucugauggagagacauguggcaggccgcacacaauuagaaggcugacaggacucgugcaagaugaccaggcagucauuuuaagaugugaggaaaggguggccccuagacgcugaacgcagauggaggauauguguuuggcuugggauggugucucaggugucccccugucauugguuuaauugaauauugaguuugggguaccuuugugacauucagagaggaaauauagcuaaagauagagaaggcugguuuagaaaugagaagggagguccaguuggggagauaagauugcaucaugggcucagaaccugggucugacucaggucucaggaaaugucagagucgguuccugaccauuuuaaguagaagaugcuuaccugcagagagaggggagcagcugcagagcugguggcucuaaagcguguccaaggaaggcaggccacucacuguaaagggaaaguaucccgagggcagccuugguggccaacuuggagugacaugcuccugcuuugugaaacauguuuauaaucauuacuugaaguaggauggugguggugguguuuuguuuugucuuguuauucaaaaaaaguaguugaaauuuuaagccuugauucuuguuguguacuggcucuuucauucaguauugucauaagguuggggaugucgcucugcuuuuucagggggguccuuuccuugccuaguuguugcuuaucagugcaucuggagcucugcagcgcuaugugcucucguuguuuacugugauuuaggugucaggggcucaguuuugaagguaauucugugguguggagauugcugaguggcaccaaggacagucuaacuuuugaucuuaaaaauccucuuguugagaguguggccaggcagcucgguccgagcagggcuuuccuugccaguggauuguggggagugcauagccagucucuuguccucuguucgacauggcaucuucugaugcucaagugaaagagcuggagaagugugcuucggccaggcuuuugagcugauucucagcccuuggucaaaagaaucugucccucacccccacccccacccccacccccaccccaccccaucccaccccccaaagaagaaggaucuuccccuggagggaauccagaagaaauuagaagcugcagaagaugcaagucucacgaagcggaagucuugaagcagcuugcugagaagcgggagcaugaaaaagaagugcuauagaaagccauugaggagaacaacaacuucagcaaagugacggggagaaaggacacacaaaauggagacuaacaaagaaagccggggaugggguggcugcugagcuggggcauuugcgagagaaggacaagcgcggugaggaggugcggaagaacaaagaauccaaagaccccguggacaagaccaaggcuaccuuguuccaagagcugacuuucuccccgaccccuuccuaaauacauauccagagacuguacuggccagugccauuuacuuucccuccugacagauagucuagaagccgaccuauagguagauccagaccgugagauguuuuaggggcucaaggggagaaacuggaaguguuuuacucuuuuuuaaaguguuggucuuuguaacguagcuauuuuucucguugcaucuuuuccacucgggcacauucgguaugguggguuaauggcuaguacuauauugacugugaaagacguuugugaagaguauguaguggcuucuucuaacccauuagauguugaauaucuguucacuuugcaaucccaauucugucccaaucucaccagaugcuacaguacuucaguggcuaauaaacugcauagugcuguggaaaaaaaaauccccuucucagaaaauguauuaauauuauuccauugccuuauaggaucaagaaguuacacugaaaaguguaucugauuuuguuuauagaguguuauuuuacuugauugauugauugauugauugauugauugaauaaaugaauggauggauggauggaugggugaaugaacuauacuuuaucaguagcauuuugggcuuauguuugaagccugcucugcccuccaaacccuuguauuacucagugauucuguauggugaguggaagaacucagggugucucuugauuucuuaacuuuuucauacguuguuaccuuguaauuugcccuucacuuuugucuguuaaaauaaccugcuuaugauuuaacuggauaaucacaguuuuccuuaaaccuugaaaacugguucuuuuaucaucuguucaucacaguaguagccucuucacagggacuugcuucacaguucucucuucauagugagauauguguagccauauauugaauauaaagaaagguguccuuguguuaacucuuuuuauaacauuuccucuucucuuuuguccagguuuaacuauagaucaacacaucaucuugcaucucauggauucuaugaguuucuaaauugguuugaugaaagagcaugguacccacugggaagaauaguggguggcaccguaaguauauuccuuaccuuugcgguaacuguaaacuguggaguaaagcauuuccugcuaagggacgagggucucggaaggccgucauuaguucacagacacaucuuccauggcuaauuagccaguguuucucagcuccgcucuuggcaguuuauuuguaggauaucuuacacugccccccauuucugauugaggucaggggcuggauuaagaaucugcugucacaaaguaccucaaguccagagugcuuuucgcuuuguuucugaacaauugaguuuaaaagcuuuugggggaaggaaauaaaaauuuugaaaaucaaauuaauuaaauguuuccagccucaagccucugaauuaauguagauaauugaaccguauugaguaggguagaguguucugccuccagaaggaugacaugaagguucuuaggguucaguguguaaggagaacuccuagagaagggggaagauguggcaggcagcucucggagaaguuuguacacuuucguuucuucuugaauuuugaugcuacagguuuaucagcaucacuccucauaagugucugcgcucucucucucucucucucucucauuaguucagauucauuccuuuuuucuaaauccuugaguuuauuuuuaugcuccccucccagcugccugugcuguuggucguaacguugagccucuguccacuguaggcuguguuucugguggucauugcuguguugucagcagcacucccugagucuggugguguuuucauuauccuuccuuucauguuaaucuguuagggucugcuucaucugggggcuuuugguuucuuuuaugcuuauucuguagcccacgcuagccucgcauucaacaguaacccuucugccucagccucccgagugauggaauacuaggugcaagccaccaugccugccuaaaauugcauuuagccuguaaacgaggagggcuuuguagugcuuuuuuaaauuuucaaauguauuauaguuaagaaauaucuauaacuucaggccuuuuauuuuuccauacuugauuauaaccuuaaugcauucuaauuuauuuacuccauacuccuuccuucuguguuuagaaagaguggugcaugugugugugcacauauauucacaugugggugcacauguacauguggagacgagaagucagccacagauguucccugggugcuguccuccuuggguuuguuguuguuggagcagaggcucucacuggccuggaacucucuaguugggccagguugauugcucagcaaacuccaggaaucucccugccucugcccaccaugccauuccccaucucccagcacugcacuauaagcaagugccaauaguccaugauuuaugugcagcuugggggugaagccaggucuucaucugagcugucucugccgcuccagucuggggauucuuauacucacucuaacauuacuguaguuuuggaacaaucuuaccucugugggacuuuguuccuacuuaggaaggcagaguuccuuccugacuucccugaugaaugagaagaaauuguccaguuuaguuucauaacaggaucugacuuugcugggaacuaggccuuuucucugacuccugugccaagguaaaaccacugaaccucuggcuacaaggcacauauuaacaccugguuucuugggcuuuuuugcuuucucuuucuuguggauucuaguaauaugaaugccuacuuaauuugaacucccuuguuuuuuuacaucugaagaguauucuuuuuuucccuuaaaguuuaaauaaguauguauucaaucuuaaacuuaugaguacaugcaugcguagggccuacagaaccacgggggccauaggaacugggguugugaauaguuguguacuaacauguaggugcugggaacugaacugaguccucugugagagcagcaaguacucuuagccagcugagccgucucuccagcuccgaguuugaacauaucugugcuguugggaggcuuugguuuuaguccuuugacccaguaguacuuuguauuuugaagguuuucuuacauuaguuccaucugccaucuaauggauauguugacuuauauugagaagcacuucagguuugugucuauuuucuuucuguacugcagacagaaucauacaguaguaagacguauugaauaugaaauggaacaaaauguuguaagaauuauaaugacuucccaugcuggucuucucaaccugaauccuauucugugcguucacuggacgcugaauauccacucuacaccuguauugucacugaugcugagaaaugcaguuauuuuucuggggcuuauauucuugugaaguugagcaguuaaaaauaagauuuauaaaguguguucaaugcuaguaaauguaauaaaugucagggagagaaagcaagggggugaguuaaagccacgggcuaggagggcaugagacacacagauucaaguggggcagucagcgagugagaguaccauguuguuaccuucgugccucuggucuugagagcaagagccuuuggggaugcaaaugcaggguuaaacaguuugguaacugaggaauaccugggaauaaauacccuggguaccaaaucuucuuguguuuguuucuuuuguugucagggugggugugccaggauaguagucuccccucccaucccugauacuugaaacagugcuuuaagccucuuagucuuuuuuuguuguuguuuccaaaugacuaguccuucuuagcuagagguauuuacuuucugaaucucagauugaaaauugggggagacuaacuuauauucaucauuucucuuuuuuauauauacacaauaagaacuaggaugauaaaaacgcuacuccuuaaaaauaaaugacuggggcuggugagauggcucaguggguuagagcacccgacugcucuuccgaagguccagaguucaaaucccagcaaccacaugguggcucacaaccauccguaacaagaucugacccccucuucugaagugucugaagacagcuacaauguacuuacauauaauaaauaaauaaauaaaucuuuaaaaaaaaaauaaauaaauaaaugacuaagacaguucucagaacugagaaagauaauuaauaaagaugauugcauauucuuauuuuaauauuuuaaauauuaaauauuaaaaaauagaauaucuuauucuugguuuauauucucucuguucuuuuaaguguauuucuuauaaauuugaucuuuguaucuauuacaaaaagauuuuauuuuguaucauguaaaaauuuuccguucacucuuaacuacaaaugauguauacuaauacaaauggaagaaguuguguguuuuguguguguguauguguccccacuuuguucacuauguaacuaaauucccuuuuuccccccucucuagguuuacccaggguugaugauaacagcuggccuuauucauuggauuuuaaauacauugaacauaacaguucacauaagagauguguguguauuccuugcaccaacuuuuagcggccuuacauccauaucuacguuccugcuaacuagagaacuguggaaccaaggagcaggacuucuagcugcuugcuucauugcuaucguaccaggguacauaucucggucaguggcgggauccuuugauaaugaaggcauugccauuuuugcgcuucaguucacuuacuacuuauggguaaguaccagguaauguuagccgccuuaaaugcuggugaccuucugcccuaaggcuuuagggcacacaugcguucuuuaccaauaaaguuucacacagaucuguuacuacucauaguacauuuaacaaaaguuaccauuuaaaaagcauacaagccaaguauaucaauaacuguauuaauaugucuauauaaauuuuaauuuucaccaccuuauuguaucuacuuuauaaucauagcuuaaaaaaaaaaaagcuaaucccagcacuugggaggcagaggcagacagauuucugaguuugaggacagccagggcuacaccgagaaacccugucucggagaaaaggaaaaaaaaaaagcuaccaggagcagccugucaacuaugcacaccuuuuaugugaacacuuuuuauacauuuaacuauauuuuaaauucccuuaaaagcuaccuggcuuguggguauuuuuugcuuugaccuggccugaaauuccaggaagagugcugcggagugaucuauagagaaggccucucuugaucucaaguuugaaagagagaaagcacccauaugagugaguuugacauuaggacacucaagaguacugccaucgucaucagaaagugucuuuaaggacucuucgcagccuacaaaggggggguggggugggcaggaagggacagacuaaaacaccacaccuaaacacaaaauuuuguaaacuauuuaaauguaaguuuucguauaaaaauaauacauguaaaugugaguagaucuuguuaauaugaugccagugggaaacuuugugagugaauagucgugauaaauuaugaauaugaaauuuaaaugaugcaaauuagacacuugcaguuuguagcaaaauuacaacaaugaggaaugugccucugcuccauaggguguguagguggcccugaggagacagaagucaguaaaggagaggcggccuggguggcuucaguuccuuuuuaaauuaaauuauuugaagaaaacaguggcauugauuucaguuuggaaguuuggauggauacauugguuaacuguuucagccacuuacauucuguuacuacuucucauguuugcuaaaaauacccuauuaugggaaacuuguacaacagaaaagugaagguacaaagucacuuagaaauaacucacucacagugggcauuuacaaacagauuauaguuuucuagccccuuguguugcuguauacuuuuguaacaagguuuugauauguguauggaagugucugagacuggccuaaaguccuugccugugccucugccucccaagugcuaggaucauaguuacgugcuauuccuggcuucuguuuacuuuuuuauccuucauuuucuuccagcuggugggugugaacuguugaaguaguagugugcuaacugaagucucagcuaccuuuuaauauuuaaauuuuuuucuaaaauuuuaauaaaauucauuuguguuguuuuaaagaguacacuuaauucuuacugcauucaguguugugcagcuggcauugcuguuacagacauuuuuucagucuaaaaguugugcuuggaccucaacccugcccucgucaguaccuccucuucccugcuguguggaagccaugcaccugcaccagaaaguuccaaugucgugcugcucuuggaugacacugucuggaggcuugugugcugggcccacauguagaggccaaagggcaaguuuguaaaauugguucucucuucccacuuuacagcgguucuaaaaccuaacucagaucagccagcuugcaaggcgagcacuuuuuaacccugagaccucucucugagccaucggacuaggcuuaucuuuuauugacuuaccuagucugaacacucgacuuaaaugaaaucuuacaacauaggacguguagugucuugguuuuuguguuuagcauaauuguuacacacauaucuacuuuauuuuuuuccuccagcuuuuuucauuaugguaaaauacacagacuauaacauguaccaagugucaugguuuagaaauguugucuauccuuguaauguuuuguggccauucauaagacccacucacguccuguaaaaugcaaccaugcuaccuuuugucucauugucuuuggcuaauuaaauagguagagaccugccguauacacuuguauaaauaacaguuaaucuuuuagucuuuuguggaccucugugccacuuuccauaacugccauuuccaguuucuaccaguggcgagcagaggagucuacugacugcauguguucaccagcacuugcucuuugauggcuguuucuuauucugggccuaggcucgccucaaauccucacuauuccugcugcagccucccagauagcugggguuccaugcauaccuuuauaccuggcuugguuucucuggugcuaguauugaugcuaauaauagguguaaggcugugugacugguucuguuuugcauuuccucagugaugagugggaagcacuuugugugucuuauagcuaguuggguaauuuuuuuguagaaaugucuuuuaaagucccuuccucauauuugaguugaauuuuaguaguucucuauguaugcuugcuacuaauccuuuauggauuaucuauuucuaugugguucucccauuuuauggucugccuuuuuaccccaugaacauauuuugauauauaaaaaucaauguuuaugaaguucaacuugucaacauugucuuuuguuccuauuauccaggaaaucacuguaaaacaucacugugagcucuugcccuaugucuucguuuaaaaauuuaauaguugugcugggcgguggugguacacgccuuuaauccccacacuugggaggcagaggaaggcgaauuucugaguucaaggccacccuggucuacagagugaguuccaggacagccagggcuacacagagaaacccuaucuugaaaaaccaaaccaaaauaauaauaauaauaauaauaauaauaauaauaauaauaauaauaauuucauaguuguuuuaagguuuauauugagguugcuccacaaagguccgaauguauuaauuugcauacugacuucuuuuuuauuggauauuuuauuuauuuacauuucaaauguugucccccuuuccaguuuucccuccacaaacccccaucccauguucccccuccccccacccaccucugggcugcucucccacgcaccuacccauuccugucucacugcccuagcaucccccugugcugggguaccaauucuccacaggaccaagggccucuacuucguacgcagcuggagccauguguacuuuuugauuguuauguugauuucuauuucccccuuugauugaucuugguaccuugucagaguuauuugaacacacaugccaagguuaccuagaguggaagguguguuuguccuugugccagcacccacuguuugaccuaccggaacuucguaguacauuuugaaauugggaaauauggguucccuggcuuggcucuuauucauaaucguaauuguuuaauauucuuaaauuuucaaucacuuuaaaauauccaucccuuuuaaaauccaaacucguuuuacaauuaaaagucucuuaacugugggcuccacuaaaacaguuucuuccuucaagagggaaaauaucagggcacagucacaaucaaagcaaaaaucaaucuccaaccguccaaugucugggaucuaacucacgaucuucugggcuccuccaagggcuugggucacuucuccagccaugccccuuguagcacacgcguaguccucuaggcuccagaugccuguacuucacugcugcugcugcucuugguggucaucucaugguacuggcaucuccaaaacacugcaugaccccuucaguccugggccuucaacugcaacugaggcugcacuuucaccaauggccuuccauggccucucacagugccgagccucagcugcucugcgugaccccuucaugccuucaaaaccaguaccaccugggugacccuuacauauuaccaagucccgcugcagcaggaguacaaccuuggcuaucucuggaacacagccucugugcuuucagaaaacacuucccagaagaugucaccucaaugaugcuggucucuucuuaaucaccgcuaauuucuuagcuccagcuaaccagcaucaauagucccaguaaugccaaguuuuugcuuuaguaguucugguaucuuguuaaucacagcugauucuucagccccaacgaaccagaacuacagaaucuucaaaaucaaaacagcaauggccaugaaaagagucuuuaauuuucccccugaaauuucacaaaccagaccuucauuuucugcacuguugucaacauuaucuuccaagcuccuacacaacaucugacagagcucuuaacaccgaaucgaucuucuggcccaaaguuccaaaguccuuccucgguccuccccaaaacauggucagguugucacaggaauaccccacucugcugguaccaauuugccuuagucaggguuucuauuccugggcaaaacaucaugaccaagaagcaaguuggagaggaaaggguuuauucagcuuacacuuccaugcugcuguucaucaccaaaggaagucaggacuggaacucaagcaggucagggagcaggagcugaugcagaggccguggagggaugagcuucccuuguuggcgcauagcugucauaggacacacguuccauguaauggacauucuuagguauuggucaugucucuuguaaucaacuuauacauuacuuuccuuuguuugcuaaagauuuccuaagauuuuaaacauaccaaggucauuuuaucugccuucuccccaggucaaaguggcuguugugccuuuugcucuccaguguguauauuuacucuuccuuccuguuuguacugccuagaaucuaaguucaguguugaacaucagaagcaagcuuccacgugcucugacuuaaguggaagcacagagaagcacccgcccaugcgaugauuguagcugagggccacugggcuucauuauaguuuaagaaaucuuuccuugguguucagcuuagcaguucaugguuagacucuguuuucugucccuguuuaagguugaucacauuguuuugaccuuugcuacagucauguuuuuuauccucugcaucauuaauauuuugguugaauuaauuuugcugugucauguauuauauuugauaaauuaucuaccuuuauauacucuaggucuuccuguuaugacaaccaaaugugucucuagacauugccaaauguuccucaagguucagaauuaccccagcaagagcucacugggcuaggggguuuuuguuuguuuguuuguuuuccuuuuuuugcuucagauguuacaauaguuuuguuucaugagauaaauauuugcuagaagugcauacugcuguguuuauauuauguguauuuuguuaggaguuuuauaucuacauuggugggaaagacuggaucguaguuuucuuguauuguuuuugucugauuuugauaucagguuugcaggaggcuucacaaaugauguagggaguguuuucuucuuggaugcucugaaaaaguuuccaugaaauuuccauugucucuuauguaacauggaauucaccaguggaccuugaaagauuuuuaauuguugaaucaguuuggguuuuuuuuguuuuguuuaguuuuuaugcauguuuuauacacuguugcugucuucagacacacaccagaagagggcaucagaucccauuacagauggcugugagccaccaugugguugcugggacuugaacucaggaccucuggcuggaagagacgucagugcucuuaacugcuggggcuucucuccgaucccaagcugaauccauuuucuaauguuauuguucugaucugauuuuucucuucaugaguaauuaguaauguguguccacuuugaaccauuuguauuucauaucaauugugugcuuuguuggcacaaguuaauuccuguguagucuguaaugaugucucauuucugcuuuuaauauuuuguauccucccuuucuaguugauuagccuggcuaagguuuaucuaucuagcuucugggcuaauucccucccccaauuacauugauuucuucucauucggaaaaagauuacuggacucuggagaagcuuuaauuaaauucaaacgcuucaucucuaaagacuaaaguuguacuuugcucaucuguccuaaccaagucugccuuuuguuuggugaacucacacuuagcaccauuuauucugugauucuauuuauauuuguaauauagcaucuuucuaucucuaauguauauuuuuaaaucuuaguuguucaguuuuuuuuaaaaaucuuuccuguguauagugguuccugugcaucuugaguacagucugccucaagcuguuaagauaauuguaguacauuuuagcaguguggcuccauuguuuuucucuuauuccauuaucaucauauauguguauguaucacucuccuaaaaaaguccagauaauaauuauauuguaugcauguauacacauaugcauauacacacauacauauuuauaguugauugcuuuuguucugcuaugaugggucucagguagcucaggcuggccuuaaauuugcuguaaggcugagguuggagugcuggaauuacaggccuauauaccacaccgagcggccugucuucaugauaguuucuuagggcuacuccuuugguuuuuuuaucagagaucaguuaauaagcauuuuccccuaugguuauuuuccuuacuccucuucuucagaaucucaauaucuaucucucucucucucucucucccuucccccucuccccccuccccccucugucucucccucccucucucucucucuccuucuccccccugucucucccucccucucuuucucucccucuccccucugucugucugucuguaucucucucucucucucucucucucucucucucucucucccucucccccuuccuuccuuccuuuucuuucuuucuuuuuuguguguguguguguguguguauuuuucaguccuuugacuguugucuaauuugguuuucuuuuauuuguuauauuuguuggcuuauugggguucauggcucuguagauuguccaacauaaacuuugaacaguugugauuuaaaaugggugcccuaccccaucucuucaaagucucuuugcuuucuggaguuuucuguguguucuuuggaauguuuuuuuauugcucauuuaugcuuguacucucaaauucuaguugcuucuaguuuuuuauuucaugaguacaaaaauguacauauuucacuucauuauugaagcucccuauuguaacaaaacaaaagccaaagcguuucucucuguagcucuggcuguccuggaucucacucuuuagccccagguggccuugaacucacagagaucuagagccucugcuucccaagugcugggauuaagguaguuugugauauagcugacuggagucuguguccucuaaauccagcaccuuaguccauccuaaucaaguuucugcugacugcuuucuuucuccccgaacauggcuccauccuuagacuccuggugaaauagcauuacagggagugcuaaaacuuuggauuuuguuucauuuuucugagcuaugcuggauuguuaaaccagaacuaaagcuggcaacucugugguguuuuagagcaguguaucuacuguuauuuuuauuucuaaccuuucuaauucaauuuagcuucuuaaagaucacugucugcauaaauauaugucagccaaggauuuggguggaguuuauguucaaguauuagcacagaguugauuagucuggggugugaugaguaccuucaaaguuucaacugauucuucugauaguuuuccaagccucuguguguguguguguguguguguguguguguguguguguguguguguaauacacuuaucucagacuguucucagggcauuaucauccagaguugugucauuggucccuggcaagucugccugucuuaacuauucauguaacuuuagguggcagagugguagauggcgucauguguuuggaguuugucaaguucauggugaccgucuguccaucugucugucccacugguuauguauacuguacacuguuaugcugcucccauugccuuacagggccauccugggcuguccucugcuuucuugcccguuuuauucuccaggcacuuuuuggcuuuugggaaaggauccucugugugacaccccgucucgucucccugguguccgcugcucuuccuggcagggcauuuguaucuguuacuuuagucuuuuuagcgcuacaggguuuguaaugacauuuccccucaaucaccccucaaauagauuaucucaggcuggcuuuucaauagccaucauuuuaauaacugucccccuguucucauugagagcaaugaacuaggaaggcuuucucuccucucccucccccuccuugcuucuuuucguuguauucguuuucauauuuuguaccaaagucuagauaucaccuggaguuaacuacacuguauuauuaaaaaaccuguuuuuaaaaagacuuucuggaaauuuacuuagguuuguugaacaugccucuuuuagcacaaagacagaaaacuuuugaauauagacuucuuugugauaggaacaguucuuaucuuuucuuggauauucauuuuaaaggcaaccauuugcugugugucugggucugugucacuuauuuugaagaugcuaauaauuugcuuuuuuaggucacaaacucauuuggaaauugcuaccuuaagacaagauugguuggacuuugauuuauuuguauguagccuuucuaauauagguuacugaggauuuacuuauguauuaggcccucuggaagacaauucaacaauauacauuuuaaaauguugauuaugauaauaaaacuuucuuauuguaaguuuuucaaaauggaaacuuaaaucauauauaugauccugaauucagaugaaaaaacauauaagccuagcagauuaacuauaugaaaauguagauuuacugaacacauuuauuuaaggcuccaguuuauugacauuaaccauuucauggcagaaaaugaaaacaggaaauuuucuuuauuuguucuuuuuacuuaaaacuaaccaaaaggacuagguuauaaaauacaucuuguugagcacuauaaagguauauuuuagucaguugggguagccaagccucaguccucacucagccuuuuccauuuuacaauggcauuugcguuuguuguuguuagguaaagucugugaagaccgggucuguguucuggacaaugugcugcugcuugucauauuucuacaugguaagaccugggccugccugccugccugccugccguguguguguguguguguguguguguguguguguguguguguguguguguguguguguguguguguguucuuagaaguuacuuuaagauauuuuuguaugcuaauguauguccucaucaguugauuugauaaccaaugaaucuuuaaccuucuaacugaauuagaacaagcugauucugaaagaccuugucuauuuuaaacaugaaagucagucccaaacacugguuuuuaagaauauuuauuuagacuuaauauccgugguuacucuggguuuuuuguuuguuuguuuuuguuuuuaagauucauuuauuuauuauauguaaguacacugcagcugucuucagacaauccagaagagggagucagaucuuguuacggaugguugugagccaccaugugguugcugggacccgaacuccaaaccuuuggaagaguagucgggugcucuuaccuacugagccaucucaccagcccgguuacucugguuuuaaaaauauaugauuacauuuaauacaaaucaaugaugugugugcgcgcguguguggucuguguagucuguguguguguguguguguguguguguguguguguguguguguguguguguguguggucuuguaauccguguuacagcuucagccaaucagcacugucgagagucgcacaguguggccaggggaugugagugccccuuuagcugagucacugaccagagucagaaucccuccuccuuaagcuaagugaaccuucuuucaguaaauagaucaucauaaauagauggaauacacgcuuguuguuuuugucuaaaaauuuauugcuuauauucauuuccaggacagccuauuucuucuaguucaguuaugugauguucuuagucuuccuguuaaaucaaaucuaacuugagcuauucuccauugaguuuagaaaagcuuacuagcuuuaugggaucaucaguaaaacaguccccccaaauccuagcauuguauuuuuucucauauuuagguugucaugacaaaugagacacacuuguuuuaggaagugagaaguaggagccaugagucugagccucucuuuucccacaggucucugcguggggagguuauguguucaucaucaaccucaucccucuccauguguuuguguugcugcugaugcagagguacagcaagagagucuacauagguaaguggcucugccucuaaaccgcgcucuuaguaaacaacuuuguuugcucaguaauugcccaugaaaaggcaguacauuuuuuauguuuaacuugccuuguguugauuacaugacacccugucacaaauaagcaaaaaacaaacaaaaaacaaaaacaaaacaaaaaacaaacagugggugggggcagggagauugccccaaaacaagccucauguguuuguucacaugcaguaacauguaaaaauaguuaauuugugugacugguucugcauuaccugugccugaauuuaucaaugagcuggccugguccaaggucuugggggaggagucaguggguagaagcauuauguaguagaacauuccuuacagggaugugguuauuaaugaaacugcagaggagcagagaugugaaaccuguacuguuuuaucacaagaauuucacuuacguuaaugagagcuuggauauaaaaugucaaaguuaaacaugguguaggauuuguuucucucagugagagacacgucagcuaaaacuuuacagagugacuuaaaauaauuauuucuuggggcuggagagagauagcuuagcaguuaacagcacugacugcucuuccagcggaaggacccagguucaauucccagcacacacauggcagcucacaacugucuguaacuccaagaacugacacucucacacaaacauacaugcagacaaaacaccaaugcacauaaaauaaauacuuuuuagaauuaaaaaaaaauguuucuguacuacaguuuuuauuugcuuuugaaauuuacacugguuauuugaggugaggcgauuuguucuguagguaacaggacuuugguaaagcuuauuaauuagaagccaaguaugguuguacauguuuguagucucaguucuaagagguaagaggguagcaaguucaaagccagccuuaaauguguaagaaaguuuugcuaauuuaaaaauagcuuauauuaaacaccucauauuaauagcaguaauuacccuaaauuugugugguaggcagagggcagacacaacauagauaguggucaaggguucucauaacagcuuugaauuuucuuauguaacauguuuguaauacuuauucugacacuccuacuuugauugucuaauaggguuuuuauuaccauauacuauuuggaauaauacuuuaauauuuguagcacaauuuccugauuacauuugcuuaaauuauuuaauuacuaucauacguaguuuugguggauuugauccaaacuauuggaauuaauaaaaagauguaugauuuuauauuugugacagguaaagauuuaccaagauaggagauugcucuugcauccuauaaacuagauacauuauuuugcaugauuggguuacuuauaaaagcauaaaguaguuuccaugcuagauugauccuuuuagagacgaugaucuguuuugaguuuuaccuucaggcuguaugaaccgggccgacggcagugcugaaaggcauuugucuuggccucucucuugcuugcaggucuuuguguugguuacaguaaaugcuuucuaggggagcaaggagcacucacucccugaacggaggucuagcagcaucuuucugucuuaagacuaaaaauaguagagccagggccuuucuuacuaugacucaacaggaaucuuugaucaaaagccuucuucaauuaauacagacagagauuuuuuccauaccuacaaacaaaaguggaauauggcuuuggugcugucauaggugagcccagucuuagaaucgucccugucaacuuguucaggagcacuucuguguagaaguuaggagacuacaugagaugcuuaggucugucuaaaagccugcucacuuaaaaucuaauacuugggaggcuggggcaaggggauacccagaguuugaugucaaccuugaucacagugaauuucaggcuagccugggguaaagaauugcgaccuucccuaaacgaauaggaaaguccuaaauuauuuuuaguggaauaaauuugcaauuuuguuuaaauucuuuuaaaucuguuuuauuuguaaauuaauguuugcuaauauuugucuguuguacuuuuugacacauacuagguagguacaguuccugcauaguugcaggagugauugagucacaguaucucauuuuuuaaaagcagaauuagccaggaagggcuaccuuuaaucccaacaaucuagaggcagaaacaggcggaucucugggcugaggcuugccagggcuacauagugagacuaucaucucagguggaaaggggaguuggguuuccugaguucucccuuauguguucacacuccugugugcucuuuuuuuuuuuuuuuuaaaagauuuauuuauuauuauauguaaguacacuguagcugucuucagacacaccagaagagggagucagaucuuguuacggaugguugugagccaccaugugguugcugggauuugaacucuggaccuucggaagagcagucgggugcucuuacccacugagacaucucaccagcccccuccugugugcucuuacucuccuguguucugaugcugucucacuagcauuugucagaacugaugaauugcuucuguaagacagaaguagaauuugaaacuuauuuuuauauugcacauaccuauuuuguuuugacugcauguaugugugcaccacgugcaugcaugccuuugugccugcugaggucagaagagggcauccgauccccuggaaccccaguuguaagccaucauguggguguuaggaauugaacccaggucaucuggaagauccaagccaacugacuggaucuuaacugcugauccagcccagaacuagagcuuuaaaucugggugcauuuccucuagguucucauccuccagauucucacccuuagucuccuacuggcuaguagcagaagguuccuuccuuccuuccuuccuuccuuccuuccuuccuuccuuccuuccuuccuuccuuccuuccuuccuuccuuucuuucucuuuuguuuguuucuuuguuuguuucuuugucuguuuguuuuuuugcuccuuugucuguuuguuuuuuuguuuuucgagacaggguuucucuguauagcccuggcuguccuggaacucacuuuguagaccaggcuggccucaaacucacaaauccgccugccucugccucccgagugcugggacuaaaggcaugcaccaccacugcccagcaauacucuguuuccauuggaaagugugauaaucuugcucgaguaguuugaggaagucauaucuuccugccuuuacaaauguggaccuuguaaaaugucugugucagugacaugcucuaccugguggcuaugagcagugucccugggaagaagaguguauaccugugccugugcgcacacccagcuguccugcuagucggaagagccuauuuccugccuguugcucuugcugcucuccccaggcuuuacccguuuaccaaaacucucgguagccagagugcucacaaaguagcaagguggcuuuacuaaguaaacuuuucaaccuucuuacaaacuuuaauauuguuugauagcagucagguggaacugauuggauuguaaggucuuucuccucuguaucuugucuaacagaagagggauauuuuguuagcuguuccuauuugacacugaccgagagaugaaguaacuuacaagggcuggugggcccuaugguggguuaauguagguggauuuguguguucacagacccuucucuuaaguuugcagaaagaagaguaguaguagcuuaaaacuccagagacgugggcagaggaaaaggugacaggcacugugugaggcccugacuggaacacauuugaagcagccaugguagcuccauaauucaaucacuaggguaugcaacagccaagaaagaccugucucaaggaggaagggagaccucuagguuguccucugaccuccacaucaugcccugacacuccagaauaaaagauggcccagagagugcugccgaguuguaauggcuucucagggagguguggaagugagcgcagcacucuuaucaaccuacgguuucaguggaccuggagcccaguguggcauuggccacagguucacuagcugccaugccacugccacucaauauucugaggaaaaacaagauuaggauuucuaucgauuucucucuaaacagaguaaaacuaaauuguacaugugaauaaguccaguuguuuuagggggcauuuuucuaaccaggagcauaguuugcagcagugaaugccaggaacuguguuuccacaggauggcagugugguagcacuuuuaugauguaaugagugauuuacgguaucguuggguugugcucuuucuuagagcucacuucuuugauggaauaguguaagagucgagaaauagguuaguguggcugcguagaaaguugggcuggcugggguugugguuugguaauggcuccuaguggaguuugaggaaggagcggugcugcggguguacugcugagguccugugaggauggugugugccuuuuaugcugcugcuccugccucugcuuggagaagccuccuccucccgcugucacgguguagccagacaugcugugcucucccugcuccucagacggacuuagaggccagcuuggauugcucuuaccaggauucucuguuuugaaaaugucccgauugucauagauauaaggucuuucugaaaguacacuauuugguacugucauauaaucuggagggaaaaguacuuuauuuuuacaguggauagagguguuucuucuucaucuucaggucuuucuacucaugugaaucuaauuuuccacuuuuuauguuuuaaguuuuuuaaaguuugugagauuuaaauuagauauugaguuaugugugcuauuuuauaaauuuaggaagcacaguaucuuacgugagguaaaugugacuguggagcuuggcuagcagucacaaucuugauuugguacaagugguuuccuguguauugaagggcucugugagucggauauguauuucuccuguguaaacacuugacagcauccagugauccacagcuaucaaucagcucaggcuacuguggguccagcuccuuuacacagaacucuggguccgugcaggguccugcagaguggcuucacuggcucaggugaaaggaggaggcuggugcacaggccuuuccagcugucauguccguuucuguuacuuuguuugacauaagccaagcaauaagaacuuacccuuuccuugaauucauuuuugacacucuuccuauuaacguggccucuagugcuuuguucccauagagacuuguuauugguugcuuugauauuucguguccugaagaguaccuagagccuuaggcacucuagacaagcgccucacugcugagccacuccccagcccugguauugcuucuccuuaccgaugauaagaacucaugucugaaguccgugggaagcagccgugugguggaugaaguugggguguuuucucugggguggucacaugcuuguucguuguaagguaguuuuuuuuguuuguuuguuuuuuguuuuuuuaagauuuauuuauuuauuauauguaaguacacuguagcugucuucagacacaccagaagagggagucagaucucauuacagaugguugugagccaccaugugguuacugggauuugaacucuggaccuucagaagagcagucgggugcucuuacccacugagccauuucaccagccccguaagguaguuuuacugccucauuuucuccuuggcuuuuuaaaaaggggaauaguuuauuguuuuuaaauugaguuuguauugucuauuauauucagcccaaauccugugagugcugcugaguuccguguuuauuucuuggaggcagccccagccugaggugauuuugcaguguuuggugugugcaggccucacugaggaaaaacugcacucuucacagucuuugcuaguagugucucuguguuccuggcuggggguggguuucugaguuccacacuguaagaugcauagugagcacaguggguuugcggcucugauguggggaggaggccgcagaccccacccagcucucgcucugugcuaauggaacugaagaauuugauuuuguauauuuggggaucacaugguaaccuuguccucccucccucccucccucugcucccccccccccaauucugcuucugacucuuaucagggcuucaacacagauuaauuaauaaaagaaacuuacuagaaggccccuugaccacauaagcagauuaaaaauugugauaacuuggauuuuauuugaauauuucacaaaggggcauaccacugcggcaucagugcgucugcagaguucacuuugaguggcuggcagaacuguggccuucauuaguucugaguuuuugaaaacucuccccacaagcucuggcccuuucuauuguauguaugagcuuaucuucccaacacaguaguuauaacuuagcagacaguuugggaagcaguguagcauuugaacuaaugguucacaauuucccuucuaaaaauuaguuucuuuuaaaagcagauaaauacaacucuaaaggcaaggaggagggaagcauaugcucugugcuguguugugacgaguauagcaggcagagaacacacaguagcaucuucuauuucgaagguauccuagacuucccuuuuuauagugacuuauuuacccaaaacugaacaucaaguacauuuaugaaaaugauguauauaaauuuuaugaauagaauacuauuuccacaucagcuuauuuuagauaaaccuuuucucuucugauaaaauuuuaguuucagucacuccuaauacuuucucucuugucagaugaccuaaucuugaucuguagccaugaguggaaaaccagucuuugacacagauugccacugcgcuacagcagcggugugcucuaggaucggugugagcuaggaggguacuauggagagcaaacagucuuucuguuagacugacuuccgugacuggcagguucuuuuccuuuuuaaacacuucagcuucuaccugagaagucuuaggaaacugcauagaaggcacaaaauacuccgagcuucugagacuagugggcacacaugauugguggcagguguuugugaggccaugaauauuuuggauuaauaacacagcaaugguaguuacuuaaugcaagugcaguugcagaauuucuuggcucuuaucaaugauuacuaauggugacguuuuagaaaugugauuccauuuauuugcucgaaagguagcacgagucucugaaauugugagugaggucuacaaacaauacuuuuaaaaauagauagaauauuuauggucuauaaugcaacuaacauucauauaucaaauccacuucaagauucuauuguucuguuaacuuuucuaaaaagauuuuuaaauauauuuauguguugaguauuuaauggcaguaguaaauuacccuuguuuccuguuuuguuuuuauagcauauagcacuuucuacauuguggguuuaauauuauccaugcagauaccuuuugugggauuucagccaaucagaacaagcgagcacauggcagcugcagguauggaaacuaguuugaaguugagaugaaaggacauuguaaauguuuuauccacuuaagauguaugugugaccuuaaucauuuuuccuucuauacugacguuaaaaugagguuucaggcucuuuauuauaucauaauuuguaagagguuuuaauaauaauagaugguguacuuagcuuucuauugcugugaugaaacacugacuaaaaccuacucgaggaggaaaggauucaugugacuugaguauccugcucacaguccaucacugagggaaaucacggcagaaacucaaggcaggaccaugaagcauaggccacguggggugcugcuuacuggcuugcucccgaaggcuuacucagcccgcuuuuuuagacaacccaggacccccagcccaagguuggcacccaccauccauagugagcuugucccucccacaucagucauuaaucaaggagcuacucccacacuuuuguccgucagccaaucugaucucauucucuguugugcuuccccuucucagauaacucuagcuucugucaagcugacaaaacacaagccagcacaccagccagcacaggaagaaguauaauguuuuaaaucuuugcugaugcaugguagugucagugugcacaguuggcugcucuucuugucuggugcauguguaaggauucugaucacuuuggaaaaagaugugcaguaggauuuuucaggucaucaaauguggguuagcugucaguuggcacagggaauauugguaggugagauaacuagucccuggggugagggauacagagguucuacagcuuugcaagugaaaguauugaaauggcauuagggaaaugcugugaugguauucacgugcgccuucucuuuaaccaggugucuuugcgcugcugcaagcuuacgcuuuuuugcaguaucugagagaccgguugacaaaacaggaguuccagacccuuuucuuuuugggugucucacuagcugcaggcgcuguguuccuuagugucaucuaucugacauacacagguaggugccaucaccuguaagauggaaguuguggcucuagauuacuguucacgaauaguuguucacagguucuucucacacacuccguauauccuaauaucaaauauuguauaaugucaaaugauuaucaaaaguucuaaacuccauuaacacauuacaaacugcaauuuuaaaaaggcaugagcugccauuccugacuuuagaaaaaacuaguuuauuuuaauauuacugcuuuucaggcuccuguaaauccacaaacauccuucucuugcugguuaaagagccagaacuauuggaaacucagcaucugugauaagcuauaguugcucacccucugugugcacuuucuucccccuccuuggagacuguuggccacaucauuccccaugcuuuggaucuaaaugacucccuaaccgugagcucacaagucuugaacagcaguccaguuucccugggguacuccauaugcccagcugauggacaggcccagcacuggaugaauggaggugugacuggagucagggaccuagguguuugaaaauacauuggcaucuauaaaauaaaaccaauauuauuugaauguuguuuuaaauuauucaugauuaauagugacaaaccucuaaaaggacaaauuggguuggugcaauggcucagcugcuaaagauacuugcugugcaacuggagaccugacggcucccugaaacccaagucaagguggaagagggaaaucagcaccucagaaucuuccucugaccucuacauaugcuccauggcuugcaaaacagacagacacuaauaaugauaacaaugauaauaguuacuaucauggcaugcacucaauacacaccaauaauaauguuauuuucuuuauuugugugugugugcaugcuuugcccacauguguauguacucaguucucacagaccucagaaugggaugucagagccccuagaacuagaguuacaggcaguugagagcuaccaugugagugcuggaauucaaaccuagauccuccggaagaauagucagugcucuucaccacugaguucucucuccagucccaagcuaagcaugguagcauacagcugcauucccagcguuugagggggugagguaggaggguuguuggauguuugaggcaagcuguggucgggucgggcuuuaucucaaaacccccacucccagagagaaacagagacauaauuuacaaaauaauaaaaaggcagauaauuuccucuguguuuuuccuuuaagguuauauugcaccauggaguggcagguuuuauucacuaugggauacuggguaaguugaaauaugcuacuuuggccuccuauucaaaagccuuucuccaugcguuccuauauugugaggacuucagucauuacuuaagcaauauuaaauacccaggccgagcuguuugaagugaaugccuguuguuuugagaccuaaguucuauauuccuguucuacagagccaacuccuuauuguuuugucagagcagaagcauuuguaugauuuaaagaugggaacuuuuaaaaaaggaaugaauauaaaauuuacauuuuaaguuuugauaccgauaagguacuguauuagagauuuauaugaaguagguaugaagaacucuuuguauaaucacuuaauuuaagcuucugcuuaaaaaaccugaaauacacuaagggugcaugguacaucuuuuugagggugcuauauaaaaggaacucauuuuaaaacuuggguuuugaauuagaccaacuauuucagggaaaccuuuugucuuuagaaugauggccuagugcugcgaugaugucacugucugugugguugcuuucuagaugacccaguaaaguccgaccaccauuuauugaucagguguccuuccaauaggacaccaaagccuccugugcaagugaaaucacauagaauaaacugucuauggcuaaaacauuugcugacuuuuauccagagauagguggauccagagaacuggagggacccaguuacagaauaaaauccaaaguggaugugcgucaguuguacuuaggcuuuagaguaauuuugaccuuuuuggaaucucagcgugcaaagugacuucuguugucacaccgaugccagccacuuccuuguccgggaaggcacuggauggagcacaggaguuagagggucaagugcuuucugccaccaagaagagaugaagagacuuguugcuauagaaguaggugauagagcuggacuacagacagcugucuacccgagcaaggguuagaaccagagccagcaguuucaugagccuuagauagcuccacuuuaaggggacauauucgcuuuaguuugacaacugugucacuagcugcaucaguuaaaaauacaaguuugacuaaggaaaguugggagagugaaugucagugaugcaggagagcuuguucaucuaaaggaaggagcuccuguuuuauccuuuaacuguaauaauaaugaacuuuuuuaauaucagguaugcaaaaauacacauuccaauuauugcaucagugucugaacaucagccuacgacaugggugucuuucuucuuugaucuacauauucuuguauguaccuucccagcaggccuaugguucugcaucaaaaauaucaacgaugaaagaguauuugguaagauuuuuaaugaacucuuugauucagaacaguuuuuuccacugagauuacucuaauguuuuguucaagaacauuuuuucuguucuacaaagaugcuuagauaagaaaaauuaguuggauuuuucaguguauguauauucuaauuacuacuuuuuaaauauaaacuuuacguccagcccaugaccuccuugaauaguuucagcucccgaugauauaggaaucacauaccucauuggcuuuucugaagcuuauagccuuuggucugaggcugucaggcuucuuuagagcgccggcugcucaggccugauuguccuuuccagugcuaccugacagauauccguccguuguguucuucuuuuccguguuggcuuuaaagaagguuuaaagccagacguuggugcuggcuuucugaggcuguuuugguuccguaaacuuagagugccuaaugauaaaugcacacauucauugucaccugucagcuauggauauuauaauguauggagcuauaauuuuuuuauaucuguaauaauuaaauuugaaugauaguacauuucucuaaauuauuuuuauuuagucaacaggacuaaauaauuuaaauaggacuauuggucaauauugauaauuuagaaacaguugcuuugugagaugccaacuuucagauguauucugugcuguggugaugaacaugugguuucccgggacauuuuucugucgguguugaaagagaaccugucuuugcagucgcucuguaugcgaucagugcugucuacuuugccggagugauggugcggcugaugcugacucugaccccggucgucugcaugcugucggccaucgccuucuccaauguuuuugagcacuauuugggggaugacaugaaaagggaaaacccaccuguggaggacagcagugaugaggaugacaaaagaaacccaggaaacuuguaugacaaggugagggcugugcugucuccaucuucccagcaccagaagaguccccagauguagaagagugccgagaugcgaguaccugaagcugggccuucugcaguuucucuccauugcuuccuccugagcugagccuucuguaguuucucuccauugcuuccuucaaagcugaaacccuaguugcucuuugagcucagaguaaacagaauuagugcuuagguauguuagcaccuuucauuuuccgagagcacggcucaucagauuucccgaugugcaccagugcuugcacuuguccuuagucugcguuugcugcgaccuugugugguucuaccucuguguauuagaugguaacuugguauucaaaagaaguguuugguuaaacaccuguuuguuaacauaaugaggaauuuaaccugcauaacaggacaaagccuguguuggacacaauuauaggaaagacuuaggaauuagugcacuugucuuaaauaaccuguuagacuuugcucuuuuaauacuggcuaagcucaucaauacuaaccagcagggaaaugcuguaauguacgaauuggcuggaauucuuucuuuucuuacucugaaaucaauauaauucauaaagauuuguguuaaaagcacauaccuauuauuuuuuuuaaucauccuuauaacuuagaguuuauggcuauuuuguuuccaacagagguagguaggggaguguguguguguguguguaugaauguaaggguaggaggagguagagauuuggcuaaaucuguagaguuucucuccuaguaauuuccuaaucuauguuuuaggugggcacagccauuucgagaguagaauuaauuuuaaauauauacauaauggauuuuggagccccaugguuaacucuuuuauauuuaauuaaaagcugccuucugucagagauaguuugcucuaagaucagguccuggaguuguguauuuucugauucacauuuacuuuaaaguuaacuuugaauuagaaaacaagagcaaaucuccccaguacccguagaagauuacauccuucucugacccauggaauuauuugauagguuaauauucucccacuuuuccccuugacuguugaugaaccaaguauaagggcuucuaacugcuugcucugcaucuucaggcagguaaagugaggaagcaugugacagagcaagagaaaccugaagagggcuugggccccaacaucaaaagcauugugaccaugcugaugcucaugcuccugaugauguucgcgguccacugcacgugggucacaagcaacgccuacuccaguccaagugugguccuugccuccuacaaucaugauggguaaggggacaacuuggcuaugagagggcuuuauaccuuccuuuaaccuaaccagaaagaaugucugugagacucugaucuggauucuccuccuuaaggugguguagagaugcggccccaccccuaagucuacucacuuugucuuuugguguggccuugccccauccuucaggauggguagcaagaacuaguuugugcuuuucucaaaucuuucugcaaauauaauuguguauacuuaguggacacugcaucaucauuagugugaaauuuggucaaaaugcaaauuacagagcccacccuaaggcuuacuugagagaccugaggguagaacccagcuaguuguggguuuaauggacccugaugguugcagggacaacgccacaucuuagcagaacaccaaacugugucccagaguaaguucauuagaauauuauauuuuacaagacaagugauuuuuuuuuucacauuaguuugaaaacacuaguguagacaaagcuccuuuuuuuuuuccuccucguagguagagcuucugacuaccaucuuugaaaugaaaauuuuuacggauuaaacaccucaaaaauuuaaacuaucuccuucacacuuauagaccucauuuaaaauaaaacugugagcuguuuuuguuuuucaguaccaggaauauauuagaugauuuuagagaagcguacuuuuggcugagacaaaacacggaugaacacgcccgggucaugucguggugggacuacggcuaucagauugcuggcauggccaacaggaccacucugguggauaacaacaccuggaacaacagccacaucgcacuggugagcgcucgguguuacuguucguuuuuuaaagaguaaaguggcucguccuacuuagcacucagaauucacuuguaauuaaacagaaaagauccggguuaaaauucuugccugccuguguauucuuguuuuaugagugguauuauauguacagaauugcaggcuaggcaaaaaucuaaaacuuaaaaaugcuugauacauaguuuuuucauugcaaauuuaagaaaauucuuagaaauaugaaaauaaguauuuuacauuguguaaauuauaugggugugcaaauaauauauucacuuuauuaaacagugagucuccguaaaugaaucccuucuguacuuuaaugucugaguacauaaaugggucuuaauuaauaaauucagcagcuuucaugaguauuguagcugaauaucacgucugcugggcucagaagagucuguguuauggaaaucacaggccaggcucagccugagguugggagaaaacugucucugaaugcuugccuauuuucauuuaaaauaugaauucccuagaacuuaauuauuaaaacauauauucagauuuugacacuucugccaugaaaugguuauugcaguuaagaugguagugaauuccucuaaguucauuacauucauagaaaauuauuucuacucaaaauuaauauaaaucaaacuuaauuucaucuuacaguuuaaaaaaauguacacuuaaauuuuauccuacaggucggaaaagcuaugucuuccaaugaaacggccgccuauaaaaucaugaggucccuugaugucgauuauguguugguuauuuucggaggagugauuggcuauuccggggacgauaucaacaaguuccucuggauggucaggauagcugaaggggagcaucccaaagacauccggguaagcagcacacaguccacgggcgcacgugcucucacaguugcucauuuaccuucuuucccuuccguuccucacuggggcccuggcuggccugggccuccugaggauggggcuagaggugugcguuggcaacacacccagaggcugcgcuguuuuccuccuguccugcucuauugcuguaguuacuccagucauuaaaaacaguaacuucacuucggauuuggaagccucgugugccguggaccagcuugguagcagcuugucugugaaagcauuacccuagacaacauguguacacaggagguagugugguccagauugcuguuugugcacucugauguucccaagugaaggugccuuauagaaggcuuaucucggaacacauccucuugauugugauuccguccugcccuugucaggacuucuggcuucucuucucggcucuugcuucagcccuucauuugcguucccauuuugcuccacuacuaaucuuaauguuuauaaauaugaaagagaccaacagucuagaaaugacugucuuugcuuugguucugugccuucuuccauguaauauaugacauucauugaucaugucauuuuuugcuuuaaaagccuucaacagauaauggagccuugaaaucaaacagauaugaguuaaaacugaaacugucagcuaggugcuccaggcaaguuauguuaugccagucaauguaaaugcuuugagcauugggccuuuuucuaggaucuagaauuaguauggugcccaaggcaagacauaagcuuaucaccguugaauauaggugaugacguguagagguguuagaauaucuguaguaauauaguuaaagccuuaguauguucuaucucuugguaaagcacuggcaaaaaguccaaacucuugccucagugcaagccuagccucccugugcugcucucuuggccagcuuuguaucacugccaggcucggcuguucugucccugaaacuugccuaggcuuucuucccuugccuuaucugauguguguuuuuaaaauugugucuuggacuguuucuccuuccagcacccuuggccccuccucuccagcccuuuuuggguauacucacgucucuauuuguccucauagaaaacugcuuucuaguuaauuucauguuucccaucuccugaggacagguagguagaauuuugcucaugugaggaaggcacaaaaguugagaggagaaacagacaagggugaagcacaggcucagauguccugcuuaggugaaaaugcugugaccucccccugagcugguuauaacaagcauucaguccuuacaaaguaugaaaugaguugguuuaucccucacaagaagagaacaagcgaguacacuccuuccugcuuaucauguacuuacugccgagagcagauugaggccaccgucggaaggaagggagggagggagggugugagguggggcccugugccacggugugcacaccucacagcacacagugcaccacacugcuuuagcaguuacaggaggucccugcuugugccuaaugcuguguugugugugugugucuacacuggugacuuccauagaccaagaaucuguuacacuguggcccuuauccccacucaucaucucccuuacaggguccacuguguguucgcauucauuugugugaugagcauuugugucuggcauaguaaauaguuuugugcguucauuauuugaaucauauacaaguaucuauagaacauaguccuguaaagggaaauauugugucagaaauuacauuuuuacuaccugaacuuacauuuuuaaaauaguagcaaucuaugccucauagaaaagcuaauuuauaaaaaugaauaaaaaaauagugcuguauauuccuuuuaguuuacugaaccguccccuccccagcuaaaaggagaguuuaggguucauagggaaaauugaaaacaaacuccaagaaaggauguggagcuagcucuagcugacauguagucggucuuggucuuuuuaacugugaggcuauaaaucugacaggauuaauuuuggggcugggggauuaaaaagaguauaauuucaugaugcugucuccagagcuagcgccuguagcuuuggguacaccaagguggacugacacugaauuugugguuucuucccacaggaaggugacuauuucacccagcagggagaguuccgaguagacaaagcugggucuccuacucuguuaaacugccuuauguauaaaaugucauacuacagauuuggagaaaugcagguugguucaauugaguucuucuauaauucuuaaucaaaugggaaggggaccuuacucaucucuuaaaaacuuggacuaaucaugucuuaauucuccuguggagagauguaugcagagcuucuuacccauuauauuuagaugucaaaccccugaucaucugggguuagaggcauguaccaccaugccuagcucaauuucugaauguuuuugugacauguuaaaaaaaauuagaccagugaguuuuucuuaucuguaaauaauggagggugggguagacuggugacuugacuuugauggaaacauuauucugauauuaaaaaauuaguuuuguguuaaaagcaauuauauagcaaacagaaggauauucuucaucuggccucacuccugcugaaaggcaacaccucuguccagagaggacaccaaagcagucugcaagcaggccguccacacucccagcuuguccccacacacgcuggccaucacuucugcuaugcagagagagcccucagccuucuuuccuugucucuccaccaccuuacuauuguugguugagcguguucugugagaugggauucugagucacuucucagugauuucccguccuauguugcauguauugauaagcuugguuugcuguugguauugucuuuuguugcagggauccaucccaaccuaaggaaguccugggggcuggaggcaaacaguaucuccucuauugcuagucagucuauagccugcaguaccacguuaauaguuugauuccaagcugucaguaaaaacagucuguuacuugcuagugagcuuggcaccuuacaaauuaaaggaauuauuuguuuacucuuaaccugaaaugcucugucugaacuucaaacugugaaacagguuuucuccacuuguaaaguaguucuguaacuguaugaccuugaaggguguguguugcugcuuucuguguugcccuaggggaggugcgcauaggugggugucugcuucuguguucaccuagcaucacuguagguaacuuuaaaggcaaaacaccaugcccacaguuauguaaaguuuuauuuuggcuucuuuuaaaggacacuugcuugggauucaaacucaugcuaggaaaacauaccugguuauaauaguuacucuagaaaauaauuguagaaauuggucgaaaugaugaguucucugcauggagguuucuuuuuuccccuccuuaaguuuuaugaacaauuuaaggccuauuggucucaugccuuaggaagcaugcauguuaagggggguaauguaauuuuucuguuguauaggcaaacaaagacuucccuauuguuuuauagacuggcuuuacacugcuuggaaaaagagaugguuuucauuugucuuaaaguuagauuuaugucugcguaaacuugaucuacuuaaauguguccauuggcuuuuuguuucuccuaagucuucccauacucagcuggccuaccuccccuuagacaccagaacauuguugucaggggggcuucuuuuauuuaaagagaugacagugguuacauuaagucaguccagugcaucagaguugaaugaagaccacaugguguaacggagcagauagucauugugaggcccugaggugaaaggaagcgccuccuccauccuccucuacucuccuccauccucuuccauccuccucuacucuccuccauccucuuccauccucuuccacucuccauccuccuccacucuccuccacucucauccauccuucuccauccuccuccacucuccuccauccuccuccacucuccuccauccuccuccacccuccuccacucuccuccauccuccuccacucuccuccacucuccuccauccuccuccacucuccuccacucuccuccauccuccuccacucuccuccacucuccuccacucuccuccacucuccuccauccuccuccacucuccuccauccuccuccacucuccuccacucuccuccauccuccuccauccuucuccaugcccaggaccacacuuacacugcauaucuaucaauuuguaaggacucugacauauauacucugaugggucuaguugucuucaugaauucuucuaucugggcauugagaccuguuaugaugcuucuuccauucuguauuguagauuuaaaaaaaaggucauuguccuuugacaguaguugcuacuuugcaauacugaauguuuuccaaaaggcuaacauuagguuuugauguuucuuucgcagcuagauuuucgcacucccccaggcuuugaccgaacacguaaugcugagauuggaaauaaagacauuaaauucaagcauuuggaggaagcuuuuacaucagagcacuggcuugucaggauauauaaagugaaagcaccugacaacagggagacacuaggucacaaaccucgagucaccaacaucguccccaaacagaaguauuugucaaagaaggugggugccugccgaaauaaucuccuggguucaguggguuagugggugaguaggcugcuauuggaaaugcuaacaacugcucaugaagaacaugacggauugugugaggaagauacaaggcuacaggaguccuguuuucaucaggagcacuugagcaaccucaagccacaacuuugcagguggccugcugguuguuggcaaccccaauggaagcuuuucugcaggcauucuuacuccagucucugcaucucucccugggaucuaaauggugucuggcuagugcuguccugccugcaugaaacucagaacuuaggagagcuguagugacugcuuccuccucuucagguuaaagcacacuuguauucaugcucuacucuugaauggggcuuuuauuuuguuugcugaguagauugucugcaguugaaugagcccuucugaaacaaaaacccaaacaaaucccuuuucuuaagcuaccuauuuuuaauguaauuacuaugacagagcuuguaggcagggauugugaggagaccauggcaguccuuucuuaacaaacagugggucagguagucucuuacuggggucauuacuccuuuaaguuggguagauguccuaaccuucccuaguagagauagcugacagugacaguggccgcagggagaggugccgucagucaggagugccaccguggcuaugguugcauaguacugaucaguaaacugaugcaggcagucccuagggacuccguaaccugaacaguucacucacacuggcuaaguacacgcccaccacuucagaacaugagucacaucgcuuagacuuuccaagugguaacuuguauucacuuuuaugaagugauuugcaguguagacuaggcuggucugaaacuagaaacuuuacuguccucaccuccugaauacuggcucuauguaugucuaaauagaaauuuauuuuuaacauauuuaguuugaggaguggaggaggagguaugccccacuccugaggugcagagaucagaagacagucuguagaguugguucucuccaccaccagggcagccuugguaacaaguguuaauguaaaaaccuaguuccugcaugagauacauacagugcuuuccucugcgucuuagaucuggccauccucuugguuuagcagauguccuuguagcaguuucuccaaccauaucuggugcagucuucuacagaaacaccugcauuuuaguagggcuggagagauggcucagugggcaaagugacugcugaccugaucccuggcaccugcaucagaagcacauuaugacaggcagcauacaccugucaaccuaccacuggcggggcaggcagaucccuuguccggccaaccuugcugaauuggugagcucuagguucagugacagacugucacugucucaaaaacaagauggagaacaguagagguuggcguuggaccuaugugcguguaugccuaagugcacacauaugcccacauaaacaauauuagacaacaagcugugaagaauuguuuuauuuuuacaagauuuaugaaacuagaggaauguuuguuuucaucuugacaugcugccuuccucagaggacaugacagaauaggccaagggauuuuugccuuuuaaguuuugaagguacauggauuaucauccucauucugcagaugggagaguggggcucugagacgggcuccauuacuguauuucugacacagccaguuuccugcggcugcuuagccagcaguagcaucaccuuucuaguuccuuagacuggaccuggacucugcuguuguucccacuaagcguguagugcuugaagagggagacaggagggacgcugucgguccucuaaagcuacucauccaaguuuucuuacaggacagcagugcacugucaggucccaagacuaacuuucauaacaaaagcugggugugucuaggugcuucugugugugagacaccugaacuaauuccauguauucuucucucuuucuagacuacuaaaaggaagcguggcuacguuaaaaauaagcuaguguuuaagaaaggcaagaagaccucuaagaagacuguuuaaaugcgcuguucuggccucacuugcagcaguccuugagagaaccggucuuugccuucugcucauguccuguuucacagcaccaaggguacagaacaucgcugggccaagucaauguacaaaauguucuggcaaugccucauuuaaaauuaaauugguuuauugagaacagcuguuucugauguguaacgugaagcaagacagagcccugcugugagcagcuggcagaagauuuuuuuuuuuuaauuauugguacauauuacccuucaaaucugagaauuuggacuaauugcaccaaagaacccucuaauuuggucccuggcacaugcguaccugucaacuuuuuuucuuuuacaagaccugcauuuuauuugaacuacccaaauagcaauauguaagacagaaaugcagaugugaugagagcuucuugaccaguaaacaaacuagcccaggucugagagagacgugcuaaaggagagucuacgucugggaacucuauuuauuuuccuguuucuccggugugaagaauguuucaucaaauguccacuuugucgcucacugccgcuguaagcagccgcugcugacggugggccucccuccgcguaguuagcugacuagauguuuguguucaggcauccggaugcacugcgguuagcgggcauccucaccagguacucacagagcagauuccaugcauucuucauucaagggcuaaauuucucuccuuugggaaucauggcaagcgcacacagaacguugcuggccaggauggcuguuaccucaguacugaggucggcuccauguucccacgcagaagauuaagggaaagcccuuacgguggacaggcaugcagaguucauuucugugacucuacacagugacaaaggauuuguaaacuuugccuggauuuuccucauuuuauaccaguuuuguucaucacgaugguuucuguugaccgcuucauguuuuuauaccuuaagcauuugaugaaacacucucuagugcucucuaggcguuucuuacuuuuauuacaaaugugacaauugucaaaagaugcacuaaaauauaaauggagauugagccuguucauuuuccagcuuauaggcaacuuuauacagacuugaaaucuuuauccaguuguuuaguaaagugagagagagguuuccugccacaggagaacuuuuacacaacaccccacugcuuuagugggacaguugagagcagugugucccuuuuaugaagaacccgucauuuacagcgcuccgggagagagaauguuacugcagaucccuuuuccacgguguagauacucugauuuauagaauucauucuugauccagaugaugguucuuucacagaccaauaaaaaaaaaaaaguauaacuaaaucuggauuucugauaccuugucauuugggggauuuuaucuuacuuugcuuuacaguuccaugcagagaaguuaugaccaugagggaaauaaagcuuauucaauuugugucacgccuugucucuugcagaccuuguguuugaaagaagugcagaguucuaaccccagacuccccucuucucaccuuagaaaggucucagccaguguguggaaaguaagugcguucauaacgcaguuuuaaauuccaccuuuuuacucagaauaagcacaccucauuaugacuuuggggucagaagaaaaggcagccaggcugugagggcagccauucugcacgcucagagacugcauagcccagcauugagugcaguuuucacaccauucccgcaccuuccucggguuuagggagcaaguuugguucaaggcuuggugucagugaagcacacaguaugaggguuuggaucucacagugcuggaguggggaagugacaaguuggcgguuucaccacacucaagugucagcugcugagcuuacgagcuuguuuugaaccuaaauucauuuuacgugugaucauuagcccuagguuucacagggagguuacauggcaaauggcaguggguguaauauaaauuaggcaggcuugagcuuccaaacugacagugcuacccuuaguuuacaguguggcauucggagugccugagugaugagcaggaggccaaagacuagacagugaaacugucaacuguuuuauaguguugcuagucaagcgacccucagacccuaagaucuggagcuguugcuuccuguugaaaaauuguuauagccuuggcauuguugcucauugguuggacacucgccuggcauauacuacacacuagccaaaaauugcucugaaguccauauauagaucggggcuggggagggucaugacucagugcuggucaucggaccuuggcuugaucccccagcaccccgguuacaccaccaccaagcugugaccugugugcuaagggcagggaagagacucaagcucacuggccaaccauuguaacugaauuauugagcuucagguucagaaagagcucaaaaacuaagguaggaugugccugaagcagcagcugccaugcccucugcucccgcugcccagcacggacaccguguagugcugcugaguguacauaccccauuagacaaccgaucugccaguuucaucuggcuggugcuucucgugguuuuuuuguccguuugccuugcuagccuuaacccugcugagguggggaaauaggcagccaagcauuucagccgcagccugcagugcagugggaag

SEQ ID NO: 5356 - RNA, 706 nt, Mus musculus
gcaacacugacugaaguaucacuuuguuuaaacuucaggaaugaucacucagugaacugcucuuaguguguugaagauggagauaagcaaagauggaaugaacgggauugagaucagcuccagagaggugagaugccuuugcaucucccacagugcuuugcgccucugagguaaaguuagucagaucaaguaaguacuuuauggacuugaaaguauaaguacauaaacauguaaaaaugcaaaguagauuuuguuuucuaagcuuuggugauuuaagcaugcuugcaugccagguaaaugcccucgggggccagaagagggcgucagaugcccugaagcugggguugcaggagguugugagcugccugacaccgguuuugggagcuggacugugguccucuacaggaacaccaagagccuuuaacugcagaaccaagcucuccgccccuauguggauuuuggaaagagacucuucauuuugguucacaaccaggaaaaucuuaguaaguaucugacguauuuuagucaacgauucauuaaauucauucauucauguuacuuuaauaaaugccaaauggaggaccauuucacugugugaacuaauugcucugcgcaaccgugaugaaucuuuaacacgguucuaugcgcaucuaaguguggaaaaugcuggaaagagaaauggcuaccuuuacagucagcacuaaga

SEQ ID NO: 5357 - RNA, 29342 nt, Mus musculus
ggaccuguaguacgccccgccccgcuagagcgccacuuagcggcacccuauauagucuucagguccggcuuccgguuucgucgcgcugcgcuggcacccagccugugcgcagcggcgacaccuuugugggcggcggggcguucguagacccuucuagaacccucuaggccucgccgccccugagcggggcagcgggcgccggcgaccccggaguugacgcgcgugcugcuggguaacgggccuguuccggcggccccgggccgccccugcucgguuccucugugaccuccagggccccugacugcgggagccgcggcggaagacaugggacucccucggugcaccugugacggccaccuugacgggggaagcgguggcgucuucgaggaaaccggaagcccguggugaccccuggcgacccgguuuguuuucagccggcuuccaaacacuggggaagcgaaacccgguggccuuggggaccgcccuacguagccaggguucagggugaguggaucgcucgcgcucgcccggacgguggagacagccaggaggggccugguggcugucgccuggccagacgcacuucgcuuucuguccccggcgcccuucugcuguucagagcggcccagucuagcaucccuggucccugccaucccacagccccgcuuccacgggcuuuuuuuuuuuuuuuuuuuuuuuuuuuuugccuucccgcucggggauugcucaaguucgguccgugcucuugacucgcugggaacgcuuucaguuuuauuuccugcacugggguggcauuuauaucggagagggaaagagggacguggguagugccgguggcgucugggagugaccaucagucuaacuugcauguuucagucccguuuuccggcuggguugcaaggcaggcuaacagugguccuccucgcaaggaacucggaauacucagaaagagagauaaaauacccauggaagcuacuagaaaucagaaauaccaugugaugaucaaaaacauugacauacugagacugaaauugaccucuaauccuuaaguacagaagagccaccccacccccguuugaauuuuaaguuggauugaacaaaaucuuaaaacaguuucauuucuaguucucaaaaaauguucuccuuacccugucuguagugaucacuccaucgucuuaaauggaaaacaauuggaauuauucgcugaauggcuacagaguguugaaugcucuagguuuguaaauggacguuuucauguaaaugcgagagauucauugaugucuaaaaggcagcuugcugucgugggaaugccaguggauuagauggauagcccagauguguaagcaucgaguuuuccacuuccucucuugaggagaaggcugcuuacucugacuuucuccuucccccuuuucugaaguccagggcuugcuuacccuccaaggcacccaguuauaauuucuaagagcuaggcuggcucugaaguugacaacuuaauuuguauguuuaauuacuucaucuguaaauugaagagugcuuacccaucuuagugcuuuuuuacauugauuuaaugaauucuuaagaacaagucagggggugguagcacaugcuuuuuuaauaaucccagcacuggggagucuugaguugcagucuagccagugcuacaaagugagacaucuucaagaaaaaaaaaaggggggggggggggagcacaguuucuagcauauaagugccucuagcagaagugcuucgguaaugguaccagagcaugccaugcuuacugagggaaauaauaugauuuuuaaaaaaagcugaauaggaugaauauaacuuuaaugccacauucugaauugaaguuguuuuauugucaggaaauaauuauuaacagcauuuauguagguguuuaguugcauugaaauacauuauuuuagauaaggaguggaaagaaggcugcccuuggauugcuuggccguaaaaacuaaucucugggcuuacugcauucagugagucaggaucauaaaaaugaaagcugccauuuuucauauuauauaucugauauuguuuuuggacacuuaauaaacugcaaagcauuaagcuacuaaggcacauauguuuaagugcuggcgucauuaaaaaggggcacuucagaaucccucuuagagaagcaaaagccauuccugccccuaauuauuuaaagugacaaaagaaaaggaauaucuuguaauuuauucguucuccguaagauuuguucuuuuuuucuccacuguuucuuaacugacccguaugaaguagguucuuggauauccuggcuuuucagagauagaaagccaguggaaauuguaaacaagacucacuucagggagugcccaggugugauuacagacaaacgcauucacuuuucuaagccuccguuuccucaccugugcuguugauggugacuuucuugccaaguuuggugucaagauaaggaauuuaacuuaccaguuucuggcacaacuugaguuuccuuuuaucucuucggguuccuguucugcauuuggauuaaaaauuugccuacacgguucaaggagaugaugucuuaaugauacaauccaacucugucauacauagguauaaaaauuaagauccuaagagcugaagugaaguaguguauaaucagggugacaaaucauagacuagaauuugaguuucugaauuguaggccauuguaccacagacaugugcuuugucuagauucucacugggaacaguuauagucacaacguucauaguauuucguaaauaaccuugauuugaccucaucacuagguccaacuggcacgcccaucugcaaagcucccagugcaggcagguaagggcuucccaauccuccccaggcccagaccacucaacccaaacucuuuuggucaauccugcuuacuggcaugggcagaucagugcugggucaaaacuuuaucagaaaaacuuccuuuuacauuggucagcagucacuggagagaugcauccugggucacagugaugagaauuagagauggaaugcucaucccugaaugcgacauuuauauuacucucagcaccaacaaggugcagagaacaucaugacaggugaaaagaauauaagagccgaaggaaagagagaagugcucuaaaaagcugccuucugauacaaugguuaucacagucaugaucucauagcagcaguuguucccuuacaagacuuaacacaaaguccuaguguggaugggguggauaaucuucaggcuucaccccauacucaggaguucuugaugguggauaaugacacucaggagaauaauuccuuacugaagagaugaccagugcgcuaguugaugguccacaugcauggcaggcacaugagaaacacagcugcacgugguggguuacccagaggaaaaaggacacgaugugugggcaugugaggaauauggggagagccagaucacaggccauaguauguguguauguauuuaaaaagaaacccaagauuuagaagauaaauuaucuagguucauaucccaaguugaucucugauuuguuguuuuuuaagcuuuaugaauuggguuaauaguaucuaucuaaaaacuagaaauacacauguacaagcaacaaugguuggcaccugacaaaugaucuaaauggcagguauugaaaauagcaaaauaaucacuaacuccuagagaaaaagauaaaucuugugucagaagauauuucuguuuucuaguuuaucaaguccuaucauauacaaacugaaagaggccaucucaguauugauuucagugaagauggaaauuauaaauaauauugauuaauaauguuugaacguauuuuucuacauaugucucucuauuagucauauacacuacccaccuuaucugacaaacugcuccauuauugugccuggaacuuuacugcucucagcaguaauuggcagcacuauuuacuucagaccuuucuauuucuauuuacuuuauauuuaauuuauaauauuaauguagucauuuaaucuauacucuaaguuauaacauugucaaacaugaaauauuuguacauacaucuauuuuuguagcauuuaaguauauuauaccuuacuuucuaguacugucacaaugaaaugauaaaguugaaauacuuccugaacuauuacuaugcucaugcaaaacuuagguggucaccaauugauaacauaaaacuaacccugccuguacauggucaagaacacuaguuauaacuugaguuccauaaaucaugcauucucuuuaguucuuuugcaucucgaucauaguucuuaaguaagaaugggacucagcauaauuuggaauacuuacuguagagugcaguuugaagcuuuuaacccagauauacugauuuacauggaucuacaguaaaaccacauaguauuucaaacaggacggcaaguaaguccagccgguggucuccacuuuucaaacacugggcuggacuguuuccaccauccucuugcucuugaaaaaacaagcuuguuuagagcauucucuggaauacauuaguacuucauuacugcuuuuagaguugacugguguagacauguuuuuguacacugugcaaagauuacccuuacauuauucaagugcugauuuaucuacccaugucuaguugcaauccagauguggcauugucauguuuauucuaaguaucuccuguuucaaguuugugugaacauugcucccuauuuauucucugacuugucaauaaaagcugaucagccaaugucugggcagaagagagaauagggcaggacuacagccagccugcggaggaaggagagagaggaagguguccuggugacaucaugggagagcaagucugaagcccagagagacagaccaauauuaaaaugcaggcaucccugggauuuuggccaggcaguagccagauuagguuagaggauuagaauagaucagucacucucuggguauugugcaguaaagcuugauuaaauaaaucuaauagucucagacucaaucauuuagugcaauaauuucugugacuauauuuucuaucuaugaguaguuaugaacaaguuucuuaaauguuacauguuagcauuaucuugauccauuuaaauacagugccguuuauccagaaaaaucaaacuucaaagcuagcuggcugguuuuguaaguacauuucaucacaggguucuguacuguagcuagcccaaggcuacguggaauucacuauacagcccaagcagccaugaacugguggcaguccuucugccucagacuuucagguagagcugugagcuacccacccauucucuaaggucuugaugaauggaagauuuucuaaagaaaaguucauuaugaggggaaaacauuacuaguucugguucuaaacucaaacagccucugcugcacccuaaucucaccuggucacauucauggcccaguuuucuccuuuguaacaaggcuuuaaucagguguuguaccuccuaguaucaucgugaagauuuaaguagaggccuccaagcagcauagcgccaaguaguuccuugguggucguaugaggugauuguguguugcugauguaaaauaacuaugagaggcuacuuauaaagaaaaggaacaccuuuuguuaacaguuuuaguuagaaguuauaagccuuaagacuggugccccaacuuucagccucuagcuagaguaaauggguggcccgccauggcaggucauucaggaguaaacuguucccaacagauuuaggaaaagagguagcagaugcuuccagugaccugagggccucccacagugccccagcucggaaaguuacacaacaucuauacuaccacuuuggggacuauaacaguugugaguauucuuaauaaguguugugucugagcuguguuuugguuuuauagaauuaaggcccgcauugaccccccucuucauuaucuagggucaccuuacuugcucucuaguuacaucuuuaucuccugugacuccuuuuucagcuccucucgccccacacuuuuccaugucuguaaaguuguucaugugcuagaaguuagcagaguaaaggcuuaagugugguagucagcgugcugucuucauuugcaagagugaacugacgucauuugguaccuucuuugaaaaccaucccucuggcuccauagcauuuuguauuuuuuuuucagauauguuauuuaccuguacaguauaaugauuuguuuuuccuguacaccugucucucacacugaguuaugaagguuuuauuuuguauuuuugcuuaggauauaauuaaugcuaaaaaugaauaugaaaaucacaauugaauuauuuaaaacuguuuaaaacaaaaaugcaaaagcauaggucuuuaaaauuauuucuugccuuuguagagcaguuuauuaguauuuaguuuuagaucauuuuagaagauacucuauucaauaaguuccauccauuugaggaauuauuuaaaucagaugaugaauagucugggcacuguuuuuaccucugcauugcagcacuauauaucuuauaguauaugacugguagguagguagguagauuguguucauuuagguaaaauaguacaugacacuuauuuagccagggauccagcccaggaccugauucgugagugacaaauguucuacugcagggccauacucaccgucuucucucacucucauagaacuugauaguaacuguuuaugguucuacguguuugucuauauuuauuuuccauucuuuagacuauaaagugguuguuagcuuucccacuaagucacacagaaccugaagcuggauagcugugcuugucuagcaauggugcuguguugccucugaaagaaaauaguuguaacaugauuuucaguuuucacguuguaaguauugucuuuucuuccccugcucacagaccaaaaauaaccuucaugcuuuuucuucuucacagcugccauggacacgcuaguagaagaugacaucugcauucugaaucaugaaaaggcccacaggagagaggcagugacuccacucucagcguacccuggagaugagucuguugcuucccauuucgcacuggucacugcuuaugaagacaucaaaaagaggcugaaggauucagagaaagaaaacuccuucuuaaagaaaagaaucagggcuuuggaagaaaggguggguccccucucauuugacuuaaaaaauaauuccaaauauugaaaauuuuuaaaaaauuucuaaacagucuuccaagaauaaguaagaauuucuaaauucuucuccauuaaacuaacuaugcugcaucagucauaucguguguucagugauauuguagaauaggauuuaacaaguuaaagauguuguauuccaaaauuuuucuuuuccuuuuuuucagaaugccuucuggcauugcuauguaaugguuucuuucuuccuuucuuuucuuuuuuuuuuuuucuuuuuguuuguuuuauuuuguucuguuuuuguaggguguacaagcaucuauuuaaaagccugaagucagccuugggagcuucccacuuucuguuuugagauaggagcuuucacuggcucauagagcuuacuaaugaacuagacuaggcugccuggcuaggaagccucagggauccuccagucccugugucccuauuacuggguuacaaguacgcaucaccaucccugguuucuuagcugagggcugaacucaagcucugcagugagcaggucaccaauugggcugucgcccagucccacuaucuauauguaacuuggaauuuucaagucuauacaaaagccuaagauacgaguaaagaaagccaucagggggagaccuucuuagacauugcuucacugcguuuaaccagcccuucaccaggacuagaaucuuuacuucuguauucauuuuuauuuuuuuaauaaaguaggaauaauauuuugagcuaauaaugacauguauuuuucuaugcugaguguugcauuucugaaugcuauauaaggugauuuaaaugcauucuaagucaucagacuuaauuuuauauguuggaauuuuucuugguugcccauuuauggcauugcaagauuuuaauugguuuauauuucuucaauucagauuuguauuuguaucuuacaaaaacaagagcuuccauaaaugguaaaagaaaugaggucuuagcaaucaaagaaaggaauuuuccuauauuuaaaaacuugaggauggggguugguagaauuuaauuuguuuguuguguuguaaaaacaagagaagucauuuauuaauauuucuuacuaauucugucuuauaacuaaguauauuugucauauauuaagauaaauuacuaaagguaacuuuacaacuaguuguuaugcuuuuaaaauuaaauagaaacauggaauuuaguacauaagcuaacauacaaaaucuguacauugugaccaucaauccuauuaauuucaguuuuuggaauaauguaagauuuaaugaagugacaugucuauuccuuaagaagucugguuuaauaguuuucuaauuauagaaauuuagauacuguagacuuggaaaauacccagacacaugagaagacaauaauacuguauuauagugugaugauuaaguuuauuacaaagcagacaggauuacuggcgagcaacagagaaaguauuugcccuuuuucuauacuauuugucuucuuaauaaaaauugugcgucaaugaaauaaucauuuauaccuaaagguagcuuuauccuuguguuguagugauuagaauaagacgagccuucugaagauagacuuacuuggucuacacaguacccacuaaagauuuauccccuaauuucauacuguuauuagcuuguuggagcucgagcagaugaagaaacaaguucugugggccgagaacaagugaauaaggccuaucaugcauaucgugagguuugcauugauagagacaaucugaagaaccaauuggaaaagauaguaaguugauuugaaaaucauacuuuguauuuuaauuguuuugucuagcaagaggcuuagaauuaaaauaauugguuaaacaauuuuaauuaaaauauuuguguucaugguauauggaaauuuuuaauaauuauauuuucuacuaauauacacaauacuuagaauuuaaggauuuaaacacuuuagcauguuaaggacuuaaagccaucucagaaucacuaacuuacuuugaaaaagucacgacaagguuguugcuuacucuuugggguuuuuguuuuguuuugcuuuuaacagagugagcagugauguccuaagaaacaaaaagaauuaggguucacuuuuccaucuugcuuuuaaaaguuagaaugagguuuauucaguauuaaccuaaauauuaagauauaagacaaacaaauagagauguuauugacuguuauuuggcauuuucccuacuuaacuagaauaaagacaacucugaaucuuugaaaauguugaaugagcagcuacagucuaaagaaguagaacuucugcagcuaagaacagagguggagacucagcaggguacgccgcuuccuuguuuauggauauucuaauugaauugauccaucucuccauuguguggcacucauaugagugcccuguggugucuguaugauagagccuucauuuuuaccucucuucuauuuuucauacacuguccuguuagcuuuucuuuagcugaaaauuguacuuuuccuauagaagaugugauguuuuuauucauggauaguaugugaugaauuagaggugagccauaaaccucauucacccaugcuaaccucacccaugccaaccucauccaugccaaccucauccaugccaaccucauccaugccaaccucacccaugcuaaccucacccaugcuaaccucauccaugccaaccucauccaugccaaccucauccaugccaaccucacccaugcuaaccucacccaugcuaaccucauccaugccaaccucauccaugcuaaccucacccaugccaaccucauccaugcuaaccucacccaugccaaccucauccaugcuaaccucacccaugccaaccucacccaugcuaaccucacccaugccaaccucauccaugcuaaccucauccaugccaaccucauccaugcuaaccucauccaugcuaaccucauccaugcuaaccucauccaugcuaaccucacccaugccaaccucacccaugccaaccucauccaugcuaaccucauccaugcuaaccucauccaugcuaaccucacccaugccaacaucauccaugccagucucauccaugcuaaccucauccaugccaaccucauccaugcuaaccucucgcccacuggugucuccugacuuauccugcuaagcucauugcccaugguugaacagaguguuauggaguagcuucaacaagacucuuaauuuuuuguuuuuuccugagaguugauaaugcacagaugagcugcugagaaggaagggucuucugggagugagagauaacaguccuguucccaucagcagucuuacucauugagcaaaagaaucaacugcugagaagccucugauagaaaaugaauuugagcgcuuuccagggaaaugguuggccuuuuggagauggagagaugaaggaguaagucagagauacuguaggauccagcuguaguaaguucccauagucagguguuucugaguacaauuaugaguaugauuguuuugacaugaucuagacuugucagucuaauucaaacuuugauggaguaggugacacugagcccuaggauucaugcguguuuaguacuaguuacugacauuuuuacuagugucaccuaggaacuguaauugcuauacaaaaacaaaguuaauauuuuguggucggucuccuuuucuagugaugaggaauuuaaacccacccucauccagcugggagguggagaagcuaagcugugacuugaagauccaugguuuggagcaagagcugggacuacugaggaaggagugcagugaccucaggacagagcugcagaaggccagacagacgguacucaaacauuguuaagaaacggaggacaucugugugcuuugugcaucucacauagguuuuguaacuaaguacuaaaucauaggucuauaauuaauuauaaccauagaauaaucucauuuccugagaaauuuauguuuaugugaaauuguugcugcuaacaucucaugcaguuuguacauucacuuuuaccccagaauauagcuuuaauauuugauuuaaaauguauauuggguugugucuuaauuacuuuucuguugugacaaaacaccaugaccaaggccauuuuuuaaaagaaacucacgguucuacaagguuugaguccauggucuuuauguuggggauggcaggcagguaggcauggugauggcgcaguagccgaaagcuuguguuugauucacaaguacaagguaggaagaaaaagaaagcuaccuaggaaugcaugagcuuguuaagauuucaaagcccacuccauugacacaccuccuccaacaaggccacaccucccaguccuucccgcaugguucuaccaacugcagaccaaguguucaaauaaugagccuguggggaccauuccuguucaaacaaccucagguuuguugguuuuuuuucaaacuuccuuuucuuccaguuccuuuuguauugaaugugucugaaaaauuuaaagagaacuuaguuuuaaccuuaaccuguauuuaacaauuuaguuagcuugaacaccugagacaacaugguagaauucuugaaaaacaauaaucuuaccacuaacaaaggaagcuugacuuacaaagccuguuucuuuucagaugauugauaguuuuagccagcuugagaauaaauuaagaaaaucaacaacaaaaacaucugccaagucagcugcuguaguaugccucuugguucuucucugggagucuguuuacuacuacuguacggggggggggggggggguagggaggagucaagucuguaagugaaacuggacuaugagaauagagcaaaaauacuuuacauuuguguauuuuaaacuaauuauagcugguuagucuucagcucaaccgucugucaaucaaagccuugcauacugugcacaacuucugaccauguuccuuuggaggucaccaucuaaaaggggggcugcuugccauccuuaguguacccauaucccaguggccuuaaaugcugcuuacucagugaugacgagcugagaaugagcuucauggaagacuauagcagucugcguccaucugucugagucaccugaacuggaacuguuuuggaaaccgguauuggaaacucgggaucugauaaaagacagcaccacgaaaauugcucucugguuggguuaaagcccaaggguuuguuugcuuguuuguuugcuuguuugcuuguuuguuucuucuuuacuugacugcagaacuuuacugcccuaccuuuaagcgugaaguuggccacacaccacuucuucagacuuccaguauucucuuccauacacccaguuacaacaaguaacuguagccacuaacaagucccuucuagaauagcugcuugcacaaaaagauuugcacugugaagcucugaguagcugucaguauuuacacuuuucuugaaauaaucgauagcuuuaugcaugaaguauguuuguauuuaugcauagaauauuucacuguagaguaagaaacaguaccaugugauuauuggaaucuaucuuauugugauuuuauuaaauagagaaaauaggaauauuauguuuaucuuugaggaaauuccuuucuaauggcacugaguaccucucuuuucauaaacauuaaguuagggauuguauaaagauguuagcauaguaccuggacagaguauauucaauguacacauuaaaacacaccaacaaauuucuuaggggaguagaugugucuguugggagauggaggauuaaguugugguuauuacuuccucugcuccacuagguggugcuaggggauaaauaaauauggcuuaaguuugcaucuaucauucccuagcaguucauagaaacagguuauuggaaauaugggaaauguuuuaacguuucaucaguuuaaacaguaaugacauuaauuccaagaagcaggaagucuuuaagaguuuuaugugagauaaagggaggaauguugaagggugagaacaacugagugggucuguuucauaguguguauuauugacagcaggagguugggaaguggaaaagcccacaacugggaucaagaaacaaacuaagaauaguugaaguaagauuuuuuucaagguuuccaacuuaaaaccaugauguuuuauguacuuuugaaucuggcuagaaucuucuuggauaugggaagauaagaaugagccaaugagagaaaucuauguucacauuaacaacuuaccuaucuauucuagccacauuuuaacaugcuaagacaugugacacauccuuuaaguguguaacaacaucccuuguagucauacuaauaacauucugguuuugauuacuagcaaacuugucuaaacuuucuaguguuuguaaguaaggucagcauuucagagaccuuucugcucgggcuuuuccaauuuuauauccuagccauuuacauucaggacaguugauccugagaguucaaagucagccaaagugguguaagaaaaaacagugguucaaaauaacuagcccauguggaguccuaguguuuugcaguauacuaaagguacuaggaaagcuguauugcagggacccgagaaacccgaaaugaagucuugagaguguggccuucagaacagugcagccuacuuauuugccauaaggaaucuuugcauguuaagggacaguccuuuugaggacuuguauuguugaugauuuacauucaacuuuucugaacuaucaguagguguaaaauauuuccuuauucuacaagaaguaugucuauacuguuggcuuuaaagaacauuuccaguaaauguguauuuuaaguauacaccaaggaacaugguuuuuaauuaaugauacaaaaaaacuaaaggcugucuggggauaauuuuauuucuuauggagaccaguaaagaacaguaccaaggaugccuacaucuaugguaguuuuugagguagagugucccuccauaguccaaguuggccuaagaacucacucuguagcccaggcuguccugacuucagggcaauccucuucaguuucccaaguacugggauuaugggagugagccaaguuuauaauuuaugucuuguaauacugaauaguaaaauuuuguuuuuucagcuuauaccagcaguuccugcuuauagacuaauucauuccugugagauuaauguuuguuacagauucgugaauaaguaugauauagaagaucuugaauauauuagauuaaaaaguaucuuuuauagguguugggguugagguuuggguuuuuuuuuuuuuuuuuuuuuuugguuucgauuguuugacuuggagguguuuguuuguaucacacccacaauauaaacaacuuagaaggggguggggcuguaccuugcaaggaaguuuaggaaguguggucuuaagcugaugacacugugccaaaccccaacucaaacucuguuaucacugaagaaaaugagaacaagaccuaugaaaaucagaaaagugcaccauucaugagaaaugguucuuugucuaaugcggcagagcgucuucagaugcugguguguguagccgacagaguguccgccguuaagccgccaguguccaucuacaguugaugagaaugaaaucagccucagcagcuagcaguggugacgcugcagcccagcccccgcacagcccagcccagggugcuuuacuuaacauagcagugcacucucuuacauuggaaucaaugguuucugaaaauauagaccaaaauauuugcacacacaagaaauuucuuuaggaaugaauuuaugcugucauaaauuaugcuuguucaauauuugcugguuuugugugcagaaauucccauuuucccauagaauucauacagauguacuuuaaacaguaaugugauagauauauuacccuucuuauauuuucaaaaguauguuuuauaggauuccaaacccaugagacauguuuuacaggaaaugaaagcaugaauacucagguagcuggaagugaguuaaacaugacagggacagguggcauuaaaacugagucuaaaagcuagucuuauacuuuauacaacuguagcuguauuguauaaauggugaaauaucuguaguaaaugaacugaaaaaaauugaaauaauuccuguuguuuccuuuuuaaacacaugacaggguccaccucaggaagacauucugcagggcagagaugucaucaggccgagcuugucgagagaagagcauguuccacaccagggucuucaccacaggucuccugaguuccuaauuccaccuuccuaauaugguuuaacuuggggggagggagcauucuguaugcaacugugaccucggauaacuguauauuuauaaaagugagagaaaaaggaaaggaaagagagggagggaggaagggaagggaagggaaacgggaagggaaacagagaaaaggaaaagggaaaaggaaagaaaagaaaaagaaagaaagagggagggaagaaggaaggaaggaaggaaggaaaauuaaaaaaaauuucugaaaaagcugaagagguauauugaaaaaauuucugauaaacuugaaguuuuaaaugaaaaaaaugauaaauugaagacauacauagaaaauauucugauaaaauugaagacaaauauagaaaauucugaaaaaaguaaauagauauauugaaaaaaauuugaauaaaauugaauuuuuauaugaaaaaaaagauaaaauugaaacauaaacaaaauauucugauaaaauugaauacauauauagaaaaaaauuccugguaaaaucaaagaaaauauagaaaaaaauucuggaaaauuugaauaaggaauauuggaaaaaauucugauaaaauugaaguuauauucaaaaaacaauaaaauugaagacaaggcuggagcaauggcucagcuguuaagagcaccaacuacccuuccgaagguccugaguucaaaucccagcaaccacaugguggcucacaaccaucuguaaugagaucugugcccuuuucugggugucugaagauacagugugcuuagauauaauaauaaaucuagaaaaaaaaauuggacauacauagaaaauauucugauaaaacugaagacauauacagaauaaauuccugauaaaauugaagacaaauauggaaaaaucuucuggaaaaaauugaaaaagguauauugaaaauauuucugauaaaacugaaguuuuauacaaaaaaaaaagauaaaauugaagacauacagagaacaaaagaaaguaggauacagugguuugcaguccacauauagucucaaaaacacuuggauaaaacacccaauacucacgggguuaguuggagcccugcuaagaauuagagaaauaacuugccuuuucauuucuuuuuuuaaaugguuuuuaacauuuguucacaugcauagaaucaccaaucauuuuuacacgcuguaaagacuaacucuuugauguuaagguaacagcaaccaaaauuauuuuguucuccauagaggaagaguuucaguuaguaauaaucuuagguacuggaguggcaguauggacaugugccacagagccugugugguagggacagcucuguguggaaggcagcuuaguggagucaguucucaucuccacuccuaaguugguuccaggaauuaaaacugaugaguugccagucugugauguguuuaaacacaugccuuaaaacgugcauguugugccugcaugaguugauggggagggggaugcagaagcccagagaagccaggggagggcguuagaccccuacaagugggauuacaagaacuuggaugcuaggaacugaauccuuaguaagcagucuugaacuacccaaucauagcuguguuuuaaucuguaguuuuaguguaggugacucuugagcaaaggacaaaagggcaguugaugauguaguucaaucuuaucuaauuuuuaagcaaucuccauuaaauugaacuuuuuaauauacucaggguauugauacuaauaccuuuaucaucauauucuguuugucuagcuguuuugaguaacugggguuugaguacccaaguaguaucaugaguauuuucuuuuuucuaagucaggcacagauucacgauuuuauagcaauaauaaaccaccugcaaacuauuacucaugccugugagccugaguuagcauguggacaacacuuucaucugcugcuuuauaaugacugaaccuuugacagacauugaaugcccagaauuguaccaugaaacagacauuguaaaaagccgauccaguguuuacugacuccaaaguagagcugcuuaaauaauaccaaagguuaagcaaagauacuuaaaauacuagguuuuucuccaaagcaauauaguuugcuguacuguuuauaacaauguagucuaaguuggguagaaauacucuguuaaaagagguaacguuuaccucacauaacuugaccuauuuguuucuagaugucuguugcuucuguaacuaauacuagauucagauagacaaaaccugaaacagcagguagcauauuugucugguucuauuuucauacuaccuaacagucucugacaguagugguuguuccgacacugugaagucaguuacucugauacugacuauuucaagcacuacuguacaaggaaacacuaugugcugaagauuccaguucaucucauugaaaauuaagaaccuaaagaaaaucaugagccucaaggauuuaaugaacaauaaaagcuuuuaaaauuuguuauaaacauuuucagauccuuuuaauuguaaaacuauaaaaggaauuuuaaaguuuuguuuccuauaaucugcuucucuagcugcugcuucguuagggaaucaugugaugccucaugccuuaugcugucaugucacauugguuuagaaccaacaguaugagacagcccagucagacauaaagaauggaaugcaggaaaucucaauuuugucuuaauguggucuuggauaucuacucaccacuucauuucacagugucgaaacaauccaaagauaaagacgaagucaaagaccauacgugaaucaaugcaauuuuauucuugaucagauuaacaaaggaaaaucauauuucuuacuaauuauauuaacagcacugugcauuauugguuaaaagcaauccuugguucugagagagccaguaaaaaccucacugaucagaggacuauuuaugauguguuuaauagaguagugacugccugaaaugagaacaguguuaucccuuacauuuuucacauuccaaauaaauacuuuugagcuucauuuauauugucauaaaaguauaaauagaaaccuguuuaauucuauugugaaguuguugcccuuucuccauaaaaaggcccaguguaacuuguuuuucaaauuccauuucagugauaauaugcaacaugcauacugggaacugaagagggagaugucuaacuuacaccuggugacucaagugcaagcagaacuacuaagaaaacugaaaaccucagcugcagucaagaaaggcaagucacugcuagcugcaaaugcagacuccagccagacugccugaagagcugcuggcugccuuaucucagucucaucugaugacgccgauaagccauucugcagcagugugcccgcucacacccaugcucugccuuggcuucagucuguagcuggccagccucacauggaagguguugcuggugguuuuucuucaguacuauucuuuuccccuuguggcuuuucucagccaaguguugcuuauguaaggccaugguguuagguuugugcuaaggggccuuuuaccauaacuauauagauagauuuaguuauauaucuaaaaagagcuccaaaguuucauuucaguacuaugaaauauaccaaacaccuugcuuuuuauuuuuaaaacaacucugacuccuuuaguuccugaucuuuuuuauaaacuuuucuuuuccuuauaggacaucugauuugaaggcagacucaaucaaaauuugccacugcuuugguugguugguuugguuugguuugguuugguuugguuugguuugguuugguuugguuugguuugguuuucuugagacaggaauuuuuaauguagcccuggcuguccuggaacaauugauacucguuugccgccucccucccuuccccucaccccccccuucgcauguguguguguguguauguguguauagaccaggcuggccucaaaacucagagaucuaccugccucugccucccaagugcugggaucacccagucaaccauugcuuucuuuucaaagccaguguuuaacuaacgcuuuugagauuuguguuaacuaguaauggguacuuuugccagugcuguuuuguuuugguuuuuuuaggaaauaaucuguccuugcacccaacaugauagguuuacaucagaaccauacagcauacguuuaaugucuuaaauuuuacuuuucaaaggaauguggugugacuuugaaagguggucaucaucuaauuuaaaauuguuacuugcaucucugauuguccaaaggagaacaagaaaacuuuuauaacucuucucaggaguguuuauaagggauaauguuucacugggggggggggggggggggguucauucaaagucucaacaaacauagcucaauuugugguucaccuugcucucauuucccaguugcuaagguuacuuaugaagauagcauagauggauggcaaaaguaagacuucucuuacagggacucagcuguuaccaaguaugcugucagugcagcuacuuacaucauaaaauaguuuguuccaaagacuaauaaaggagaagagcucucgccauucuguguucuuuuuaacugacugauaauacagucuuuuggugccuuugcaccaucaguaacuagaauguacuucccuggacaggguuaggcacagucaccaguccuuacacucagugucuuaaguagaccggguuauggcucacuuacccauaaccuauccaucacugcuuuccagaagaauucauuucuuucaguucuuuuacucuauccacccccuuccacccaucacccaaaagucuccauuuguuucuuuuaaaaugacaugaguugguuggcccagcaggauggcucagcaguggaagagcccccucuccccccugcaaguuugagagccuguugcaccuggagcucacaguggaaggaaagaaccaacuccagaaacuuguccgcucaccuucaugcucauguguguaccugcauucucgcgcgcacacacacacacacacacacacacacacacacacacacacacuauuagguugcauagagccaugccuuagauacaguuucaauuguggcagguugagaagaauaagagaggcugccugccguagcaggauacuggcuguggugaacauuaaccucugagcagucuuuccuaagccacuguguguaugaaauaccuuuccauuuacuuuuuaaguugaucugcuuguugaccaaagcagaauuauauuuacuauaagaaauugagcuuacaguuucuguuucaacuacuuuauccacagugcauguuaaauuuucauuugacucuuaagaauccaagguauacuuauaaaaauaaguuauuuuugaacccucucccacugagaaauuucaguaagccaaagaacguauuuuagaccuacuaauucuucacaacuuuuucccacuaaguauggucuaaaaacuuugacuagccacacuaaaggccaagaacuuuucuucucuuugccuucuuauaccuuuuuaccacacacagacucuucaucagcaggaagacauaggcaggaaagaaguuugacauccauuuugcaaacaaagcaauuggugagugaccuuagcucagggucagcaaauauguacucucucagaacuuagaucuuuuaacgcccuccaaauccauuucccagugaugauacuaaacuggaaaugcuaauuuuagugucaguuguaaagcugguauauaauauguuuacaaucucaacuucuagaagacugacacauagcugugcuuucuuuuuagccuguaccccaguaggauguguugaagaccuugggagagacagcacgaaauugcacuugacaaauuuuacugcaacuuacaaaagacaucccucuuugucaccaaauggcaaagcuccuuguuaugcuccgucuuccccuuuaccaggagauagaaagguuuucucagacaaagcaguucuucagucauggacagauaacgagagauugguuccuaaugacggugcagacuuuccagagcacagcuccuaugggagaaauucucuggaagauaauuccuggguauucccaagcccuccuaaaucaagugagacagcauuuggugaaaauaaaagcaaaaucuuaccuuuauccaaccugccgccacugcauuaccuggaucaacagaaucagaacugccuuuacaaaaguuaauuucacuugugauuugaucaggaagacacggacucagggguucucccaagagauuguucaaacugaaaguggacuuugauugauggcuugugcaguucuccaguauguacauuuguacauucuguauaacauuauauauguaauugauuuuccaguaugggaaccuccaguuguaccuuugauaacaauuauacauuuuugcuucuuggauagaguggaaaugaaaauuuuaggcaugguuuuauaaaguaugugaccugccuaaauauccaaucauuaaauaaaaagcagccuuuaguauaaaagaaaaaacaugucugcugguuuagauuguaucaagaagcaaguaagaguagguugagcuucuguaaauuccugauacauaaagauuugaaauauaauggaauaaaaguagguuaugacaucucuaugcuauuguuucaaguuuuaagauuuaaaaucauuuuuaaguaaaauguuuguauauacaaauuuaaagugcaauuugaauucuaagacuugaauuaaugacuauugaagccaacuuuuucccaguauauuuaaauccuaaauaguuaaaaaugaugugguaugugaauaaacuauuauaaccuuauacaauguccaguuaaaagaagaaagagcaucucacagggcagucucuucagugauguguagugaaccucccguguggucauuuucagcaggacagcuauuuguuuuacacagagcagcuuacacacuguuagauaugacauuugagaaaguaaaugcuaauuagcugcaucuagaacuaaaucuugugcuguacaauugugaaauaucccaacucauucuaagugcccaaucacuuguaaauaaguaaagaaauaacaaagauggcuucauguggaaauucaucuaaauuuuuucaagguggaagcauuaagaguauuaguaaucauguauuaccuguuugauguaagaagacuuuauccuuuucuaagugccauuucauguaucuugaauucagaggaucucugaccuuguaucacugaauagaaugcauagccaggcacuguucacuguugaguuaucucagucacuuacucaugccuguccgugauuaauggaauugaugucagauacuggaauguguucugaccaaugaacacagcugacucgagggaguacaggcuccugccaaguaauacaacaagacccaauaugcauaaaacaaauacacaagcccaggcucuagcugaaggcacuaacugacuguguaauaagaaagcaaacgcaguucucgugugacugcggaggcuguccaucaucuuaggacugauguagcuuaaugguuugcuuuuuuucaaaccaagaugagaaguuuucuuuuguaaagagagucuuauaauguuuuugaacaaugccaagaaauuguuuuaauuaaaauuauuuuuguuuuuaaaauggaauuggaugugaaauacuguccuugccuauguauauuuccaaagucugguauuaauuuuauuucuccaacauacucugaauggagggaauccccucuaacuaguaguaaccguuaucaaaaaggauugcuagaacagucugauggguguuaacagucaaaguguuaaaagcuuguguaagacuccuuagcuagaaaagagaaacccuaaaauauucuuaccuggucagaaaauguuuaaauauauacuuagucaaugguaacagcuguauuuugugauucauuaaaauugacagucccguugguccuuuucauacuagcugacaaccccaacaagcuucccuaaaucuaauuaagcucaccuguaacucauuaauauuaggacacaaccgacaguagccacaugcuccuuccucuugguccuuuauuguauugagccaacgccaaaauagaacugccccaugaaccuguaaaaaccggggauccaaagacacaucugcagcagguacacuagucaggcaagcggugaaugggaacacaguuuaucuaguaccuacugguuucgagacacacaacagaaaucuuguuacuaugucacuggcuucuuguaguaacuguaccuuuucuuugagucacugaaaacaacuguagcccuguccaauagaaaugugccagugccaacaaggccagcgcagagauaaugggcugcuuggccuuuccccgugcugcaguaucuuccugaguuugcucugcuuggccuccagucaccuucuguugaucugugcuuugggagaauggguucuuugaguuucaaacaaaaguaaaguaguucuuuggugaguacacugugaagcuugaacaugcauucauugacuagguucauuucauuugaaugagaaauuuuuuucauaggauuggagccaaaguuaaaucuugccuuccugguuuuuuuaaaauaguuuuuaauauaaaaagcucagacuaggguaacacacuaaaagagaaacuuaccacaguuccucccaaacccccaauaucacaaaacagaaguucacacuaacaaugccaacuucuuaaaauccaagauuauacaguauuuucaguagccaaguucaaaagaucaagaaacaaugcagaaacuuuucugucaaagguuucaguaaaauaauucaccaaaucucaucuguuuucacauaagccucugauggcagugcuggcuaaguuaucgccguaagagacugcuggccacaguggcuggcacacuaagggguagagugaagaaggcucugguucacugcugccguuagcaguguugaaggcgcuccauuccuccuuugcuuuaguccuuucuucccacacuagccaucagccugcaccaucagaaggaaauguacacaugaaacucuaugacaguuagcacugugauugcagucagaguuacaguacuugggguaagaccaggagaacaauauauuuuuuuuccccuauuucauauuuaauaaaucagaacucugaaauaaauauuuguauuuuauuuuuaaaaacucaauauuuucaugaucagggugagcaaacauuguuucaguccaucauuucuggguuaagugauaacuggcuuccguaagacgggacuuccugaugagcgcuuugccuacauguuugugggaagcuucugcagccucuucuugguaggaacuccaguuuuucugaauucuucccuuuccuugagauacuccaguuugcauucuucauagaaggcuggaucauuauagcuauaagaaguaaaucaauauauuucaaaauagauaaaauauaagcuuuauuacacuuagcuauucauguuuaaucuugaaaagcugacuuucaacaauagucaccaagacacaauaaacauuaaauuuuguaaucgucuuaucacagaauggaacgaugagugaugcuacauucuaggagcgagggaggggaguugucagugagaacacaguugggccacuccuugcagggccacagaacagagcuggugagggaagcgagacgcgugugucacugcaaguggacugaagcucacagaguagauuguguauguagcaagaagagcccaagagcacuugagggcacagcacugacgucacacuacgacagucuauccugagagcaacaggacaagacugacuagaaguaaaggggucuugaaugauggcagugugugccagguaggcuaaaagggaacagcacagguuuuaaaguuggaucucuaauaauaguauugaagcaagaaaugacaggcaccuaagcuagcccaaggaggagauguggagaugcagaaaggaaaggcugauuugguaacgaaccagagugaguuaggagacagaugacucuagauuauagaaaacuaauucaagccacauggcauggacugagcaaaaacauucccuuuuaagacaugaguaagacaugaagaaaagcagagaaacaggaucuguaaugauuuaauccagagguauaagcuacacuuagauuuaagauucuuaacagaacccaaagaaaccaacuuuaagcaacagcuuaagggacacaggguugaggaguggagaaauguguggccgacuagacagcauugccaggggaaugauggagcuacaauuauccgaagguugaaugaaaaggggcugcuucuuggguguggccaucagcaagcacacuacgauagaauccgaaaugggucacaauguagugaggaaugaagaugagaggcagacacugucucaacauguuccucaaagagagcggcggccacaugcgugcuguggcuugccauaguaauuaacaaagaacacuuucugggacuuaaagaaaaaauucauaacuuuccaucauucuucagcuagugucaaaucuaccuuuguuugguugcuuuucucucuucagcaauaguccuccuuccccacaacaaacuagacccugagguucauauuucuaggaguaggaaaagaauguucaaauagugacaauaaauaccagucaacuaagaguacaucagagaguguaagugcuuacuaagcaccuacugugcaucaaguacccuggucaaugugcuuacacaguacaucacagccgcgccuagaaggcuaucccuucucaguagaggauagucaagguugcaaugcuagcuaaguucucccugagccaguugagccuaggcugcccucucuguagacucuuccugccacucuguucuagggcugccccaccuagaaaacauuuaugugcaaccaaaacaugcuauuuuaauuacuaauuagauguaauaaaugauaccuauaaccaucagaguagaagccaaaggcacuuagagaaauucuucauuaagucugcgugugccuucaggaccuacccacucaggccacaucacucauacauguaccgcuccucugacaauggagugcugcugugcguguaagacuuugugucccagcuuaugaugcacagcucagguuucuugauaacuugguggcccauuaucaaacauucaguuuccaguaaggcccaauagcaggccgagagcugucucuaagagggagaauagcuguauucagaugagaguaaagccucgcuccaaaucccaaagucuccucugucguugacccaaaguggccugccaaaggcuccaaacagcaucccuaucugccacugguaacucagguaccaugaagucuucuggauaauaugguccaagugguaaagcagccuucacagcagccuggaccuguugaagagccucuccuucuccuguuccagauaccacucagagcuggcagcuuuugugucacuugguaacauacucaagugaggaaugugcugucucuagaauccaguuagguccacuaaacauuggacguccuucuucagggcggagaggcucagguacauuaacugauccuucacccuggaaggaauaucucuguauguacaccccacaccgugggauuaaaugcuccacuuagguagaaagcccuuacauuugguuggauuuauuucccaucuucuaauacacauaugguuaccaaaaaguccauaguggccgcuaccuccugcucacuugguccaauaagcauaaugucauuaauauagugcuccagugugauauuuuauauuacagacauuaugaucgagaucccaucacacuaaguuauggcacaaggcuaggguuaauauacuauugaaguagaacuauagaaguauacugcugguuuuuggcaacugaaagcaaagugcuucugauagcccuuauggacagguacagagaagacggcauugcucgaucaacagcugcauaccaugcaccaggugauacaaucuguucaagaaagcacacuucgucugguaccacagcugcaacaggaaccacuacuuguggcaguuugaaugaaaaauggcccccauaggcucauacauuugaaugcuagaucccuccuugguaguacuauuuagggaaggauuaggagauaagauggaagcucucagcuacugcuccaguacuaugcaugccugccugccugccugccugccugcccacuugugccauguucccugccaugauggucacaaacucaccucuggaacuguaaaugaggcccuuaauuaaaugguuucuuauauaaguugcuuuggcccuggugucucuucacaacaauagaaaaguaauaacuaagacucuacuugacuaaguuuuugcagacaacugucaauucccacuacccaucagucuuuggcauuggccacauagaauuaaagggaaaugugaugaaaaccaccacccuugagccuuucuagucuuucauagugacaccaaugucugccauucuuccaggaacgugaugcgcucuauaguucauuacuuucccugguagaggcagucuacugguuuccauuuggccuuuccaaacauaacagcucucacuccacaguuauggaaccaauguaagaauucugacaacuuguauacauucugugacuggggauaaccacaggaugauuccuaguaacccaggauccuacuugaguuccaugucagccaaaacaccaggagucacccaccuuccguuaaguccauacuucaacuggagguccacaaugcuucuugggguaucccaauaucagugucaauucagaaccuacauccaauagacucuggaaagucugauuauuuccuuuccccagugaacaguuaccuuucuaaaaggcuguagguccuugugggaaaggaugaaagaaagacagacagacagacagacaguaaaacucucaguuauuucaaauaaugcuguugugcaugggauaaugaugucauguuaaacauaauugugaccugguuuuguuuucauuugaaaacuaaaaauuacauaaggagaugugauuaugugucagacugacaacuugcgauggcuaaccuagguugucaacucauccacaccgagaauccacuaaaauccaaacagcugggcacaccugggagccauguuucuugauuggaucauuugaggucagaagacccacccuaagucugggccacaccaucuggcugcagcgucuuucaauggacauggaagaaggaagccuugcuuuuugccugcuugcccucacucucccuggcaagcccaucucuccuccugccgaggcuuccuucacuggcaguuggaacggacuucuccagaauccaacagcgaccaaagaccagcggagacagccagccucgaggacugagcaacugcuggccuuucugucaggauagccuuuggugggcgagcuugaccacaggcuguaagccauucuaaccuccuuuuaauguaaguagauguguucugucaguucuguuccucuggagaauacauauguaaaacaauguaacaaauuucagaucugagcuacaggguugaaaacauuuaccuauccaucagaucucuaccauggucaacuagaaguccccacucuaacuuuaccaaacuccaaaucucuuaacuuuuuuuuuguuuguuuuguuuugaucaguguuuuacugcuagacaaaacaacagcuauuccaaccccuaccuccucccaauuguucugucacuauggcuacccaagugcuacucagggugaucuuauaguacacaaagcaguucccgaggaaaauauucauguuguaauuucuauaauaaauguauuucaugacuggcuc

SEQ ID NO: 5358 - RNA, 840 nt, Mus musculus
ugggcuccaugcuacuuauugcuacuuuauugaacauauaaaggcuucucauguuugaggaguuggauuaaagaugaagccaaaggccagagaccagagcaggauuuaaaaagcagggagagaagggaggcaagccuguggauacagaaauaguacaucuuguuuguacaugcuuggguagugggugggcugagggcuagcuagguguuagaauggucauuuuguacuggaaauagcccuuaagagguaccaaagaaggcagaguuagucgcucauggagaugccagaagacccugagcauacagcugugguuaaacaaguugcagguuaucucuggugacaucuccugcccuucccuuaagcuccugcuuuauguaggccagcuuggcauccuuucucacuuuagaauuuaucaucucuuuaaggagggauuucaauaugcaggaucaccaagaagcuacauauuaacacccaguccaugacacuggagucucccuggcucuucaacaguggagacacaggagauaaagaagagggaagaagggggauuggggguguuguuagcgcuggagagagauaaucugugggugccuaccaugcugugauaacuucuucaucaggaccauguagaaccuguguaagcuggaccugccucugcacuucaaggccagugaaggggcauccacacgcacuguaaacagagaacugaauguuugucuagagcugccgacauucugagcccugggacucaacaucccucacuauggauaaucguggggucuucagaguucucagagauccuugaacugugaaacagaggugacucuuaguugacucaca

SEQ ID NO: 5359 - RNA, 2005 nt, Mus musculus
ccugagcucacggacaugaggacuggccugcuagagaaagagcggcccaggcagagcauggcaagugauaucucuggguuaucgacagggaaguagacaaaauagcacagaggguugguaucugcccagcucuagugcucuaaggcuuuaagugcuuuuauuugggaaccaaaugaucucaggugggguagaaccccccccccccccgaauaauguucacggcaacauauacuaucaugucuuugcaaguauaaccuuugcaaaugaaugagcaauggauugguguaguaaguaauagcucauguuuuaagugugaagacccuuucuagagcauuaaauaccauaucccacuuuccuuuuaaagacgcauuuuaaaaugaagauucuaaacuauaaauagcucaugccucugucacccaaggccugcuuuaaauacggccaguguuuguuucuucgaguucuauggaacucggaaggaaaccacagagcagccaccccaggauggcagagucugaccugagcccacaaaagccaaaaaguagcaaggcuggaguuaaaagucuggcuugacacuuugucuccagcucacacccuggcaccuucaaggccuugucuuuuuuuaacagcagagugccagccucgaauuuuuaaaaucuuagcucugaaucucuugacugguguguuuaagauagauuuugcauguugcuauuuugaaguagcuguuugucagagccagagagauggggagagaaucaaaggguucagugcaacaugcuugucuaggaagugcggcuaaaaaaucaagaaguuucuagauucugacaagccaaaguuccuaggccuuugcuaacaggccuuugcaaacagcauggguagcuggaggccuuuuguuuggggagcugccaugggcaugcgugugagguaagcagcuucagggccucugcucacccacuccagugcuaccacuuucucagcggugacuuucaaaagagcugcagcuuguggucaaucaaucuuagguggggcugaacugccuagcuugagguccuuuguucuaaaucgagagcaucccagagcauccaugugggccucucauuggacaggagcagaugguuguucagggaacuuguugcuugggaguucugccuuggaaacuucuggccgaaaucuuauuuaauuccaagaggcuaguacaagucaugugguaaagagaaggacggcgugucauuauuuauccugaacuugcagaaacuaguuacaguguuuuguuucaggcaggaauugaguacugauugcaguagcuuuggaggauggaugcucugucugacuuucuuaugaugcuccuggaagaugagacccucuaggaagaagguaggagggauguuuaauacaccaaauagauuuuaaaaacugguugagugcauauuacuuuuagcuucagaagauauuauguauauuuaagaggaauuuaacuauuaaaauuauuuuaauuacuuuuaaaaaaagguaggagggccucuggggucaugagaacaggaugauacaagcaagaacggcuuaguuuucuucauugacucuucccccuacccccaaccuccuuuuucuuuugagagaggcucucauguguuccagagugaccugaaccucaaggauaaccuuaaacaucugacccgcagccucugcuucccacugcuggauugugauggaucucauucgugcuugucucacuccuggaacaaaaccucugaccggagcaacuuaaggaagggaaugugaaaagcuaugcugacaggggagguaaggugguauaaauggcgcccuagcuuugguugcaggagcacgaggaggugguucaccuagcaucuacagucagaagcagugagaugugaaugcuggcauugauuacugucucuacuguuacuuuguauucggucaaggucucagucuguggagcuuacauucagggcgggccuucccaccuuagucuaaccacucuacucucgga

SEQ ID NO: 5360 - RNA, 9422 nt, Mus musculus
uuuccaagcggucaaguaugccuagaguuuagcagagccagccgagaggaaauggcugguugcuaaaugggaacucagagcuaaguccucuucuuccuuagugugaguguagggguccugagagguuagacaaggagggaaggaagaaaagaaggaaggaaggaaggaaggaaggaaggaaggaaggaaggaaggaaggaaggaaggagagagacaccuacaacccgggguuuguuuucuugcggaaggaaaggggcaccuacaaucccgaguuuguucccuugagggaaggacgcuaaauugggcgcgcgcugaagccgccccgcagguccgcagguggguagccuaggcgagggaggaaggggacauuaccuuccccucggaagagggcgcuggcucccccaacuggccuuuauaaccaggccgcgggaggcgaggaggcagccgguugccgucugcgauucgcuaaagcaugcaguugggagagcagcuccuggugagcucggugaaccugcccggcgcgcacuucuacucgcuggagagugcucgcggaggaggaggaggaggaggcggaggaggagggggaggcggagggagcgucagccuccuccccggugcugcccccucgccccagaggcuggacuuagacaaagcguccaagaaguuuccgggcagucucccgugccaggcggggagcgcagaacccgcaggcgccggcgcgggggcccccgcggccaugcucagugacgcggacgcuggggacaccuucgggagcaccucggcgguggccaagcccgggcccccggacggccgcaagggcuccccgugcgcggaggaggagcugcccuccgccgccaccgccgcggccaccgcgcgcuacuccauggacagccugagcuccgagcgcuacuaccucccgucgccgggaccgcagggcuccgagcucgccgcgcccugcucgcucuuccaguacccggcggcggccggagcagcccacggacccguguaccccgcguccaauggcgcgcgcuaccccuacggcuccaugcugccccccgguggauuccccgccgccgugugcccgcccgcgagggcgcaguucggccccgcugcggguucggggagcggcgcugguagcagcggcgguggugccggcgguccuggcgccuaucccuacggccaggguucuccgcucuacgggccauacgccggaaccucagcggccgggucuuguggaggauuggggggccuaggggugccuggcuccggcuuccgcgcccacgucuaccugugcaaccggccccuauggcucaaauuccaccggcaccaaacugagaugaucaucaccaaacagggcaggugagugcaggguggagggaccccaggcgccugguuguccgcacacugcgggcucugcuuaggguguuuaagugguacaucauaucuccaaagucgugucccuuacuuccuaaggcacaccuguagcuugggcuccgagcccacguuacucuccucucuagucaccuucaccgggauugacugggaggaggaggaggcggagauggaaauuugggaaugaacccuugagggcagaucuacgugacccgcuggcuccuggguuugcagcaggcgauuugugggcugcauagcgaaagagggcuagcuggagcuggcugcggccugcgcacaaguguuugaaaagaagcuuuuuaaagcuccuugguuugguggggcucuucuguaagaagagcagaaagaagucgguuugagcuggugacuagguagacaguuuuuggagccagauguuugggggagggggcucugcuugcggggaagggaccagaaaguucaggcacaccuucaaauugucaucagcuacuucuugaggaagugaggaguggauauugggagacagggacccaaagagggcucguugagagagagagagagagagagagagagagagagugcaagaaggcgcgcuccggccuaauguucucagucaccuaugucuuuaaaaauaauuuuagacauuucagaaagaaaccuaguagauaccugaaaauagauggaugucucagaaaagaagcacgcgaauuagggaaaauacugauuuggaggcuguuccaaauaaauaugucaauuuaaaaccauuuucuuaguuucaggccguaguagccauuuuuguuuguuugcuguuuauugcagaccccccauguguccgggagggaccagagccgcuacuuaaauaauuuccucugguucuguucuuugcacaggcgcauguuuccuuucuugagcuucaacauaaacggacucaaccccaccgcccacuacaauguuuucguggaagugguucuggccgacccuaaccacuggcgcuuccaggggggcaagugggugaccugcggcaaagcggacaauaacaugcagggugaggagagagggggccuggaccgggaagaggucggagccucaguguuggaccggccacauuuaaaucaagcaugucaccccaaccuggggcauggggauguuagcaugugcugccuucugcugcuggggagaaauuuacuccguccuuuuucuuguuucucauuauauaucaaaccuugaccuugacccuaugagggcuauguuugagaaaugaauagccaagugaaguucuggguuuggggaaaguuccugguaaaugauccuggcauuuuagaauucucuugagaaagcccaggccaccuuuaacuuaaucuauaaaaguuaaggacucgaugaggcacuuccccuccagcuuaaggucucagaccaacaaucaagaaccauccucucuccucucaacucuguuuuuuaaguuuggagaggcuggugauuggaauaccaugauuaaggaaggcuggaugcacccuggcccgggggagugacuggagucccgcugggauccacugauuucagucgacugaccucccaggaggagguugcuacagcaaacccaagccuagcuaacagacauccucuccaaccugccugggugaaggcugucuccuuucauuugcuuauguuuccuuuccuuuuccucuuaggcaauaagauguacguucacccagaaucuccuaacacuggcucccacuggaugaggcaggagauuuccuuugggaaguuaaaacucaccaauaacaaaggugcaaacaacaacaacacacagguagggagacuggaaaagccugugucuucuggucggggucucuuggacagcucauccuuuugucacugugcuuagcuaaguauuuacaguugugacuuugcucaauuuuaaauuuauguauuuaccugugucauuuguacuuucuuacuacuaugcauagaaacaucaaauuuuagggggggacuuggggagccaaaaggaaagaguaucuaucaaauacacagacacucuguuuuuguuuugguuguuguuuguuuguuuguuuguuuguuucuuaucuuggggagugggucuuguauaccuagcucgggcuggccuugaacugcugacccucuuacuucucagucucagaugcugcgguuacagaugugcucugacauuccagaaucagaguuaggacuuuaagucgaaauuguuaaucccgaggaucuuaaaucuuaaaacagaaucuuuaauaaaaccaaauaaacaaagaaaaucccccucaaaaacaaaaaagaaagcuguaguagggagcaaacagaaguccugucucaaaauguacagucuguuaaaaaucuacuuuugagaccuaugaaagucucucuuuucucuauccccagaugauaguguugcagucucugcacaaauaccaaccgaggcugcacaucguggaagugacagaggacgguguggaggacuugaaugaaccuuccaagacucagaccuucaccuucucagagacacaguucaucgcugugacggccuaccaaaacacggaugugagugccccgugagccacaggagccucucaaguuaggucuauugagauaaagcacucaguuacuauucuucuccccuaucuagaucacccagcuaaagaucgaccauaaccccuucgccaaaggcuuccgggacaacuacgauucguaaguacugcuuuucuucgagcacgggucaucucccucuaagagacaagaguaaaagacuccaggcugccugcaacuugcugugaaguugacgugaccuugaauuuaggaucuuucugccucagucccccuagccccgagcucaccagcaugggcugccacacccaggcuuugugugagcuagacaaucauuuggucaauggaguuucaucuucgagcccauuugcugggucaccuuuaacaggaaaugagucaucaucucccugaggacauauuuaguaugacauuuuauauuugggauuuuuuuuuucuuaccuguuuuucugcuuaauuuucugaaacacacacacaugcuggagauugaacucagggcuuuguaugugcaagacaagcacucuaccauugagcuauagcccuagcccuguuuuugcauauauuggccucgaacauucuugcuucaauuaaaaaaaaaaaaaaaaaaaaaacugguuuaguuaaagaauguuuaagacuuaaacaugaaguuuuuuuuucuuuucugcacuuaaguagggauuugaauuauuuuagaaucuccauuacuuauguccauuuguugugauuauaaaaagauaaagaaauauaagaauauauucuauggggguguggugacgugugggggaaagggaugucucagcaggcucauguagaggcaucccggcacccugagggaccagccacaagauggaauaguauagaauagaguuuauuuagggcauggggagggagguuaagaggguaguagaggcagagagaggaagagaguagagaaguagaggccggccaugaccacauggagagaggcagggaagggaauggggagagaggaggaacaagugagcaagaggcaagagagagaggagggggcaaggagacccuuuuacagugggccaggccuaccuggcuguugccagguaacugugggggcggagcuuagacggaaugcuaaccccuuucccuuuuuacauuuauuuaccuauuuauuuauuuauuuuuuacuguuuugagucauuguuuauccauguugagucaguguguagcccuggcuguccuggaacucucucuguagaccaggauggccuagaacucagauccaccugccucugcccccgaaagcugggaucaaaggugggugcugacaccuuccagcccaauuuuuauuuuuuuaaaaaagguuuuauuuuuaauuauguacauuugugucucuguguggguaugugcaugugggugccaguaggccaaagguuucaggucccuuagagcaggagugacagguggcugucagucagcugaugugugugcuuccaaccaaacucuagucuuccucaaaagcaguucuugaccuuccagcuccugauccaacuuuuaaaaaagcaucacuagcagauuuuuucccccuccuuacgugucacaagagaaaaaaaccccgaaaggauacuguuuuucacaacauuugacucucacggcccugcauuccguccgccccguugauuagggaggguuguucuagucccucguguucgaagacugcuacaguagauuuuccauauuuauuuauuuugagacagggucucaugugaucaaacucaaaccggcucuguagcuccaaugaccuuucaccucugaccuccagcuuccaccuccccaguaccgggauuacaggccucggccaccucugauuuauguugagcuucagagagacacccaggccugucugugucaaugcuguugaggcucgccuucgaccccaugauauagccacagaucccaguuucccauaggaaauaucugaccccuggaggaaguguccucuuaagggguggggaauccacucuguucucacagucggcagcacaacucucuagcuucugggaggcagcuuguuuggggacaacgugaggguuguuuuuuauuuuuaagugucucucuuuauauuguagcauguacacggcuucagaaaaugacagguuaacuccaucucccacggauuccccuagaucccaucagauugucccuggaggucgguacggcguucaaaacuucuucccggagcccuuugucaacacuuugccucaagcccgauauuauaacggugagagaaccgugccacagaccaacggccuccucucaccccaacagagcgaagagguggccaacccuccccagcgguggcuugucacgccuguccagcaaccugugaccaacaagcuagacaucgguucuuaugaaucugaauauacuuccaguaccuugcucccauaugguauuaaguccuugccccugcagacaucccaugcccugggguauuacccugacccgaccuucccugcuauggcaggguggggaggccguggcgcuuaucagaggaagauggcagcuggacuaccauggacauccagaaugagcccaccugucuucccagaagaucagcuugccaaggaaaaaguuaaagaagagauuaguuccuccuggauagagacuccccccuccaucaagucucuagacuccagcgacuccgggguguacaacagcgcuugcaagagaaagcgccugucucccagcacccccagcaauggaaacucgccccccauaaagugugaggacauuaacacugaagaguacaguaaagacaccuccaaaggcaugggggcuuauuaugcuuuuuacacaagucccuagagcauuauuuuaaccuuuaaccuuuccagauggaccuggugguguuuuguuguguucuuugccuagguuaccaaaaagacuuuugccuuccaccuuugauguauccuguuuugugcaauucucugagagaaggcgccaaagcuuugccacggccgcagguaacuaaacugaagcagaccuagcauugguuuuaaagugacuggaggacgcaggaguguuuuuaaaacugaaaaggucguucaaggugcuggauugauucauuuaugggaaacgagaaauguucagaaaaagcaggcuaugaagaacgagugcccggugcuauuaaaugaauuucaaagacaagaaaacaugacagaaaaaaacaaaacaaaacaaacuuuggcucuuauuucuacucauaaaucuuuaagcaaacagcagcccagaggguuaaaauauuuuugcuucgggaagagaaggguuggaccuugaguuaacagugggcucuucacagauaucuucugccagggccuauagaggcugagccugagagucaagcggggaaaacaaacaaacaaacaaacugauguuuaaguggcuagcuaguacucacugccuucaauuccuugcagaauuuuggaauaaaccauuuguuguagggcuggcucuguguggcugggaugaccuguagaaggcaggaggaucagaaagaaagggagaaguuaaguguacaauuguauguuuagacaccuuagaauauucuggaauauauuguacaaauucaacugccuagguaucagauaaaaauaauguaaauuuggugcuuuggcguuguaaagaauuugcaaaaccacaacugcaguuaagaggagggauucauaucuuggagauauucuguccacuucgcuaaguacucagcugccuccguacuugcuucuacacacuuaaggaaaaacccugcuuaauccucuuuccuuggucauccccacuucccccuucaguaaaugugaaaaaaaaaauugcaguaugaugucacaguuccuauaggcuuuuuagagauucugaauuuuuauguacagucauaagucauuuuuaauaaaugugguucaauaagggaccagguauagcucugucuucuguacuauggauuuuauuuauuuaacuguuucuuucugcccccuuuccagagugaacagucucucucucucugucucugucucugucucucucucucucucagucucucucucucucucucucucucucucucucucucucucucacauacacacacacacacacacacacacaccccuucccccuccacagaaggcucuauaaucuuuuaacuagcuacugauaucguugaguggugagcagggagugcuucuguuuauuuccccaaccccacagaugaacaggaucuacuuccucgccccacuaggaaguguggacaguggguguuggcugggguuggggaaggaguguuugcccuggagaugcaagauugugcucugcaggcuuaauccuagcuuccuauccuccccccuggcccuuagucauuuaguucuuuuccuggguuuacuuuaggcgaccaguucguagacccacguaagcgccaugggaacccccguggccauucgagaguuccgggucccuuaagcaccgcagcggcgagauguuagcgcacccuauugcgcccauuuacgguuuuccguggauguccucgcucgccuuacccucagcuaaauuucauccaggacucaggauuugggcgcggcagccacaaagaaguauuccauuugucugguacacugcaguucugcaaacagcaucuggacagcggugcaucacgguuuuaguuauuaaucccggacggggaagggcaccccaggcccucacugaauccuaggugugcggaagacuaagcaguuaggggaagagggcucuccccgcccccugccagacgucccgccgggcuaucugcagacggcuuaaagcccagcuugcaaacccuugaagccccuucucauccugggguaaaggucuagcugggagggucauuuuaacugcggagcgcggaaaugcagcugcuaagaggauuagcuguggggaggcaagcaaucaggcgggcccuccuccccuucugcgcccaauuaagguugccagaagauauaccugagcuguggacagucuuucccguccuccaaacuucugggaccagagcaccgccacgaacuuggggggcccacaaacuccgcauuuccaagacucuuuggcaaagccgccccgacuuuucccagaaugccagguguguguagucucuagagauuugcuuuuuaauguguuccugugggcaggggauuugggagaaagacguauaguuggcccaaccuagucaguaccaacuuacugcacccacguccaacgguugguguaucuggagugucaaaugaugcucugcuguuucugucuuaaaaaaaagaaaagaagaaaaaaaaaaaaagaaagaaagaaaaugcuaaucgcacgccgggauaaagaggacucuggcccuagucuauuucaagucuuguauauuuuugcaccguacaguaaaaagaauccgguacuuguga

SEQ ID NO: 5361 - RNA, 1335 nt, Mus musculus
cguuuccaaccuccaauauagagcuuccccggcgcacaccuucccucuggauuucucuuagucuauuguuuauuuuaaugucuauucugacuacugguuuuccaggcccggggugacaggcuccuucuuugcuuuguucagugccuaauagcuuauagcaucucaauacacaucuguaagauggagggaggaaaagagggagagaggguaggccggcaagugaugaggcuguccuaaguagaaaaagaacaaagcaugaagguguugcucccauuucuacccugacaagcauguccacccaccucgagccauguccagcucggugcaucuccggucaggguugguauggacacgacacuuaaacacagcuccaggagacuuuacugaagugcuauauuuagaaucugccuucggugcacccacgaggacccugcacaucaaaaagaaagagcguguggucacaaaccagugcuggagaagaaaaggcaggggguuacaucuuugucuaggcaagagugagcaaucugaauaggcaucaggaaacacacacacacacacacacacacacacacagacacacacacacacacagcuuaaguaaaacaaccaacuaaaagaaacgcaaaccuuuguaaacuugacacagccagagucaucagagggggaaggagccccaauuaagaaaaugcuucuguaagagugggguguaggcaagccuacaggcuaauuuauuaauuagugauugauggggguagguccagcccacugugggcagggccgccccugagcuggugguccuggguuuuauaagaaagcaaucagaacaaaggaugagaagugagcuaguaagcagcaccccuccauggccucugcaucagcuccugccuccagauuccugcccuuucugaauuccugccgacuugcaucaauaauggacaaugaugugaaauacaagccaaacaaacccuucccucaauagguugccuguggucauagccugucaucacccugacuaaggccaucgguagguaacugaacaggcucucacuuuuacuaguuaccgguuaccagagggauaaguaagggggggaggggagggaggauaggcuagggaggagucggaucagucugggccuggugggugccaaacacaaagagggaagcaacauuaaguucacuuugaguuacagaaauaaaucugcccuaaacuuuaagugugugcauucauucgugaguuguaaguguacauguguauguauacacgcaugugcccccaugugugugcauucauguguauaugugagcagaggucaccucugguugucauucuuuggg

SEQ ID NO: 5362 - RNA, 685 nt, Mus musculus
ugggccccagucacugagccgccgcugaggacucagcugccucccccucgagcccccucgcuuccugacacuccgccccccccccccccgccuucucccgcagcugccuucugcaggccguuuccaccgaggaaaaggaaucguauguccgcuaauccagaaccuccacucuuucgaccccuuugcugaugcaaguaagggugaugaccugcuuccugcuggcacugaggauuauauccauauaagaauucaacagagaaacggcaggaagacccuuaccacuguccaagggaucgcugaugauuacgauaaaaagaaacuagugaaggcauuuaagaagaaauuugccugcaaugguacuguaauugagcauccagaauauggagaaguaauucagcuacagggugaccagcgcaagaacauaugccagcuccugauagagacugggcuggcugaggacgaucagcugaaggcucauggguuuuaagugcuuguggcucucugaagcuuaagcgaggauuuccuuucaaugaguagaauuucccuucugucccuugucacaaguuuaaaaaccucacagcuuguauaauguaaucauuugggguccgcuuuuaacuuggacuaguguaacuccuucaugcaauaaacugaaaagagccaaaaaaaaaaaaaaaaaaaagaauca

SEQ ID NO: 5363 - RNA, 21978 nt, Mus musculus
caucucaguucaguugggucccugcaccggacugcgcaaggaccccaggccgcuuggugauuuugcucaagugaaucacgccgcguccccuccuccgcgcgccccgaccggcauggacuccggucgggacuuccugaccuugcacggugagugucccgaacguaggggagacccucgggaaagccgaaauacacccgggcggcagggauaacagcuccuucggccgcauuuaaaccaccagagagccaacuccuuguccccuugugggaucccagaaaaaccucggcccgcgcuggacacaaccuugggcguuuccagacuuucccccaaaucuggcccaagagaucggggagcaaugcugacaucucucggggauuuccccuuagccuguucauaaaaggcugggcuccuggguccagauggcaccaaaggggucagggaaggaaagggacagcauccuuagccaaacucucgauucagaggcuccccaaaacacgggugcgccugaagcgagucaggccgcgcggguguggcggaugaggguguaaauggguggggcgaggaggaggugugcaaguuuggcugaagucguucuggcagccuucgcuccccagaacagagaaaagcgaugccagggcugggaggagcagcgcugucuuuuugcugacccuccuggucggacugggccagaucucaguuagaaccgccuggcagcuugguccuuuguccagccggcuuuguuucuucccaucugggcuagcucuucuccccaugccugucccucuagcagagagggaaagcgcaggcuccuggcugccugucuuagaagcguccagggaagagcaaggaacuaagugguauuuacgcacacucugugggaggggcuguggggagucuuuccuucgugucuccccaggucaucuauuagcucagcaauaccugcuccucucacaucgauccacgguuucacaguauuuuucacuuaacucgaguaucccugagauuguagguucuugguuuuuguuuuuuaauuaaacaacguguacuugugcuggaggggguauggguguauggagaucagaggacaacuugcaggaaucaguuaucuccuucuaucuugugcguucuaggaucaaacucaggucacugggcuuggcagcaauugccuuuacccacuaagacgccuugccuccugggcuguagauuuuuguguucaccuguccuccgcuccacucccccuuggaugugugcccugcaggcagcccccaaccuguuuugcaucaguugaccuggacuuuauuguugugggggcccaguaagcuuggguuucuaaaagccaccuuguugggcuguguuccugccccucccacuguucccucauucucuccagaggucagagaugccccuacagcuccugacuggugggaacagaggguggccgcucugagggucacaguggagaggggcgggcucuccccuggccgccucccucuggcugccucugaccgccauagugucauggaaccugggucauggagcaggccucagugucuguacccuggucccauuucuuucuugggucagcccugguaucucccguacccaggaagacacagagccucagucuaauacagcacaggcuuggccagccuggcccauccuguuugagcccagccuccuggaguugugacucaguccagccuuuccugcaggacuggaauguacacuguggccaagcugacggaccugugggcccagcgcuucaagcguggcauccaccgugaccuccagaagcagcuccugccuacacugccaacccgauggggaggggagaggggucaaggagggucucugugggagggcguggucacuguggcuuguacuuguuagcugauggggagucugcacuccucuccacagugcaggucccacagcacuggucacuuucugacuugggcaguugggggucugcuggagaggugcccucaguccccuccauuagcuggagaccuguggacucaccaagagaugacacguggcucuguccuuacucauacagaggcgauguuggauaaagacacauauugugcagacaaacaguagaguucucacucuccccugaauuccuugcagaagucucucucucucucucucucucucucucucucucucucucucucucacacacacacacacacacacacacacacacacgcucgugugcccacaagcugggaauugucuggcagagugguuagaugaugggacagaaucaagggcaaauguagcuggauuuguaugcacggaccaaggggcucuuucuaccacugaagccugcuaauugauacuauaguugccaucuuccccuccuacaccaccccucucuauuuuaacuaagccuggacuggcauccccagcagggcccugaaaagacauuacuucccaggaccuuuuccuucacuaaagacagucaccacacugacuugcccugcaccuggcccaccugcccuauugcccgagccggcagucuguaaaagggacagggagccccuagagccacaggcuccaacucuagcuuugccauuugcuguguagcuguggccuuucugagcccuuuucucauccaugggauugcaauauauuuuuccacagaggauguugccaggauaaaauacuagugggggcuggggacuuaacuucagcaaaguagcucggcgggcacacauuccuggguuuaguccgcagcaccuuauaagccuggcacaguggcacaagauuacaauuuuagcauuuggaaguuggcaaccauuaguucaagaaguagcagcccucagcggcacaggguguuggaggucagccuaggacacacaagauccucucucagacaaacaaaaucaaugggcuugggaguucuaagucacuucggaagccaaggaccccaagaaaagugagcacagaaaguagggguggccugccccccacugaugggaguuaugcuucaaagcuaucugcuuuggggguucugggcccaugauacacacacauugauccaaguuguuaacucuuuugugucucaggccacucgaggaguagggaccuucucagaacugcauucuguuguugugggucguuuccaguuuguuguuguuuggaggguuuuauuuguuuuguuuuugaaacaggaucucacguuauaccccagacuggccuguucacuauguggcacaagcugaccucaaacucaucgcaaucccccugccucacaauccugaguacuacaauuacagaugugagccacccuaacaaacuuagggucgugaucuuaaaucaucacauaaagugcuuaagaauucaaagaaaauacagcauauugggguucgaucccaucagggcccaggcagucuuuguuuuggcuaagaaccucuauauagcuggguagugguggcacacgccuuuaaucccagcacuugggaggcagaggcaggggguucucugaguucaaggucagccuggucuacagacagaguucuaggaagccaaggcuaugcagagaaaccugucuccaacaaacaaacaaacaaaaccccuucacauguuuuuuguuuuguuuuuguuuguuuuuacaacgugggcacucuacucaccccuaccucagacaaagcuuucuuguguccacauuucacccaugcccacauuucaguucgucuccauucacugccuugcucauccaucacgcaugcuucaguguggcgguggcacccuacucacucugugcuucggcuuuuuguuuuuacugugcuugucugugccaaaaaacuggcucugccagugacucagucuugcugcuucagugaagccccuggggaccucuucaaggacaguggguaagggagaggugagccaggccucugggugguguccugacccuccugcaguggggacucaguaauugcagagugaaugaaagggagguuguacgaaugaaaggccccaguguuuccgggcacucuggccgcacaguucugcacaaaguugcagucuuucugauuuauucuagguaacccugcagacucccuuugagggcagcauuuuccuccuccuccucuuuuuuucauuuuuacuuuuucuuuuucuuucuuucuuucuuucuuucuucuuuuuuuuuuuuuuuuuuuuuuuuuuugaaaaauuguguuugugucaggugguaguggcacacaauuuuauccuggaggcagaggcaaguggaucugcguuuaaggccagccugguuuauacagagagaaauacuguuucgaggaggaggggggagaaggagggggaggaggaggggaaaaggagggggaaaaaagaaggagaaggaggaggaggaggaggaaggaggaggaggaggaggaggaggaggaggaggaggaggagaaggagaaggagaaggagaagaagaagaagaagaagaagaagaagaagaagaacaagaagaagaagaagaagaagaagaaaagagcauuugcauuuguuaccuuggggaucgcaucgcuuagauaggaaaaccagggagcaggcagcaggccuagucacaacaaaucaguugaauaguugaggauaagagauuuggcgggcucaguugauuagcaccggcuccaccugaccaccuccacgucucugugucaccagaauucccuccgcagagcauucuucccaguucugacgccugggcuaucuugcagaguuggcguuggcauuccuugccaggcucuaccgcacacuuuauuccaguccccacccucacacacccucucaaguagagguuccucccuucccugccuggacuccgccuuucccgagcaagagccucccuccugggcuccgccucucccuccgugugcuuccuggcugugauuacuccacgucgccuuccaggcaguggcugccagcccucgggaccuggguuaugucuggcaggcucugccacucuaacccuccagccacgcuuacuauucuaacacucuggaggugaaggcacaaauauccggaguucaaggccaccucagccacacugggagauugaugucaaccucccccgucccaccuccaagguucugguuccacuuccuccgccuauuuucuguucucuccagccucccuagacuaugaacccgcccccagacuuggcuccgccucccaaaaucuggccccgccuccagagagacgggaccgcccccuccucugagguucuggcuccaccuucucaaggcuagacugccggccggacucagucggcuucuaagcuaggauucacccuggcagaggcuuaggagaacaccaugcagugucuagggguccggaguugcagacggggcagcgugaaccgcucccgggagcucuaccugcaggagcagagucgcaaaguagcggcgcucaauggacagagacuggguaagggaugcaggggacaccgagaaccugcugccagugacugggacagcagcuggaacaggacgcuccucccuuuaagccucagauuauacauguuuauucuucugcggggcuguguuuucagugugggugugugggggugaguacuuggagaacuagauaacuaccuuuuccugagcagcccaaucuccaugcugccugcuaacuccaaccccuccugguuacaaacucaucccugggugugugauucccuguggaacugguaugacuguguaacccaacgcugucuacuaugaugguggacaaauguagaccugaacaagugacacuuggugaccccaggguuggcuaagugauucugucacacuggugguauuaugacacgauuguguggggaugauaguguguaaugacauauacccaaguguggcauucugguacugaaggugucuguguauagccuugugugacaguggcugcuuaugacugaugugaccauguggccuagggugauggaauggcugcccugcuguggugugaguuuucugaugcuguuacccgcuggcucugugacuuuugaguaguguggcugcauguuucacugcucugacccugcgagcagccugccuacuucugagucccaacucugccguacaacuuccuccaaccucaauuuccuccucuguaaaauggggauaaugauacugccuuucuaccuacgguuguugaggggauuaaacacaugugcugccaacaguaacuuauucaaauaguagcuaucauuauggcggcugcuguuauuauuauggugauggcauccugcacuguaugugugugaaacaguaacacgcgcuccaugagacuaggguaguuugcacacugugucccugggugcaagguugugucugugagaucguuugugauggugugguauaucuugguguagcuauguaugugugugguguggguuccaagcccagcaccuccaucauguagcuuguuuguuggcucuccuggauucccacccuccaugucuucuacaugguugcuucucugugggcaagccaggaaaagauuggugaaaccccugagugcucagccuacccgcccucccaaggcugaggugagggcuggauaaggguuucccaccgacuuuguacuuaagagaacaagcauccugugguaggccacccagaggccucagaaucaggaagcccuucccacuccauggagacacccacccagauuucccaguuccuggagggugguagcugucucccuacugcagcccaucacugucugaccccacagccugggccucugcuggcucugggacaggauaagcuugucaucccuucacaguguuuuccagaaugagagggugggggcuugccuuccauuucccagcaacccccacucccaucugggcuguuagcaggagcuugccuaacugcauccagcucagggggcagggcauugacagauggucaggaggggccccuccuaaaguaccucagccuggaagagacagugggaucucccagccgaggccagaggugacccucugcucugacagucuggaaagucccuaaccuucccuccaugugagauauuccaugcgagccccuucucuccucccaggucuccccacacugaaaagcugcucauacugagguagagcaucuucuagcaaugagucaacuggcaugggacaaaggugguggcaugugagaugacugucaucucggaguggcaauaaggcuuucugggacacuguucuuaccccagggcagaugagggagcagaggcaugggggauggagggagaaggaggcuucugaagcuaugggagguggaugcucucacaaaagcagggagcugaugauggguagggaagaugugggugagugaagccugguccaucuuggcuuguggauaauguguugaaggccauaggggcacggcgugguggauuaacugggaggagauaucagagguggagagucugggcuccgaaaagcagccuguggcuuugugacaauucuccaacacgagcaaagauucuagcuccucaaacaggacgguuggagucccugaugccacuuuucuguugggucacauaguuuuuagggacacauuuagguguccauuuggcuuugaacugauccggcugcuggacugugugugauguaaacacacugggugcgugcaggugcccacaccgcuuuauagguguaucucugugccacacuggugcguuauuaagguacagggugcagaucuccuuuaucauccuuaguacaggauuugugucuggaugaagacuccuaagggguuuaaugccuuccuggugccuccugccugggucugucgggagagaggacucugaauacuccagagcccgugacucaggucaagccacauaagagcugggcaggaguggggcaagcaagcagaguucuguccucccugugggcucugucucagcuucuggaaggauugagcucugucuuaaagcagcaguguucugagggagcccagacccaggacacucagugguugggguccaguaggaaagacagggccaucccagcaggcuaaacacaguccacaguggggucaucauucucuucuggggacaaagaucagagaauggcuuaagcagauucuaguuagaggcugcgggaugaggacauaugggagaggguggcuggaauagcauagccccagggauuccauggcaguaaaccaugaggucacacagcuggucaggaagugugccggaacuuagguacagauaauguuggagccauuggaggcgggagguuauuuggcucugcgggccuggguucauuuccagcugcgcuggucacuuucuuccccuccuuugccuuguccuuucaucccagcucacuucacucugagccaggccauuucccaggucacccaguaacugcggagcuuuugaauugugcucauugauguuguagacaagucacagugucuaaguaugggcuuggggcagagaguguagcacaguggccaaacacuugucugcuaugcacagaugacguagguucaauggagacucaacgcuggggcagaaagugugaucuuagguggguagacgucuugccugugaaggaggcagggaacgggccgguggagucaaaggagggaggaggguacagcugaguaaggaugaggccaaugagaacggacucugaguggccagaggacaaggccaguaugggccugaugcuaagagggacacgguggagaaagugacaucucaccagcguugccucucccagggcugcaggaugacccggaccuucaggcccuccugaagggcagccagcuucugaaggugaaguccagcucguggcguagagaacgcuucuacaagcuacaggaggacugcaagaccaucuggcaggaaucucgcaaggucaugagguccccggagucgcagcugugugagugcccgggguccauguugggugugguacaggguuaggguggaggccagucauggaccucgaccacagguggcccaugccuaaggagccaaagggagaaacucagguuggcuggggucaaggagagauugguguugaaucacuuguagggaagccaaaguuaggcuggucacagagagaagccauaggagucaaaggaaggugaacaaacuuaaccauggucacagauggggacagccagucucagaagcaacuguagagccggacagggugguuugaaugcauugcugccacccagacaauggguggaucagagcgguagggccaaaagcuaggcccaaaguccgaggacagauaagguacuuccgucccaguggcugguauguaagguggggcucaggaggaguuaacacuccugagagugagccuugggaggcgggguagagaaccggagggagaggagagaggagggcuggguacugucuuucuagagcgucucaaaggcucagggauuuaaaguugugggugggagugcaaauggagacgaccuccugagagguuugggguagcuuugcagacacgcccuuccgugcaggagcuccaugaaagcuuccugaaagagagagagagagagagagagagagagagagagagagaucuuaccugggagugggaguggggguggggguggggcuuagccaagugccaucauuagaauugugacaguggcuccugcccgcacgauggucugauaugggaaccuccagcucaagauuccugaauucccucugcuagaauuaaagcauacaccgccacguggaguuuguuguauuuauuuacuuacuuacuuaauuauuuauauaugcauaaagacacuguagcugucuucagucacaccagaggagggcaucggaucacagguugugagccaccaugugacuguugagaauugaacucaggaccuugggaagagcagucagugcucuuaaccaccgaaucaucucuccagccucuguuguuguuuuuguuauuuuuuuuuuuggggacaggguuucucugugacuguccuggaacucacucuguagaccaggcuggccucaaacucagaaauccgccugccucugccucccaagugcugggauuaagugccaccacuuuguuuuuaaaacaggaccacauacagccggagcuagccuugaauuuacuguguaguugaggguggugcucaccccgcauccuaaggauggauuccugaccccugcugcuguagucuucugguguguuccuuuggagaauggaacucuaaagcgucucagaggucacucugaggguugggaaugcagcucgauugguagaacacaggccuagcaugcaugaagcccugccuugaguccccaacacuccacacacugaaugugguggcacgugguuguaacuuaguauaugggggguggggguggggauaggaggaucagaaguucaaggucaucuucaucugcauaaaguucuagaccagcuuagaaacaggaagcccuguuaccaaaacaaacaaacaaacaaacaaaacaacaaaaacaaagcaagcaaacaaacaaacaaacaagaaaaucaccuugauuuucugccccaacuaauggccccuagcacaggauaaccccugaccuugucaguguuugugaagccagacaggcucccgcacugggcuccuguccugacacagaguuuccuguuagcugcuggugggugggcguggaugggaaaggaggcuucacuggauuccuaguggguacauuugaaugugcacuuagugcuuggagggagauaggggaagggguaagaagagaaggcucuuccaggagcaacugucacucaggcuagcccccuguaaacaggccagggagccaggcugagaugggggucagaucugggggcacuggacucauguggggggaggcuugcuuccgacccagauggcugccacaggucucauuguuuagcaggacuugguugcaugcagugucaccuuaccucuggggaaacugaguccagauaauggaggaguaacagauucuccgguuucucuuugucucuguauccugcuaagucucuccaguaacuucccagugcucauucuuuguccccaggaguguuauuagcagcgaggauaggcuggccuuucucucccaggcccugggggcuccacggcccaggcuuccuguuuucauuccuggcccagcaggguccagcugccuaguguggggcaaagacggauuagccagggauacguucugcaucccagauggugcaggggucccucuuuucagagcuuaugacccagucaaggcacgugguacacguguaguccugaggguggcugggaggccccggggacucaggguaagagcgguuuggggaggauucagacugaauggaugagaaaggcugaagaaggaugugacagggguaguccugcuguggggaggcuggcucucagccaggcugugggggauacauugggauggcagcauagaagaucuuguuuguccccagcuuggaagacuggcuugaugggaaggcucucccagcuuccuaagggcagugauguaaucuccuagacccccaggaauagcauaguaaaccggcuaugggcuaugucuaaccugcuaggguggccuugucugucccuuacugcugagcccccuaggucuaggaugccucagaguacaguagcucuaacgcagaacucagccuuuccggaagcugagacagguccacgaggacagaacccugccuccgucucccuguccugcccagcucucucagagacgcagacuggcuucugucugccucuugggacccuggaagguggggucuuucucugcccuucugccaaagggcucccugaagucagaacucaugcagucacacgcaggguaaacacaccgcguuucuaucuggcuuugggauucugucgcuugaccccagagccaggacuguccaaagugggacaguagagggaccugaagauggugauagcuauggggacucaaagacuaguguggucuggagggugcaugaccucuuccuaucgcaggugccagaucacagcaggcuucuccugcuaccuggucccuucauuucugugaccauggaccugguccuugcugcuucuccuagccuaagaucucugccucugugucucccuguauugcucccacucugcccacugcuggcugcccugugcccugccuguaaaguguuuccguucuucuucucucccaccauccugaccuccuguccuucucccuggacccacgcucugagcccccagucuggcuguggcacuaggccgugcucuucuccuuguggccuuggcugugccagaggcagucauuucccccacagccuguucaucugacccauccccucuucgcagucuccaucgaggacauucaggaggugcggaugggacaccgcacagaaggccuggagaaauuugccagagacauacccgaggaccgaugcuucuccaucgucuucaaggaccagcgcaauacccuagaccucaucgccccgucuccagcugacguccagcauugggugcagggccugcgcaagaucaucgaccgcucgggcuccauggaccagcggcagaagcugcagcaguauccuccugggggcagugggucccggucgugcgugggaugugcuaucuauggucaguugugcuucgguaacaaaaugccaggguguguuggauccuacgcugguugcuaugauacuaggcaaaaacaagucaggagaagagggcuuuauuuuauguuuuaggagaaugugguccaccgugcaggaaaggccuacaguagaaacucggguggcugguuacaucgucaggaagcacagagaaaggggcgaacgaacacuaaggugcagcucacauccuucuuacucaaccugagacuccagggaauggagugaaccucauuucuuuccucauuuaaucuccugacacucccucaaagacacacccaacugggcacugcagggacugacuggcuggcuugcccaacacuaguguguuucuucagguacuagcauggcugguucuggggagggcccucucccuuguuugcaggcugcugcguuuucucucucugaccucucaugaagagagaaagcucuccuuuauaggcacuaaaccuuugguccgggccacaccuucauguccucaucuaacucaaauuaccuuccaaaggcuccuaccuuggaaaucauaguacaggggggggagguugcuguuucaaccgugcauucuaggaauucuuguuuuaacccagggcagaagggagaguacagaggaucuucugacccaaggucaacagcugugucucucugugagcaguguggagauaggcaccugggaagugggguguggcagguugggagagagguggggugauguagucauguuuuucaggguuacugcccucaaggacuuggaaggccauggcacucuccugagccaugucuuggggggcaauacugggaccccaggguucagaucugccuucaggcugaagacaguaacuugugaaacuugugaauccguccuauucacugauugcuucagcgugagauugggccggggccagcucucauuuuugcuuuauuugccugagacagguucugggcuggaacuugcgauccuucugccuccugaguguagggaucacagccuuucccaucaugcccugcagugucgccuuuuaugacagcuuuauaaagggauaauccacauaccauaaaauuaaccccugugucgaaccuagggcuggggcaaugguucagucaguaaaggacuugccauguaaacauagggaccugaguuugagcccagcacacacgugaaagcccugauguuagagcaucaucgcccucucccgcccccccacaaccccaccauuaguggcucuuucauauuucccccuaagucaggccaagauagcccccauaugcucccugugacgcagaguccugcagccucucccgaauggcuucuuguuccuagugugugccggcacucauccacucuguacugaggcucuguacuccauuucuuccggcgcccuaacaguaucccaccauauggacacacccuuccauaacucauccgggacuggggcugugaguccauuccacucucggacucucgucuguggugaaaacucaaaacuacauucuguguggagcguguguucucaucucucuugggugcacacuaggaggaaaacugcuagguuauuuaguaacauuuacggcuaacuuuuuuuuuuuaaauaagauuuuauuuuuaucauuuuauucuaaguguauguguguuuugccugcguguguggccgguguaccauguccaugccuggugccagaggagaccagagacagguguuagaucccuugagacuggaguugcaugcuguugugagccgucacgugugugcuugggauagaacccugguuccucuggggaagcagccggugcucugaaccacugagccauuucuccagccccuuguucuaguucuaaguaugugucugugccugugugugcauugugugugcauauuauguucaugcgugugcagugucugcagaggucagcggaggacacuggaucaccuggaguacaguuaggagccacugugaacagccccauguaggugcugagaauugaauucuaguccucuaagccaucucuccacaacccucccugugcuuggcuuuuugaaaaccugccaaaucauuuuccaaagugguucuaacuauuuagauucccacaguaauguaggggguuuccauuuuugcaccaaucacuggcucuuagguuucucuuugguuauagaugcucuuccugacugagagguaaaucuuugguucaucuucugcucgcuuuugugugugcuaugagauggaaaaucuaguuucucuuugcauuuggguaugcagucuuuccaguacaacucacuuuguagaccaggcuggccucgaacucagaaauccaccugccucugccucccaagugcugggaucaaaggcgugcgccaccgccgcccggcuaagauuucuuuuauuuuauguaaguacauugucacugucuucagacccaucagaggagggcaucggaucccauugcagaugguugugagccaccaugugggaauugaacucaggaccucuggaagagucgucagugcucuuaaccucugagccaucucuccagcccaugacuuauuuuuuuuauaaucauuuuuauuacauuaguuauuuauugugugucuuugcauacuugucccucguguguguguguguguguguguguguguguguguguguguguguguguguaggucagaggauaacuugugggaguugguucucucuuaucuuauggguccuggggauuaaacccgguugucagggacccaugcuugcugugccagcccaugggccugaaaauguguuauccuguugagcauuccuguugaacugucacuggcugugaacaugaggauuuacucuggacuuaguucugugcauucguccaucugucugucuuuccaugcaguaucccugcccucucuuaucucccguaacuucguaguuagcuucauaaucagcaagugugaguuguccacaucuguucuuuguuuugcaagguugguuuggccagucuggguccugugccuucccacauguauuuuaaggucaguuuggguuaauuucuugaaaagaagucaacaucauuugauaggauuguacauuaaucuggagacuuuucagcaugaaaaugucuuucaauccaugggcaaggucagaugucuuuacauuugauuauuccuuuuuccacucguugaagauuugcguguguguguguguguuguguguguguguccacaagcguguagugccugcagaggccuagagcugggguuauaggugguugcaagccaucugaugaggacacaggaucuuaggucugauccucugcaagaacagcaaacagucuugugugcugacccaucucuccagccccuagucuuuugccauuucuuuuaauaauguuuuguggcucucagaauuuuaaguuuuauacuuuuaaaauuucuucaaauaaucuuaauaauuuugguacuauuauaaauugugcaguucuggcuauccuggaacucacucuguagaccaggcuguccuggaauucagaaauccaccugucucugucucccaaguccugggauuaaagguaccacugccuggcacuucuuagguuuuuguuguuguuugguuuugcuuauccguuuugagacagaaucucagguagcucagguuacccuggcacuggcuguguggcuaaggaugaccuagaacucccgauuguucugcgacaaccuccuuccugggugcugagauuacaggauguacaggccuggccuggggcuuagacuuuuuuuuaaaguuauguaaccucucuuaugcugccugugcuguuguuucaugugugauuaaacucuaaugucuuuuuuuuuaaacacacgcccaugagguucauccucuugucugacucagugcucugugagaguuagaagcacuguccaccccgucaguuccucagcgucugaacggagaacgugggguggggugugugcgcgcaugcgcauuugcaagcaugggggcugagacgucccuggacaggaugacuugauccagguuugaguuugcaugggauuucuccacuuucguuuccagccucagguaccagaggcaugcuggcugaaggucugagaaacccaggcugucaucagcaccgugggaggugaucaggcggggcaguuacugccuggguuccuuuucaguagucuaaauguccucagugaaccuuuuuuauaguaaauauuuucaaacaucaucagguuucauaaugaacaaacagaaaaaagucccuuagcugggucugauggugcaauccuguaauccuagcuacucgagaagaugagacagagggaucaccauuucaaggccuaacgggacuauggagcaaguuuacggguugguguaggucauuugacuuaaaauacaaaguaaaugcagggcugcaguagagugcgggacccugcucggucccuagcaccaaacaaacaaacaaaccaacaagcaagaaaagcaagggaaaggaggggaaagacccauccauaguaaggaaggccucccgguccucggccccugcuuuguggucacgugaccacgggcaaccgcgacuucccguggcugggaucuuggugggcaucgggcugcuguguguuuuccugacugcucgcccagcuggauucacuccugcuugcgaaaggcugauaaaaacaaggauaacaagaugaacuucaaggaggugaaggacuuccugaaggagcucaacguacagguggaugacagcuacgccaggaagaucuucagggugagcuuggcucgguguggcuauagggccgugggccuggcccgaggccagcucugagcccugcccaugggcugugcuggguuugcaggaaugugaccacucccagacagacucgcuggaggaugaggagauugagaccuucuacaggaugcugacccagcgggcagagaucgaccgugccuuugcagaggccgcagguucugcggagacccugucgguggagaagcuagugacguuccugcagcaucagcagcgggaggaggaggcggggccagccuuggcccucucucucauugagcgcuacgagcccagugagacuggugagggcccaacagucacagagccaauggcugggagacugauggaacagcagacagacagacagacagucgugcuucagggagccagccccaggguugcugaccaguguguggcuauccuguguaagcaggcagauaggagaaagagaucaguaucuacccugucugggccucaucuuccuccugucccuuccucaaugggcauugagcauuccugccccgagacauagaaagaagugcugacaaagccaagguuauuucuacuuccuucuucguuagacacagcgucgauccagcuuugacacaugacagagagaagaagaggccugcucaacacuuccagccugcuuaguuuagugagacccagucucaaaguacagagaaaggaugacuuggggacauggcucagugguagagugcuuguguaagaccccgcgaucaguccucaggaccacgcacucuagggacacagaggaggugacaccccaccuuuggggauuuuagacuaggaggaaggaaaagagacagggccucagcacacuguaaccagagucucaccgggagaucaggacuucugcuccucagagcugcagaggacugggcgggcaggcagaguggagaaaaaacuucucuuuccacaguggugggcaacuugcucugacucaaaaugguggcuucucccauccuagccaaagcccagcggcagaugaccaaggauggcuuccucauguaccugcugucugcugacgguaacgccuucagccuggcgcaccgccgugucuaccaggacaugaaccagccgcucagccacuacuuagugucuucuucccacaacaccuaccuacuggaggaccagcucacagggcccagcagcacggaggccuacauccggugcggcccagggaacuguuaggggcaggucgcggugggacccgggauggaaccuggagggucuuagccuaguugucaccuuuucucugcagggcucugugcaaaggcugccggugucuggagcuggacugcugggacggccccaaccaggaacccaucaucuaccauggcuacacuuuuaccucuaagauacuuuucugcgacgugcucagggccauccgggacuacgccuucaagguuggccaugcccgugggagugaggagaggacacaagggguggaccgucccuuuuaacucaucuuggggcuucuaggcaucccccuacccaguuauccugucccuggagaaccacugcagccuggagcaacaacgagucauggcucaucaccugagggccauccuggggcccaugcuguuggaccagccgcuggaugggguuaccacgagccugccuucgccugagguagggagugguacccuuaaggugaggaagugaaccuggcuuguaggccuaugugggucuugaccagucuguccguacauccccagcaacugaaggaaaagauucuguugaaagggaagaaacugggcgggcugcuaccugcuggaggggaaaacgggccugaagccaccgaugugucugacgaagaugaggcugcugaaauggaagaugaggccgugcgcagccaagugcaacacaagcccaagguucuaggggaagcuguggggguggggcgaccccgggccccucccaccccguuacccacgggacuugccuugccuugguuuuucuguggcugccauucagauccucugcccccucucuccgugucucucucucucucucucucucuuucucucucgcucccucgucuggguuucuggugcucagugcccaccuuguccuacccuaccuauggcucuaaccugggccuccccgcggcccccaggaggauaagcuaaagcuggugccggagcucuccgacauggucauuuacugcaagaguguccacuuugguggcuucuccaguccuagcaccucugggcaggcauucuaugagauggcuuccuucuccgagagccgugcccugcggcugcugcaagaaucaggugagccccugucccugcagacacacgauccuggccaucuggacugguugaggcugggccugcccuacguacggcccugcagggucccaaguuggcauucccagcguuguguccagacagagcuggugggguggguauguccuuagcccacccuggccuucucugaugacuugacuccaucuguucucaggaaauaguuuuguccgccauaacgugggccaucugagcaggaucuacccagcuggguggaggacagauuccuccaacuacagucccguggagauguggaauggaggcugccagauugguacgaaccagcugggguuggagggagguuagagaaagcacuuggccuugauguccacagcugugaaggucacaggaugcgaggucugggggggccugagaagguuuggaugcgggccaaauuacccagccagcaagucugugucuggugugaacuccagcccuuugaguuuccuuuuggggaaugaggucacaccugucacuccagcacuuuccgggggaggggggggagugggugggucaggaguucaggguuauccuuagcuacuuagugaguucaaggccagccugggcuacaugagacccugucucaaaccccccagaaagagauuggggagaugacucagucagcaaaaugucugccauagaagcaggagguccugcuugggaccccggcccacaugaaagcacaggguugaugacaggcaaucuguaaucagcacuacugaggcagagagaagcugagcuccacucacuggccagccagccagcccagaggauucaauaggagcccugucgcaaaaaagaugccaggccuuuggccuccgcaaguauaugcaaauaugcaugugcacacacucucgugacacaccuauauuauacacaacaccacacacacacacacaaagaauguggucaguguggugggucagcuaggaugcuggaaggcaggagacacuggaccauuggauccugcucuaacucacaugggaacccagaugcuagugcacucugaguaggaggcuaggcucuaggacucuggggccaacccacaguugaugacugcucuguuccaccuguaguggcucugaacuuccaaaccccugggccagaaauggauguuuaccuuggcugcuuccaggacaauggagguuguggguaugugcugaaaccggccuuccugagagacccugacaccaccuucaacucacgggcccugacucaggggcccuggugggccccgaagaagcuccgagucuggguauggccugauacagggggcauggcagccuguggaagucccuuccugcucauugauguccuugaacgcucauugucuccgccuuuccucagaucaucucuggacagcagcugccgaaggucaauaagaauaagaauucuaucguggaccccaaggugauaguggagauccacggugugggccaggauguggccagccgucagacagcaguuauuaccaauaaugguauaguaugcauugggccuggguuaggugcgcuggugcuguugacuuugcugcucauacgguuuuugccuuucuagguuucaacccacggugggacacggaguuugaguuugugguagcagugccugaccuugcccuuguacguuucaugguagaggauuaugacuccuccucuaagaacgacuuuaucggccagaguacuauccccuggaacagccucaagcagggugaguguuggaggggaggagucuucaaggagcagugggcggagccugccaggggcagugggcggggccuggcuucucuuaacccacagcucacucauccucucccaagugaccagaacuguccuuucccacuaggguaccgccauguccaccucuugucuaagaauggagaccugcauccaucagccacucucuuugugaagaucuccauccaggacuaagccugggggacugacgcaguccgcccugagugggcggagcuguguccacaccugucuggcaauguugcaccucuggcgcggagcuugaggccacugaacugccuucagcucuaacacaucgccugagcuucuacuucucuggggguccaggagcaguccaguccccggaguggucuaaaauuccguuaggaacaacacugcaucucucucccuaccccuaguugacuuuagguugugaguuuuuauauaaaaaaaaauaauaaucacaagauaaau

SEQ ID NO: 5364 - RNA, 4963 nt, Mus musculus
caucuugggccagccuugaccugcauaugcacuugagaaugaucuugagcuccgccccacccccacccccacccccuugaaccuucugagugcuggguugcaagguuuguaacuccacacuuuguuuauucaaggcuggggguuggggugagaacccaugcaagcauccaaacaacuaagcuacauuucuagacccaacuuuucaucuuucaauuuuauuuuguguguguaugugugaagucaaggaauggauuucagguugucaggaauguguaccaggugccuuuacacaguuuuucucuuucuuagugguggucuuugaagcacaaaaggguguuuaauuuuuuuuuuaauucagcuccuuuuauuugugaaaaaugauuuugcacaggagucauugagcuuucuggauuugcccucugugcugucuggugggcauuucaccuuuucugucccagcacugagcggcuccucgucauuuuauuaugugauucucaagaucuccuucaucuccuuccuccuuucuucucuguuucucuccaugcucaucuuccccauuuucaguuucuuuuguaugcuugcagcaugucgcuuuucuuugugcacguguguguugugugggugcacaugugugucaggugugcauguuugugcuugugugggugugcaugugugucuggugugcaugugugaauucacgugauagccacagaugaaccuugggugcuguuucucaggagcugucuuaguguccuuuauccugauaaagcaaauguguggagaaaggauuuguucacugucacucacaaucuaggugauaguccacccucacagacaggucaagguagcagggacauaaaacaguuggucacaucacacccacagccaaaaauagacagagacaaauuugccagugcuuaguugugcuuaacauucucucuacuugauaaaguacuagcuccccugccuagggaauggcccugccuauaaugagcuacauagaucuucccauacugaucaacacaagacagucccccaugaacacguccacaggccaaccacugacugauccagucagggucucacugagacucucuguuaaguuugaugaaaaacccaggcaugauggucccuacccccaguacuugggagaugaaggcagaaggauuaggaauuuaaggcccucuuggcuacuuuucaaguuuaaagccagccuaggcuacauuagaugcugucuaucccccauccaucaaucaagguuuaauggaaagcaagaaucucaaguggggguguucuaaauuucuauugcugcuagaacacucuaggaacagcauucuugguggagaguugaguuguccagcaccauaaugugacaggugccacaacagggcagaggacagguguugcccacuaggcauuuuuaggcaccaauaucugagcaugaaagggaagaacuguuguccccuuaaauggcuaugagcuuuuuguuccuaacaaggaguuacacacacacacacacacacacacacacacacacacacacacacacacacacacagagagagagagagagagagagagagagagagagagagagagagagagagagagagagaaaaucaaauacaagagucauggugaaucauuaccauacuguccuacagucaacuuugcucuuaauaaguuaccucagaaugcuagccucucuggcccaugcccaggaagcuuugccaucugauauuuuagggcaugugaccuaugaagaggcaggaucugaaaacaggcaggaucaggcaugugcagcucucugcaggcaauggcaucuuuucugugcgagcacgcaccuguuccccaguaagaccccauggcuucccaaguucacgcuuauucuuguuuuggaagccaucccuggugcugcagaaaguaaggugcucucuuaccuccugcuugugcuuauuggucaagggugacccugcugugcucccuggcagagggauugucacacuccuucuaggggauggagaugcaguuuagcugguaagugcuugccagcucgcacaagccaugguuuaauccccagcucuucaugagaauguaaacaagguguguccaugcagguuuggacccacaggcaucaggagguggaacagggaggcgugguagaacccccaagguuacccucaggacauggcgacuugagcgaagucuaugauacccugucucaagacaauacauuuuaaaaguucaaaaauuuaaaugguguugagcacuguguccaacuaaaauuuauauucaaacaaacaaaauuucuuauguagucuagcucuugauuuauaaagggagaaaacgaggcccaggaacuuugcaguggagaugggaccugaauccagaaucuugacuuuuguuuuuaaugucgcuggucaucacaucccauuauagaugauugugagccaccauguggguucugggauuugaacuuggguccaucuagaagagcagucagugcucuuaaccacugaaccaucucuccagccccccaagaaucuugacuuuugaucuaauucccuccccauucuuguuccccuaaccuugggauacagaaguuuuguaagacagaaugucaucuagaagggugacucccucaggucuagcaccagauggucugacauuggagaaucuuaggagaagagcaugcuuugcguguguguguguguguguguguguguguguguguguguguguguguguguauguguguacacgugcacaagcaugcaugcauaugagguucagguuuacacgggugaucauguauaugugugcgaguugagggcagagguccacaugagugucuuccucgaucucccacccucugagacagucucuuacugagccuggaguuuacugacuuggcuaggcugggugaccagcaaacaauagagauccuccugccucugcauuccugcugcuagggcuuuagguaugagccucccuccaagccuccaggccuccaugguuccauggcugcauggcuccaugaccucauggcuccaugaccucaugccucccuccacgacuccaugaccucaugccucccuccauggcuccaggaccucaugccucccuccauggcuccaucccuccaugccugguugcugcaagaguacugaaaaucaaacuuuggcccucauaccauuggggcauccacacuauuggcugagcccauacacuuuaaaaaucacauuccccugccuacaggccacauucucucagcucuuucaaguguauucauuaaauucuuuaaaaauuuuuauuuguauucauuuaauuucuuauacacuuuuauguuauugggcauuuuuaaaauuuuuuuaaggggaaaauccuuggugcuuuauuuuuucuuuucuuuucuucuuuuccuguucuucuuuucagauauuuuugugugauaagagacauucgacucgcgucgcggccgcggagacuagaaggaggacuccggauccggcucggcgcuugcccucgcucgccauggagaccgagcugaucuagaaggccaagcuggccgacauggccaccugcaugaaagcugugacagagcagggcgccgagcuguccaacgaggagcacaaccugcugucgguggccuacaaaaacgugguagggggccgcagguccgccuggagggucaucucgagcauugagcagaagaccgacaccucugacaagacguugcagcugaucaaggacuaaugggggaaaguggaaucggagcugagguccaucugcaccaugguccuggaauuguuggauaaguauuugauagccaaugcaacuaauccagagaguaaggucuucuaucugaacaugaagggagauuauuuccgguaucuugcugaaguagcuuguggcgaugaucgaaaacaaacaauagaaaauucccaaggagccuaccaagaggcauuugauauaagcaagaaggagaugcagccuacgcaucugauccgccuggggcuggcucuuaacuuuucuguauuuuacuaugagauccuuaauaauccagagcuugccugcacacuggcuaaaacggcuuuugaugaggccaucacagagcuugauacacugaacgaagacuccuacaaagacagcacccucaucaugcaguugcuuagagacaacuuaacauuauggacaucagacagugcagggagaagaaugugaugcagcagagggggccgaaaacuaaaggcauccagggcaccaaccuccuuccccucaagaaaaccuuuuuacaucuccauuccuuauuccacuuggauuuccucuagcaaggaagcccauucguguguaugggaucaacuguuuauauagucuuuucacacugcagcuuugggaaaacuccaucccuugguuuguguuaucuccgccuuccuggugugcaguuacugcuguagaaaaguaucaauagcuucauuucauguaaacacgaguaacuuccagacacuuguguagaggagugacagcacacuugguauuuaaguaaucugaaccgguucuacaagugacuguguuuuguauuacugcgaagauauggaaaauguagugcauuacaauuuaaaguaauuguaauaauaacgucuugauuucuacauuccuuuucugaaccuucuuggggguuuccuuucagaagcaacuuuuccaugcacuuauuacaaauuccuuuuuaguaggaauccagaaguguuagauugaaugagaaagcgcuuaaugcaucugggcuuggggucacagaucgaaaugucuccugugucacauauucuggagguuacaucugucugugacaacagggaguuuccuuaugcauucuucauuugcugcuguuuaaguugacaacuuccuucccaauaaaaauucacuuacaccucaaaaaaaaaaaaaaaaaaaaaagagagacauucau

SEQ ID NO: 5365 - RNA, 5480 nt, Mus musculus
caggacagccuucuacgucgcaaggccugaaaggggaucacaaccccgguagaaugauacugcgagagguaggauggggucuuuagagggccugcccacuccuagguacaaccaauuagauuaaggggagucugauugagggccgcccacucaccccuugccccagagucccgcccaacgcccguccuaagacgcuuucucuccacucaaagccccgcccgccaauccuacggaagccaaucguaaugcgcacucuuaauccuccuugaaaggcagacuggaaacuuccaaguuugcacaaccuuuuguagacauuggggaaggagguuucccaaacuucugguuuccuaggaugaacucagccucaagggagucccuccccuugagcucagcgcgcagccgcguagaaggcggagcccggcccauggcuucucugcugagcuagcccgagaagacccuugucucccaucaaaauuugcugugcucagccccgggucccaaaaccgagaacugaggaccuagaaaauguugaggcaccuaguuaagccccaaccggguuggcugucacagaagcucucucagaaaacaaaguaauuuuggguuccgggcuggugugaagaaccgauuaaggugcugaacggcaggcagguucuaacuguaacgugccccacucgucuuaagccuguugaucuacguuuguuugggauagugccauuagugcccacauuccccuaggaauucuacuaaacccggggauggggguggaggguggagggagacccaguauuggagauugacaccuaaauagauuaaccaagugaauuaacgaaaaaaucuuccuugggucuagacccaacguuaaagaguaaggugguagguuccgcguguuuuuugcagaccccgggaagguagugcuguuugucucagaaaacaaaggacaagauacccuaaaugccaauuuaugggcaaggucgugggcuuuccccuuuaaaaagcagagucacaagugacaucagauagcuaaagguagacugagccuucggguuacuacuuccgaagccagucugucucuucccucccuacuaccagaauauaaauuacuguacagaagggcuguaacuccuucaaguccuaaacaaggcugauugagcuaaccaugcauaauaaccacuaccagaucgccuaguccauccaccuugaucggugggccaaggcagaugccagaggcgguuuauauaaauucucacaccuucgaggggaggugagcaaacguuagaagcacaaguggguugacuuuuaggcuggguaguucuggccccguagucuagauucuagcaaagggcggagcuucucggaaagcgaaagaaggaggggcuggcaggagacuuaagggaaguaggaaacuccacaggcgagcguacuggacggcaccgggggcccaggguugccugccaugucugcgggagacccccgcgugggauccgggucccuggacuccuucauguucuccauacccuuggucgcgcuuaacgugggagugaggcgccgccuaucgcuguucuugaacccucggacgcccguggcggccgacuggaccuugcuggcggaggagaugggcuucgaguacuuggagauccgagagcuggaaacgcgcccugaccccacucgcaguuuguuggaugccuggcaggggcgcucuggcgcgucugucggcaggcugcuagagcugcuggccuuguuagaccgugaggauauacugaaggagcugaagucgcgcaucggugaggaaacgugcuuccuggcuuugugccaaggaucaacgaggcuagccuuggcauauuaaucuuguucauuuuuuucuggggugcgcuagggaggaagagagugacagucgaauuuucugucaguaugcaggucagcguagggauugggagaggggucaaaaacccugaggaaagauggaaagagccuaggcaaagaccuucaguuguaccaagagucaagaucugcuuuucucgcgguaucucaguugugucaggaucaaccggacaagugaggaccccuuccaucacucacuggcacucagcacaacacccccgccccgcccacagugagguacaccuugcuagaugggggucaccauucucauugagcacuaacugggugccugagcccuucugacauucaauccucugcuccgauugcucugugcccugcuagaugcccaguuuggcuccauucucuagagccuuagaaagggaaggcaggaggaaggcucagagaagcaggcugacuuuggaguccucucagaugcucauuuugggagaguccaaaaggaaguguuaguuuguagagccauccaugguaccaguggcuggggaaggcucggcccaaguaggcccuuuuuaaauuuuuuuuuuaacauuuauuuauuauuauacauaaguacacuguagcugccugcagacacaccagaaaagggcgucagaucucauuaugggugguugugggauuugaacucaggaccuucggaagagcagucagugcucuuaccggcugagccaucucgccagccccaaguaggcucuuuaaacuaauucaggauuuugaguguguguacagcagcaaccuggggcauggggggcgggggugucggggauggggugggaggaggagccucuacacccuucucuucuccacagaggaggacugccagaaauacuuagguaagcagcagaaccaggaguccgagaagccuuuacagguggccagaguggaaagcagugucccacaaacaaaggaacugggaggcaucaccacccuugaugacccccuagguaagggcccaguacugugccccuagguagaauaggugggccacagccucaaacaugugaccugcagagggcauggauaccggaagcagauggauggaccugggaccuugggcaagcugcucauucugagccuugguuuccccaucuaagaaaugggaauaauggcaguccucucccagagugguucugagacuuuaauggcaugccuccaucauaguuaaccgggauuucaucugggaggaaguuaucuguucacugguagagagggcauguauaugacauugcuuugauauggauacaggcccagguucccuugauggaagacuccagguugggcuccuuccagccuucugcagaggcugauugauucccuuguccccuguccucaggacaaacgccggaacuuuucgaugccuuuaucugcuacugccccaacgauaucgaguuugugcaggagaugauccggcaacuagaacagacagacuaucggcuuaaguuguguguguccgaccgugacguccugccgggcaccugugucugguccauugccagcgagcuaauugagaaaagguugguuaaacaucuaagaggguaggugggugaaugcaugaaacccagagguccagaugcaaggacuguccugcuagcugggcucugucccgccuggguaauguaguccuuccugaccccauccucugaaggaagucaccgcagugccacucucccucaggugucgccgcaugguggugguuguuucugacgauuaucuacagagcaaggaaugugacuuccagaccaaguuugcacucagccugucuccagguaagcuuaggccugcuuuggucaaagagagaguagagauauagccuuaggaugauaguccaggaaugcaaaaccaaagcacuacagaucucugaggacggaccuguguacuuccuuauguaguggauauguaucauggauaccugguugguggagagcugguguuagcccgugcuuuagggacugagccugucccacccuagggccccacgugguccuaauaccacacccuuuggccuucagguguccaacagaagcgacugauuccuauuaaauacaaggcgaugaagaaggacuuucccaguauccugcgguucaucacuauaugcgacuauaccaacccuugcaccaaguccugguucuggacccgccuugccaaggcuuugucccugcccugaagaugacccugggagcccuagguaugucagucugucuguguucuuccgcuugccuccuuugacacuguaguggggagcuugugguccgucuaucccuagacaucuacaguagccagaugucaucucucaaguccuuacggaaccagugacugcaagugacauuaugacuugccggguugccagccaggacaguguuuaucagggcugcaugagucuaagcgaaggacuaguugagcuacaucucagacaucuuuggccucagggucuccuccugagaaacaggauauggagaucaggcagggaaauagugaggcacucuucuggcuauccuaggagacccagugugggcugaaggggagcugaaggagcacacacuggcuguuaaggagcaccacaggcuugccaggacagcugcuuugaccugccaaccuuaaacucccuuucuuccucccacagggcagaggggaagaugagacugaugcggagccagauucucugaugccguccugucuacaucuuugacuccccugggcucaacccguguucaaugaugacuggccugagcaacuaggacugccuuuccucccagccacccaugccugugcacgcaccucaguacacacaugccuccucgcacacacaggcaucugcauauguguguuuccuuugggacagcucccaaggauagcugaguggaagaguucuaucaucaagggggccuggccaucucccuggacaaaaguggggugccuuugcuacagguaguggcacgggccuauaguuucagcauuugggagguagaggcaggagaaucaggaguucaagcuuauccuuggcaacacaccuaguuuaaggucagccugggcuacaugagagccuaccucccccauccccuacccccagaaaagaaggaaaaucugggggcacuguggauuucuccucucuuuucucuaccuguugaaagcaaagucuaggaaggccccaaacaugauagcauuugggcccuuaguaagcugaagauaaaaaggagaagcuguuuggcuucgccccacaaagcagcugcaggcucagcuguuuucuccccagcagcgagguuugcaucuucuuauuccuuucacguucucuaccauagaggcaaugucauggucccucucaggguacaccccagggcccugaguccccaagaaagugagucuccccucagugucugggggaggaaugaggccucugugcacggucucauggggcauuucacugcuugauguugagcauuuuaaagcaaccugggucaaguguaaaccuccuccaccuguguuagagguuucaugggaaugucaauaaagaaaagaagggcucguguuuguacuuuguacuucugugugugaauuuauaauaaaaaguauucuauuuugagaaaguguac

SEQ ID NO: 5366 - RNA, 12311 nt, Mus musculus
uggccuggccccacgugacuaggccacgcagcagcgggagagggcggccauggggcuaggggcaagcagcgagcagccggcgggcggcgagggcuuccaucugcacggggugagccggggugguggaagaucaccagggaggguugcacagccccgaggccugcagugaccucccugcaugccuugcgaggcccagcgcguccaagauccgaggccccuucucuaaggagcauugcaaggggcugggagagcucgugggcuuugggaaagcugcugaagagggggugaaguggccagaaugacuggagccagggugggcauugggaccccagagugaaacaucccgagaccuagauggggcccuacgugucacuugcagggagguacgagcgaacaggcugcugggaaguauagucugguugauaaagaacgccguauggaguuggggauagaaagaucuuugaacucagcuccccuguuuugccccuuugaaaagcagguagaugcagagcuguguggaggcgggcagguuugucagguugucuggcuguugggucagccugccugccuucauuccuucagacaggaucuugguacuuaguucaagcuguuguuaaacucucagcugcucuuucucgguuccucuuaaaucuuaucuaucuaucuaucuaucuaucuaucuaucuaucuaucuaucuaucuauuuauuuugugggugucucauuauguauccccgacuggccuggaacuugcuauguaggcuagacugggcuggaaccuacagaaauccaucugcgugcgccugccuccugagccauuaugccucucuggucuaugucaaaggaagucuggagucagggcuagggaagcgguuucuagcuggagagccacauuggcuuuacagaucaaagugacaagauuugugcuuggggguuggcagacauugggaugcauccaaccggggguguuuuaaaacagguucacgggaagucaggaguuugggaucuuugcacaagggcugagggaagugagguggugggggugguggacggagugaaggcaaggggggcugguuaaagggggacagguugaucaggucagaggaugaggacccguuacagagauguguuuuugguguguguguuguuuuuguuugugcacacgagugugcaaaccagagguuuuagaucccuuuaaguuggaguuauaggcauuugggagcugucacacuugcaugcuggggacucaacccaggucgucugauagaauaauaggcucuuuuaacugcugaccuauuucuccagucccuuuguuuguuugcuuguuuuuucuuugagacaggguuucucuauguagcccuggcuguccuggaacucacucuguagaucagacuggccuugaacucagaaaucugccugccucugccucccaagugcugggauuaaaggugugugccaccacugcccggcuguuuuugauguaggauggccuugagcucuugauacuucccgaaucccaggauuacaaugugcacgaguauaccuagcuauagacauguuuuugaauauauauucuaugccaggcagagcuucaggcacuagagauaacaugguagacaaaguacucauauuuggaaaucaaacaggggagaaggaaggccauaaagagcuauguggaauaggaugugguggcucaucccuggaauaccagcauuagacgcaaaggcaggaggacucccaaguuugaggccaguuuaaguuauacaucaaggcucuuaucucaaaaacauacacagugagcugaagagauggcucagcagucacggacacuugacuucuaggaagcccagggugacuugguauuaugugcgugugcgugcaugcaugcacaaacugaaggucaugacauuggguuguccacaucugcccguaaguccagcuccaggggacccaggguccucuucugacuuccauaggcaccuccccaccccauacacacagggcaucuguauacccuggcacacaugaacacaaaauuuucuuuuguuuuuucaagguaggguuuuuuuuuuuuuuaagccuuggcugucuuggaacuaccucagagauacacuugccucugccuacugagugcugggauuaaaggcgugcgacaccacugcccggcuacauaaaucuuaaccacacagcaacggcacugagcuccuucuccagguccuagacuuggcauuuuauuuuauuugauauuuauuauauggagcuguggaggauuuuuguuguuguuuuuagauuuauuuucauuuuauguuuaagguauguauguauguauguacacugugucuggugucuacagaggucagauaaggggauugcagucagaugguugcgagccacccugugggugcugggaacugaaccuagguucucuacaagagcaguccagccucuguugggacauuguaaguggaggggugacauguuuuacacacacacacacacacacacacacacacacacacacacacucaugcaugugugaaauggcaugcguguguagaggucaguggaacuuggguuugaaugacucuuucacagagguugccuaagaccauuggaauuuuuuuuuuuuuaaacaaaaucucgauuguucaauuuuacccaugaaaacuugggagccagaugcuggggugaaacccugcuagcucagagagacagagaaaguacccagcugaccuucucccucagccuuggccccagcagcaaugcccucucacacugucucaaaaaaccucuuucaaaccgaauauccuuuccuacuucguauguaucucucuguccaaccuccugaccccaucuuagucuaaauaauccuaugcccaggucaugucaacugguugcuuguucuaccucuuaaccuuugguuggcuguauuuaauccuguuuauaauauucaagcagaaagcucucggauuaaaggugugugccaaggcugagucacacaacaacuaaaagcagauuuuccgguaaauuaacacagucucgggguccacaguguguuaaguguccuguaacaggaaaacucagacauuuacauuaugauucagcacaguagcaagauuaguuaugaaguaguaauacaauuuuauggggucagcacaacacaaggaacuguauaaaagguuaacagcauugggaagguugagaacuaaaggaacccugaagcagggaccccugagggauggagcaggacuaggaguccccaaacaguccaggaaugcuugcccuuggacuuggccaagcccccaccauaggcccacucccacuagaggccguggcagcucuagcaagugccacucagggacucaguugcuguugcuguccgggaguuuuuaugccggggcaaacuggccuugaacuaaaggcaccuguaacacuugguucucuucaggcuccugaagaguucugcagcuuggggaaucuaguguagguaucuaggaucugaggucaccugaguccugugcccugucaucggcacuguuaccuuggggccugguugaugccuggcccaagaaguucauagcaaaaggcuugagucaaaggccuaggugcaucucuggaguucaggaccugggguaaagguugccuuguuugagcaaggcccuguagguggggccuggcgauguguuccugguacagcuugugaugggggagcuggcuguacuuuggagacagcaguaaguuaguaauugagaggggcagggagcaccgagagcagggguggggagcaccgagagcaggggugggugcagcugagcgcauguccugacccugggauccgcucuccuucacugucagccugucccugccugcucaacuggagcuaggcagcuacucagggucuaggcgcuucagaaucuggccacaggcugccuugcccagcccuuauagcaaggucuggcugcauuucuccugcgugucugggcuuuccugcccaaucccaguuuugggguggggguggggugauauccuuuaggugccccuuacuccagggcuaucugaguccuuucuggaagcauucgcguaucacgguugggaaacuuaugucagggaaggaggugagugggggggugggugagcagagcagucugcggaggugagaccuucccacugguccagggugggggcugggcuccuugggccgugacgcaccucugcucuggaacagguacaagagaacucgccggcccagcaggcaggccuggagcccuacuucgacuucaucaucaccaucgggcacucgaggcuggugaggcuccccacugccccguccccacaggcugcuccuguucgcuucugccuccuuuuuucuuccccugugaccagggccacagagggacauuuggaggcauccagcaggccuaagaaggcugccuuucaagacauaugaggccuuaggauguggcccuaagaggccuuuugcuugcuuuguuaguuuucuggaaggcuuggggaccaaagcuuggggugccugaacugggugaugcuggcucaggugcugccuggagcugggugguggcugugguggcugcaggcccaaaccuagccugugaagccgggcccagcaaucguuucaguuugcccucacacccugugcuccaugccucucagucccugaccagucuaaggguucuggcccaggggugggaggucucagacagagccagcuccucccugacccugcagaacaaggagaacgacacgcugaaggcauugcugaaggccaauguggagaagccggugaagcuggagguauucaacaugaagaccaugaaggugcgcgagguagagguggugcccagcaacauguggggcggccagggccuccugggagccagcgugcgcuucuguagcuuccgcagggccagcgaacacguguggcaugugcuggugaguccugguaggguguguggagugggcggggucuggcacacaggagcaggauggccagggcugauggguggggcagggaucagagggcagugcugugggaucuaguuuuguuccaguguccucagaggacagcggguggaucggugcuuuuguuaaccgugugaccuugggcauacuuguuucauguuacuguuuugggacaggguuggaauucacuauguguagccagauuggccauaaaccugcagagaccucuagccucugucuccugagugcagggacuaaaacugugugcuagcacacaguccacaaucuaacccuaggcugcacugcuugcuccacuggccucagaagaagcaaguggaucuuacugaguucaaggccggccagaccugcauagagaguuccagguuggccaaagcuacauagugagacccuauuucaaaaaaauuuaaagaaaaccaucucccugccaagagaguuuauggcagagugaaguguaagcguugagguccugggucuggauccccagcagcuaugaaaaagccaggacagcagcauucagcaaggacacuguguagagugacagaggacaccuggccaccacacuuacucacucaaaauugggggguggaggguaccaagguaaagguccuugccaacaggccuggcaaccugcguucacuugccuugcugccugagcccaggcacgccucugauagacuggaagcuaagcacaaggcucccucccuggaaggcugcuggagccuggguguccuacacauggccuguggccacgagcggcaaggacaguccuaacacaguccaacccaaagccauaaacugcuaaaaccauuacgaggggccuugcggaguguucaccuguacuggaguucaagcuccggaagccagguggugugcacuugugacuggcuagggacaggcgagaugggcagcucccaggaacucacugccaggcauggagucuaauugcuaagcuccggccaaagagagaaugccucaaaggaggugaacaagauucccaaugaugacacccaaggauaucuuggccuccacaggcacacacagaaugagcacauguacacaggcacacacacacacacacacacacacacacacacacacacacacacagcgagaaaaagagcacguguccacaggcacacacuuuuuuuuuaaugauuggcuauggagauagcuuaaugcaugaauaaugucaaucaaaccugaauucaguccccaggaacccacacuguggaaggacuguuguccucugaccuccacguaugccagggcacacgugcacccacacaaguaaguguggugguguuuguaaacaaaagcaaagcacuaauucugagguguggcuuguaaggaggcugugugguucuguagcaugagcuucgagauggcagcauccugccugcuacaccaucacaccaaguaaagagaggcaggcucuuggaacccacaagagcauaugacccaaaacaaguagccaccccaagccagaagcuggacagcccugccacgaccacacugcucuugagggcuccggagucggccuugucagcccuuugugcacgggcacgccuuugcacgcagaccgcaaagauucugcagaggcagcuagaacccaaccagcaagccuucccagcaggggcaccuucccuccauagaacaggagacugaccauugcagggcucugguguaccaccgauacacacagugucaggugggcauaugagucugagagcuaaggcuaacauguggggcagcucagccacugagauucauuccuguacccguuauauagcaacaggccagagaaacuacuaugccaucuuuaucuaucuuggcuggaacagcacuaaacacugcagcaggcuucuggugguucaugcuggcccacccuucaaauaaggaacaaagccacgggggcugcacaggcagcucacaaccaucugcaacuccagucccaggggacccaagguccucuuguggccuccaggagcacugcacacauguggugcacagauaaacaugcagauaaaaugcccauauauacaaaguaauaaaauuuaaaagaaacuaagguccagaguuaagaaugcccaagagugcugccaucuguucaccaggcaguaacuugggggaggggagaaacuugggcccuguggagaagucuuucuugaggcccugcugggcaauagagggcaaguguccccucccuagagaagccucuucucucugcuuagcguugaaucuuaguuuaucauucucacuucaggauguggagcccucuucaccugcugccuuggccggccugugcccuuacacagacuacauaguuggcucugaccagauucuccaggagguaaagaacccauggcgugcuuguuuccagguccccugaagggcugugggcagacgcguugcacuugugucucaaugcugggaacaccccuccaacagacacugucuuucuccuagucagaagacuucuuuacucucauugagucccaugaggggaagccucugaagcugaugguguauaacucggaguccgacuccugccgggaggugacugugacucccaaugcagccugggguggagagggcagguacuuccuggggucagagggcuacagggcgaggugggugggcuguccuagugggcaugggcuccuggcaucccuuggaggaaacagcccggaccgcucauccuugcccaggauccuugcucagucacuguugcugguugggggaggguuauauagguagggagggcugaagugugggcuacccugauggaacacaucuggcuuuccacagucuggggugugguauugguuauggguaccugcaucggaucccaacgcaacccuccagccagcacaagaagccacccggugccacaccaccuggcacuccagcuacgaccucacaacuuacugccuuuccucuuggugccccaccaccuuggccuaucccucaggacucuucuggcccagaguuggguuccaggcagagugacuucauggagguaugugggagcaccugucaggccagggaagagaggagugucuggggcauugggccugccaccuagaggcuaucuagggaccguagaaacacuguuugugggccugugaguuccuugauguuagggggcccaucugcuucuagcauauagaaguagagaggcucugcuugaguaaaacaugcuuuuggcucuauuguccucgaguggaggugaggcacagguagucauuuaugaguuggaaacugugacucagcgauggggagaaccuugugccgcagugaggugggggcagccaggccagugcuagacaugguaggccgcaugguccccauuugcaccuggauucaagggagguucagagaacaggggcauuaccuguggguaccuggggauccccucggggagcggcagaaagcuuccccaguauguguuuguagggaggaucuggcuggccucccaucacggggaggaagggcagugcuugccgugcaagggcucuaguuagguugaagugaacaucugugcaccggagguuucuaggcacuggccuaacuaacccucaguuucucccuuccugguaccucuaggcccuaccacaagucccugguagcuuuauggagggacagcuccuugggccugggagucccagccauggcgcugcugacugugggggaugccugcgugcuauggagaucccgcuucagccuccaccuccagugcagcgggucauggacccagguauggggcagguccugaaagagacugcaguaccuagagcccugaugcuaaagugggcuacaggcucacagcuggacuugcacagcagugccccagcuuuccucaggaccugcuagccucugucaguccaguccagaguagaggaggcccacucugggugacuugguagauagagguaaagcaggauuugggccaacugccaugguauuacuccaugauguucagcucuggguucuuucugucccuuagacacagguggugggagucucgaugggguuggagggaaggcaucuguggggcugagggcgagcuagguagcccaggaauauggcagagggaaggcaggcucccauaucuccaguaguuggagguuuuuuguuuuguuuuuuuuuuuuuuugcgagcaaagaacuggguuugcuuucccucuccaggcuuccuggauguaucaggcaugucccuccuggacagcagcaacauaagcgugugccccagccugucaucuuccacagugcugaccuccacagcuguuucagucucaggaccagaggacauugguucuagcagcaguucucacgagcgggguggugaguggccuuuagugaugccgucugagaaauccuguguuuggggagggcugccccgaguucccuaggugggcuagagguuggcuguaucaagggauucacaugagugacuuccucugacuccaccaaagccugggcugcaggggucaucaccgagggugggucuccucagccccacuucauguuucaggugaagccacguggucagggucagaguuugagaucuccuucccagacaguccaggugcccaggcccaggcggaccaccugccccggcugacucuccccgauggccucacaucugcggccucaccugaagaagggcugucugcagagcugcuggaagcacagacugaggagccggcagacacagccagccuggauugcagggcagagacugaggggagagccagccaagcgcaggccaccccagauccagagccugggcugugagaacaccccuggugacauuugguguggcuuagcuggguagcucucuaggcugcaggcucuugugaggcacgggcauugcuacaauacauacaugguccugggucgaagggacagcacacccgagcagcaaccagcuucuguagaggcaggugacggaaucuagacugucaaugaagcaucgaugccccaucacaauauccaggugaagauggggcgagggacaagaggcuguguccauaggcagccacaccuguacugaggaagacccuaagucccaaugcccuuccucacucuaauccuuacacuggaugagcgaggugguauaucuggccacuuuauuucuuaggaugggaaauucuagggauuuaccuucagagggaucuaccuccgcuagcuguucacagccccagggggagguacaaaggagcuuacacuccaguucuuggguccuaugacgcucccuucagcccucacguagacagcuggcucugguggcagacgggucaaacuacgcuuccugucaaaaccccuccaccugcccgugcucaggguucuucuccugaagagcuggaaaaggccccucccaccuguccucagcguaagggaaaggagccuuuacaggcucagucuccgagaggacagcugcaccgcugccuugcuacagauggugccaggcauguccucugcagccccaguuccauguccuuugccaaucacuguaagcugccuuuggucuucuuuuccagccucuuuguuccaucauccacagaccauguaacugucuguucaggguacuuaggcugguaagccaaggacucuguuccaagaagcacaggccaaaugguucagugggccagguccuggaugggcaaacagaacccaaagcacuaggaauacauuuauagccaggccugugaggcccccgcuccccaggggccacugagaggccugaggccguacaacauggcuuaccacagggcugcucuggggccagcucaauuuagcugugguuaggcacucugacccccagcugccuucauuggaagguucugcuccccaggaccccauguggggugaaacggaggcugaugcuguuucaaguaugaacccccagaugguuucuuucccuguaaucugcuauggggaaagugacaagugaaaaaauaaacauguccagcacacugaaguguuuguaacuaaagcuuuauucuauacaacccgagauacagacucugccccuuuggcguugcagacuguccaguuuucuggaaacuuaguacugauuuuugacuagcuggggaaaaaauuacaaccaugcugggguaaacuccuccauaggggcacaacugccuguggaucaguacugcgccagugaaccaaccagcaaacccuacgcuuagugcagaggccccuccugcaaacacgaccaccccacccccugcuuuuacuuuauagcuaucacuaaaaaauaugcaccaaaagugcaccgauguguccagcauagaaaggacuucuguagaaaagcuggcuacucuagggcggagaaugguuuaacacuggcaaguguucuugcucacuugaggguauggaagccauggccugucuguguuccagaguuaagugaggggacccuguucugcagucaauuuguaagggacagaucugggccccucagcuguucccugcaggaccugugagauagagagaaaacaucuuucuuccccaagccccccuccccugugcuccugugggcagggaccacacacacaaggcaggagcagacggacggauggggaaagcugcaccccccacccccaaggcacgugugcuuccgcugugcucaaagguucaucuccugcagcuucacgggcuggaccauuugucugaauguaaaugaccuugggaagaauccaaaguaguuuuugccaaaaguugaaguguuuauccccaauaaguuaauauucuguacaagauccaagugagucuaugaaagcuuuugacuguuagaaagacggcagaaagaccuggacgaaggcguaacaaaagcccguguauaaaacuggaaaaacaaacaugaaccacaauauaaauaucaaaccaacucacugugagaucuuuuuacucuaguaacauaaacuuuagguagcaucugaaugaaacugcaacuucagcauggccguaaguucugacaguugucgugcugcucacgcggagcaggaagcuguggcuucgcuggcuuugcccgcgaggaagacuggcggaaggaguggccacagcagcuugggcuaucggacagccagggcgccaugggcagcacugcgcagcacaggcuguggguggcagccugcagguccacgugcugcgcaggcuccagcccuggaguugcaggucuuccuacaagagcacagcugagacguggcauuucaaaaguagcccaacauggucauuucucaggaaaugggcuggcucuugaauugugcaacagugauuuccauuaaaaauaacucuuacauaguga

SEQ ID NO: 5367 - RNA, 13582 nt, Mus musculus
augcagcgggagcggggcugggagggggagggucgagcuuccacgaaggcuuccaggaggaggaggcaguccuugcugagccauccuagacguuguugggauucccucaggugagcagagugagggugaaacguuccaggcggugcagucagaacgggagagaaaagcgcucuagguacugggucgaacuggcccugccgugggcugacgaggacucgggugggcuccugagagagaaguugacugcuagaacacacuuucuucugccuaguaguacagggaguuggcugcgagccuaaggaaggucuuggcgggagcagaggaggcagcaauccgcuguaaguagccaggguccggccuaggagaaaccagauucuuuuuuuuuuuuuuuuuaaggagggauggggguggggaagcugguuccagcaaucucuacuuuagguauuguucggaguaagggcucuggcccgagggcagaggugaaggccaggcccuaggaugaccuuuucuucucuccucaucccuggcuggucuccagucugagcuaacuuucugcgggaucugggaaaaagagguggggugagggccggggaaggguccucagauugaauugauaauaaucugcccugggcggguggaggcaggggaggagcuuccaucgcucgcagccucagucuacccagucugcagcucgggacugcucggcguggagaagcgggcaucucuaggacccggcucugcacgaagcucggcuccgcgaucuuaggagccgagcgcggagcagcggcgucgcggcccggucacaguccgcggggaggcucgaggcgggggagggggcggugccuccggggcggggccgaaggcugcgggcugcggggcggccuggcgggaggcccggcgugcgucagcgccgugagccccggaguuuuccacugacgaggagggcggagccgcgggcggggccggggcugagccagucucucccgccgccgccggacgcgcagaccugggccggcugcaccgacggccgcccggccgagcgcacugcgggucgcugugugcgcugcgacccuggggccggcacacgaguggcuucggugaacugggcgagcccugcuagcuuaggugagugccacgguuccugaacgcggcgggaugggaaauggggcagggggcgucucgggugaguggcgcugucacuccagcuccccgcugaucucccuuggguccuccggaggggacgccgggauccggccuccgagcccgacuggagaucuggcgccuggagugagagcccacggcugcgagguggcggggggggggcaggcuuccccucccccgccucguugugguuaccccagauguccaggcgccccaaagccgggcgcagguggcagugggacggggcgcgcgugcccgcgggugaguuuccuuuugaccuaguugccugagaacuuuucagaaguuacucgcguggccggggcaggugacauuggucgucuuccuccucgggcucccuagggggagggugcccgagcugcggcgugugccgggcgcccucggcaggcgggggucagggaggguuuggagggaugagugaggaaugagcgaggcuuggugagucacggaccccgggagggaggcgggggggagaaggauugugucguauguucaccugucaccgucacacucagaggccacugccgugagucaccggggcgcagcuacaccgaccacccgcgggcacacguaggcucucucccacgcaccucuacucccucuucugcaugcauuuccucuccuuccucaguuuccccuucccggagguccuuucgccuucauguacuguagaaaagccuacaccacagcaacggccacacacuuagucacucggguugccgauacagucacucccagauguagcccaccuuccugacaacagagaauuccucccuccucucuagcuacccacccaacaucucuggaccgaagucucagccuucugcagagaguaagucaauacucucugcccccaaaucuuugacagccccgcccacaucucccgagcugucaccaaauccacccccuuuucuccuuugcgcuuguccugucaguucaccuggcccuacccuguguccuacgggucacacccucucuggcucaggcgcugagccaucuuucaaccaugcaaaucuagaauugucaguccuuacuuacgcacuuggguggcuuccugugcccucgggcuaacacaggcccucuuaguugcaucgccaccagaaggcgcacuggcuguccuugcuccagucccuguaccaugcagugugaccccccccccccaaucuggaacucugccaacaucccuccuucagaggagccugccucguccccaguucuacccuucuugccuauccuguauaacuccuacuugagagguguuaguuguaggugcuuuaccugugugcccaaugccugucauaguguuuggccuuuaggaagcuuagccaggauuagauugaugaaugaaugaaugaaugugaaaaacuggcuuaagguggaggaaggggugacugucaagugcaguuuucccuggguagaacugaguauuuuauacagccagcaaacauuuggcauuuacccagggcagggcccuggagucugaaucgaaggaacuguccccuccccccaucacuuucugaggcaugggugggggagggguacgucagugcuuccugucugcugugucuugagcugcccagcacuuugucuccgugaacugcuuguaggugauuuuccgcaucccaggaagcccuucaggagggucugggguccugugacccuagguguuggaggugggggcaugacugaucaagaccugggguucugaggucaaaggacacauucuucagauuccuggaagggggaaucaaggccgccaaggggcuggggacuggagcacacuggcgggcugaggcuuccaauagcugccgcuuguugccuggguggaauagccuucgcugguucaguguauuaaauagcuauggucacuagacuggggugacauuccguucucugggcugucagcgccugugugugguggcaggaagggggcggccccagauucugcuaccaucccggaaggagcccgguucucuuugauuccggggccugccucuggggcuccucagggggugugguguuucugucugagccagcuccugggaauggcuuuuccuuccuccaggacccuaggacaggacuguguucacccugggaacaggaucuugaguccugaguagcugcugcagcccuacccccacccccugacucacugucuggcacuuuucuugggcucuucagcuaucuuucauuccguuuucugacuuggccuccucugcugcacagucuuucugucucugccuucuuucagccucuggaucccagguggcacuccucccucccuucuucccucccuuccucccucucucuccucagacccagccagggcuccagcacucacgccucaaacagccuggccuuuccagaacucugccugaagcuuugaauguuaacgcucuucagccuuaguucuuaucuuggguacacucagcuguggaucucuauccaguccacaccuaccucucugacaucuguuuacucuuagggacccggagccucugagaugccaccucacacuugcacucgagugagccugucccugucuccuuccccuucccccccuaccccguccucaaagccaccuuugaacacuguucuuggcucagccagcucugacccuggcugggggaugggcaugugucuccucauuagauuagcuuucagggccaggaaaacuaagaccccugccugggcuaaagcacugccugugucacaguccugcugcccacucuucugggccucucucugccaggcuuauuauggcuaugcaaaaauagccuauagccaagccuugugugaggagaggcccguuacacuguggucacuuauagcucuuaaagaguugaacccaggguuucaaugugugccagacagcugaccuaugucccuggcacauauggaggcaaaugucugccaucccagcacgugggaagugaacgaacacuggaggaucaggauagaggccaucaagggcuacucagacucucucaaucaagaucuauuauuuccuaaagcacuugccuccaaggucaugacaucggagauuaaucuuugauuugggacuuuuuuuuuuuuuuuuuuuuuuuuuuuagaaaguguucuguucauagcaguauccccaaaaggcagaagaaagugugugugggagggugggggggcuuuugauguccuuuuggaaauaacuuuuuggagaagaagguuuuucucuguaaaucagguuggcuuaaacuccaggcaauucuccugccucauuugagauuggauaaacaugagcuaugauacucaacucagaaaugacuucuggaaggguguaagucuuggugggcuguuccagucuuugaagaagguagggaggauagcagggacauggccuuguggggaacugcaaacaguggugcucagcaugggaacugcaaacaguggugcucaacauggggacuguaaacaguggcacucagcauggggacuguaaacaguggugcucaugugcaaacaauggagcucagcauggggacugcagacaguggugcucaacauggggacuguaaacaguggcuggcguucagcaugguguuuucuuucugucauuuggcugugggguauaggguggcucagaagagacuagaugguagcaggugggggcagacacagaacaggugauaagcuccgugugugugcugagaagccaccucagggcuuugcaggagcccuucagggagcuccaccaucaggugaccuacauagaacaggaauacagucuaggaaugccacuccugcaguggaggaauugugaagcauuuaacaccccugcaaaccuacccaggccaaccucuacccaucauccuacccccacccccacccccaggaaauccccucacaacuguccccuggucccacauacccccuccugggagauuguccuguccuuucaccugacuguggagaaggcagguacaaugccuucuaauugggucuccccuuuugucaaucucccauuugcauuuucugucgaguucaugccugugucuccacucaggaguccucgggcuuacuaucauuuacacacuuacugagcacacgauucacugacugaggacuugacauguguccauuccuguauuccacccagccaugugagguucuaauguguguuuauuuccuucgagacgccgucucccuuagcggaggcugaucuugaacucuugauucuccuguaccuccagaguacuaggauagauaucaagugugcaccacccuggcuugccuucugggaccuucagacaauuggagacagugauguugagggaccuacccaggaucacccagccaauaaccaaggcaagguccaaaucaggcaguugauuuuggccucuaggauaugucccaagucggugccuagccuguaggugaacuuccaggacugagacugccugggugugggugcaagaagaggggagggagaagcugaggguggcugcaggcugcagguuucuggcuugagcaacuggguggguggcugcaguuacuaagacagggaacacaggaagaggaacagauggcauggggagggagcagagagguucaauuuggggccugugaaauuguguauuuccaggagaaguggguccuugcuugguuugggggucuuggacuugugcccuuagucucacaggaaacaacuggaauuagagagggagguaguucccccccucccugugcauuaggcugugguggucgcaggauguuuagggggcuaccugucaaccuguguguaugaaugagugugucuguguaaggaugcgugugcccgugugugugaugccuggcucauggccaaacacccucaucuccugggagagucuacagacagguuaacugggcuguuuguguuugugguuugacucugggaagccggguaaccuagccugagaaacugccccggaaacaccugcguguccuucuucccccgggccuggggugagggcuugaccugguaguaagauuuucuugagccucucccaugccugccuggaggagauagauggcuguucuccauugaguacuuuuauccagugaguugacagcuggcgcccuccgauuuagggaccugcugggagguauagguuaggagaagggaccacaggauaccuuggugaaggagacccagacagcuuucugcuuaguuuuccugccucuuucacuuccugugaugguggugggggaggaguccccagcugugggcauucaacccugaaugagugaguaaggcagacucaagacagcgacacagcagguagcugcacucagccaccauccuugaacccacugagggucuccagguccuggaaggacuguuacuugucugagcacugggggguuaggaaaggagcuuuaacccccuccagccugacuggugagugagugcaucuuaccuagguccagagaagcuacaaaggagcaagggaaacgggagagcagcuuuuccugaucaguuucacuauuagagguuuguuuuguuuuaaggagaguuaaccauaauggugagcuauugaaggugaauuuaagaucaaagugaagucuccugccacaguccagccuagagcaggggacuuuucuccuguggcauggggguuucugagggaaagucuaagcuccaucccagggaggggaggggcuugggaaaguccuucugcugggaauccagccaacaucaaaaccagugcccauucucagagcuccuguucagccuggcccaggagcugaccugaagcugucagugggcaaggcgguggaccuguguggugggagaggagcgccgcucugggggggggggggucgucuggagauuguagaaggcccugcacaggcaagugcacaaagacccgagugccugugagucagccuccaggauuccugugaagaugagccaggcuaguucugucaguccaucuguuggucugucugccugcuggccugugugugugucugguguaugaauguguguaggugugugcauguaugaauguguagguggcaauggggaagguaccuggcuguuuuccagagaaggcuuguuaucaggggccaggucuugggaggccaaagugucuggaacuuggauuugcguguuaagacucauuugagggaggagauacuacuguguugauuggggcuggggacccuacuggagacacuaccaugaaccugcucuggcugggcuggagggcucagagucugggagauaccauggaagguaugcaggggaaacauggcuaggcagggagccuaucucuuaaucguuccauuaucuucaucccaggcgucuguccucggcuguuggaacccccuacauuccaccaugacugggcuacugaagaggaaguuugaccagcuggaagaggacgacuccaguuccuccuccuccucaucguucucuagccggcucucucucuccuccuuccccgccucuucugccuccccugccuggaacucugaugaggagggaccagguggucaggcaccccagucugaucaggacuccuguggccuccagaguuucacucgugagucucccauucggcuccccccaacccucccccuucuuccuucccuaaaacugaaauuggcguuuuuggccucgguagcccccucagggugccuccuucugugaagucgugugacugcuccacucugcagagacaccuugacuuccuguugaccguggggguugugcuguuggaguccgagacuuugcuugaguggcucuggcucuggggccuuagagggguguugcggcucuguuuccccggcacacccuaccccuuccaggaacaccacuggggcucaucccucugcuuccaccccccccccugcacuaggccugcuaagccucuucccucucccuccauuuuagcuucuuucugaauguccccaaaaggguuuuuccagaauaguuuucuucucuuccuuuuuuugagagcacacucucauauaauccagguugccuuccagcuguguggcaucugccucccaaguacagggauucgggaugcacgccaccauggcugacuuccugguuaucuuucucucuuuuuuuuucuuucuuuuuuuaaagacuuauuuauuuuauaauaugugaguacacgcucacugucuuuagacacaccagaagagggcaucagauccauuuacagaugguugugagccaccaugugguugcugggaauugaauucaggaccucuggaggagcagucggugcucuuaaccucugagccaucucgccagcccccucccugguuaucuuucaaguuuguauaauuuugauuuuaaacugaaagauggucuugaugguuuuuuuuuuuuuuuuuuuuuuuuuuuggguuuuuucaagacaagguuucucuguauagcccuggcuguccuggaacucacucuguagaccaggcuggccucgaacucagaaauccgccugccucugccucccaagugcugggauuaaaggugugugccacuauugcccagcgauaguccauuuuuuaaaaaaauuauuucuuuuuauuuuugagauuauaauuacaucauuuccccuaucuuccccucccuccaaaucuucccacauauccguccuuauccucuuucaaauucauggucucuuuuuuuuuuuuuaauuauuguuacauaagucuauacagcuauauuccuacauauauaacuccagccugcuuuguuuuuauaauguaaaggcaaccuuugauuuucagcaugcucuuucuccuucaagaaccauuuuagacacuuuuccccuacaaggggaauguuuauaaacacaggauuacgucucccuaugaaguuuugaaaccauaguuguuccuuccaugucuccuauacaacauaccuguguguugcauauuuuuuaaaaaaguaugauuuuuaaugccuggaauacuaacaggaaauuucuuagaaggaauuuucucagguaguugaguacaaaguuaauauguuaacuugaagucacuuggcaaacauauaaucccagaaccggggaggcaggagggcugggguucaaugucgcuugcuguugaaccaguccuagccagcuugggauaaaugaugguguaugccuuuaauuccaguucuugagagacaaagccugguggaucaagaccaaccugggcuacguaucaaguccucggacagucaguguuacauagugagaccuugucucaagaaaacauaaacaagggcuagaaggauggcacaguaguuaagagaaucuugcucuugcagaggacccaagugugguccuuagcacccacaucagauggcucaccaccaccuguagcuccuagcacuagggaucuggcgcuuucugaacuucaaaggcacccacacccaaguggcauacacucacacaugcacuuauuaaaaauaaguaaguuugaauugggcagugguggcgcaugccuuuaaucccagcacuugggaggcagaggcagguggauuucugaguucgaggccagccuggucuacagaaugaguuucaggacagccagggcuacacagagaaacucugucucagaaaaccgaaagagacagacagacacacuuucugggucuguuucagaagacuuaaacuauaaaggaaaagaccaaugacacaaauauauauuuuuaauuuaugugcaugaguauuuugccuguggauauaugucuauguaccaugagcuuguuaugccugaggaggccagaagagggcguuagagcuucugaaacugaguuucuuggcugcgaccucuccugugggugccagggcucuuaacugcugagccauuuccccaguucuuugauauauguuuaaacaggggauuauauuauuacauguaaagaauaagaauuacagaaaauuguacaaaggauuuauaaauccgugguaaggguggcaagacgcuucaucuuugcggguucauuugugcugagaaaugacaguuaagcugguguuggguugggggugguauuguucuccagauccagccaggccuggcuuuuaaguucagauccaagguggguggagaaagagaagggguuggaaucuuucuagagauuauaccacaucgagggaagcucaaucccuucucuuuucccuuucagccccguccauccugaagcgggcuccucgggagcguccaggucacguggccuuuaacggcaucaccgucuacuauuucccacggugccagggauucaccagugugcccagccgugguggcuguacccugggcauggcuucucggcacagcaccugccgccuuuucuccuuagcugaguuuacacaggagcagguccgggcucggcgugagaagcuccgccgccguuuaaaggaggagaagcuggagaugcugagguggaagguacgggagguuugcacguugcggaguuguugguguuaggggagauucaauggcugggcuauagcucaggcagggagagcgccuccuaguggggaggaggaccugguguccaucaccagcacugcauaaaccagguaucuuggugcacccaucguccuggaacuuggguggugaaagccgaggaaucagggauucgaggucauccuccgcaagcuugaggccauggcccuuucccaaaugaaaguagucggcuucagaccacaggcuaggcccugggcauaaauaaugcuugaaucuuccuagcugaauccgaucagccggcuagacugaucugacacugccaguacaucgggguuugaguaagagauccuuguagcuguggagcacaguguguaccccucccccacagacagcaccccacucucugggagagcuaaaucucucucucucucacaccgucuuucuguacuuauaguuuucaguggcuggaguuccggagucaggggcaggcgugccucucacagcggaugccaucgaugacgccucuguagaggaggacuuggcaguggccguggcaaauggccgccuggaggaagccaauuuccuccagccccauccaccucggcagcgacgggcucuccuucgggcuuccggcguucgaaggauugaccgagaggagaagcgggagcugcaggugcugcgccagucccgggaggauugugguugucacugugauggcgucugugacccugagaccugcaguugcagcuuggccggcauuaagugccaggugcguggucggacuggguaagauaaggggggugugccuauaaucccaguacucgggcagggcuacacagggaagcccugucuguggggagccgggccugcuggcuucuugcaucuccgaaguucucacuuuggcuuugucuuucucugcagauggaucacacguccuuccccuguggcugcugcagggagggcugcgagaaccccaauggucgaguggaauucaaucagacaagaguucagacgcacuucauucacacccucacccgccugcagauggagcagggugccgagagcuugggggaccuggagucccccguggaggacacuccuguugaacaagccgcgcuuucccccuuuccgccuuccaagcccccugugagcagugaacugggggacagcaguugcagcagcgauaugacagacucuuccacgaccuuguccucuggcagcagcgagccuccaaaccacccugcccaccccagccugccaggucccagcuuccggucuggcguagaugaagacagccuggaacagauccugaauuucagugacucugaccucggaauugaggaggaggaggaggagggagggggugugggcaacuuggauaaccucagcugcuuccaucuggcugacaucuuugguaccggugaccccggcagccuggccagcuggacucacagccagucuggcucuagccucgcaucgggcauccuagaugagaaugccaaccuggacgccaguugcuuccugaacagcggacuuggagggcugagagaagguagccucccuggcaguucuggguccccugagggggacgccguccagagcagcuccugggaccucagcuuauccuccugugacuccuuugagcuucuccaggcucugccagauuauagucugggaccucacuauacuucccgaagggugucgggcagcccggauagccuugagaccuuccacccauugcccagcuucucuccaccacgggaugcgagcacuugcuuccuggagucucucgugggccugucugagccgguuacagaaguccuggcaccccuucuggagagccaguuugaggaugcugccuuggcaccuuuguuggagccugugccaguguaaggauuaaggugccuucuuccugcccugagacccuguugcugcucuuugugaucuugggguuccccgaggucuauguauguaacggucuccuacgggcugguccugcucauggugccaugugggcacccucuauuuuuacauuaacacucugaauuuauuuauuuuuuuauguuuuucuguacugaagaagggaggguggggaggguaccccucuuucaaugccuggucucuuuauguccaaacagaggucuuccaccuccuacuguaugccugaaggaggaaggggcggggcucuccuggagccucgcagucccucuuucuguacuguaagaugcuccuugcuccaaagacagcgacggcugagcgcagggccuuaggggcuucugugaaccauaggagcuaggucuucuggacugugaagauguaauuuauaucuguaauuuauuuggggauggagacggcagugguggagccucucuggcgggugggcaggcaguguuggggccgaggcuucgguguacccugccagucugggcuucggugugguguguggguucgaguuuauggcugcucuauuaaacagcggccuggcucaacugagcagacagaggcugugcuugaccagcggugaccaaaaccccuucugcccccuucccagaaacucuacuugcccucuuuccaauucccucuccccaaggccauggauuauaaagccccucuguaagauggugagccaggggcccuaagagggcaugaagcacacccugaucacugucucaggccuuucugggcacugacucgacccuggcccaccucacgcccccaggccaguuggcaacugguggcucuugagagcucuuacgcccuucauuagcugauguuggauuuuauaugcauuuuuuuauugucucuaagugucagaacuauaauuuauucauuucuuugugugugugugugugccaagaaacgcaggcucugggccugccuccuugcccaggaggccuugccagccugugugcuugugggaacacacuguaccugagcugacagguaccaauaaagaugcucuauuuuuaag

SEQ ID NO: 5368 - RNA, 1648 nt, Mus musculus
uggacuagccacugacagcauucaucuaggacagucagaagaacccagaaugcagcgggagcggggcugggagggggagggucgagcuuccacgaaggcuuccaggaggaggaggcaguccuugcugagccauccuagacguuguugggauucccucaggugagcagagugagggugaaacguuccaggcggugcagucagaacgggagagaaaagcgcucuagguacugggucgaacuggcccugccgugggcugacgaggacucgggugggcuccugagagagaaguugacugcuagaacacacuuucuucugccuaguaguacagggaguuggcugcgagccuaaggaaggucuuggcgggagcagaggaggcagcaauccgcuguaaguagccaggguccggccuaggagaaaccagauucuuuuuuuuuuuuuuuuuaaggagggauggggguggggaagcugguuccagcaaucucuacuuuagguauuguucggaguaagggcucuggcccgagggcagaggugaaggccaggcccuaggaugaccuuuucuucucuccucaucccuggcuggucuccagucugagcuaacuuucugcgggaucugggaaaaagagguggggugagggccggggaaggguccucagauugaauugauaauaaucugcccugggcggguggaggcaggggaggagcuuccaucgcucgcagccucagucuacccagucugcagcucgggacugcucggcguggagaagcgggcaucucuaggacccggcucugcacgaagcucggcuccgcgaucuuaggagccgagcgcggagcagcggcgucgcggcccggucacaguccgcggggaggcucgaggcgggggagggggcggugccuccggggcggggccgaaggcugcgggcugcggggcggccuggcgggaggcccggcgugcgucagcgccgugagccccggaguuuuccacugacgaggagggcggagccgcgggcggggccggggcugagccagucucucccgccgccgccggacgcgcagaccugggccggcugcaccgacggccgcccggccgagcgcacugcgggucgcugugugcgcugcgacccuggggccggcacacgaguggcuucggugaacugggcgagcccugcuagcuuaggugagugccacgguuccugaacgcggcgggaugggaaauggggcagggggcgucucgggugaguggcgcugucacuccagcuccccgcugaucucccuuggguccuccggaggggacgccgggauccggccuccgagcccgacuggagaucuggcgccuggagugagagcccacggcugcgagguggcggggggggggcaggcuuccccucccccgccucguugugguuaccccagauguccaggcgccccaaagccgggcgcagguggcagugggacggggcgcgcgugcccgcgggugaguuuccuuuugaccuaguugccugagaacuuuucagaaguuacucgcguggccggggcaggugacauuggucgucuuccuccucgggcucccuagggggagggugcccgagcugcggcgugugccgggcgcccucggcaggcgggggucagggaggguuuggagggaugagug

SEQ ID NO: 5369 - RNA, 23859 nt, Mus musculus
ugcaggagaucaacccagagcaagcacuguacuuaccaagccacaccccaagucaucauuuucagaggagacccucacaugugagugaaggcuaaguguagcuugggagagaggguggacugugaggggggcagggggggcagccuuuggaacaccagcagcucuguccuuggucuggugccguuucccuguucugguaaauucugacuucacuacugcuuccuaacauagggcacaacugagaacauaacagaugcccaaccuggaccauuuccccuuauuuaucuacguaaaacugagucucgguacauucgaguugcaggauccaccuuagccucuggguaguggggagagggcacacagcugggugcucccccauuagaauuuaagaugauuuuuuuuuccuaguaaacagagcuuucagaaaagcagagagagaagccugucugacaggguugggugguaauggggaugggcugcagagaaugcggagaguucuaaaggacccuggaugucagcaaagcccagggaagggggcagcucuacuuggcucccugacagugaagcauguucucugccaccuggucccucuccuggagccgucccugcaaaagugaagccuggaucccuaggcagacauugcuccuucuucugugagcccccagcuuuuuaaucucuuacuuauccugccuggguagaagguguuuuugccacugcuacaacuuacaccaaccuggccucaacuaugucgggguuguugcugcuguuucgagauaagaccucccucuguagcucaggcuggccuccuagucgcagcaauccucuggccuccaagucgcagcaauccucuggccuccaagucacagccguccucuggccucggccucccaagugcugggaucccagggaugagucauaucacccuccaagggggcagugauuagugguggugaucaauaauuauuaaauaguuaagggcuguggugguaggaauggaaauggcuaucccacagcucauguguugguuaacuguuuggaaagaauugguggguguggccuuguuggagggggugugucacuggggauuuaaaaaaccauucccagugugucucucugcuuccuucuuuuggaucaagaugaggauucucagcuguuccuucugccgugccuuuacuccaccaccaugggcccuaacucucugaagccauaagcucaacauuuccuucuuuuauaaguugccuuggguuuagcugaguaucacagcguguuguccugggagcuuguccugggguaacagaagagcucagaaguucuagcuuggagggcugaggugagaacuuagaucuagaauaggcuggccacagagcaagagccugucucagaagcaagggaaaccuuaggcaacaucugaugguuuauuuuggaauaaaaaagaacuuuugcuuccauuuguuuuguuuauuuuggguuuuuuuuuggggggggguucuucauuauuuagagaauacuuuauuaguuuuuguaaucaaacccacguagauaagaccuuacauauuuaacacagugcauugccccuguacaaauggggaaaaaauuaaguccaacauuucuagaccaauauggcuguccauuucuguucaaugccaacucaacacaguaaacuggauacuuuuuuccaaaguugacagcacuuuugcuuccauuuguaaugcaccguaguucagccaccuccaaaugcuacugcuuagaaauacuuuaauugggagcucgguaguuaaaagcacuggcugcucuggaagagggccuggauuugauucccgccccacuaugugacucacaacccuagucucaggggaccugggaugcccucuucuggccucuuuggguccaagcaugcauguggcaguggccauacagacaaacacuuauauccauaaaauaacaaaaauaggucucgaaagaaauaguuuaauaggaggcuggaaagauggcucagugguuaggagugcucacugccuucuagaggucagugugggucccagcacccacgucagauggcucacacccacauauagcuccagagccagggaucagugcucuauucuggacuucauuuaugcuauauagacuguacacacacacacacaugcacacacauacaugcccacacacacuugcacacacacaugugcauacauacaugcccacacauacaugcacacacacuugugcacacauacaugcccacacacacuugcacacauacauacccacacauacauacccacacacacuugcacacacaugcacagauggaugagguacagucuguggccuucagguccauagagcaggcuugcugccuccucacccugaaaugggauguccugcaagcucaggcgagcucagugcccucggugugugcagccguccaucugggaacaaggauaccagcgugaguuacugacacucgucacagagcucaccugcugcggcauccaugagcaggacaggcuggcuugucagcccacagcaggugaggcagggaggaaaggcaugcacaggccaggggaugugugugcuggagaagaggaagcggauagaaugcagugggaaguaaaaagaagccauggugcugagaacaugcucaccagacagaagagaggagccuccgagagugcuaagucugugaugcuacgacucgggguccucucuggcacauggguagauggccggauggugagaugaauaagauggaugggaagggaguggugggcacaggguacccucaggccccagcugaagguggaguugugugggaaacagacacggaugagauugguugacagcaacaguaggagauucucagccagauuccagacaggaacacgaggaagagcuugaaugcccuggggauacagcucagauggcaaaauguuagacuagccugaguuccauccccagccccucauaaacgguggagcaucccagacuugggcaguggaggcaggaggaugaaaggcucaaggucuuuuuaaccccauagcuauuuaaaguccagcccaggaugugugggaccuaucucaacaacaaaacaaacaaaaacaaagccagggggcugaagaaauggcucgguggcuaagagcacacacugcucuugcagaggacacaaguucgacucccagcaccuauagugaugggcaacucacgacugccacagggagaucugaguucucuagccucccugggcacauauacauaauuaaaaagaaagcucgaaaacaaaaaguuuagcagaaaugaauaaggacacggagucggugagcuggaauaggaugggggugguucugggaggagagggguagaggagggauugugaucgaaauacaugugaaguucccaaggaauucauacaaauaaaagccaaaaaaacaagagcugaaguggggacaggaucggggugaggagcugagccccaggggaagcugaguagccccugacuuagcugcuggggcaacgggaaagggccaaugucugcgagccugugaggaucugcuggcucucugugaaucucuccugcagggaaagaagaacagacagggaggccagaaggaaggagaaagggaacuaaccgaggcuuccucaaaugugaacagcuggagagcaacuggagcuuuuaguuccuaccucacuggacaaagcaggcuccugagaacucccaagaguugugauauggucaguggucagcgaaccugggcccagugcugcacaggggguaccagaggcuuccuaagaacacuggaaagcagaggggcccucacagcuugccugagaccccuauuaaggagagcuugagaccugacuugugugcugcuggacuccgaggcuacagacugccaucucacuaggaauaaauaauauccauccacccccaggucugccaacccacagcccccuguaaaccuuaggucucaguaauuccuaggucagccaccacacagucuccagcaauccccaggucugccacccaacaguccccaguaguccccagcaguccccagcaaucuccagguuugccccagucucaaguccccuagauuugaaaugcaggcucucuugcggucagcugguucccagccuggagcguugagcccguugagcuugcuugucacagcaucuaaagauaggguaccacacaggaaaccagaugcuauuggcuaacuucgaaaauaaagaugcccucauagagagggaagcacuugccucugguggagucugcgugagacugggugagugacuggcacuuccugcagaaguucccuucccaucugcucagguaaguaccacggacuccagacuccucccauaccugggcguggggucaaucaggcacagucacaggguuucugaugcuguuugccuuccgugucuauuuuccugaggauacugcagauaaaucaggagaguaaaggaccuuuugcacgcucguaacuugaggaguuaguaauuacauuuuagggaugugaaaaaaaagguuuauauuagauguuaccaaaaaaggccuugauauaaaaucacaucuggguaauuggaaauauugauauucuuaaagaucacaauucagauugccagucagacuuuuuugauccaugccucuaaucccagcacuugggaaggugaagcaggaggaucgauacaaguuugagaccagccuaggcuagcuaaugagcucuaggccaguuuaggcuucugugugagaccgccuuaaacaaacagcaccaaccauaaaaacuagugauugugguuuucauuucuuuuuaaaaggagcuuuuaucuucagagacucauacuugaaugucuauagaaacagaauaaucuaauucagccaugaaauaggacauagaugaaauauuaacugggaguugauaauuccuggagcugaguggcgggugccagguguuuccuuugauuuccccccccccccccccgguuuuuugagacaggguuuuucuguguaacugugacuauccuggaacucauucuguagaccaggcuugccuugaacuuauagagauccaccugccucugcccccucaguacugggauuaaaggcgugcgccuccauugccuggcuccccugauuguauauaggcuugugaauauaaagagaauaauguuauauaaauagaguugcuugccuagcacacaaggagcccugggcccugggcacaaucuucagcaucuaauaaaauuggacuugguggcacacacugugaucacagcacccuggagguaaaaggcgggaggucggaagugcaagacucuucucagugaagcagaauuuugaggccagccuggacuuuaugggauccugccucuaaaaacaacaauaaugaugauggugacggugguggugaugacggugguggugguagugguggugcuggugguggugguggugguggugguggugguggugauaaauguucaaaacgauguuagcauuuuuacuauaaauauaaauuuaugugucaaaaaagcuaagagugcuaugcuaaaccugcagaguuggauaguuuuaaggauuccucuuccccucccccucuuuuaaaugcuuuuuugguaccaucuucaauagucauaaugaacauuuauuacauuuauaauaaacuugucacaaacucauucuucaguuuuauaaaugcucagaaccauggcucagacacuugggcacagacaucugagcuaggagucguggucuuagggaggaaacgauaagaacaggccaggagggcuggagagguggcucagugguuaagagcaccgacugcucuuccgaagguccugaguucaaaucccagcagccacaugauggcucacgaccauccguaaugagauccgacgcccucuucuggugugucugaagacagcuacaguguacuuagauauaauaaauaaaucuuuaaaaaaauauuuaaaaaaaaaaaacgaacaggccaggaggagauacaccccugcuugacacagacaagccccuauucagaggacccugcagccucgcucacucugugccugaucauuuauaaccaugugcgagaaaagcugggaacuugggauucuccugccuucugucuuuccaauucugccauuuuuuuucuuuuaauuuuuucccaacugcuugaaauacaauacuugagguaggaagaaauucagucaaaugugaagauacgcaggucauaagaagacccuguucaggcccaggucauaagagggccccagccuacugagaggagacaagcucagagugagaccuggccugcugagccuugggaaccuaugagggucagcaggguaggugcaguggcugaacuggaaugggguuuuccuggacaacagaaauggccccaggaagcuguucgguggcuuuucccagagaaaugugaaccaaguuauccaccaacgcuaugacuccuggggcaagcaggaacgaccccacacccaaguuuaggcuggagaaucagcaagucuuuugggguuacucauagcaacaugcccuaggguuagucacagcuuaucucaguggggugcccacucaugagagcuguguuccugggacuccuuagccuccugagagggaaccuuguaaguuagcugaauccugugagccucuauccccuuuccuggaggccaucguggcuucuuuacccucuauccuguucaccuuuguuuuuaucaaaggaugcuggagcagaaaauagucccagcccaguucagucuggcuagccuggcccuucacacaccccuuuuuuucugggaagaagaacccgaccaaugcuaaucucuuugaaauauauccuccgcccuuugcuucugccgaccccauugcacagggagggcuggaggguggugggagaugcuguucaacuuagggacacaguacacacugccccugccaacacuucuggcaaagucagcuuccugcuuuuccuauggcaguaggcuucggagugcaccguuagagugugguaugcaaagucccaaacacacauuggacgucuuuagugccuaaaacaauacgggccagcaaaguggauucaggcaccuguugcugauguguuagaauggcggucgcaucucagcagcacucugggccaaggcaguuccacguggaagagguuuuauuggggaaagagagagaagguggcugaauaaacagaacaggcaaggagagagagugcgagcaguguucuccuuauuuauauggagaaugacauaacgcagguaaagguggaaggugagccaaguggauguugggaauauggugccuguugccuuggcaaccugucugcaggucgcaagucaugcuguugccuaugugauguccugaugccaacaguugccaagcuugaccaccugaguuugaucccugggacaugcgcaguagaaggacagaacugacucccucaagauguaaucugaccacguguuguggcaugugcgaaaguguguguggggaggagcgugggcccccccccacacacacacacacacaaaugaucaagguguacucuaaccugcaucguggcuaguccaagugugugcacacauacauauaaauaaauguaauuuuaaaaaccaugcaugucuauuacuucagggaaaguuaagcucugugaccuuagggcuuuaaaaugacagccugcuuucagagguuacuaaggaucccaggucgugggaacgggagcgaagaaggcaugcuagggcugauccagaucaaaaccaacucuaguuccuucuucucccgagccagcugugcagggguggccaugucaggcauggccuggggacugcaugagcugcagggggggaacucaggcuguugcgggggggaggagggggucgggguggggagacccucgcugacuuugaugagccacagcucaggagcucucagaagcugggaccuugugugacucaggucauugccugccaaggaaaaccaaaggaaggcuaaggcuugugaccaaaucuguggucugccuuuccuccuggagguucagggcaaacugcccugaggguggaaucucccugaacucugaauggagagcgcuuuaaccaacucaucuggucaaauuguuuugaauuaugaguauuaauagaaaaaagcaaaucuguauugcuuuuccuuaaaugccuuuccagaacauugcuaagcuaaaccuacugacuauguagcacaguacgcugagagacaugaaaggucaucagcaauauaggccaggcuauuggagagaggcaggaggaagucagugaguuugaggccaucuuggagacccaggacaacauaaagagacccugucucaacaacaacaacaaaaaacuucauuauauaaaaccuugcaaacaguuuuuuuaaaucucacaucagaauuaaucagcuccaaugucaaugcaccauaaugaacguauaguuugaauuggcauuugaauuuccuccaggcucucugggguggagucugcagcucuccugucccccucuucugcuacacagccagcuuggcucucuguaaaccaggcugccccugaaaucucccaaacaaguaggcucuuccccacccccacccccacauccccucuugucugcuguuuuggguacuuucucucacauccucucuacuugaccaggaaaccccagacucagccccucugagccuaccucaccucauucccugauaccucccucugucugcaaguuuccucccaccuuuaaaaguuucuuuuaaaauauuuauuuauuuuuaguuuacaugcauugauguuuugucugcauguaugucugugugagggugucagauccccuggaacuggagucacagacugucgugagcugccaugugggugcugggaauugaacccaggucuucugggagugcuaguagccagugcucuuaguugcugagccaucucuccagaccuaaaggugacuuuuuaugacacccuuuuaugccccuccuucaguccuaaaggagacagaaauagagacccaagccugagucuauuauuuaaccuucccuguauuuggugauaaacauuuauagagcugcuucuguguuucuuucucagcagguucuuguacagcacucauccaguacaguacuugucuuaguuaggguuuuacugcugugaacagacaccaugaccaaggcaagucuuauaaaaaacaacauuuaacuggggcugccuuacagguucagagguucaguccauuaucaucaaggugggagcauggcaguauccaggcaggcauggugcaggcagagcugagaguucuacaucuucauccaaaggcugcuaguggaagacugacuuccaggcaacuagugugaggaucuuauacccacacccacagugacacacccauuccaacuaggucacaccuauuccaacaaagccacaccuucagauggugccacucccugguccaaggauauacaaaccaucacacuccacucccugguccccacagacuuguucaaaaacaugagucuaugggggccauacuuaaacauagcauaaugcaaaaugcauuuaguccaacuuucaaaguccucauagucuauagcagucgcaacaauguuaaaaguccaaaguucaagggcucuucugagauucauccaacuaauuaacuguaauccccaaagcaaggcaggaaaccagcugugcaaacuccaaacucugcaucuccauggcugaugucaaagcggucuucagaucuccucuccuuuuucaucuuuguugacugcaacaaacugcuuucuccugggcugguuccacucccuguuagcagcuuuccucagcauguaucccauggcucugguaucuuuaacaucuuugagucuccaaggcaauuucaauguuacagcuucuuguuucagugucugggauucuacuugaucuuuuggacuccuccaucacuuuuccagcucugcccucuguagcacucuaagcucagguuguucacuccacuacggcugcuguucucuuggugaucaucuuacugacaucuccaauacacugggguguuccacuccaacuaagcuucaccaauagccucucauaggcucucuucagggugccaagccucaaauccuuugcaugaccccuucaguccugggccaucaacuacagcugaggcuucaccuucuccaguggccuucccuggccucucacagugcuaagccucagcuucucuccaugaucccuucauuccuucacaagcauacugccugagucaccugagugacucuuacacauuaccaaguccagucgcagcaugagguacaaccuuggguaucucuggaacacagcuacuuugugcucucagaaaacaauuuccagaagauuuuaccucagugaugcugguaucuucuuaaucacuacuaauuccuuagcuccagcuaaccagcaucaauugccccaguaguuccuuccauucuuaacucuagagccagagccucauggcugaagcugccgaguucugcugcuuacaggaacuagaacaugauccccuuguacuauuauuacauuaucacuagcuuuauguuuucuaaauccuucacugccuaagcuuggcuauccugguucuugcucuguagauugaccuugaaugcagagaucagcaugccugucucaugggauuaaagguguauaccaccaugccugguucuaaauucagcuggguagggucuugccccaaggucccacucccuuaaucuguuauuuccuagaacacaggauuuuucuucauuucacuuccugguaugccuuuaauacucgaaccauauauuuuauauuuugccuuucuaagcuugcuaugcuuguucaaacuucucuuugugagacuuaaccagagaacaaagucucugcugggcuuuuuugaaacuuccuuugucagugcaauuaaugcaauuaauccaagucucuucaccuuagccucaggcagacuuuucagacaaggguaaaaaguaaccacauucuucaccaaaauaccacaaaaacagucuuuaugccacauucugaaauucuucuccuuucuugggccaggucaauacaguucaaauuacucccagcaacaaagucuuccauaauccuacuaggaugaccaauuaaaccccauuuaaagcauuccacugcuucccaaauccaaagucccaaaauccacauucuuucaaauaaagcauggucaggccuaucacagcaauaccccacuccugguaccaacuuuugucuuaguuaggguuuuacugcugugaacaguaaacccaugaccaaggcaagucuucuaaaaaaacaacauuuaauuggggcugccuuacagguucagagguucaauccauuaucaucaaggugggagcauggcaguauccaggcaggcauggcgcaggaggagcugagaguucuauaucuucaucuaaaggcugcuaguggaagacugacuuccaggcaacuagggugaggaucuuauacccacacucacagugacacacccauuccaaccaggucacaccuauuccaacaaggccauaccuucagauggugccacucccugguccaaagauauaaaaaccaucacaguacucuagagcagaaugaaaaucaaaagcuucuuguagcacagaaucuucccggacagagaucaaagagaaaggaagcccuccccuuaccugcucaauaaaccagaguguguuauccuagacaaucuacuaggaaucugagacaggaauccuuccucccuucccauuucacauacaaucaaaugcaucaguccuuaaggugaucaacaacugugcaugaagcaagaggaccugacagcguauacauacauacaugcaugugugagagcaugugugcacguguguauauguguguguguaugcaugcaugagugcaugccugcauuugugaauguauguguguaugcaugcaugcuugugugugugcauguguguauacaugagugugugugcauguguguguguguguguguguguguuuacguguguaaaaccaacauccagugcccuucucagucauuuccaccuugucuuuucagagagggucucuucuuuuucuuuagaacucacccauuugguugggucaacuggugagagagcuccaaagaucccucugcauuuuccaaaugcugggguuauaucaugccuagcaucuuauauuuuugguugugagccuagucuuuaauaacugagccaucucuccagccccauguuuagcuuccuuuuuuuuuucuuucuuuuuuuuuuuuuuuuuuuuuuugguuuuucgagacaggguuucuuuauauagcccuggcuguccugaaacucacucuguagaccaggcuggccucagacucagaaauccaccugccucugccuccuaggugcuggaauuaaaggcaugcgccaccacugcccagcccauguuuagcuucuuaauauggguucagaggcuagaacucucaucuuggaguuugcaaaauaaguaauuugcugacugagccauuccacccacccaagaccccuggauguugguuuuacacacaaaaacgagugggcuugguggcucauauuuuugguugugagccuagccuuuaacggcugagccaucucuccagcccgguggcucauauuuuuaaucacaguacugaggaggcucaagcagugcgauuucagugaauuugaggcuagccuaggcuaaccuagagaagucuggguuagagaugggcaauagcaugagaucuaaucucaaaaaccccuacagugacuagaauucuaauauuaaaaaaguccuucuguuucuccauuacuuaaaaaaaaguaauaaaacauuugcuuguucacaguuuguuuguauagaaauaaacaaaugccacaaagugcuuuaaagaggaagagggagggagagguaucaaaccucagauaauggugugcuuuagaaaggagguaacucuguuacccacagggagguuccuauagcuuggguuuggguuucucuuagcauucauuguuuuuuuggcuugguggugugccuuuggucugggcuaaacccugcugcgcaacacucucacucuacuuuaccugagcucauagcuauaggaacagaggguccgcuaacuugcacaggaaacugggcggaaauuguaaaaauaaacagaaaaauagauagauagauagauagauagauagauagauagauagauagauagauagauagauagauagauagauagacagauaggacugucagacacuggagacaucgcuccgucaguaaaguguuuauaauaccuggagaccagagcucuguccucagaaugaacuaaaaggcugugcucagcaacucaggagaaugaaaaccuaaaggcagacaccaaguuuagaaaucaauaagcagaaucuggagccaaaggagagggggaaacaccauaaugaggaugccaacacgaggagaagccaucuuagaagaagggaaguaaagaaacaggaagcuggcuggaagcugugggcaacggugccccaucccugguacaaaagaaaggaguggaccccaaaaaaggaaguggccagaggaaguggaccaggaugggcagugagagugaggagggaauuuuauaaagugggucacacaggagucauuucuguuuggauuuagaacaaguguuucucaaucuuccuaaugcugcaacccuuaaauacaguuccuccugcuguggugacucccaaccauccaauuacuucauuacuacuucguaacugugaucuugcuacuguugugaauaguaaugcacccgucuguguuuucugauggucuuagaugaccccugccaaaaggcuacugggcucccaaagggucaggacccacagguugagaaccgcugauguagaccauuccaaucucugcuucuagguucaacucagauuccccagcugaauaucaguuaguggaaccacaagcuaaugcuggagaauggagaccugagagauaagggagguuuccguggacauaguuggguggaaguaggaaggguauuugugccuacaugagugugcgugcguguguguguguguaggugcagcugugcacacauguauguguaugcgugugugcuugugcagguguaccugugcacacaugugcaugcaugugugugugcaagugcacacguguaugugcauguguguguguauagguacagcugugcaaacauguauugcaugcaugugugugugugugugugugcgugugugugcaggugcaggugcagcugugcacacauguauguguaugcauguggaggccagaggucaaccuuaugugucauuucucagguaccccccacauuauguuuguagacugucucucaaugacaucugaggcuuaugguucagaugcaagccagugagccuuccgugugguuccggauaccuucaugucuucacagcaggcaucucacugacuggguccaucaggauuuguguucuccccugagcuauguaaugcacagcugccacuguuggcugaugguucaaugcccacacaaaccagcccccagauaugcuuccuggaagccccccuaagagugaaagacagcugagggaguccugcagagagauuccuugucagauuuuuaccuuuccuuuucgaguguccucugcuucgguagaaugccagcacuggggcaggucaaugaucucaggcugccucacuauguagcccaggcuagccccaaacuaaagauuacccuggauuccuggcugcucuccaucugcugccaggaaggaagcccugccuuuagguucauuucccagucuaaacaucucagaguacccagagaucaaggcuugcucaggucagaccagaaaguucauuugcugggcuuaucggguuggaggacgucuugggagggagcacgcuuugcugaccugagguuucuaacucuaguggaauccccgugcucuggggcucaucgaugaugcuggguuugaaccaacacagcgugcuagcaucuuccaaguagauauaaaccuugugucauucucacucacagcggaggcagugugguuucucagcaucgggcuagaagacucggcacaaauugcuggcacaggugucugucuguccgccaguagccauggccagugugaugggugagaaugcaugcugagaugaugacgagucuuucccgcacugguuucugauuguggagccacggugagcuccuacugggaccccacgugugagacuuaucuuccccugccaggucuuacuuuuacccagucacucacucauuuagcacagcagauaccugcagagcugucaaguguaagggcccagggcccacagccauaaaagauaugugcacacccugugcagcucuccaggaagaggccgcgcggaaggugucaccaucacuuucucggaaccugucauugcauugcuauuuauuuuaguuuuccaucaaaauucauaucuuuuucuugauuuuuaaaauugaaaaauccaacaauuaauagauuuuccaaauggagaauacuuacguggcuaagaaagaauccaagcaaauauaguaaaacuaaaccuccuuuucuggguccuucgguccucagaaucgcccuccggcacuguugcucccagggauucagauacacacacacacacacacacacacacacacacacacaugcacacauacacauacacacacacacauauauacacacauacacacacacacauacacacacacacauacacacacauacacacacauacacacauacacacacauacacacauacacacacauacacacacacacacacagaaagagagggagagggagagggagacggagggagagagagaaccuuuuccaaccuucucucaaauggaagcggucuauguccaugggaccucacacgggcccugugguuuugccuugaagcguuuaguguucugucauucagauucacaguaguuagcucugucaagacugaucagagcucaauaacgggcaucauacucuccuccacuuucaaaauaagccaagaaagguacauuucuugcgucaguggaaaaaaaaauaccaucuuuacuaugcaaauuuuccacagugcucaggguccaguaaaacgaguuccacgggcugucuaacagucagacggucucugcaagggccugcuguaacccacagguuaacagauggucucugcaagagccugcuguaacccaugggcugucuaacagucagacggucucugcaagggccugcuguaauccaugggcugucuaacagucagacggucucugcaagggccugcuguaacccaugggcugucuaacagucagacggucucugcaaaggucugcuguaacccacgggcugucuaacagucagacagucucugcaagggccugcuguaaccuuggacuaggcucucuccuuagacuagcucguggucaaucaggagacugaaccccagacuugcagagggacccagcaagcccaaagucuccuagcucauucucuggcuagagggcuccauccuccacagaaguccacagaagcuguuggacuggaggacagauccccagccaaagagcuuuuccuagcuuugaccuccucuugggggucagcacugcuaacucuucacacugggagaaggaggaagacuguggcuacccuggggucucccacuuaugaccuccacaggucauauugcugcauggcaugucuucccgcaccugggaagauaauccacucugcauacaagucucucaggauaagcaacaauuccuguuugcucgucugucaacuauagauauaugaaauaucacauuuuaggggauacuuauuuauuuacuuauuuauuuguaagacaaagucugaaauaucccaaauuggacugaagcuugcugaagcuugcuguguagccaagaaugagguaaccuugaacucugccaguucuccugucuccaccuccugauugcugggauuacacaugcauacuaauaugccugguuugugugacgcugagguccaagcccaaggcuucaugcucccuaggcaaguacucacaccgcaguuacauccucagcccugaaugacacccguuggguccagcgagugcugucagccagcagucugguacugaccagcuugaacgcuccugaguaagaucaccacaaaggcccucugcagagaaaggggccccguggccugaagcagagacugccuaugcaauccccgcagccugaacuccaucacagcccgaggugguccagagcagacagccucagcccaguccacuaggggagagauuggcuggcuggcuggcugacaugcaaauucacagacaggcaaugcaggaagaagccauggcugggugggugggcugcggugagaccauugugagcugggugcgcuggguguggaaacucccuguuaaaacccgugagcuuugcuuuccauugcaauggggaaggaggcaaaggcagccaggaagugcacucugagaugacuuuagacuucugaagggucugucugugguuucaagaggcagaggaggaagcccagagcagcuugacagaguggccaaccaacacauccugccuggagcgugaggggaaggggacagguguuauuacccaacuuguggggaaagaauagggauaggcuaggggugagaauaucccaauagaugagccacugaaagcaagagcagcaggcuggcugagcccauccucugccuggugucagcugaugcuucucuggcuacagagcccaugcuacaacaaugcuuccuuuccaccuagagcugccagauggccaacccagugcgauugggauggaggaacuuuccacacagaauuaacccugacaaaauccuggguacuaugagacaagaguguagggacuacacugguuauuuuccucacaccagugaccaaauuccaggcuagaagcaacuaaggaugaaagaaguuacagcuucuucuaugauagccugggcugaggcugaggcugaggcucuggaccaccucgggccaugauggaggucaggcugcaggacaagcauagcagucuuugcuucaggcugcaggaccuucuuuuuuuuuuaauuagguauuuucuucauuuacauuucaaaugcuaucccaaaaguccccccguacugcccccccccauuccccuacccacccacucccacuucuuggcccuggcguuccccuguacugaggcauauaaaguuuacaagaccaaggggccucucuucccaaugauggccuacuaagccaucuucugauacauaugcagcuagagacaugaacucgggggguacugguuaguucauacuguuguuccaccuauaggguugcaguucccuucagcuccuuggguacuuucucuagcuccuccauuggggacccuguguuccauccaauagcugacugugagcauccacuucuguguuugcuaggccccagcauagucucacaagagacagcuauaucaggguccuuucagcaaaaucuugcuuguguaugcaauggugucaguguuuggaggcugauuaugggauggauccccggguguggcagucucuagaugguccauccuuuugucucagcuccaaacuuugucucuguaacuccuuccauggguguuuuguucccaauucuaagaaggggcaagguguccacacuuuggucuuccuucuucuugaguuucauguguuuugcaaauuguaucuuguaucuuggguauucuaaaggaccuucuucucugagcaccucugcugugaucuuaguaagcuggucaguaagcugccucacagcugguguguccuuccuccccgaaaggaaguggcauacugacuggugggaucacucuggugugaaguggugugaaguccuggcaggcgugggaggcagcagguuccuaugugccuguaaaugggaaagcucacucacuccuuuucuaggagguuugggacccuaaccuaugcaaugguuccauccacguuuagaguguuuugguuuuguuuuuguuuuaccaagacagaauuucacuguguagcccuggauggccuguaacucacucuuguagaccaggcuggccucagacucagaaaucugccagccucugccuaccaagugcuaagauuaaaggcguguacuaccaggccccuggcuacagugggucucccuaccuuauuaacucaauauuuaaaaucccucccauggggcuggagagauggcucaggaguuuagagcauuagcugcucuuccagaggacuuagguucaauucccagaaccuacaugguggcucccaaccaucuguuuucaaagguuccaacacccucuucuggucugggcaccaggcacaaccauggugcuggccagucaugcacacauguaaauaaauaaaucuuuguaaaaauuauaaauaaauuaggccccucacagaugugcugagaugugcauuuccauggagauucuaaauuccaucaaagagcugagagaugcaaaugcuauucucaaagaggaaucaguccggguggcucccaugucaggguggcccccaugucaggguggccuacaaacaccuguaaguccaacucuaggggauccauugcccccuucaggacucaacaaacaccugcacuccaugugccuucccacacacaaacccacaugcacauaauuuuaaauaaaaucauauuuaaaaaaaaaagaaccagcguaguaugggcucauaucuuugaucccagcauucaggagacagagacagacagaucucugugaguugcagaccaacaggguuccaagcaagucaggguuucacaaugagacccuguugcaaaaauaaaaauaaaaacagaaauguuuuaaaagauaggaugagugaagacaaaaucuaguuccaauuguucacccuuucaguguuuucucccgcuugcugcaugcagccagugagaaccgcgauccucuaagacucacgugaucugguuugcugcauacagccagugagaacugcgauccucuaagacucacguggaccugcuuacugcaugcagccagugagaacuacaauccuuuaaggcucacgugaucugguuucuccuuccccuccaggaccucaccauguccaccuccuucccugaacuggaucuagagaauuuugaguaugacgauucugcugaggccuguuauuugggcgacauuguggccuuuggaaccaucuuccuguccgucuucuacgcccucgucuucacguucggucuggugggaaaucuguuggugguccucgcucucaccaacagccggaagcccaagagcaucacugacaucuaccuccugaaccuggccuugagcgaccugcucuuuguggccaccuugcccuucuggacucacuaccucaucagccaugagggccuccacaaugccaugugcaagcucacgacugccuucuucuucauuggcuucuuugggggcauauucuucaucaccgucaucagcaucgaccgguaccuugccaucguccuggccgccaacuccaugaacaaccggacagugcagcacggugucaccauuagucugggcgucugggcggcggccaucuuaguggcgucaccccaguucauguucacaaagagaaaggacaacgagugucugggugacuaccccgagguccugcaggaaauguggcccgugcuccgcaacucggaagucaacauccugggcuucgcccugcccuugcuuaucaugagcuuuugcuacuuccgcaucauccagacgcuguuuuccugcaagaaucgcaagaaggccagagccgucagacucauccuccugguggucuuugccuucuuccucuucuggacaccauacaacaucaugauuuuccuggagacucucaaguucuacaacuucuuccccaguugugacaugaagagggaccugagguuggcccucagugugacggagacaguggcguucagccacuguugccucaaccccuuuaucuacgccuuugccggggaaaaguucagaagauaccugggacaccuguauaggaagugccuggccguccugugcggucauccuguccacaccggcuucucgccagagucccagaggagcaggcaggacagcauucugagcaguuucacucacuacacaagcgagggagaugggucucuccugcucugaaggggucuccccgacccuagcuccacuaggaacccagaguucuugcaucagauuucccugccgcucccccugcaucuuaugugcaagaaauauggaccagaugccugcaaaccaaccccgugguguuuuuuugaaaaauuuauguucaaugugugaaaaacacacguaucucuuacugcaaauguugaacauuggggcuuacuggugacaaaaauucuaaccagauuagugcaauuacaaagggguuuggugaguccugguugcaugaucaugugauaaaggacaacuaaguccucagacugaguggaaaccaaggcuuggcuccaauguccccucucugaccuucagauccuucauagugacagaucauccagguucuaucaucagagaaggaccacaucucucugauuucaaaauugguauuccuagggaacaccuccguuggccgagugugucggguguccauuccuugacuaggugguguuauugaaauagaagggauaccuaagaugcuguuggaaucucaagguuagcgguugagagagacacaucucucagaagcuggggggugggagcuacucugacagcaagaacugcugacucgccuuaccauggagcucauucaggcuccccuucaguaacuagcaguaucuguugcuagcuucuuuaaucuucuguugagaauguccugaacucuccaaggguuagaauuuggguuacugcucacagcaucaaauucaaucccaaggcccuguccuccaagaccaggaagauaggaugcaguucuaacaagagacuccacgcugacuccucauuccacaggacuccguccacccaguuggccaugucccuuuuucuugucuugacccacaucccuccacucuucucagcccaggggaagaaauagaaagagccaugccccagagugaagggaucgauucauaucccaacucuguugcuugcacauuggggagacuggagccaacagagcuucagucccuucaauauagaaaggggacuguggugccuucauccauucuagcauaguaccucagcaaggacuuuagcauucccuggaucaggaacuguuacccugccucugagaaauggagcugguggagugggaggaaccugcaggcuuugcugcaggacacagccagacaagaggagaccuauuccuacagcaucccccaacaugugccuagaucuacaaagccauucccauguccccgcugucagggcaagacccaggccacgagagcagcuugcuuucuccccugacccugcaagcaucacguaggauguagccacaagaaugucuucaugcauucacugacuccggucucauuugcaggcuuacauugaaaguuccaguucugcaacuugcuuuuuaaaaaacacuggauuucaggggcuggagagauggcucagugguuaagagcacagucugcuccuacagaggucccaaguucaauucccaugucaugucugaagacaaggacaguguagucaaaaaaaacacuggaauucaaauagcucccuguuccuguguugguugugauaaccauuucagaagucucucccagccuguugcucacggcggcaugucugauaucuccuuggcagucuguauguuugugucgaggaugacagacagacugagucauaucccccacaggcauauccaacccuuuguuauugcaacaccaugcugucauauucaaaggucacaaaugagaaccucaaaauugaguuaccaaagugggagccuggagagauggcucagugguuaauagcacuggcugcucuuccagaggucugggguuggauucccagcaagcauaguagcuuacaauggucuauaauauaacucuaguuccaggugacccaacacccucuucuaauuugugaggguagcagacaugugcauugugaacauucaggcaaacacccauacauacaaaauaaguaaaaaagaaaaagaaaggaaggaauggagagagagaaagagggggagagagagagggagagggagagggagagggagagggagggagggagagggagggagggagggagggagggagggagggagggagggaaaggaaagaaagaaagaaagaaaggaaggaaggaaggaaggaaggaaggaaggaagaaagaaagaaagagggagagagagaaagagagaaagagagaaagagaaagagagaaagagagaaagagaaagagagaaagagagaaagaagaaagaaagacagaaaauugguuuuucaagauagguucucucuauguagccucggcuguccugaaacucucuguguagaccaggcuggccuagagcucaaagaaauccaccugccucugccuccugaguacugggaucgaaggucuguggcaccauggcaggcuuagucaauaaauguuuuauuuucaaaaguauccuauaauguuuuaaguaaguuuaugcuuugguguuggucuguauuucccgcugucucgggucacaugguuaagcgugccuagagugugucuaucccacuuguaauucugucaauaaacauugguuuccuuccagcucuuggcaa

SEQ ID NO: 5370 - RNA, 2776 nt, Mus musculus
guggcagaggagugggcagcucugaaaccucagaagaaaggcucgcucagauaauugguaagaaucauccuugggguuagggcucagaggcagugcgggcaccguuuucaucuccuuacagagagaucaggagaaggcugauauuucgggaucauaagaguuuugagugucuccaaagccugagcccacaagcgcgugugucucuugguggcugauaggagcaugucccuuguucuccaggacacagaaagggcugaaagcucucacaggaguaaaaaaauuagacaagacagcauuuucuggcgaucauccuuucuccacagaaaacuuccauucaaucccaccuccuuguaugucugucaauggagucuuagacucugcauugugugggguguggggaacgggaccuaggaccuggcucggguccuaagcaugugcugugcccccaggcccuguaauguuuuauuucguggugugugugugugugugugugugugugugugugugagaauaugugagugugcgcauguacaggaggucagaggccagccuuggugcuauguuucaggcgcucuccccucgcuuugugcucaccaagcaggccaggcuggccagggccacggagcucugccugucucugccuccccugcgugggcauugcgagcacacacugccacgcauggguuuagggguuugaacugaggucuccaugguugcuuagcaagcaccucgcuuacggagauauccccucagccccaguguuugacacgacugaauuccagccuuuaccaggcuuaccucuggcgaacccggugcuucucguuuugagaggaauugggaucauuuuuuuuuccuauugcacuuuaaaucguuuugagggggggggguuauggaagcaaugagugaaugaacuaaauucaagaauaucauaggauacauccgaagcaaaauacaaaaugagacaucauauaugcagcauaggaaugaguaagcaaauguugucuguugaauacauauauacuuuguuuguuugagacagggcuucucuguguagcccuggcuguccuggaacccacucuguagaccaagcuagccucaaacucagagagccacccucuucugccucccaagugcugggacuaaagauguguaucaacacaccuggccuguauuuuguuuguggauccauaaaaugaaagagaaaccaggcagaguggcgcgugcuuuucaucccagcaccugggaagcagaggcaggugaaucucugggaguuugaggucagcuuggucuauauaguaaguuccaggacaacuagggcuauauagugagacuaucuaaaaauaccaaaauugacuaauuacaaugggggggugggggagagagagagagagagagaggccaagcaaggugguacagaucuguaauaccuccacugagaaggcugaggcaggaggaucaugaguagucugggcuauguagcaaguuccauaccagcccaaaccacuuagugagaccuuguaugaaggaagcaaggucuagggagaacagcuugaugggagagcgcuugccgcacacuaacacccugacauugagccgcagggagaaaggggagguguuuaagggcuucaaucugugaauacagcccucagcaccucucacgugccugcuugaccaggucuuccugccucgauggauuacacgauggagcccaacgucacgaugaccgacuacuacccugauuucuucaccgcccccugugacgcagaguuccuccucaggggcagcaugcuguaucuggccaucuuguacugcgucuuguuugugcugggccuucuggggaacagccuggucaucuuaguccucgugggcugcaagaaacugaggagcaucacagauaucuaccuccugaaccuggccgcauccgaccugcucuuuguccucucuauuccuuuucagacccacaaccugcuggaccaguggguguuugggacugcgauguguaagguggucucuggccuuuauuacauugguuuuuucagcaguauguucuucaucacccuaaugaguguggacagguaucuggcuauuguccacgcugucuaugccaucaaggugaggacggccagcgugggcacagcccugagucugacaguguggcuggcugcugucacagccaccauccccuugaugguuuuuuaccaaguggccucugaagacggcaugcuacaauguuuccaguuuuaugaagagcagucuuugagguggaagcucuuuacccacuuugaaaucaacgccuugggucugcugcuccccuuugccauccuccuguucugcuaugucaggauccugcagcagcugcggggcugccugaaccacaacaggaccagagccaucaagcuggugcucaccguagucauugugucuuuacucuucugggucccauucaacguggcccuuuuccucacgucccugcacgaccugcacaucuuggauggaugugccacgaggcagaggcuggcucuggccauccaugucacagaggucaucucuuuuacccacugcugcgugaaccccgucaucuacgcguucauaggagagaaguuuaagaaacaccucauggauguguuucaaaagagcugcagccacaucuuccucuacuuagggagacaaaugcccgugggggcguuggaaaggcagcuguccucgaaccagcgaucuucccauucuuccacccuggaugacaucuuguaaggggagugugcagggcaggcagacu
